United States Patent 11,913,074 (METHODS FOR ASSESSING RISK OF DEVELOPING A VIRAL DISEASE USING A GENETIC TEST) - sequence listing, part 17

SEQ ID NO: 1831 - DNA, 157663 bp, Homo sapiens
  source 1..157663: mol_type = genomic DNA
ccatccataaacatatgtctttattctctttctgtacatatgggcaatgataaagcttaaagatgcatgtcctaagaaatatgcaaaaacaatgaatttacataaataatttatacttcagaaaattaaagttgaaaaatattttccacattattagagttcacagtatttaaatcaagctttcccacttatactccagactatattgtcttagcagagagtgataaaatctaatcaggaataaaatgatcaagtttctgtttttattcagtgcacgagtagacgctatttcagtatcaggccgcgccaagtgtcgaggctgcagcctctcatcctgacccttcccctcctgagtggctgtgacccagcagaggtcactggcgtggaatggttacagcgtcaccaaaccactccacggtggacacattcaaccgagcggtaacatctggtggtctgatgcctcatttccaagtaatactttttatagccctgaaaatggaaaccttggcatctaaacaaacagagctgaacatgtgaacactaggacaaggcactgtactatggggtttggtttctttatgggaaaggtgtttgcatagattgctagctatttagtgtgcaggaaaacagagcccccagcgtgcatggctttgtgaggggtgaagctgcatggtgctccctcagccccaagagagcgcagtctctcattctccagccccagccttgtgggctgtcccgctggtgctgtcctttagaacccctacaggagagttttttgctcaaaaagctgcaggtcaaaacggacccagacctccccggtggggacctcatgcagcagcagtcggcgggtcatagggcctttgctttcctgttctgttcgaatttttgccactggaatttcagtacgacccaggaaatctggtgaataaacacaggagagtcagaagtctttcttctttataaaatcattaaagagctacatccggaagaagtggattcataaaaccttcaaatctgaaacaaggaacttcttttggctcatggctgttgaatgtcgtgagtgggtgtgtggggaatgatggcaggtttgtgtgtgagaagctgccacatggaattcaaatctccattctgagaatgctccaggagtggtgttcacgtcgtgtgtgtagggagtgatgggtcaaagacctgaaacacatctcaggccacctcctcccctgaggaaggccacccacctgctgccaaagcgagatgacacaggcctgtgtcacttccctgaagtggcatggggtctgcacacagctgaagcccctagatctggactccaggatctaggaaactgggaaagcctttagatcccctggctgagcgacacttaccatctggtgaaaactggtctctgtcaaacagggtgagacacagcacgtcttggtagagatccttaataaagaactggcagttaaaattccacttgggattgagtgtgtcctggatggtcctggtggtgtagctctgggagcccatgctgatttcacagtatgggttgctctttcctgaacaaaaacaaaccacagacacatgtggtgcatgcaggtaaaacgaagcgactgacagtgccctccctgagcagaagcaggattccaataatgggtcactcgagaccatggcagcaggagccgctgcctggggcaccatatccctgtggtctagtaacagggtctccaagttcccagtgctgacagcagcattaactggggagtggccgagagctccaccgccaggaccactccgcacggaacaatcctgggtgagtgtcactgcaacctgctgcatgcttcctcggcgcagacacactcgggaaggcgggcactggcacttactgggaaaacagtgataagaatattggtccaatatgcgcattttagtggcactggacacactgttagaaagcattcctttattcagtgttcagaagagtcatcagtggctgggcgcagtggcactttgtcagtgacaaagtgctgtaatcccagcactttgggaggccgaggcgggcagatcacttgaggtcaggagttcgagaccagcctggccaacatggtgaaaccctgtgtctactaaaaatacaagaatttgccaggcgtggtggtgcacacctgtaatcccagctactcaggaggctaagccttgagaatcacttgtaccccagaggcagaggttgcagtgagccaagatcgtgccactgcactccagcctaggttatacactgagactctgtctcaaaaagtcatcagcaaaaactggggcagggcagttatgtctgctgaatgaatcaaggcagtatttaccatttggtttgcaggcttttaattctgtagcttcaatgacatgcaccatcaggcgcccaatgcctgaagtcttttgggagcgggctacaaaagaggaagacaagtctcattaatctcttctccaaggatgcagaccctgtctttcaaaccaaccataacactaccggctccctgtccccatctgccactgccctgggcccaacagcccagcatctggctgccctgtgcctttccccaggctgtgttgcctgctaggaagcccctgcttgctctttctgccctgcctgctttctctgcccgtcagcatcctactcatccttcaagatgcaggtctgatcccacatctacctcccagatcccttccctcctctgcatccagtatccctcgcttatgagcagcccacagcctgctgggtctgaaatcgtgtgtaatgtctgtctcctctgccagacaggagccagggtagagcatggactgtttcgatcatccttatattaacccctcaattgcctagcaaatagtaatattaataaaataatacatggtatttgtgcagcacttaatagcagctaacatttactggatacttactttgtgttaggcatgtgctagacttatgtaaattatattatttaaactgcataattacctgataatgtagctccccattttactgatgagaaacactgaggcttagaaaggactggagtgtgatccactcagagctgctaaatggcagggtcaacatttaaacatcagataccaaagtccaggctcagttaagcctagcacagagcctggcacaaagtaattgacaaatgtgggaaggactgaacgcacggacgatgcacagcaacatatgcagatgctgatgggaagcaaaactcaggcagaaaaaccggattgacatctttggccaattaagagatcatatgcgttatgaaatgatcaatcattgatttttcaacagcaagcttttaaagtaccattaaaataacactaaattagcaaaagctgttttaaacataccttttaggagtatataacaaaatgggggaaacctgaataaaaaaacacataaagagctgcaactatagcagccaggaagctggtgggaggcccaggcaggagggcaggctgcatgggggggcccggcgggaaggaaggtggagatgcagggggccggcggggaggaaggtggagatgcagctggctcagagcacaggccccctgtggggtggaggccacaggctggcctggcacagctggagatgcagcagggaggttggggcctggcattcatgtggaggctggagaagaatgtgggagctctggtctgaaggccacggtggggcagggtggggtggggggtgctttacaaagaccattgcggctccactgagcaggtgagtgatctgtgccatgaacacagaggacatcaccggtgcaacaaatctggagccccactggcataagtcacatgctggccccgatgtgggagggagttgccttgagggagcttatggccattaagtgagaaaagcagggactgagagggcgcaagcagaggcaacagaggatgagcgcccggaggatgatcgcagcctcaggacagcggggggtccaggtagaagtcacactggttagggcaagagggtgtcatggaggaggctgtgtttgacgtgggccttgaaggatgggaagaatttaaggtgagggcagagcacttgagctggagggggagctcacatgggaaggccaggcagggcaacaatgggctgctcaactaggcagctggatgggccgggcacaggaaagagctagggatggggctgggtggcaggtagtagtggggatgggccctgagtgtggggtaagaaatgtgtcgttaatttgggaggcaatagggaagatacttcagcaggaagaggtataagagcagctctggaaaaaagaatactccagaaatgaagaggatgggtggcagagaggaaagagagccttgtgctgcagcctgggtgggagatcgggggcctgtgatacggggacaggaaagggcgatgggaaagtggcgagggaggaggactgcagtgcagctgaccaggtgtgaggtgccagggaggggcctgggtggccagggaccacactactgtccacagagggtcccaggaggagctgctgctggaaggaggctggtggtcccttgggaaaagccgatgtgtgatgtgggagcagcggggcaggtggttctctggagggtgctgttcagaggcgcgggcttgggagagtgtggctagcctgaccctgaagctgggggtcggtggggtccccgagggagagcgctacagaggtcggggagaggcctgggcaagggtggaagaagaactgggaaggcggccatggggtccagagggaaggcagcgcctcagtgactgccatcagtgcagggagctggggcagggaaagtgagctgagccactaactaggccactggtgtcactggtggggacaggacgtggactgaagtctggtgaagtgagaagggggaggaggcaggggcagaaggatggggagagggcagacttagggtctaggccccctggctgcaaagggagagggtggatggcaggccctagaggagggtgaggaggagcagtggctgctcaggagctgaagggagacagaccacaggtgtggcatgtaatggagcaccacagcccaagcagaggtgaggtgagtcatggagagaaaggagtggagaaggtgcagtggagtgggggggatagaggtggtgcagagagggaggtcccggagctggcactgccagcccgtgtctgtgtgggcaggagccccagggaggtttgcagtagtagcttcaagaggggagggctctctggtctgatcccgcagcaggtctggtctttcagacccgtccctatatcatcagcctgactgcaggagcagtggccggcattcctagggcccctgggggctgcgtcccaccctccgggcaccctgataccttggtaagctttctcacgcttcttcttctcggtgtcgatgtactgctcagacgccgccttgatcttctgcacccaggcggtcctacgggagaagcaggggcagccgttggccgcatcccaccctcacaggtcagcgtggagccccagagctctgcacatgttcttcagtcttttgctaacctcaactttcacaagtttcctatcaaagacctgatattagtcaactgaaagatgcttatgctaatggagtatgagagctggtagtgacccttcttggctgaccacaaaatgccaggcactcgcaaggcgctgggacctggagacagatgatgcattggccccacggatgatacctgtcacgaggggttctagcgcacacagaggagcagcagcaccccccgggttggcgccgcggaggcactgttggagctgcagcctgaaggaagctgggaacagcggggatggcacccacacaagggcgcctgaggggcgaaagtctgcaggtggagggacgagggctgaggcctgtggcccaaggaggcctcggaaaccagcaaagcacagtgggctgtcgcctgcgggcagcccctgcagggactgtagcagggcctcaggtgctgatctgccatttgggaaggctgctgagtggtgtggggagagactagaagccgggaagcatgttaggaggcagctgcagtgaccaaggcctaccatgggactggagcagaggggatgtgttaagagaggttcaggatacagaattagtggggcttaagcacggctggagatgggtttatggcagagggagacgtccaggccttctcccagagttcaaggcaggccacacatggtcaggactgacctctcattaatgttgtctgttcggagggtgtagacccgatcaatgtgggaaatgtggaagacaggctcatcgctggaagggtctgtgggcagtttcaccaagacttcattcaggaaaatgggctgaaagaattagggccaaaacacaggctgtgagatgggctagaacactccacccgcctatgtccagagagagttctgtttgttctgaagagccttgttgagaaggagaaaggggtctagcgtctaaggtcttctacacagaacaaatgaaacctccatttgtaagaacaatgaagcctccatttctggaaaagtcattatcgaggtgggtcaggtgttgggactgggtggggacaggagctccaagcgcccatgacggctggtgcaaaaggctctctgctagcaacgctggtgctgtgctggggctcggcttacagagacccaatgctgaatgcacacagtggtgagcccaggtgtcacgctggccaggaggaagccagaatctcagctggaatctggctgatggcctgtggcaggtggggagtgcccagctgcatggggcccttcccgtgggaagcagcaaaggaagcacgagcgatctggaaccaggtgaggagggtcccgtaaggccagctcagggtctgccaggaaggccttaagatagaggcaacacctcattaggcccctgatgctacccccagacgcgtgatactcaccgttttatacattttgaattgagcattggacttcgagctgaaaagtttctcagagccagaggaaacagcaaactgcttgaccatgtaggtaagaagcaggaagtcattgaagaggaatccgtgcagttccttgttgctcttggtcttgtataatttcccactgtgtaagagcttccggggccccaggcagttggtgagagagttgaaaataagttgcttaaagagaaagaaaatttcactttttaaatcccggcacaaaccatccagtgcccctgagaggccagtgccctgggcctgaggatactgtggtggagttttctaggtgggaatgtggctagaatcattcactttgcatgaaagatccttaaatacattactcttcagagtccaaactggcccagtgaaaatcattacttctagccacagaacactgattctaccagctgaattcaaagaactcaaaacaaaaaatcccagtgttctctccttaggagaaaggaagatgacaatccaagaaggaatgcccttcatgcctgcaatcccagcactgttgggagacagaggcgggaggatcacttgacgccaggagttcaagaccagcctggccaacatggtgaaaccccagctctactaaaaatacgaaaattagctgggcatcgtagcagatgcctgtagtcccagctacttgggagatggaggccagagaatcgctccaacccgggaggcagagcttgcagtgagccgagatgatctcgccactgcactccagcctgggcaacagagtgagactccgtctcaaaaaaaaaaaaaaaaaaaagaaaaaaaaatgcctttgcaggggcagggtggtgagtccacgcaggctgcctaaggtgcagactgtccacgtgagggaaggctcggagctggttccccacccagagcctccctggaggcgcacggcttaaccacacaggcctgacctccgcgaggccttcacactgcacgtgcgcctggatccactccagtcggtccgagttttccttctcccgaactccctcattcacttgagagcacagctcctctgcccgctcgagggccagctttagggaggaatggtctgcatggctctccggggtgttctccagaatctggaaaagagtgggcagtgtcacatgggggagctgcgtctctcacctgcccacctggaccttcgcaggaccgctcctccaaccccatgttatggactgcttccatgccctggaaacgcggcggtgaacaagacgacactttccgcccttgagaaactcgtactcccacaagttcttggggacacagggacaggtaacgctgctgtgacaaggtgacagtgctaaacggatcaagtgctctgaactgtgtgggtctctggttgctctccgactggctcccggtaataggcgggagcctcccgactccttccgaaatttaagccatgtaagggtgcgccctcctgtataaactggctgcagctgtggtaagtgtgaacttgctgaatagcaatggttcataacaattttggggtcactgatccttttgaaaaaaatctgatgaaagcaatgactcccatgccacaggaaaaatacaataaaatcacattgtcagcatgtggaagaaatgcattctgttcattctgaagcgatttcaaacgacgcatgctgcaactgtgaacgcgcagaggccagaatacaaacgtgtgtggtccctccagaaattaggagccatcaccagatgccccgtctggactctctcactctagtcagatgagtgcacagtccttcatttacaattctaaaatgcagaacagcctgagagcctaaagtttttattcagtacccatttggtggcaaaatctgacctaaacagaagagatatatttacttactcttacagtgattgttcttatgttccactgtaggaatattagtgtgtctggttgtaagtgctaccctaaggctcagttgaggagtcatatattatatggtatttgagctacattccgaattctgaaacacatctggccccaagtatttcaatgaaggggctgtgaacctgcattatggttcagtttagtgcaggcgtctatcacatgaggtctatgttgaggtcacacagctaacagaccaaaagtcaaggaatcatcaatagaagtaacaagcttatcatattcctgctgcttttctttgtaagttactgtaatcaatggttaatcgtgggataatcttttgtaaagtctgccttttccttagaaggcttatgggctcaagagggccctattgcttatcaaaaagaaagctggaaggaattttagaaggaatgttgaagccgaatacagcgagggacacaaatgaactctatttatgatgtgccaagtggagcctcctgggacatctaggaaaggtgttcagggtggatggaggcagatctcagaggaaagactggagtctaaggttactctggtctttctctgggttcaagatgggctccacaactggagacctagaggggcctttccctgcctggacaagtatacttatgactttgagatgctggggagtttcttgaaaggtgggtgacaggttacccaagtgatactggattcctctctgatttgcccacttcaaggattcagcgtgtttctgtgcacacacacacacaggcatctggtccccgggacagtgggatcacttgtgcggtgtcacactgtgtgcagggtgaggtggcatgctcagggctccctgaggatctggcctctgtggacctcagcgcatcctgctcctaactcagaccccactgcccggcctgcacactcacacttctgatgagcagtgggtagcgggtgatcctctgcatgggtttcagcaggaagctggagaggggcattcctttacaccgcgggtcagatgccagcttctgcaaaacaacagtgaggctcgtgaggaaatcacagctccgatcacaggaagcactggtctttgatcgccttttagatttcacatttcttttatttatttatgtttctccctgtcttactgttttagaattttttttaggtgagtgttctattttttatttttattttaaaatttgtgtatattcacaacatacaagtgtaattttgctacactgatatgtcgcactgtagtaaagtgagggggcttcgactttcttttaaataactcaggatctaaaatgatacctattaggttcacagtaggaatatctcagctcatgtgccaagcccagcggatgctcctcagctctttcccatgacctgtgctgggactgtcccctgccctctcttctcggagctgattcacacttgaccctcaagactcaggccctgcttccccttgtccaggctctcccctgggacaccttccctcctttccatgaccctccctggccacctttagcatacaccacatgtgcaccaggtgatacagggagaggcatcgtgttgcagtgtctctattccacacccgatttgtgaacgccaggcccagggcccacatcctacttgcctctacccctagctctggtacactgcctgaagacagcagctgctgctctaggatggcagcttttaatgactgaaaagtacactcactgtaatccacctcatcatttccccactactggatatttaaattgccccccttttgttttggccgtatctatataggttgctgtcacaagcatcttcgtgcttcttatttccatattttctgagtctttttaaaaagtaacattttagaacacagcttattgctagattttgctttttaaggtaacctatagcaggcctttcatgaggcagtatttttatttattttgactactgttacaattgtgatgactttgaaatcctatttacatcattattttaaaacatgcacatatactaacaattctcagtttatctcattattctgatgaatgtttaattctatggtcttggtttccatgtttcttccagttcatttcgaggcaactccctgcctcctacccttatcacaaatcgaagggctctgtcctcactgccttatattgaatcatttttgcatccctgagatcatcgtaaggaaaaatacgataatcatttattgaatgctaatagtaatgtgttggtctctgagttaaagtcctttaaaagtactgtgtgataatctccttttatagatgaggggactgaaggcacccacatgttaaataacttgcctctggtcacacaattagacagtgacggggccgagattctgaagcctgtcttgttctaagcatagtatgctatagcctcctgagataatcctatttggttatgataggctcttcttttcatgtaatgcttaattttatgaattgttactttaattaagagtttaacagctgtatttgtaaatgatagtgggttttaacttaaacaggccttggaatcatggctacttttgctttatagaatgaattaggtgacctttttactttttcctatgatctgtaacagtttgtataatatagaataatctgttcctttagagttggagagaattccctgttaaatccatcaagtgaacccagctcctttttggggtaagtttctcaattttctccttggtgtatagtatcgtaatagtaagattttctatttttaaaagattttctattcttattgagccagttttcaagttttaatagaaaattacaaattttgttcatgttttcacatttgttagcatgtcttttggaattacatgcactttaatttaagagatctccttacatccattctgttacttgtgttttttcctctttctctattagattcatcagttacattttattacctctcttcaatataacagttcttggatatattgatataatttgtgctttttacctttattacttcctccattttccttttctaatttctattctctgcctaaacatctttatattttattcttactttctactcttttctgataatgaaaatatttaaattatatactctccttaagtactgatatggctgtttaatatatcccaatatgcagtatttcatgaacaaaaaaacccaacaggaaatatgaaaaaaagcaagaaaacagattttactttcaatttcctcaccattttaacaggtataataatagtttctactactgaacaacatcaatgcaaataacttctcaaaatatgactttctattataataacctgtacgaaggatgttgttgactcattacattatacacagtgttctctctctgagtacagctgtagctttacttctcatgtttaacttgtgacgtggcatcacggaactgatcctttcttcttctgctcatcagtttctggaagctttgatgacatctgtgcacacttctggtatatttacaggatcacagatatgcattttatatattatcctaattcctggtatcgtctttgtttcctactctcatttccttttgtccaagtttattcatctagttattttaaattttatcttgttgcattttatatatttgagtaagctattttagggccgggcacggtggcttacacctgtaatccaagcactttgggaggccaaggtgggccgatcacctgaggtcaggagttcgaaatcaacctggccaacatggtgaaaccccgtctctactaaaaatacaaaaattagccaggcgtggtggcacatgcctgtaatcccagctactttggaggctgaggtaggagaatctcttgaacttgggaggcagaggttgcagtgagccaagatcataccactgcattccagcctgggcaacagagcaagattctgtttaaaaaaaaaaaaaaaaaaaagagtaagctattttatactctttctggaataaggcaggtattaaatgaaggcaatttacaaaattaagaaagtgacattctggttgtttcttgggagtataaagtagctgataagtaagtatgcttaaaaaaaaacactctgctatcagatggggaaaaaatgatggtcccagtgccaggaaaaaatcaggtctacataaaggcaacacaaaacaatcggaaaattctctgccgttttggtgtttcctttggaaactgatggggatgcccttctccattgctgggattccctgttgggctactgtgtgctgttgcctccagcctcagaaggagcctgacccgcaaggcccagaatggaattacctttaaaaattctttgaaatctgtgtcttcatctgtcttctgctgtaacagagctgctccattaagctggcagctgcagaacctgatgtaagcctgcatgtgggacagctcagcggccaggatgtccccaatcatctgcaccggcatcttctcgcccccggtcttcttccgcacccgcaaagccctgccaagaacacactctcattttgtgtttctaagtgaatgacttaggtaattaaaggatgaatcccatggcagaccaatggtaatgataaccagtgagctacctaagaacctctggcactgggaaggagaactcaagaggaagaggagatagcttgggccaaaagctctgctggtcaagccaaccggggtgtgatgtcagcaaagaaaaaaaaagtaaataaagtccctgcagttgggtgggctgggcacggtggctcatgcctctaatcccagcatttcgggaggccgaggcaagaggattgcttgagcccaggagttcgagaccagcttgggcaacatagtgagaccctgtctctacaaaaatgaaaaattagctgggcatggtggtgcacgcctgtagttccagctactccggaggctgaggtaggaggattgcttgaatccaggagttcaagttgggtgcagtgagctacgatcacaccactgcactgcagcttgggtgacagagtgagaccttgcctctaaaaataataaaaataaaaataaatttaaaaaatacacacctgggtagctgggcatggtggctcacgcctgtaatcccagcactttgagaggctgaggtgggtggatcacgaggtcaggagattgagaccatcctggctgacacagtgaaacaccatctctactaaaaatacaaaaaattagccgggcgcagtggtgggcgcctgtatcccagctactcgggaggctgaggcaggagaatggcgtgaacccgggaggcggagctggcagcgagccgagatcgcgccactgcactctagcctgggtgagagagcgagactccgtctcaaaaaaaaaaaaaaaattagccaggtgtggtggtgggtgcctgttgtcccagctactcgggaggctgaggcaggagaatggtgtgaacccaggaggcggaggttgcagtgagctgagactgtgccactgcactccagcctgggcgacacagtgagactccatctcaaaaaaaaaaaaatacacttgggtgtttcaaggcctttagaattgttttggtttcaccttagcttcttggcaaagtttcttttgaaagattctaacttgttcttggttgaaccaagaaggaaattttcagtctgtaagagaaaaaagggagcaggagctgcaggggccaggtgtggaggcagagaggcactatccctgagggaagctgggactgctcatcctcccttggggggcctgtcctcacagccacgaaggatggaaaatcaccccaacagtagaacttcacatggggatagagacttaggaggccaccaaactaggcagttttatctgcgccgtgagctgcagctctcctctgactcttctgccctgccagggtcaaggacatcttatatcttggaatcatagattgatatgttgtttaatgatttaattttttctttatcaaaatattttgttatatttctttactttcttcaatacttatgtattttacagtcacaggatatttcataaaatgataataaaataacaagcctgaggaagcagaaagcagttgaagttcctttgctaagaagcccttgcagagggttttgtgtgagtctcagtctgggggctttggggtcagcggcaatgacaggtgatgctcaggactcacttcagcagctttgtgttggacatgatgagctccttccagttaacaaaaatcagggccatctccccttcagtgagaaagcctgactctgccatgcgtttctgaaaaacctaaagtcaaaacatagaaaaactagttagcttaagtgtggatacacagcctacgtgtggtctaaatcaaacaatgtcttcataaactgaaactaatcagatcaaataatgtcaacataaactgaagctaatcatccaaataagcatacttatgacacattttatactgcataatgttctttctttttgctagtgcagctcttatcaaggctagttccaaggactgaatctagtaatctggttaagaggagattttcagatttctctcttagggatgttatgaaggttaaataaagccatgggcatgaacacctaggcactgtacaagcttgcaggattgaggaagcaggccattgttaggtggagcatcgtagagttctagacaacaatttgtgagacattcaacaggagaaccagagtaacaacttatgccacccctaagataactctaagcagatgtgggttttagaagttggctgctgagggagaaatagtaatactctacatctgtattacatagcacttaaggatttacaaagcactgatatgtacaaatatgcagatgcttgtgtgtgtgtacacacacgcgtgtgtgtttgcagggttctcaagtagcttcacgggtgatggaggcgaagctgagtcaggtattattattaccaattgacctatgaagaaataaaggcttagagggagacttgctcaagatcacaaagacagaatatgaaaggcctaggactaaaattcagctctttttgattctaaatctaagtttcaactgcataactgagattcctagggaatgactttaaacaccttaaggaaatagagaagttacctgagacactcttctcatatgtcatctttccaaaatgcccatgacatgctgctattagaatcactcaaagctctccactgtccgtgtgataagacacagactcctcctggaggttccagggcctatgagacctgccccctgccaacctcaccagcctggccctcagctacttcacactccagtcaccctggatggcctgtaggcccctgactccctccatacatgccatcccacttctgtttcctcctcctggagtagcaaacttgtccttgtccaaaacataactgggaaagttcttcctggctggggtggtcactaaccccaggtttcagccttactggccccactgtacctctctccatccaacaggactctgaattcctggaggacaagaactttctttcatctctgttctctggcatagccctttgcacatcgtggtttgtaattcatgtttacagagttgagttgaacatggattcacagaattcaagtacaagtgctgggcactctctaaagagagttttacagttccaaatcagactgaagacactaggccactcctgtgagagcagccctggaaagacggccggcctgctcggaggctgctatggagggacagggaagagtctggctgtccatctgtttgtttatttgctgattcattcatgcccctctagccatccatgtagctgctttgtgccgggcttggtgaggtaagcagatgggaataagctggtcaggcctctgggaaccttcatgaggatggtcataagaaggcctcacctgtgaatggtgcttttcacccagaatcctggacccagacctgatgcttcactcctcagagtatggggcaagcacccggtgcctgctcacctctgtcctagtgttagggagacctccacacctacttacagtgccttaggactggaatctgaccagcagcagggctgatccttgtaggggattaatcaaaatgatgggcttttcttctaggccatctatcctggccagagaggtgcagacataaacacacccaattcactgactacttatggaaaggccgaccaagggccaggctaagttttgggaacacaggatgaaggctgcacggtccctgttctcagtgagcccacaggcgtgcagtgaagatagatatcaccaaccgagaagtgccatatagtttgcatgggaggggaacaagtattccatgtctggatatcccaggcattaggcctgcgtttaaggtggagagtgaatccagggcagggcttgctggggaacagacgcagaaggacgcagcctctgctccattcagctatgaaaggcatggccaggtatacgctgcacctgttgggtgtgtgggggtaggggacgcctgttcttttcaggtggtttgttaatgtaactggtcttctcacctgagggcctgtacactgggaactgaaaggcatggaaacaaaggtatagtagaaatggaaagtcttcttttgttcactcaagcacaaatcattttaaagtgctactcgaataaggatagctgtcatcagcgtagaggtcactggtataaacaaacagtagctatatgatatttgggaactattttacaatatgctcccattgggttttccaaactgatacaaccatgaggtgaacactttcactgtttcacagttcctccagagataccagtttatgaaaatgtcagatgttaaaacagatattaggcaaatatccaaggaagctacggtctgccataggcccttcccatccactctatccccgtccttccttgatggggctcctgccacatccaacgaagccatgcgaatgccctcttgttctcccgcttcactctgagtgacctcatctgggggaaagagctcattagagactttcaatctcaagcattatccggcaggcagagacagcatttggaggatgtgagagcttccgtcactatttgtgaattcacacatcaaaagtgatgccttgctttgactctgcgtggaggcagccctgagtctgatgcccaccatctctcatgagagacagcagataccccgagagctagccagcagcagcctcctcacctcgacgacgagctgaaggtcagccatgtaccgctcttcggtctgaatcagctcatgaatatagccctgtcttttcctctcaattggctgcattgtgtccagggtttgcagatcagcacaccctgtggaaaaaacagggtagtttaaaatattactttagtcaactttgtagaaaatagacatttgtcagcagatgtgctgggtttacaaatgctgctttgaaagaatgacgcagccttaaaaaggacgctgctaacttctgcagagcagcatgcgtacgcggagagttggcattaatgagccggcactcacagctccaaagtggcaaatcagcaatgtctgtaacatttcaatgtgctcctaatttcttttcagaactgtgcagagcgtgtgaagaatctcaccacctcaagacatttttcgaagttactgaaatgattaaatgaatcagatgcttcagaccactccaaactgcaggtcatgagccattagtgggtcattatatcattttggttttaaaatgctggtcaggcccagcattaaaaaataaataaatagaaattaccatgcatatggctttggtaaatattgtgaaatgtttagttatgtatgtattcgaaatgtaaaatgtatttctcactgtgagctactgttaaaaaaatgtttgagaaacagtctctagatttcttaaaggaaagttctaaggttataaaacctgaaattcccagatcccagcaattcccagaagaccactgcctcatctcactagaacaaataactcctggtacactgcagatatccagccacaaatgacaggaaagtcacaagcaaccttgcatcagggtgagaggtactgcattcactatggatcaattcacaggcacatcacagctgaactagatgtcaaactatgaagtgacataattccagagtcacttaacaagtagctgagggcttgcctatacacagtgatgtggcgaaatacctcaggaaacccttcttagaaaaaaaagcaaaagcagccgggcatggtggctcacacctttgggagtaatcccagcactttgggaggccaaggtgggtgtatcacgaggtcaggagatcgagaccatcctggctaacacggtgaaaccccgtctctactaaaattacaaaaaattagccaggcgtggtggtgggcgcctgtagtcccagctactcaggaggctgaggcagcagaatggtgtgaacccaggaggtggaggttgcagtgagccgagatcgcaccactgcactccagcctgggcaaaagagcaagacttcatctccaaaaaaaaaaaaaaaaaaaaaagcaaaagcagtggaagttgtcagaatcaaaatggagtcacttgtgttaaaaatcctgacaaagggccagggaaggccatgaagagagagttctcatccatgaatacttgataactagaactatcacaaaagactgcaaaaccacaaacttacataaaggccatggtgacctgacacaaaaaaatagtcctgcaaggttatctgcccagcaactgcctgtccaacctcggacaagtgccacccttattgattctcacggccaaggataattatatatttaaaaaaattatgtgatcctcttcatttttcctttaaaaacttttgtcctcctttagttctctgaatatgcacctgttggtatgcatattcccattacaataactatttttcttttctttttttttttttttttttttttggagacagagtctccctgtgtcagccaggctggagtgcaatggcgcaaatctcggctcactgcaacctctgccttctgggtgcaagtgattctcctgcctcagcctcctgagtggctgggattacaggcacacaccaccacgcccagctaatttttgtatttttagtagagatggggtttcaccgtattggccaggctggtctcgaactcctgatctcaggtgatccgcccaccttggcctcccaaagtgctgggattacaggcatgagccccatgcccggtgcaataactattcttaaataaatatcactttcttttagagagtctccctctccgttatttaggttgacagcatgtaggtacccagcaagctacaacatgaggcagcaagtggcttgtgtcagaaaactgggaaagagacgaatgaagtagggaagaccttctgtagctaaggcaaccaagaagggcagcagagcgaaggcgcaccctgcacctgccaggacactgtccatccagcagggcgtgttgctctttccaatttcctttgcatttgtatacattttgtatagatctgggcttacagacagttctaaggaagacagcttttctatattctacagatgttgccaacagctttaaagaaattactcccacagagaacaaaaaaataaatgaataaggcaggttatgtttggtgtttctaaaaagaaatcatagactgtggtgcctgtaatcccagcactgtgggaggctgaggcgggaggatcacttgtgcctaggagttgaagaccagcctgggcaacaaagtgagactctcatctctaccaaattaaaaaaaaaaaaattagccaggcgtggtggcatgtgcctgtagtcccagctacttgggaggctaaggctgggaggactgcttgagtctgagagttcaagtttgcagtgagctgtgactgcaccactgtactccaggccagataagagtgagaccctgtttcaaaaaaaaaaaaaaaaggaaaagaaaggaacagggagaaggaaggaaaaagtgaatgtaaggggaaagggaaggggaggggaggggaggggagtgagggaagaaggaaggagtgaaagaaggaagggaagggaaggaagggaaaaaaaggaaagaaacaagaaaaagaaagaaagaaaggaaagaaagaaaaaaaagaaagaagaaaaataaagaaaagaaagaaataaatcataatgccactgtcatgttcaaaattgttacgcttttagggagatagtattttattatcttctgccagggggaactgcagagggtaactgagtgttaaaaaaaatcactgaggctaatccaaatgtctgcttgacgaggcttttgtggagcaaggagaggcttggtgaccagacacctggcgaaatggcactgatcctgatatgatccagtggtgctactcggtgtggccaggtgattgatggagggaactcagaccagtttccaaggttgccccacctcccacaccactgtcttacaaacttcatgttctgctttcaagacttttgccatatccacattccatctctattattatttacttaatatttttctctaaacgtactcgtgtttgaagttaagtgtgctcattatgtttcttctaataatcattaaagcaaatatataatcattcgaatgaaacaggtccattttgtgtaccagtgcgttgagcaccacaaggatacaactatcacaccttgggaaacaatgatttacattaaaaaccacaagtattggccactgtatctggaataataccttggaataatagcaagaacctcagatatttgtttctaaaactagactatacattgcattagctgtagcaggataatgtggggacacccctggcatgccatgcctagctgacccttttgcatttcatcatgacggctcttcaactttttttttttttttgagacggagtctcactgtgtggcccaggctggagtgcagcggcgcgatctcggctcactacaacctccgcctcccgggttcaagcgattctcctgcctcagtctccgagtagctggaactacaggtgcccaccacacccagctaatttttgtatctttagtagagacggggtttcgccatgttggccaggctggtctccaactactggcctcaagtgctctgcccatctcggcctctcgaagtgctgggattacaggcgtgagccaccacgcctggcctgctcttaaatttttaccctctgtttaagtttccaacccagctcctaccctcacttccagatgctcttacctctgatgtcagggaaaaaataaagacacgaggcctctcttcctccccttctgtctgtccatttgtccctgtgtgtccttcctgagttagggaaggaggggtcctgtttctttctaaagccactgtctgtagtcagcctctcctccagggcccctccctttccttcacgcttctatgttcactcttcgccatttccttcttagcccataaacattgctaagtgtccctcctatcccactgtttgaaaccaaccaacaagcacacttctccaaccctgccccctcctcagcaccgcctgcctttggtctcattggcaaatgtcactagaggggtttacacccatggccaactctcgctagctttccctgtcacatctccactcgggattctggtttctgccccactgcccgacactgctctcgggaaggtatcgatgaccttggcattgccaagttcagtgacctcttctgagcttgcaccctcccctgccggcccacagcacaggcgccttggatgggaggcttttttggagacttgagtctgcctttctcagcccttgagcctctcctcttcttggtgtttccttctgtcttctgcctcttgcctgctgcctggctctctgctccccccagtccagcaaatgccaaaataggctcctgatgctcctgtcctgtgcggtcagatgaatccagacaatgctgcaggctgtatatctcactcgcagggccccagtgcacattagcctattaggcagtgagaaactctgtgctacagaaaaatttgatgagctcagggttcccaacacgtatttgaccacagaatcctctttttttgagaggagggagggtaacatcttttttgtcctgagaaaagtcctgatgaactgaggaattcgggttttatggataggatacacccctttgccactctctatacctgcattgtcaatagagtagcccttagcaagctgtgaccgctgaacacatgcagtgtttccatggtactggtttgtatctgtcttttaacattacacatcgtctaactggtgctgttgttaatctgtgtagttacggtgtcagtggctctgactgcagaccagggactgtgtctaacacatttctgtaatagcaagctgagcacagcgtgttggctacctgcagtcagggaatatttgttaggggatagaatattgtgttggtcctaggcctgtttgtgcccaggtccatttctcaccttttccctgttctgctctgggctgcaaaaaagccaatcctgcaggctgttttttctaagcttctgttctatttggcctctgcctgggtttggccaatgagaggaaactctggcaggagactgaatgttacagggtggagtaggaaaaatgtcctctctccagaagagtgacatgattaaaaagttttttgtctgttaagtaatgaatggaaatgctgggcttgcatcttacacaaacttggagttcaagaattcagatgaattaacacaaaaattggccaggtatggtggctcacacctgtaatccaagcactttgggaggccgaggtgggcagatcacttgaggtcaggagttctattagcggtaaatgtgctcagactttgtctgaaaatgtatttatttctctgtcatccatgaattagatttctagctggacagttattttttctctgtgttgtgtgttatgtgcagccagtctaattgctgttcatgtggttattctggtttttcttggtgctcacttgaggtctgagcacaaaggaatcaatattactgtagaaaaatgtttactgaatgtagctggaaaattacacatttaacattattttcagatatttcactttaaagaaaaagaacttcctaatctccccaggtagcctcctctgttattttactggacctattgctaacatttagtagagatgaaaccccatctctattaaaaatacaaaaattagccaggggtggtggcgtctgcctgtagtcccagctacttgggaggctgaggcaggagaatcacttgaacctgggaggcagaggctgcagtgagctgagatcgtgtcactgcactccagcctgggcgatacagcaagactccatctcaaaaaaagaaaaagaaaaacaaaaaacaacacaaaaattggtcactagctggtgatacccttagggtgactggccaaaggaatggtgcaactggcctggagggtcacactcacaactgtggctccatgagattccacagaaaaaccaagtctcattaaagatgagctcaaagtaaaaaaaaaaaaaaaaaaattacaaaaaacgggaaaaatccaccataaattgaaaaatgaggattagaacaccaagaacatatgacagtagaacaaaaatacacatggagatgtaaaatatatatgtttaacattactcaagacacataatgaagggcttgaagccataggtagtctattaaaagaaagaataaggagagttgaaaaagaataaaaatggcaaatattgtcatggaaatgataaattaatagattaaatagcagattaaacacatcctaggaattagtaaacctaaaaacagatgtgaagaattatttagaatgtagcccagaaagaaacagagatggaaggctgggcatggtggctcacacctgtaatctgagcactttgggaggccaaggcgggtggatcacctgaggtcaagagttcaagaccagcctggccaacagggtgaaccgtctctactaaaaatacaaaaaattagcggggcatggtggcgggtgcctgtaatcccagctactcaggaggctgaggcaggagaattgcttgaacctgggaggcagaggttgttgtgagccaagatcgtgccattgcactaaaaaaagaaaaaaaagatggaaaacataaaacggaagttaagagacacagaggacagaatgacaaggcccaacatacatctgacaggtagtccaggagaagggaatagaaagaattgagagaggtaatattgagattataatggctgagacttttctagaattgaagaatgatacaatgcctcaaattcagaacaatggcttctgattaggaaaaaaataaatccataccagaacaccaaggagggaagaaaaaacatgattaaacagtcagaaagaaaaatcagaataaccacatgaacagcaattagactggctgcacataacacacaacacagagaaaaaaataactgtccagctaaaaatctaaatcacagatgacagagaaataaacacattttcagacaaagtctgagcgcatttaccactaatagacatgactggaaaaactattaaaagacgtatttcaggaagaaggaaattacataagaaggaaaaagaaaagagatatgagaaatggtgagccaaaatactagtaaatgtgtaagaaatcaaaataatcattgactgtataaaacaacaataatactaagttggcaggtataaatacaaggtgaagttaaaacacaaaaatgtaataacatgaaagacataagagaatcattagagataaatcatcctccttgcattgatcagcagaaggaagagatattgatcaaaggcaaacaggtatgttaaaaatggaaaggtaaccactcaaagaacagacatagactacataatttcccaaccagtagagggcaataaaagaaacaaagaaacttgatcagtgcgacagaagtccctgtgtcagcagaacaaaaaggggcaaagaaaatgcctggtaaatagaaaatacataataaaatagatacaaataaaagtattaaattgttttaatcaatgtaaatggcttaaatctgtcagtgaaaagagaggctctggattaaaaatcaggtcatagaagtgttggaagtagtgggctagaaaaagctatccaaataaaaattctaaaagcaactggggaggttttattacaacagacaaattaggctttaaggacccgtatgagatggtagaaacattcaccaggaagaagaataattctgatcttatttgcaactaacaggaaagcctcaaagtgtaaaataaaaaaacaactaacaggaaagcctcaaagtgtaaaataaaaaactaagacccataccccacctccctccaaaaaaaagaaaaaactgacatatctataatcgtagtagagtttaatatagttctctcaatgaaaattaatgagaatatgaaagatttgaacactattaacaaggttaacatatgaacacacatacaagagactatacattctttttccatagaaccaggctgggcgtgctggctcactcacgcctgtaatcccagcactttgggaggtcgaggtgggcagatcacttgaggtcaggagttcgagcccagcctggctaacatggcgaaaccccatctctattaaaaacgcaaaaattagctgagtgtggtgacaggcgcctgtaatcccaactactcaggaggctgaggtgcgagaatcacttgaacccaggaggcagaggttgtagtgagccaagattgtgccactgcactctagcctgggtgacagagtaagacactgtctcaacaacaacacaaagaacccacagaaccaatttcaacaaacaccaaggaatcaatattactgtagaaaaatgtttactgaatgtagctggaaaattatacatttaacattattttcagatatttcactttaaagaaaaagaacttcctaatctccccaggtagcctcctccgttattttacttgacctatcgctaacatctgtgattgctgatgactcgatcctcatgagatcctttttcactcgtcttccaggtcaccacctctcctctcctcatatcctcccacctcactggtctgcccttccacggctcctttgctcgttcctcctcaactctccagacttctaatgtcgcagtgccctaagattcagtccttggaactttcctcgacatactcagagccttggtgacccagttcattctcatggcttatttatgtactgataggctcccaaatttacactccagcctgaacatcttccctgaacttcttcacacgttctgctgtatactcagtatccccattcagatgtctaaaaggcacatcaaagtaacatcaaaagccaaacccctaatcatctcccaacctgctcctctataattttccacctcagtggatggcaatatcatctctccagctgctcacgccacctgatacttctcacacttcacattcaatccacctgtgggatccctcttcacaatacatccagaccacttctcacacgtcccccatggctgttctgatccaagttatcatcatcttgtgcttggattactgaagtagctttccaatggatctcctggcttctgatcccttcccctctttaatctggcaaggcagagcagtactgttaaaacacaccagatcatgtcactcctttcattaaaacccttggctgggtgcggtggctcacgcctgtaatcccagcactttgggaggccgaggtgggtggatcacctgaggtcaagagttggagaccagcctggccaacatggtggaaccccgtctctactaaaaatataaaaattagctgggcatggtggtgggcacttgtaatcccatctacttgggaggccgaggctggagaattgcttgaacccaggaggcagaggttgcagtgaccggagatcatgccattgcactccagcctgggcgacaagagtgaaactccatctcaaaaaaaagaaataaaaataaaaataataaaaaccctccaatgggttcttctcactccaaacaaaagccaaagtttataaatagcccacaagaacctaaacaacctccttcatttcctaggtcacacccagaccctcgcttcctccttctctcctgctcttccctcttcccaccgcacaggcctccgcactattcctcaggcaccacaggatgctcctgctgcagggattttgcaggtgcaaaatctgcccagaatgatcttccagatatccgcatggctccctccagatatcctcacacccctccagtctctgcctgccgtcactatctcagagaggttttatctgagtattttattcaaaataaaatccctctggatccacctcccttgcagaactcccattcctcttccctgcttcatttttctaagatgctacacacttcacattctcattttgttcgttttctgttttagcctactcaaacaccagctccaagatggcagaaatttttgtcttataatttgccacatccccagtgtctgacacacaggagggcttcgataagcatttatggaatgtgatgtgaagatacactctgagcttcaggagacagtacagcagtgttgactacaggcagtcagagaaattgatgaaaacttcctggtaggtcctttttggtagacaagaagagtgggcaaagaagaaagatgagagatcatggctactatcaggttgatgttcccagaggaataattagtagtgggctgggccacaagacccacccccacactgtgggaggatgtggagactgagagacaagttatgaatcataggtatgtcgcaccatagttgggaagcactattccaagttacagtgcaagcaagaataagaagcaaacaagagatgcctaagaaaggagaggggaaagatctgggcagattccaggaggtaaaggacaaaagacaatctgtgatgacgaacacagagagtgcttgttcagattatgtcacaagtcccacaaaagtccttgcccatttggaggggagcagtgccggtgaacaatgctattctctgtgtgcccacttatgcggccagagtatcacataatggtttccagttatactgtagttaagctcagtgaaaagatgagatttttaacagtaaatctagatgaataaactgcattttctgaaggctgcctttttattgaagttttatcaggacactagaaagttacaagatattttatgttgtaaaagaatagcttttcatccacttggcaaatatttattgagtaccgggtagcatgcttccaccacaaagatatttgtttttacttttggaaatttaaataattactggacaaatttctaaattcatgtctttttgaggcctgtcaagttctactccattaggagctatgttgctcctgtaagcacaaaaaggaaagaagttgaaatcatattctaatgttgcagaccatcagaaagcaaactatttgcctatcagaaaatagtcatattctagaatttccaaaagcaactatattgacaagtgcaaccagataaagacaaattttattggttttatttttacttttgaatctactgtaaaaggtcataagcctaagacagcaatgacctcctaatgatagacaaaagcgcagacctggccccagagagcagttagttcaggctaaaatctgcattaccttctaacctgccagacttgtaccatgactcaattgagggagttaatgtgagatgcaggatatagactattataaagagatatgaaatagtagtttcatcatgttagaactttcaattctaacaataaaaataactataccaatatgtgtatgatgattttcaaaccctgatcaatcctccgaataactgataacagctctgacccctgctctataagtaaatagataatctgaagcttagtggtgaagagacttaccagataaattagagctactacatatctaaatctaggtaacttgattcaagtcttatactttccaatggcaggccatttaagatgatgcttacactgcaattactggagattccatgtataaacctaccaggtcctatgcttggtgaactgaattctaaaggcaaaaaaggtttaggataaatattctgaatgccaattagcccaaagcaatgaaaaagcaaacaaggcccttactctaactcttttttatgtctaagtgatataattattcccttacacacccttctactctgtcacacacacaattaggaccttgtatctaatagccagttccaaagagactgttccatgcactgtagcactttgtatcagtgcactgattactacagttctgtccttgggcaatacgggtttcatatgcacatatatattttttcttagtattactgaacagcttattacaccattaatctcccccaatggtatgttcatataactcatgttttccacttgtttatgactacatacataattggagactttgccccaaattgctgagtttaggacacacaaattctatagcactggctgactctgacttcaggtggctaatggatgaccaccggtgacacagggatcccagtggcaggttcttcggtaccttggaatgtaacttgaccagcttggattcatttaaagcagttaattttctttaccctccatcttgcaattaactgatgactgttctgcttttgtggttgggagttaagagcagctcccagttaatggaaagcagcatgtgggggtggctaagagaatgagttctgaagtcagatctggacttgagttccaactctactacttactcagacaacccaaagattagttcatgacttggtacacagcaaatatttactaaatgttagctgttatttctagtatctattatgtgtcagacattaaacttgtgctttacaaaccccttaagcctcatgtgcaatgtgggtattattattctcacttatacagaccaggctaaggctcggaggggtgagctagctgagacaggaatcaaagcaatcctcccactatacttcccactacactcatttatcgttctctttgaaagagtaagtgatttttgccttttgacaagcttaaaacatctctcttaagaatgtccttcataatttgttgttctttaaagcaaagtttaaaaagtgattctaaaactgattctaaaagtttatacggagaggcaaaagacccagaatagccaacaaaaaaattaaaggagaagaataaaactgaagaactgacactacctgacctcaagacttactagaaagctgcagtaatcaagccagtgtgatactggccaaagaatacacaaatagatcaatgaaacagaatagagcccagaaatagacccatataaatagagtcaactgacctttgacaaaggagcaaaggcaatacaatggggcaaagatactcttttcaacaaatgatgctggaacaactggccatccaaatgcgaaaaaaaaaaaagaaattgtctttaaaatgaaatatagacacaggtctctactgttcgcaaaaatcaactcaaaatgcatcacaaacctaaatctgaaacacaaaactataaagctcccagaaaatagtgtaagcgaaaatctagataaccttgggtttagtgatgactctttagatatgataccaaagacacaatccatgaaagaaagagttgataagctggacttcattaaatgtaaacactttcattctgcaaaagatgtggtcaagagaatgagaagacaaggcacagactgaaaaaaaatttgcaaaagacgtatctgataaagaactatttttcaaaatatggaaaggactcttttaacagttcaacaataagaaaacaaataaaaaaatgggccaaagaccttaacagatgcctcatggaaaaagatatgcagatggcaaataagcatataaaaagatgctttgcatcatacgttgttgggaaaatgcaaattaaaacaaaaatgagataccactacacacctgttagaatggccagaatctgtaacactgacaccaccaaatgctggcaaggatgtggaacaacaggaactttcattcattgctggagggaatgcaaaatggtacagccactttggaagacagtttgccatttacaaactaaacatactcttaaaccatatgatccagcagcaatcacacaccttggtattgattcaaaggaaatgaaaacttatgtccacaaaaaagcctgcacacagatatttgtaacagcttcattcagaattgccaaaacttggaaggaatcacaatatctttcagtgagtggataactgtggtatacccagacaacggaatattatttagcactaaaacgaaaggatcaagccatgaaaagatatggaggaaacttacatgcctattactaagtaaaagaagccaatctgaaaaggctatgtactgtgtgattccaatcatatgatattctgggaagggcaaaactatggagacagtaaaaagatcagtggttgccaggggatgggagggagggagagctgaacaggtagagcacagaagatttttagggtagtgaaaatactctgtatgatactgtgatggtagctgtatgtcattacccatttgtacaatcccacagaatgcacagcaccaagactgaaccctaatgtaaactacagactttgataatgacatgatgtaggtgcatcaattgtaacaaatgtactgctctggtgggggttgttgttaatgggggaggctatgcctgtgtcggggcaagggacatatgggatatctctgtgtcttcctctcaattttgctgtgaacctaaaactactctaaaaaatgaagtcttttaaaaaagtgattatgaagacaaataattttaaaacgggcaaaggatctgaatagacatatctccaaaggaggtatacaaatggccaacaagcacatgaaaagatgcccaatatcattagtcatcagggaaatgcaaatcaaaaccacagtgagatgtcactttatgtccactggatggctataataaaagtcagataataacaagtgccggtgaggatgtggagtaacagaaagccctgtacactgctggcggaaatagaaaatggtgcagccagtgaggcaggtcctcaacaaattaaacatagatttgccatttgacctgggaattctactcctagatatatatccaaaagaaacatggacatatgttcacacaaaaacttgtagacaaatgttcacagcagtattattcacaatagccaaatggttgaaacaacccaaatgtccactaaataatgaatgaacaaaacgtggcatatccacacaatgggatgttaatttggccataaaaaggaatgatgtacagctacatgctactacatggatgaaccttgaaaacattatgctaagtgaaataagccaatcacaaaatgctacacattttatgattccatacatatgaaatgttcagaatagacaaacatggagacaaaagattagtgcctgctcagggctgaaggctggaggggggcttagggaaatgggggtgatagctaaattgtacagagattcattttgaggtgataaaaatgtcttataagtgactgtggaaatggttggacaactttgttaatacactaaaaaccaccaattgcatggcaagtgaattgtatctcaatgaagctgttaccaaaaaaagtgattacattcagctttatccttctggatactattgtcatagagtcttgtccttgtttattatgttcagtctttgactccttgactcttctctgtgtgtcctttttacatagagaaaagcctgtgcaatctctgatttttcctgtgtttttttttctttttttttttttggacatagggtctcattctgtcactcaggctggagtgcagtggtgtgatctcagctcactgcagcctcgatctcccaggctcaattgaactgcctgcctcagcctcctgagtagctaggactacaggcgtgcagcagcaccactcccagctatctatctatctatctatcttttattttttatttttttttgtagagacaggtttcaccaagttgctcaggctggcctcaaactcctaggctcaggtaatcacccaccttggcctctcaaaagtgctgggattacaggcatgagccaccatcctgtttttgtttcactggtatgagtaacagttgtagtgccgaagttcattattaggagatggtggcaatatcagcacactagtgtagaggctaacagcatggacttgggagccagaccatggaccacctctaccgcttactagcaggttccacttggacaaattatctaatctgttttaatttctgtatctcaaaaaagaaaacaatgaagaggtaatacattcaaggaccttagaaaagtatctaaactaagaagtcctcaaaaaagagcacttttcctcttttatttttactggtgtgagagatggttgcagagccaaaatttcattattttttaaaaatcatgaaaatagcaaaataatctctttctcatataacctgtttcccatctttgtgagttcctttcactatccaacccttaactgctgatcttctaggaggtctgatcttcttcccaagtaatctcatctactttcactggttcaacaactaccaatatgtatgtcattccaccaggtggtgtacatctgatgttgtctatcttatctgaccacctgcttgacaactctatgtggacatcccataggtgctccaaactcctcttcttcccccaactctaattcttcactgcagttggtggcaccattatcccatcctgtccctcaagacacaaatctggaaataactgacttttccaccgacactcatattccatctatctccagttcctgccaattttccctcagaactccgtttcatcattttttgctccaccttgggtgcatatcagaatcatatgggaggctttgaaagatccccacgatcaggccgaacttcaatccatttaaattaggaccctggaaactatagatttttcaagtttcccaagtgattccaacatacagctgagctagagaatttctgacttagcccttggcctgcctctcaagcctcaacttttatagttcctggctctgtatttccattctgacgatactgaaatgcttataattacacttccccaccatgccatttcttgtctttatcatacactccaccatcctacccaccaaatctggcttattgctacttatcttatggacctggcagttgcttcctccagcaagtctctcgttcaccaatctatggctgaatttggtattccttctctgtagtccttaagtgcctggcaaatatctatcactgtgctgaatatgctgttttataattatctgcatatgggcctaatcccctcaaagaactatgtaccacctaagacaatggccacttgacactcagttttgtatccccagcacctgcttagccttatgtaaacacttcatacatgttagttgaataagtttccggagatgaggaaaggctttttggaaagaggttgtttgtgctagatgttgacagatggactggatttagatccatatctttctttccacccaagggcttatacgaccaccaacatgattaactttaacactgcttaactttgatacctccaagcattcactgctgtttcttttacataaactcttattttgtactaaaagtcttactctacatttgcaatgagtattaatttgtaagttccatccaatctttttagaaaaaagttgcagtaaaacttataaaaacacaagtctattaccctagattatgttttccttacttttgtgagcaacaatgtattaaaatcaaactttatttcacttttgagatacatatgattatctccaatcaaattatcttcatcttgaccacttatacatttattttgccccctatgatataaaacaatttgctggcctgttctcatgagactacattaaggaaaaagagacattccaaagacatttaatcatgactaaataaaaacaattaaaagtaagttttaaagaatgtttcaaaagaaatacacaatacaactaatatagtttgtgttcttttaataaacacacttgcatagttatattacaattttgtaaaaataaaaacagattatctcatgccaagcgtgcccagcatttgcacaatctcaatacctttaatactataattttcaagacacacaaaataaaattttaaggcaaaaacagcactttgcaacaatttaataatttattacattacagtagcatcacagcagcattcaataatgccactttaggcaaaagtctttcagtatttccattatagattctgtttacaagaattcataaactggtaaaagtcattctaagaaaacctggcaaataaagctttggactggaattggtatttctttctctacttttctttcccccagtttctttcttttaaactacagtatttatattttaaaatgttttatttcaaaacatttaaatatcagttacatttttaatagttatattattttaaaatgactctttaagataaagttttagagaaactatattatggatagggctgatttacattctcaaattttctaaaaatcagctttggttttagaactgatttttttcatttctggaaaacctaaaaggtttaatcaaataatttaaaagtgattattatacattgcaattgcaatctttaaacaggtattttgattctttacctcctacagaaattcaaatttattcagttgaactcacattttaaaattctatgtttctgatgaactctaaccttctaatgttgccttctaagcaaattgaaagctgacttatactgaatgaggaagagaacaaatacttggctgaatgaggtattgcaaaagacagcatgcacttttaagaaagacttaagttattatgtcatatgatttccattctttttatctttttcttaaatacatgacaaaatacctacacaaagagtggtatttcagttaatatagtaaatttattttccagactgacattcagcttaaatacgccagtatatgatttaatccataggtacctgatgaacatattattttcaggttggttacagatgctaaacgctgtctgaaggtcattcccagtaatttatatttatcagtgtaaaagtgaagtgatttgaactataaaaatacgtttgaaataattcatcaatgtattagataaactcagtttcagaattataaagaaaaaaccttagaccaaataatgtggctgattaacagtggtatgatttctaccccgagggtttaaaaatggatttaaagtaactgtctttgaactcaaaagaatgcaaaagcagcaagttcagaaaataaaaggcaagaacaggtaattaatacaatttgggagagtcagttgaattcacaaggacccagtctttgcactctttcagtgaatgcaggcaaatctgttattctatctgtaaaatgaaattattgctttcctattaatgtcatatttataaaagtatcatgaggatgccaaatgctaaaaatagaggtggtctagtaactagaaattgccaccctagggagcacacatacttatctccctacatcctaataatgtgatgtattttggaacacagacattataactttatgaagttttaactgttgattctttcccaagcatcataaagttatgatttaggcaatgtatgactgaaataattcattcataatgtataggcacattaacataaatattgcacaaaatatgcctctaactgaaactgagaggtacaaaaacatatttcactctttgtaaataactttgtgaggaaatatgactctgtgattgtatatacacttttcctgatactttgacattcacaaacagtagattgcactgcagtttgtaaacattttaagttgcataaaattctccttgattttcaaatatagtataatactgtctactaaaactcctttttgtatcaactaagtactctcacatatattagtttataataatgtttgttattattttttaaagtgttttccattccaggaaaagaagtaaattcttatgtcaaagtagccaatatggttgaagaacaggtattagagaagtctgatggtaaaatcaatcttagagcctcaaagaagctccatgaacacagaggaatgccaggtgttacacagctttccttcactctaattcattcttgactagagcccacatgtctgttttggggacatttaaactcttaaaggatttcttatgatatttactaaatacattaagaagaatgtcaaccagtgcccctttgtatactgggacatgtagtcacctgattaaaacaggtaacaatgaactctgactttaaaatggattaagatataaatgctctaagctaggaaaggtttttcccatctcacagtcaatgatgggagcctttcattcctcaaaaataatccctttataggtcatcgaaaaagaatacacacgctgcagcacatgatgcagtaccttcattagcccagagcacataaagatcctaagcgaactaccataggacagtgctcattcttgggactggaacaaatgaaacactgcacatacctgccagagcaggccactttcctcttctctgagatttaaaaagctcccccaaaatgttgttattcccatcccaaatacacagaaaacagggcatggctgtttccagttcttggcctttaaacaaatctaaatgtcagtactcatagtggcatattacaaagtaataaacagtgcacacttgagggcaaaccacatattgagctaattaagagctcactgtgattaggattagatcaaacataatagcagaacataagcaaattttatctgaattctgtaaatgaatacacatgttgcaataacattaaaaaagcatggcagcctattccaaaccagtaagaatagtttgtgcaaatagtgggtctttgtgtgtttgaactcccaccacataagggcaaactcaatatgcatgctaatgacctacaattatcaaattaaaaaagaagaaaaatgctaaagatgccagagtgaacagcagggaaagccacacaaagacccactatcctttaactttttacaaataaatttaaactgtaagttagaaacacaaaaaaataatcacaagtggctctaacattcaaacgaagtaaacgaattgtgtaggagatatttgatcagggctgcctgccctgcctccacgctagagtgaaacttggatagtgggtctctggggtgctttcacaactggaagacaacattgggtcctaaaaaaagaaaatgaggaataaaatgaacataatgcaaattaggtgggtgagataaaatttgactagtaacaacatgcaacatcaactaaacaaatttgaactgttaaaattctctatcttaaaaaaagttctaattatgtaacaaaatgaaaaataatacttaaaagggccaaagaaacacaaatggtaatctataatttaactagctttcattgactattacaagaactacaaacaggtgattcatctataaaaagctgggtaggtacaacaaggatctcgtatctattcctgactttaaggattaagcattttctgaaccatatcctattaaaattataggtttatataaacaatgtgagttcatagctaccaacacaattaacattaatcttcatcttctttgaaaaagcaattatgattcttcaatttctgataaataattacttcaagtaaacaaaatcggtacgcctcactttcctagataatttaaacagttgttttatagaaacaataaaccatctcagaggaacctctttagaatttatccttagaattacagaattgagagcccttttattccaggatagatgacaagcctttagccattcatttaggcaaaacaataaaagtattcagtttttagatctgattaaactaaaaaaaacccacatatacccgccagaaacaaggtaataggtaagttactggtaataactttataacaaagagaaattcgaaactactcttattttataaaataacctcttgaacattttgttttcccagctgtcagtatgtaaaatgaccaagaaaatgatgagttcctccttgcatccccaacatttgcccttccagcaaacaattagtacttatccttcatgtaccagctcaaatatcttctgttgtatctttcacaacatgccttctttctccacaaagatttagggggtctttttccaaaacatatttgtataaatattcattgcagcaattgttatatttatctgaatgttgttccccactaacctctaaagctacttcagagaatggattgtcttgtcttgtttgtattcccagtactcctagtcagtacagagtagacactcaagtaataccaaatgatgaatttcttaaatgaacagtgggaagaatgttaacatagaatccaaaaccccccaaaagagtaaaacctgaaacacataggagctataaaatcattgcgtaggtcaataatgaccgaaagacgattattctttttcttcttattttaatctttcaatatttccttgtttgttttgagacagggtctcactctgttacccaggctggagtacagtggcatgaccatggctcactgcagcctcccacctcagcctcccaggctgctgggactatagggatatgccaccacactcagctaattttaaaaatttttctgtagagatgaggtctccctatattgacgatcagtcttcctgcctcggcctcccaaagtgttgggattataggtgtgcgccactgtgcccagccctgctatttccatgttttatttcagggagggcttgcattacaattggttgtcttctagaggcatgctgtctaatacaggagccacaggccacaagtggctatttagcttaaaattaaagttaaattaaattaaaaattgagtttctcagtcgtattagccacactccaaataatcaaaagtgactagtggccgctgtattggagagtggagatatagactgttttctgtattgcataaaattctactggatagtgctgtttagattgggtatctctctcaactacaggcagactaaggctctgccagttccacctatactaaaatagcagacgaagcattttctgggcaaaagtaatttgcatgacaaatgtgtccttgaataataactaacagatgatatcaatctattttctgtatcattagtgtattaaacatttactgacaaccagaaactatgctgcttctttttggaataaaaaattgtcactcaattaactctctgggaaagttacttttctaggagactgttactgccttgaagtagatttctctagagtaatttttaaattatctgcagaggggaaactgaaaggaccttcataaaataggcgggggaaaggtataagacctggggccatggtcctgtccttcctttcaaacagcttttatctgttctttatattccctattctatgaggcttaattggaaaaagtgtttcaaaccacaacaacatattcagaaaaccatcactttagatcatagatgctatagaagccaaatgtactgacacaccggcatgccttcagggatcactagccaaagatcttccaaacccagtaggtctgaaaagtcttttccattctcaacaccaagaaagatgccacagctagttagataaactggtttctaattaatcattgtgaactgccaaaccatcagcagagcttaaaaatgatcatttattaggcaacccaagttacaattttctttatcacttctgaaaccctccaatatttttgggactattcaaatcacaaaaaactggattcctcccatctccaagttgggaaacttagttgctttatgtaaagggaaggtttctcccagggtcagaactatctttataagctctaaagtgagaatgcacaaaattatagatatggtataaattcataatccttatactgaatcataagtgtatctgagttttgtttgggttaccttttatatattctcagcaactgaatttaaatgaaaggctaagtattttaaatttcataagagatatatcatgagatattttaaaaataaaactaaaaattaaaagagtgggaaaaagtgacaatcatttcataaaggtaaaaagttatttccaagtactattcattccctaatttattactaatgctatatttactgtcaaccaaaagaacggctagataaatacagagagataattttatatagtaccaaacttcacacttcgagatctggacccttgttctgaaaataatgaaatagaccttgattgatacatcccttgtggaaaaaggtgactatctaaagaatcacctgacaagaattttgcaacagtcaaatatttaatttttaattttcttccaacatggatgatatgtaaacagcgagaaataaatgagaaggttagaaatgtaatggcttctgtacactaaaagagtaattttgaataggtgaatagggtaattgctggctacttttttttttttttctcttgagacagggtttcaccttgttgcccatgctggagtgcagtgtgtgtgatcatgacttactgcactcttaacctcccgggttcaagagatctcccacctcagcctcccaagtagctgaaactacaagcacgtgccaccacacccagctaattttgctattttttgtcgagatggggtttcgccatgttgcccaggctagtctccaattcctgggcttaagggatcctgcgtgccttggcctcccaaagtgctgggattatgggtgtgggccattgcgcccagccactagctactttttattaaaccaaaaaagaacatgggacactgaaaaagaggatgatagtaaaaagaagctgcagtatagatggcagtcataccaaagaactcataggaaaaattatatactctcagattaagtctaatacgaaagtctggagctagcaagtatttaaaataaagctgtataacttctgaccttgtaaaaagtttccttttgtttcttctcactttaaacactaatctacatttgctgtgagtgctgagtttaagatctaatccagaaaaggaataaatgcagtgctgtatattgaagtttcacactaggtgagagaaaaataatttaatattactcacactgttgacttggatctgagtctgtcgtcatcttaacgtagtttgaaggaaagagaccagtcaccccgttgatctctccttgccaccaatcaggatcatctttgttcataacattaatgagttgtcccttggagaaactgagctcatcttcattatttgctgcatagtcatacatagcaatcacctgacatactatcacaagaataacaaaataacacattaaacaaattaattattcctgcaagggtcaatcatttgtaatctccctaggatttaaattattttaatattaaatattaaaattaggctaaaatttcccttgaactgctctttctcaccctccttcccctattcctggtcttacaaaaacaagaatttcccaactgcagttaacaatccaagtgaagtacttcactttaagtatgatggtgtaacaatttcacattgaaagatttcaaagagtcgaagtggttcaagtatcagtgaataagctggctgttcctacactgaacttttcagaaaggaaattctcagtggcatgtcccttttaagcagacataaggaaagaacacatttttaatgttttccaaagattgagctaatctaagaagttgctgagttttaacaaactcctctaaaatgaaatacaaattaacccacttccataccaggatgaaaggcaggtgtggctctttcactacttggacccaaaagtttaacatgactggcaggaaaccatcctttctgtcgcttttttcctctggcctaaaaattagcaaaagaaatacataattgaaagatgagattaaaaacaatcattgagacataacttaaaaattagaaaaaccataaatgtgtagtaaataatttaattttgcctaaagagaggtctggtttttgccctcagctcctggaaagtaatctctaaatccttggactatcctgactggtcagagtgtcttagtttacctgtgggtactgggtcatgccaaatctaacaatgtgatgtgctttgggtcatgcagtatcagctctaccttggtaggggatggagactgagttcagaaaaacgggcaatcaactgtatctatgtgaggaaccccagtcaaaactgcacaccaaggctttgctgactggcaatactctgtgtgtattgtcacacatcattgccaggaggagttaatactgttcatgactctgccaggagaggacaactggaagctctgtttttggaactctactgcactctgccccatgtgtctcttcccttggctgactttaatctgtatcctttcattgcaataaactgcaacatgagtgtaatagctgtagtgagttctgtaaagtccttctagtgacttacagaacttgagagtagtcttgaagacccccaaatttggaattggtttcaaatatgagcatgatcttgggggcctcgaactcagcattagcctttcaagtaaacattaaacaactggaagacacactaaaacatgcatctcaaactactgctgaaaacagcatctgaagaagtctatgtggaggtctttcaggctcagagttctcggaatatttcacaaaaatatttatattctaaaaagacatttctagagttctcctaacccttaaaatggtgcagccgactacaaatacttcttggagctttgttaatcattaatcaggaggtcagaagtaaaatttgtaaagagtcatgtttcccacttagttcggtccatcttcaaagtaaatcagaaggtggaatttcagggggttattcaagaaggtattaaatttgaacccccatttttcttcaggaatcctaagactcctgatttgcaagaatgaagctatgtttatcctccatactacaattatatatcactcatataaaaatatagctattatatctcttgtcatcttttaatccctaaaatgctttttagttttaactagtaaggaaataatagaagtgagagaagaacccttttcctgtatcaaaacatatgcaataaccatctattaacgttttagggaaaaaaaaaaggttcatctatgtctgtattgtctttaattgcactgctgtttcaaaaacctaagaccactagcggacagcccaattagtagtattttctcagcacaccatctagattatgtctttctcctagaggctatactgcaagcctgggactatcccagggaaagatgatgctgtttctttaagaacatgatctgtgaattataaaggaatgcattattggaaaacaattatgtctttggagaaaattattccttaaattgttacttataacatcaactcaactgtgctaaaaatgtacacacaagagactaaaggaaatataatgcagtaaaatattgatattgattacctctaagtggaatgattatgggtgatctaaaaatttttattaattttatcttttttatggagcatgcagtacttttataataaaatttatagatgctatttaaagaatattacctgtaactctccttgccaccacccacttgtatttttctttagaattaatattaactgtcctggtgcaaggctaagttgttcagaaccagaagcaacatatgctgaagttacctgagcaatctctgaaaagacaaagaagaaactatgaattcaagattgcgacagagcaaacacgttagtaattttttaagatcactactatacgtaccaggttttttatttgatgctccagacttgctagcactcccaaaactctacaaggaaaagataccgtgttgttttattatttccaacaatccaaatgtaaaagtataaaggttaatgggaattagagatttcaaattcccaggattcttttctctttaaatgaagatgaaaatgacaatgaacctcatgcagtattaacaaataagtgaaaaatccaacacttatgaggagatctggtctgctaatgtaatacattatatacgagtggctgtcatcgtcaaccattgactcaacaggaagagctcgttttctgaaacctaaatattaaacatgaccctccaggccaaatgcactccatttatcaatggcgttagcaccaatgcccactatgcacaacatatgtgtcctggatatgtcaaggtatacgttattttgctcctgctttctctaagggatcctgacttatctatggatcttgatgaacaggagacaatgtttttatttttatttattttaccatcctccccccaaactgactgaatctgacctaagaacaaaaaatccctatcctgtgtagcaactattacttctgtttcactttaaaggataaactggcccaaccacatttcctctttataggaatttgaacaacaaaagggatgggattaaaaagaattttgttctgttagtgaacatagctgcagtacaagtattaagcagagtggatggtagttaaaagctaacattttctgagtactgtataacagacactgctctaagaggttccatatattctgctatttaattttcacaataacactattaagtaattatgattatccccattttacagagaaggaaactgaggcacagaaaggtacagtaacttgtccaaggtcacccaggctctaagtgttacagctaagagtcaacccaggcagtctgattctactacaccaatggctctcagcatgtggtttgtagaacctggaaatagtccttgagcctctttcaggggtctgtgggataaaaactatcttcataaaaatactaagacattatttgtcttcttcactgtgttgacatttacagtggtgggtaaaatcattggtgctttagtgtgaatcatggcagtggcaccaaatgacactgaagtatggtagtgttcttcaccgccatgcactcacagtaaaacaaagccagtttcacttaataatgtctttaatgaaacagcaaaaattttattaaatcttaatcttcaagtccataccttttaaaagttctgtgtgactaaacagaagtgtgcctaaaacatttgtgctgcatactaaagtatgacggttgtcttaaggaaagtatttgtgtgactaaattgtccactcaactaggtttttcatggaacaacatttttacttcaaagaaccaacagaaaaactatttagacttgggatttagcgaacattttcttaaaaatgaagtaagcctgtcccttcaaggaaaacagctggcaggattttttgccaatgataaaattcaagatttccagggaaaattaaaattttagaaaatttgtacctaccactatgagtctgacagtttcctagtattgaaaaacttttctgatgagtggtggtattaacacatacgatttttcagatactgtgtaatgaaatgtgtccacacagggaatatctgcataactcagtgattcaatattttccaaataaacaacaaataatgttatcacatcatgcacgggtaaaagatccactcaacatgcaaaacagactagtgaattttaatgtaacagtaagaactgttcaccgatagggcttcagattccatgttgcaactaacctataacgattcagcatttgtcaagttttagtgtggtagaataaaaaagaacattggtagatatctgcaaatgctattaaaatacttcttcattttctctcatgtatgtgtgaggatgaatttttttatacttcaaccgaaaaaaaaaatgtcaccgactgaatacagaaacagacatgagaaagtagctgacttaattaagtcagactaaagagatttgcaaaaatataaaacagcctgtaatcccagcactttgggaggccaaggcaggtggatcactggaggtcaggagttcaagaccagcctggccaatatggtgaaaccccgtctctactgaaaatacaaaaattagctgggtgtggtggctcatgcctgtaatcccagcactttgggaggctgaggcaggcagatcacttgaggttgggagttcaagaccagcctgaccaacatggtaaaaccccgcctccactaaaaatacaaaaattagccaggcatggtagcggatggctgtaatcccagctattcaaggggctaaggcacgagaattgcttgaacctgggaggcggagctgtagtgagccgagatccagcttgggcaacagaactaaactccatctcaaaaaaaaaaaaaaataaaatatatatatatatatatatgtgtgtgtgtgtgtgtgtgtgtgtatatatgtatgtgtatatatatgtgtatatatatatgtgtgtatatatatgtgtatatatatgtgtgtatatatatgtgtatatatgtgtatatatatgtgtatatatatgtgtatatatatgtgtatatatatgtgtatatatatgtgtatatatatgtgtatatatatgtgtatatatatgtgtatatatatgtgtatatatatgtgtatatatatgtgtatatatatgtgtatatatatatacacacacacatatacatatacacatacatatgtatgtatacgtatatatacgtgtgtgtgtcttgctaaactttgttttcatgataaatacggctgtttttcataaaagcacgttatttatgttaccatgtaatggatttaattattgttattttaaaatgaataaatatataatttcgcttttcaaatttctgatacggtaaatatcattagctatactgaacatactttaaaaaagcctatggggttcctcaataatttttaagactgtaaagttcctgaaaccaaaaagagaacttctgcactataccatactggtggtggatgaaatgaggcaggagctcatgtaagctgagtcacattaatgttacagtcttaaagtgaaaattggcgaactacttcaaggtggtcctttttgtgtttctctgaatccagatctacttcctagcagttatcatgaagctcaaccctaccctacaactcttgttcttagaatttcatgaaatcttgccccctttatctaactggagccatataataaaccctattttaccggagctactgtgaacagtttctttgtaaccaaagcaacctgatcaaaaccataaacatgatctctaagtataaatcttgattaacaagaatgggttgattttatttttaataccaaaataatttaagtataaacctgattaaccagaatgggttgattttaatatcaaaatacctcttgatcctttggtttgacatagtttgatggaaaaattccacttctatctccaatacttcctgtccaccactctccatctttctgggtcaccaatatttcttcaccttctgtgaaagtcaaatctccaggttccacacttgaatatggataaagtgcaatatattctgtagggaacaaagcaaaaagaagtagattctggttttaagattacagaagtgaaaaagaaattaggttattctccaagacattgtataagtttgctgtaaaagaccttgtgccttcaggaaacctaacataaaaagatctaaaggtagaaaaaggaacgaagcaattatttaataattccttagaaaaaagttatttgacttaacataaaactttagagtttcttttattcccaattgtttatttttttatcacaaagaattacccaaaactacaaacagataatagtatctctatagataaatacactgaggcttagtgagattaagtcactcagttattcagataatggagtcaagataggaaaatatattttttaacttttttataccagaaatagtttaatctgctatattattttctctttaattcttttaagtacacagttatggaaacactcaatacccagaagacagcagcactagaagccaagctccatcctgatgacccagctcctagcacagtgcttgacttggagtagacgctcgataaatagttgttaacaaatgacctcaagggaaatatctaaatttttatatcgcctttgatttttgtttctgtgattgtcactgcttagaagaaacagttggtgacttggttttctaagtctttttctttctttctagttttatttatatttggccaacatggaatttgatcttaatatcataaacttgagacgatgagaaacaccacctacaacctatttactattcgcattcccagtattactcaattaatttaacaaaattcaaagtgattacaaggtttaggtacgctgcaataaaagtcgggtcctttccaacatgctcctcactactttcctaggctcagctcagagcactcattccacagtacacctatgattcagcttcactggtgacatgacgttcccccgttccttggctcatgccattccctctgtctagaagtgcattctcatcctttgtcactctgctagatcctactcattgtttaggatgatgcaacactgccatctctgtggattcatatgtcctactctaaattggttttgttcgctcattaaagaatttatcacaactgtatgctccattctattgtgagcactttggaaacttttattcatccttgtattttccaggctctagcatagaatcttcaacgtaacagatactgaataaattgtttaacattaaactgatatttttagcaaaacataaaatgtacctcaactattcaactaactttataatggacttatacatttcatttataaatgtatgtaactattaaataaaaatatcctctgaaattagggtaatctttcatttttcaacacattaacaaaatcaaaataatttactaatcaaacaacccaaagggatatagaaaaaaattctttgcaatacttatgataaagtataccttggtcctccttaatgattcatatggtacattgtaattaaaatgtataagcaatgaaatgtattgaaatttccttacctcctaaacatctataatcaataattgcaacactttttatttatgatgttattcatcaaaccagtctatgctgaattttcatagcactgcctttctaaagtgccaagtattttcacccatattttttctatattctcaatattcatgtgaaatagataggggcaggttttcctaatctcactttaatactgcagacacagaaatggggagaatatgcaactatgtgaagaacagcaactatgtgaagtcaggtagttagtcaagagctaaattgattaccatctaatttacaaattgccaaaagcttaccttctccaactgaataggctgccgaggtaggtttcttatttacagctgcatacaaagcttctggtctaccaaatatataaacaaacaaacaaacaaacaaacaaatacaagcaaaaataagaaaggtgatttgatgcacagcaggttttagtagtgcattttttagggctttctcaaattaaatatagtcttagtacacagaactgggaagacttatacacaacatcctgcaggattaagaacagcctaattataaacttctacatttttaaatatatttttaaaatttcaatatgatttacaaatagtttttcaaatgtgagatatttcgcctttctaaagaaacttaaaagacacccacaaattgttaagtggtaagcacatatagggcttagtttagtgtaggaaaaaataaaggcaatatatacattttattatttgtttagaatgcactacattaaaaaaataaaaataataaaactttgtttttattatctcagaacagctataacattaatttccattttaacccaggaatctgttttcaaaaatctagaagactgtcctgtttaactagacacctgtgggatgcaccaggcctccctaggacctgtgagtaaattacactgtgaggcagtttttaaataaacagaaggggaaccttattacaactactggtcacaactgaatggactgtcttgtttaatgctaaattctccattactgcaggttttcaagttatatgccttatctgttagaaaacactagtaactgaatgcatagttagaagaaatgccctctaaaacactgaaacaatctgtttttgcttaagttttcttctctgtaaatgttatggacataaaataagacaatttctataaaggaattgtctataaagggcctagcacagtgcatgcatacaaatgccagctatatatggttgttgttactgttattatattcttctaaatccaaaattcggccaggtgtggtggcaaacacctgtaatcccagcactttgggagaccgaggcgggcagatcaactgaggtcaggagtttgagaccagcctggccaacatggcaaaaccttgtctctactaaaatacaaaaattagcccggtgtggtggtgcattcctgtaatcccagttacttgggaggttgaagcaggagaatcgcttgaacacaggaggtagaagttgcagtgagctgagattgtgccactgcattccagcctgggctacagagtgagactctgtcttgaaaaataaataaaaagggctgggcatggtggctcacgcctgtaatcctagcactttgggaggccaaggcaggcagatcacctgaggtcaggagttcgagaccagcctggccaacgtagtgaaaccctgtctctactaaaaatacaaaaattaggctcatgcctgtaatcccagcactttgggaggccaaggcaggcagatcacctgaggtcgggagtttgagaccagcctgaccaacatggagaaaccccgtctctgctaaaaatacaaaaaaatttagccgggcatggttgcacatgccagtaatcccagctactcaggaggctgaggcaggagaatcgcttgaacccgggaggtggaggttgtggtgagctgagatcgggccattgcactccagcctgggcaacaaaagcgaaattccatctcaaaaacaaaaaaaaacaaaaattagccgggcatggtggtggatgcctgtaatcccagctacttgggaggctgaggcaggagaattgcttaaacccaggaggtggaggttgcagtgagccatgattgcgccactgcgctccagcctggccgaaagagcgagactccatctcaaaatcaatcaatcaatcaatccaaaattccatgtcaggctgaaaagcaaatttttagaaacagcactaccttccagaaacacagaaactcagcagtgaaagggtctttaaagattatttggcttaaccttttcattcagtcaattagaaaactgaagattaagtaggttattccttacagcctggcaaaaatagcagagccaaaactcaagcctcttgattgcaaaagaccagcatcttttcatcaaatcagactgcttttctaccaacttccatataaaacacaagagacagttacccatagctatattatagtacttatttccttgtattattatattcgacaacttgactccctacagagtaggaaataaaggtcagagacctatctagtttttagcttttttcatttgaaaattcattcaattgttcattcattcacgcctctcttcattcactcagctaatatgattgagcagctactatgcatgaggattagaacaggcatgaagaaactgaaaaatgaacaaataaaaaaaaagacatgcatcccagcctcattgagcttatgatctaataagggacattggtttaaaaaaatcagtaactataatgcagagtgctataagcaataagagaagttatattcagggaatcttggagactcagaaatgggaatgccccaatttggcaaagaggaggccctcagtaaagagttacttaaatattgacaatttatagtaaacaggggagaaatgcttgaaagaaaatgaaaagtaacttttctaactgatttatggtacaaagaagtggccaggtgaggtggctcacacctgtaattccagcactttgggaggtggaggcaggaagatcgcttgagcccaggagtttgagaacacagcctggggtaacacagcaaaaccccacctctacaaataatttaaaaataagccaggcatggtagcgtgcacctgtggtcccagctagccgggaagctgaggtgggaggatcgcttaaggctgggtggtcgaggctgcagtgagccatgatccaccactgcactctagcctaggcaacagagtgagaccctgtctcaaaaacaaaaaaagcaacagatctataattttgagtagcttgaaaattttatgaaatctgaaataactagaatgaaagatattctaaactgaaacaaatacctgaggtatgcttttttcatcctaagaattacctttcttttttctttttttttttaatacggggtatcactctgtcacccaggctagagtgcaatggcgtcatcttggctcactgcaacctctgcctcctgggctcaagagattctcctgccttagcctcccaagtagctgggactacaggcatgtaccaccatgcccggctaatttttgtattttttgtagagacagggtttcaccacgtcacccaggctggtctcaaacccctgggctcaagtgatctgcctgccttggcttcccaaaatgctgggattacaggtgtgagccaccacggccggccagaattacctttctgatattcaaactcaagtataaaattgttattttattatacactcaatcagaccatggctgactcattagtgaaaataccaacatccacatctcatgaaaacacataaagatgcttactcttcccgttttacttcactcccaggaatgatcttgacataagatttgggaaaccatcctcttcctccatgcacctccccaaaccaccaattttcttgctgctccaagacagtaataatgtcatgttttgagaagttcaagtggttatctttctttgcagtccaggaacaaagggcctgtgcttttaagttttctaccacttgtccctatgaatacaaaaccaccaaaaatttttaaaaggcaatggtaactatgatttctgtttctgtgtatataacatacttactgttcaaacagcagaccagttttgtgtcgtggtgacttaagataaccttagtctactaactgactttaaattatacatgatagacaactatgtgactagccttctgttaagacagactgaaaacccaccattcaaagaaacctcatcacatcactggtagagaaggtaaataatgtgtactcaagaaatgtattcacacatccatgaaatacatatcatggaacaaatgaaaaaggaatgttactgtaaatcttttttctcttccagcttgcaatgtaattctgtttactccactagggaaggaaattggcatgcttggctccctctgtttctctgcttttctcttaacttcctcctattctattctattcattcttctttctttccctcctctctcaaaggaaggagtgttttgttcctttaataaggctaaactcttcacttattctccaagtcttctattataccctttcattttctaaaaatatttaagtccttctcttcaatctacttctctacttgcttctacttctgaattccttaaatgatagtcttaaactttttttccaatttcactccttgatcacttctaatttaggttcagcactcatcacactactgaacctcttccagacaaggttattaataataacatcaaagccaaatgcttcttccaaacccttattcctcttgatctctaaacagctaacatcaagccttgtagttcctgaagctgactctctggtgattgatggctcctcttttgtccaacccttttcccttactgttccacaggacttccctaaatactcttaattatgcctatgacttctcaaacctatattttcagtgtaattttatctcctgatctccagacttgtatatcaaactgcctactgggtgtttctaccaagctgtccctaatacacatagcttaaacttagcatggctgaaacataatcatttttagaacctaccaaacccattcctcctgcactgtctaccaaagacaaggatactactatccttttggttgctcacgctaaagactgaagaattatctttaactcctatttcttcctcactctccacattcaatggattatctatttaatatcatttcctaataatcttctaaatctatctcctctttcttatatcttaattaccatagcacttgttcaaaccatcatctcttgttatttagctattgtaatatccttccttaactggttgttttcttctgctaatccagactttatgttagtgccagaattatctttctaaaacatacacaataactccactcttaaaaatcctcagggactttccactaccaagttgcctagcacggtattaaatgcttcccaaataaacctcaacctctctctccaacttcgcttaaccctttctccatgaatcctgtattccagccatattattaacaatgcttgtttcctgcaaatatcttgtgttaacatgccttggtgactttccccaaattgttctttcatgggaataactttccttctttgttgggtgaaatcttatctttgaagaccctactcaaataccttgccctttgtgaaggctgctccaattctcaccaattgagtaagatgatctcttctatatataccccctacagaccttgtagatatctttaatacagcatttctcatgctttacagttatttatatgtctgtcatgttcattagattatgatctactgaatggtgagtttctggtttttaaaaattgttttagagacggggctcactctattgcccaggctggagtacagtgatatgatcataattaattgtgcctcaaactcctggtctaaagtgatcctcccacctcaacctcccaagtagctagtactacaggcacatgccactatgcccggctaatttttaaattttttgtagagatgaggtcttgctgtattgcccaggttgatcttgaactcctggcctcaagcaatcctcccatcttggactcccaaagagctgggattataggcactgagtcactgtgcctggtgtcaatgtcaggtattttttgacttattttttccttaaatttctagcacataataaaatgcctggaacctatggccatggcattttttgagtgaaggtgaaatctggaggactttggactttattctgatgaagtctgcaatttaaaaaaataatgttaatgtaaccctattgcaatagttatatctaaatcagaggctaaatatacgttaaaaagttctaacgttcccaaataactttaagaaaaaaaaaaaaaaaccgtcaagcccaagtctctcatcttcttattataataactacaaatcaagaacaatatatcatgagatttgtaaaaataacattttgagcttagaaaccttagctgctagcaacttggtattatggaaaagaattgttgagaaacctaggccgggcgcagtggctcacgcctgtaatcccaacattttgggacgccaaggcaggtggatcacctgaggtcaggagttcgaggccagcctggctaacatggtgaaaccccgtctctactaaaaatacaaaaattaggcatggtggcaggcacctgtaatcccagctactcaggaggctgagtcaggagaatctcttcaaccagggagccggaggttgcagtgagccgagactgcaccattgcactccagcctgggcaacagagtgaggctccgtctcaaaaaaaaaaaaaaaaaaattgttgagaaacctctaagtaatagtcatttcttcaacttcacatcacatgtgaataagaaagaaactgaatgctacaaactctggttaaatgagtgaatggtcctttgtatataattttcattctattttaatcaggagcaaattcaaagaataaagcccacaaaaataacagacaacatacctgtccatgaataggtgatacagatccaggggacacagttcgagtgaaggctgattttttctgccatgatgtatttacagttaggtttgaaaaagatacattttgataatcagtcactgatgctggttgatttgaagaaagtggtctgcaaatataacactttgatataagtatatttatttgtttagaacttaatgaagtactaccaatttatcaacttacatattatatacactgtgcttacacacaatttgtgggaaaagaaataattattaacaaactactgacccatgttttcacttactaaatttcagtattaaatctggaacaaaaagtagtcttgaagagtacaacccggattacactatgatgaagtagtaggctgacaccattatatattaggtatttacacatttgcagatctatataaactttactgttagctaaaaacttactcagaggaagttgaggtagcagataaagaaactgtaggaggaagtaaggccttctttggagatacagctttttcattttcacttgatggcattttttctacataattgcatggaaaccagccaaaatttccttgaaaactaccataaagccaaccaggttctcctacggttttttcatcaacctacggaaataaaaagaaggattaacagtgcttagaaattcacacatttacaatggaaagagatgaaaactattgtatagtattctcattttcagaattaagcccatctaactaaacagctaaggcattttctacaaattaacagctactatttccagtgactggcaagttgtctttttaattttaattttatccaagttacatgaaaatattttacaaagacaaatagcattcattatatatggctaatgagggaaaacaatcctcccctatctcatggctccttatgccctgattttcactcctgacctgccattcttcctggtttcttctatatcaccatttatatttctgaataacatatttatactgctttttcttgaattttttcaattttagacattactggcttttggctatgggaaatgaagattgacctctctttcactgtagcctcttactctaccaatactgttatagcttaatctttatttaaatttatttaatgtttataatattatgattatgtttaaatatttcacatctgagtcatgcagcatgctgctgattaaatttccttttttgtaaactttttattctcctataatcattactttttttgtttttggcttacttttttctgttcctgttacacagtttttttgaactctctaacagaacaataagatcttctctgaatactattttccaactggtaaacatgtcaggtgatttatcaatttcattgcttctcccagacattttcatcctacagtgtgacatcctccatcctcacagtgtttctccctctgcttcttggtccttgttccttaaacactaaggacagcctcaagtttcatcactggctttctttcctcattctatacccttcctgaataagcccacttactcctatagtttgatcagtcctctgtgcaataatgaatccaagagctatgatctcagtgctgacttcttcccgaagcaacatgcctatactttcaactacttgcaagatatcttcaagtggatgtcccatgggaacttccaagtcaactttaaaactgaacttttctcctccatcccctccttctcctaaattcctctattattcacaccaccaaaaatttagtcattctaaataaaaaatctttggctcttacctcttttacacttccacatccaaactactgaatttgtcattaaagactcttctaatttgtcaacccaccctcactgccctacttcaggctttttttcatttcacactcaagattattatgatttttactcatccttcaagattctaacttcccccaacccaagccagagttatttcatacataactgtcataattagcattatatacattatatatgcataatgacacttaattatgtagctaatacataagtatatgtacttactacagataaattatttatatgtaaataatgacttatttacatatctctcttccatttgtccgtgagctttattgacccccactgtctagcatagtagaaatcacttaactcactgaataaatgaatatggtagttgtgtctctgttctccaatccattttccatacctttctaaaacacagacttgacagtgttatatatctattaaaatcatgttgaatccattcatatttttaaaaactgctttctcagatatcattaatataaatttcatgtttaaggtgttaaatttgatgttttgacatatgtatatacctgtgaaaaatcaccacaatcaagatagccaacacttccatcacccccaaaagtttcctcttgttccaccataagtcctccagcttgcccctccccatgaccttccctgccatctctacgaaaacactggcctgttttctgtcctatatattagtttacattttctaaaattgtatataaataaaatcatactatatgtatcctttttgtctgcctttttccactcaaggcatccatacagtaagaacagtttgttctttttttattgctaagtaatattatatcatatgaatataccacaatttgtttatcctttcaaatgttggtagacattaaagttttttctagtttttggctattacaaataaagctgctatgaacatttgtcttcatacggacatatgttttcaattctcttgtgtaaatacctaagagtggaatggctgagtcacatggtaggtacatgttttaacttttttaacaatggcttatggagatataattcacattccacataatccttccatttacagtacacaattaaatgcattttagaatattcaaagagttacagaatcattaccacaataacttacagaactgttttcctcaaaaagaaacactaggctgggcacggtggctcatgcctgtaatctcagcactttggaaggccgaggggggcagatcacctgaggtcgggagtttgagaccagtctgaccaacatggaaaaaccctgtctctagtaaaaatacaaaattagccaggcatggtggcacatgcctgtggtcccagctactcgggaggtggaggcaggagaatcgcttgaaccaggaaggaggttgcagtgagccaagatcacgccattgcactccagcctgggcaacaagagcgaaactctgtctcaaaaaaaaaaaagaaagaaagaaagaaacactatttattagattgtcatagctaagaaactgaaaaactttgagtaacccgaagttgttaagattttctctgttttcttctagaaattctacagttataggttcacatttgacatcatattttacctattttgagttaatctgtgtatatgttgcaaggaacaaattgaaattcatttttttgcatatgaatatccattgttccaataccatttgctgaaaagactgttctttttccactgagttgcttttgcacctctgtcgaaaatctgttgtttatacacacacacacacacacacacacacaaacacacgtagcatgaatctatttacctactctgttccattgatctattttcctgtctagatgctaatatcacaactgttttgactgctgtaacttttataataagccttaaattcaggtactaaaagatttccaactttgttcccttttcaaagttgttttgcttttgaatcatctcgtcatttgctacaaaaacaaaaagaaacaaaaaaaaaaaacaaagcctgctgagatttttgttgttgttgtagagatgaggtcttgctttgctgcccgggttgatctcgaactcctggtctcacgcaatcttcccattttggtctcccaaagtgttagggttacagatgtggatcacagcacctggctgcctgttaaagttttgatgtaaattgctttgagtctgtgtaagaatttgagaagaacagacttcttatctttttctaaaaaatttgtttacacaggacttaagagaagaactgacttcttatcaatactgaatcttccaatccatgaacactatatatctttccatttatttcggacttcaatttttctcaataaaactttgtaactttcaataaacaggtcttgcaaatcttttatcagttttatctgtatttcatatttttatgcaattgtaaatggtattttaaatttcaatttctgaatagtcatcgtttctatacagaactacaactgattttgttatattgatcttgtattctgcaaccttgctaaactcatttaaatagttctagtagcttaatagattctatgggactttttacatagattatcatgtcttctgcaaatcaatacagtctgtcttctccttttccaatcttgatgccttttactctatggtaagccactttagacccattaggatttttctcctagcagatgttgtctctctagtttaaagctcttaaaagttcaaacttcttagtgtagaatttgaatactctgaaattacagtttctttgtcaggtttcaacttacctttctagcttcatctcttaccatttgttcgatattctaggcaaatagttatatgacattctttaaaaacacctggcacatgcaagcctcaatgtttttatttaaggtattctcttctgcccagaatattacatggtttagaggaaatactacagacttgagagttaaaagaaccacatttcagtcttagccatgctacctggttatccttcgttaagataatgaatgctatcttgtgtgctttgtcatctacaaatttggggggaaatacctgtgctgccctcctctagggtatctttcagaattaaattgagtatatttatgaaggcgctttggaaactgtaaagcactaagcaaatataaggcataatccttcaaggccttcctccatcctatccttgggaaaaatgttccccaattctatttggttgtttttccttcattctctgggttcccacagtacttactcatataaattagtattgaaatttatcatgttatattttgtacagtaatacacatttcttttttttcctagactgtggtctccttattcatttttgtatgtcaccagaggcacatggttacaaactcaacaaatgttaacttgaatggattattctaaatttgattaacaatagacttaaagcttaattagtaataaatggattattagggcaacttcatttatgtttatggtaaataattctcattttaatgttatatgtctggctatttattacatcatgaatgaaatatttagaaaactcctaaaccagagctgctatggctaaactgtatgatgtcacagtaatgtagctcccataaaatggtgttctaaaatagttagaatgaaagcaaacacttatgaaatattatcctgtaaatctagtttaagactagtttaaaatagttaagtctgccaggcacggtggttcatgcctgtaatcacagcactttgggaagccaaggtaagagggttgcttgaggccaggagtttgagacaagcgtaggcaacatagtgagaaactccatctccacaaaaaaaaaaaaaaaaaaaaatagccaggtgtggtggtgtgtgcctgtagtctccactactcaagaggttgaggtgggaggatggcgtgagctcgggtggtcgaggctgtagtgagccatgatcccgccactgcactccagcctgggtaacagattgagacccagtttcaaaaataaataaataaataaaataaaatagctaagccagagcaatataaattcagacaagaatacaataaaccctgaggaattacacaaaccaaagtatttcaatgctgcaaaatgctcagcattgtacctgatttaaatgtattgtcttggacatggatgacgctgaaaaccatcattcccagcaaactaacacagaaacagaaaaccaaacaccacatgttctcactcacaagtgggagttgaacaatgagaacacatggacacagggaggggaacatcacacagcgggacctgtcagggggtgggggactaggggaggaaagcattaggagaaatacctaacgtagatgacaggttgatgggtgcagcaaaccaccatggcacatgtatacctatgtaacaaacctgcacgttctgcacatgtatcccagaacttaaagtataaaaaaaaaaaaaaagtatggtcttaaggaaaggaatcaccgtaagctatgagtattggctatatataggtacacatatgtacatacatacatacacacacacacatttaccacatttacttacatgcccttcctactttcctttctacctcccttcactgacggacttggctggctggctgacttttcagacagggtcttactctgtcacccaggctactagagtgcagtggtgcaatcacagctcactgtagccttgacctcctgggctcaagtgattctgccacctcagtctccacagcaggtgggactacaggtgcacaccaccaagccccgctaatttttttttactttttgtagaaacagggtcttcctatgttgcccaggctggtctctaacgccagtacctacgtgatactcctgcctcggcctctcaaagtgctgggattatgggtgtgcacctgcacctggccaaaagcttttaaaagtattaatttctagatacactttttcctagtgttttcaacctaatcaagaagaaaaatctcgttcatttattctgtagttaggccaagttgttttagtaagaggtcaattttaatctctttcacatctgtcatttatagttgtaattaatttttagttgttaatttacatactgagttaaactgaacattttatataaattctcacaggcctagcaaaactacttattacttcttcttaactacttattaattaatgttagcaaaatagcattaacagattagaaggctagaaaaacatttcagcttgtcatcgaaaatgtggccaagactcagtggaatttctaatccttttcactttcaatgaaacctccggtaacaccctcatccattaagttgatcagaccttgcctcctatcttaccgggaatttggaagtcctgggacctgacttcatcttctacttcagcaaaatttactttaatccctcccaccctttcttcctgccctctaatgacaaaggataaggtattcaatccttctaccactctcttccagggctccagattccagccttctagccttttcaagaatcttcctcatctccatctattagtcagaacagggaggtttgacaaggaacatgaagtgccttcctgatgctgtacgttctacacactgatctgaggggggcttcacagatacacagatgtgtacacattctttgagctgtatacttatggttgtacactttgctatatataaattatactttaataagaaaaaacaatctttatcagttatttatactctttccattatcattaacctgtttcctctctgcagatcctttctactattatttaaacttgctcaagcttcagccaactttaaaaaaaaaaaaaacttccctcaacccacatttctcattatttactaccttctctccttctccctttcaaagccaagctcattcaaagagttttatatattcactgtctcctcttcctctcttccaatttattccaactcactgaaatctggcttctcgctctactagtccacttaactgatactgctgtcctcaagttaacaacacctgtgctattgctaatctaataatttttttagtccttgttttatttcacttgcagatcactcttctcaaagttccctaacattaaactctcctgtttttttttttttcctactactagtcactccttttaaggctccacttcctctaataattccttcagtgtccatgtttctcaggaactgcatcctcaatcctcttctctctcacgttactactcccctggatgagctccattactctcatgtcttccaacaccatcacatcacactggcgacatccagatttacatcctcagcccagaccgctgcctgacatctctctaggtactctggagatccaactactactgcctggacatctgaaactcatacaaaactgaactcataattctacttatatattccccctctgattttccctcttaggaaatgacaccatcattaaccaatttgttcaaatcaggcaactcatgactgacagtagtaactcatgactaatacttcatgttaatgattcagcagagtacacaagcacccaagacacacagctaactttatgtttctgttgtcactgccaccagaatggctctctgaccatgggagaggtctgtgctaaagctggtagcagtctacaaccttttccttaccttccttcctctactgctttaggttgtcacgctttttcattagcctacaagcgtgttaagagcagagataatgtcttattcactaaatccctagtctaacatagtcagccctcaaaaaatatttgttgaaataaataaaaaatataaccaaaaatataagtaaactcttgaccaaacacgcccagagattggttgtatctcttcatccagacaccatcaccaacaaggagaggaggaatggtaggaagagcagacagtggacttgggctggttgtagaacaaacctctccccctgctcgggcacagctccggtactactaatagcggcaatggcaagagcaggaatgtgtgtttagggtttatcttgggtgctagcgttttggtaaatttttttccctagtatcattaaacatttgccacctaactgataaatcacactaactggtgacagtgcagggggagcgggggaaagaggcactggctagatactctggctagatactctggttaacattagtttaacaagaagaaaacagaagcagagactaaaatccaagtttgtgtgcttctaaagcctgtactctttccattatgtcctactggctctatcaaacactactcctgggatcttctcttattcatgtattttatatggattgtgataacacaataaagactttcgttccaaggaacaaattgcctgtatccagttagggctgtggaatctaactccttcaattcttttaacagttgctgtatggcatagcagaaacaacgctggatttggaaataaaaaaacacataactgcatcccattctggcactgcaatgctgacagttacaacttgtgtgagtttaagcttccttggctagaacttagttagtaataataactgtcctatgcagctctgaagtatgttgtaaagtccaaatgaggtaatgtttaagaaacattttacaaaggtaaatatatgaaattaatggtcaacattactacagaaactaatatattacaatgtatttaggttattcatgattaaaaaaaaaattcatttcctacctgaattatatctccagaattaaaactcatctcatcatggttccttgcttcaaaggggtataatgctctataattcaccaaaacactagctgtctcacctaaagagaagacaattgtcattatttgcaacttacatgtatacatctttgctatgactcaataaagagctctaaaacctaaaagaaaaaatcaagcaccaaatactacaatgaaaatccacttgatacagacttgctaggatttcagtatcttgactagtcatctaataaaaaagcaaacaaggatgctcatcttaagtaaggtaggaggcagcaaaacaaagagatgacttgcgggatgaagcacacacatgggtagaaaggaaagtgcaggagtgggggccaggctgagctgtacaaagtggaaggagaccaagcaaagagaggcttggtttgatctgtggaggtctgaatataacagggaagtaaaggacaaaaaggggggtctcaaaagataagaatagcaagttaacagggatggctgaagaaaaatctatacatctatcagaatggttctaaaaggaaaacagtggaagagtacacaaatatactgaatttgataagaataaaattgtttactttgttcatctttagaatgttttaacttataaaatttcaacaaactgtatcattaataatgattcaaagggttcatgtatctaaaagagatacaatactactaaaagtattgtggaaatggactgaggtgtatcaaaattttactgttgtttcattaaaataaatagcttagttatagtggttgaataaaatatttaaaactattttacttcaattatgaaaaccatgtctgagtcttttcacaatcagtagtaactatcttcttttctcctgctgtgctaagatttctactgctgtgttaagatttcagtctgttttaataagcctactgctttttatccaagtttaatttataaaaaggttttttctgactctacaattagtatctttctaattttcttccctttttttgtctcttatcaggtcatttttttcttgttgcatttgttctactgtctcaaagtatccttatccttacgttttttctcctcagctttcaaagtatccttatccttacgttgtttctcctcagctttccgttcctcttcttgaattttttcttgtgttttttcttcctggagtcgcttttgtttttcttcttcctcctttctaagattttctttccataagttttcttttccttgctttgctttcctttacataaaagaaaaagagtttgtataatgtcctagaaattttttacactaaataaaaacatactaagatctggttcctgtcaaggtgaagaactagcaatgaagtattagtacaggggtggggagaaactgctgagatcagaggtgaaaggaaaacaaatcaatcaatcaatcaagaaaagctttggaagctttggattgattagtggatgcactggggtgtatgactgacaatttcccacacccaaaaattccctcctgctaaccaacctccaaactcaagaaaaaaagaaaaaggttgaaatggaaccattcagcaaataaatctaaaaattacatctaagtttccttcctttctctccagatatttgacaagaactgtcttccagctgttattcccactgtcctatctaatctttgtttcaggggtttagtcattgttgctgtggaaataggaaatgcttctagaaaaacaacctacttttttttttttttttttttttaaagagagagggtcttactctatggcccaggctagagtacagtggttcaatcacaggtcactgcagcctggatctcctgggctcaagtgatcctcctgcctcagcctccaaagtagctagcactacaggcacatgccactatacctagccaactttttaatttcttttttataaagacagggtcttgctatgttgcccagtctggtctggaactcctggcctcaagtaatcttccctccttggcctccaaagtgctgagattacgggcatgagccactgcgcccagtctactttttatattattacttcaaaaagtcttttttgtttgcttagataatagagcatttctcctctctaggtccacgtgctttggtaaacatttcaatgaaatctaacacagctacagtttggtttccagccagtcaaggtgatctgtgatcaattattttagtattagaactcatgcatcttatagttctcctttgcatgtattttcacaaccttactcagaggtagagctgccaccacttaaatttagcaccttctccaagcctcagcactatcagggcagtgaagattacagctggaaacattcctgagatttgtcagcatatatacccttccaaagtgggaaccttggcataattccacatctctattccttaattcctgaaggaatctcgaaatcctggataattcaaaatattgtaggcccttagtcatcaatgctttctccttatctctcaactgtttcagacttcatactgctggttcactagcccatttactagattccttccaacaatttccaaacctccttcatcctctatcatgtcatagaatgcttcctccggcaactttcaaaacggacttctggttctcctgtgaggaaaatgcttctcttgcagtcctcacttaatttcaactaatatcccctttctcagttcctctgtaactttccgggacacttttccaagcctagtaattaatacccaattagctttcatttgaatttttatagcattataaatatcactatcagagtacttagcacatatttagcacaacaaaaaaaccagagggctcattaaattaaaattttctatatattttttaagctcttcattctttccatcaactcctcctgccaggtaatcatggccacataagtatgagactaggacaacctggataaggctccttgtttaatttaaggaaaggatgtcaggcccctctactctaggcttactgaggggtggtacttggctgagctcaacctgcaggaaatcatgccagaattctggtaaactttatgtaagagttagtagttgagaaaccggtccagtgccacaggatgcctcagaagctgggcaaagggcaaagaggccacaactaaaatgtgaaaacctattaccaataccttggggaaaagaagggaatatacctgggcaaatggccaatcaatccaagatgtggtactaagacccagcttcagactgagtaggtcctatatgcacttccgctctctttgatttctcttctctactacctaatgtgcaaggatgatgaatgaaattaaacgcatataactagtataatcttttggcctgaaaggaattgtgaacacgatgaagaaagattaaggtaactgcatatgtcaatagaaagttctgacataaggattagctgtggaaccactgcacagctcccttatgtaattaagtggtacaagttaagcagtaaataagagctgtaagagctacttcgtttgaactttactttctctacttctatattattctattatctcgttaggaggccacaaaaacaggggtctagatcaccaggcgcagtggctcatgcctataatcccagcactttagaaggccaaggtgggcagatcgcttgagcccaggagtttgagaccggcctgagcaacacagagaggcctcatccctattaaaattcaaaaaaaattagcagggagtggtggtacatgcctatattcccagttactcagtgggagcttaggcaggaggattgcttgagcccgggaggtcgaggctgcagtgatccctgatcataccactgcaatccagcctcggtggcagagcaaggaccctgtctcaaaataaagaaatgggggtctaggagtaaacaatattatagttattcgtttaactgtctgaatctcctattagaattatgaggagtaatccaaagtctaccagcatcacagccaacaatagccactcaaaaaaatgtgttggaggtggctactttgaaaccattaagaatagaggcctgccaaatggtaatgtgtcttccttgcctccctagtaactattagctttttcatagaaattactcatctactctttaccaaggcaaaaaaatactggttcatccatatttgttaactaattatactactttctgatactagaaaacttggaagaaagagaagaatgtattagaaaaagaatctcaatggcagaaaaataccatgcaaagtttctaaatgaataattctaggcttcagataccacaaatgtcttacttctccttactataaatggaggcaattaatatatctcaagtgataaaaagagaaatgcatcaatgtggcattctacattcagtattactatatacaattaagtattctgcttttatgatctttcaggaaactaatagatttaccaaggaaagatggaatgaatgagtgtttactatgtgcaacaaattatacttggctctttagctacattattttattttttaacttaagagacaaggtcttgctatgttgcccaggctggccttgaactcctgggctcaactcatcatcctgcctcagcctcccaaatagcttgggactacaggcgtgtgtcaccacgcccagttccagctgtattattttatttaatacatttacctatgagatatgcattattgtctctattttcagatggagtaactgaggttcagaaagataaaaataacttaaccaaggtcacccaggtagtaagtggaagagcaagaattctaatacaggtttgactccaaagtctgttatttttcactagtagaaaataaaatcagttactgcaaacttgatccctaaaaggactgaacttatgagatccagaatctgattaggataatccctttattttccttaaattttcataaactaaagatatgagcaacaaaattacaattctaatggcaatatagcacaataaatatatcagctatattaccttgcagcctcatcttctagtttctttttctgcattagttctaatcttttcctttcaatttccttcaacttgtcacgtttgatcttataaagctgttcaagggctaactgctgtgtgttgtaggtttctctcagttcctaaggagaaaaagaaaataagtcaatacgtgaatgatttaaatatgcttgtcatatgtattaatgtggcatttgcattaaaagataaaaatcctatagcaagttgaactaaatttaaaatatttaaagttttaaaaaatatctagatgataaaaaaaaccttaagtatttaaaccatatagctcctgagataaacacattaaaataatctacttttccatcagttcatttctacggaacacagaatctttaacaagccgatgctttgatttggtacatcattttcaattaaaaaaagcaatccattaaaaatatgggggaataatttgcttgttataacatctgaagagaaattttgttcagtcatgtttttgacatatgtaatttaaccaagttatttttatccaatatcatcttgaactaaacacagaattattaaataatttagttcaaaactaaaaatggaaaagatgtctgcctaaaatcatgaccaccatgagccaaaataatgaaaagcattccaaacaggagttgaaataaacaactgcttattgaacatctagttgtatgctaagtgctataaagcgttccaagaggatccaatacaaggctgactcccacgtctacagactttgtctttaaagagttcacaatctcaatgtagaggcaagtgtcaacatgcagggcagaggtaaattccttagcaggaacttgtgattatctgttcagcattttctcttcctcttcttcaacagcaccctgccttcctctaggaaactgatctttccaccttcctcccaacatcttacgtggttttaaaaggtctgccaaactcagagctcctcccattcccatcaggcacaattgtttactcctgacctaaacaatcacagcaccttacttccctgctcagaaacgactggtccaaaggacataagcataatccaagctggcccagaatattttcctgggattcacatatgttgaagtggggagaaagaaacctttctgcagctcattaaactgggataaagtaaacctggagctgcctcacaaccaaataagacctggggataggaataaaatcaactcagaaaaaagagaagtacagattagagactgagctggagagaaagggtactatagaagctgaatgttcaatatcatggctcggagacctaggaactgcccctgtccagcagcccttccatggattcagttagtggtcctaggatgcttctaataatcactcattagcttaactattttgaactagatttctttcatttggaatctacagaatcctgaacgagagagtagaaaaaggaggctggaggaaagaagtgggggcggggggacttaagagtaatcaaaagaaacttcatggcaaaggtgagagctggacaatatttgggtagaatgttttggtaaaaaatgttttttggtatcaacctatacacaataacacaactccaaactccatttcttttcagagataactattttataagtgaaccttttacttgattgaaatagtagatttgatctaagtacagcatgctgtccagagactatgtccaacatgtctgagcaaaacatttacaacttaagccaatagtaatgcatactgcttttatagcagaatttccacagctctcagcttctagggttttatttgttgtacctttctctaaattctattgaaaagcagaagaatatagtggttacaatatatagagaagcaaggtggtttagtgatgaggagcatgggtctggaataagactaacaaggcttgactcaggctctgtatactagctgtataaccttaggaaagttattttatagtttcctcatcagtaaaatgaggttaattatggtacaagggtgtccaatcttttagcttccctgggccacatggaaagagggaaaattgtcttgtgccacatgtaaaatacactaacaatagctgatgagctaaaaataaatacataaataaataaaattgcaaaaacaaatctcataatgttttaagaaagtttacaaatttgtgtagggctgcattcaaagctgtcctgggccgcatgtggcctgtggaccacgggttggggaagcctgttatgatacgtgcctcacagagttgttgtgaggataaaatgagttaatacatataaagtgcttattatagtgcagagcacctaggttctcagtaaatcttagttattattattggatgaagtcaaaaatgaggagagtactcagtctaaaaggagagtaaaaaggagccaaattaatgtctgatctcaacaaggctgcaggcttagccctccaacttgtcctttaaaatagagctctaagtattcctttactaaccctattccctgcagtgtcagagttaatgagcttccttgtgccattctgtatattcctctatcatagtgtcttctcttccaactatatgattgcctcctccactgaagtgagtttcttgacaagactgtctttcatcaaggtgtctccagccaacagagagtctagtacaacatggatatttaataaatatttattggacaaatgaaaaatgcataaacaatagtctatgcaaattagtaagatttaaagagcaccacaaagcttgccaagtatttcctctatttgactatggtgatgtaaaaattcctatccttagacctattcctctgggttaagtcactacttccaggaggtccttgctacacataatagttaagcaagaaaaaaataaaccaatcagaattcattaagagttgttctcaatcttttttttttttttttttttttttgagatggagcctcgctctgtcgcccaggctggagtgcagtggcgcgatctcagctcactgcaacctccgcctcccgggttcaagcaattctcctgcctcagcctcttgagtagctgggattacaggctcatgccaccacgcccggctaatttttgcatttttagtagagacggggttttaccatgttggccaggctggtcgtgaattgttgagctcaggcaatccacctgcctcggcctcccaaagggctgggattgcaggtgtgagccactgcacccagccaagttgttctcaatcttaacagaatgatagattatctcttttacgttaaggaacttctattactagtttgctaataagttttacttttaaaatcataaatggatattaaattttatcaaaaacctttcctgtatctaatgagatgagcataatctttttctcctttagtctgtttatatagtaaattacattaaacttttctgtatgttaaatcatctttgtatggctgaggtaaatccaacttggtcatggcaggttatgccacctgcaggggtattactaacgtagattactccagatccttggaagcatagggttaagacctaactccttgaaggaaaccacaattctaccattaacagattctactttccctctatggacaagcatttccccaatcattatctcaagtcaacactggttgactttccaaaatactaaagatattttggagattctgacaacccctttcttaagaagagtgagggaaagtaattttgttttttcacaaataacaaaaatatttgtatattcgtatataagagtttacaaagcatttccatctatatgcgatctcatttaatcacaagactttgcaaagaagacaggcagataatgtcagcatgttttgtaaaggaagaaagcaaatttggagggtaaatgacagatcgttacacaactggcaagtggcatggataagactagagttcacttttttagattcctaggccaggagttttcgttgcacttcactgctaaagatgtgtgaattttcttttttttttttttttttttttttgagacggagtctcgctctgttgctcaggctggagtgcagtggcccaatctcacctcactacaacctccgcctcccgggttcaggtgattcacctgcctcagcctcccaagtagctgggactataggcgtctgccaccatgcccggctaattttttgtatttttagtagagatgaggtttcactatgttggccaggctggtctcgaactcctgatctcatgatccacccgcctcagcctcccaaagtgctgggattacaggcgtgagccacagtacctggccagatgtgtgaattttcttaatggtataatggcctgtcaaatgtctcacttttgaatccactggctttgtcttagtataacttgaccaaaagagtaaaaatcattaattctgtacatgcatattgcaggttccagtaaaacataacattctaaattaaataattgaaatattttacttctgttgtcactacaagtagcctaaaggagtggtggttaaccccggtgctctactatcacaaaggaccacagcatcagaactaagtgcctgtcctgctccaacactaccaggaccagttccatctcacctactgataagacacagcctttcttctcattccttatcacctgaattcttatctctacagtgctgtttatcccttaatctgacccaatcccctactcattctctcctcaaacctctccactctcctggaacttcctctatgtgatcaggaaactatcatacagctaccaatcttctctgaacgaaaattctcttccctcgtcactttcttggctgatccctccggatactacttttctgctagtcctctctcagtttattatcatatactccatttacatcagggtcagaggataactacagtattttccttgctcttcactgccactttcagatggttatttccccctcactcttagcaactccatgcttttctggggctcctaccatccagcaataccattctctccttcctttttattgttatctattagtcacctggtcattcactcacctcactattctctaagtctttgacatccacataaatgatgcaatccaaacctcaagtctcaggctgatctcttcatcaatgacctttttaactctacttaatccatcactcccattattacaccctgagtcttactaatcagaaacagaactaccattgaccaaatatcccattcttcaaacgtaagttcttacccttcgaacttttcttatacctggtacatctatatcaatagggtttgtttgtttgttttttctgagacagagttttgctcttgttgccctggttggagtgcagtggtgtaaccttgcctcactgcaacctccacctcccagattcaagcaattctcctgcctcagcctcccgagtagctgggattaaaggcgcgtgccaccacacccagctaattttttgtatttttagtagagacggggtttcatcatgttggccaggctggtctcaaactactgacctcaggtgatcaacccgcctcagcctcccaaagtgcagggattataggcgtgagacaccacgcccagccatcaataggttttcaacctcactgagaccattctgttgactcccatcattctctttctttattaacaccccttcctctcttcacatccttcatgtctagttcatgtttcagagctcatcttgatcatagtgcttttgtcaagatctgtaactcttctgtccctctctctttgtgcatgtctattaaaacctcaaacctgtatgaaccatgaacctatttcatcagctttctctgtgcttatacctaaacagctgaacattggtgaggcaaaatcacacaattaggcatactgttttcaatttaaatacatcacctccaacttcaaaaagacattcaacattgctcagcacacttaggttttcctctactaagcttgcatatctgcactgagatgtctatttcatgcctatttctctcctgaaacttcctaatcttccatccattctcctcactaccagctataaaccttgcctcattaggccatcagactgcagccctctcaactttccatctcaaaaaaccaatagcactttctgcatctccacccctcttcttctggcctaggctgagttatatcatgtcctcctctacccaggaagattctttctgatggtccaacttacctctgattttaagtcttgaagctgtcgatatgggagtgggccagggaagtactgggtagagaaaggcgggtccctggctagggcttcagcctcgggcctatgcccatgaacctaggtgaggacaggcactcctgcctttgcacccaaatgttgcatcttccaagaccaccctggcctgccacgccaccatcctgtgcctacaaaaacccgagatcctaaaaaggcagaggcataagtggctggacgtcatgaggaccacatcggcagaagacgacacaagcagctggtcatcaagagcacgccggtggaagagcatgtcaacaggcaccagcaggccagcaggccactgaccagaggaacaatgcggagtttggccagagcagtgagaaatcaggttgcggcccgactccagggtaaaaccgtctcccttctggctcccccatctgctgagagctacttctactcaataaaaccttgcattcattctccaagcccacgtgtgatccaattcttccagtacaccaaggcaagaaaccctgggatacagaaatccctctgttctgtccttgtgataaggaagggggtctaactgagctgggtaacacgaaccgcctatagacggcaaactaaaagagcactctgtaacacacccccactggggcttcagctgtaaacattcacccctagacactgccgtggggtcagagccccacagcctgcccatctgtatgctcccctagaggtttgagcaggggagcactgaagaagtgagccacatccccatcacctgcccttcaagggggacaagggaacctttcccgttttactgtcaacttcctactctctaccaacaaatttaactgcattcataaccatcttctccccgtatgttacactgaaagtattctttttatctaatcctttaatctgtgctctccattccatcttaatctgcttcttcagggactttgctccatcaattaccacaatctcaatctttctctctttccccctgcctcctcctttcttttctctttactatttccttcaagtctttcttaaaccaaaaaaaaaaaaaaaaaagattttcctttgacccccatgcttttttcttttcattctaagagttgttgctactcacttaacccttcctcaactcttactcattcctgatccactgcaatccagcttctgcttatcactcaagtgaaatggcacttttagcaaggtcttcaaaagttttctttttgacaaattcaatggatatttttctttttctttttttttttgagacagagttttgctcttgttgaccaggctggagtgcaatggtgcgacctcggctcactgcaacctccgcctcccgggttcaagcgattctcccgtctcagcttcctgagtagctgggattacaggcatccgccactatgcctagataattttttgtatttttagtagagacggggtttcaccatgttggccacgctggtctcaaactcctgacctcaggtgatccgcccgcctcggcctcccaaagtgttgggattacaggcgtgagccactgcgcctggccaatattttttagcactatgttaactaataactctgtatcattttctagtaactacagaagacctcttttcttgctttctgtgacaacacagtctcctgactgctctgacagtatagatttcatatctctttagtttcctaaattgctctgatgaaagtatcaataagcagtgtaagtctggaaggcaggaagcagaaggaacaaagtaaaacaagggacaagaataactgctggcctgtggagaatcaaatgctaactcaaagaatcagactctgtgagggagaacagtccacaaatcatcattaaacttcactttacagatgaggaaacttagtttagtttctatgcaatccgtagcaaaagttctaaaaaccatataatctggccattcatgccataaccataaaggctaaaatatgggtcccctgctgctaccatctttccaatttgccctacttcgctcaggtaacaaatgaactctacttatcatgtttctgtcttcactgtggaatatatatgcatataggcaactgccctattgctatccattttagtactgagtaaaatgtgtagtcaaaatctactagagtcagcaagcagtaaacataaagcacatttctttaagctctattaaaatatttttaataatctacgttatacatggcaaagagaaatatttatataatttaaacatttttatctgatgtgcaagcatgtctaaatatgagcctggtaactagacctgactaaagttgcccctgcattattggttctttaaaattgtccttacaacagtattaggaagcagcttggtgcatatatgacataaacttgccctagatttcataaagtattaagttttattttaaacactgattttcagtgatatgggtaagtgatttaatctcacattttcctttgaattgagttagtaatcatctttatcagttaacccactcccagggatgttgtaaaggaaccaggttatatttctaagtgtcctggacttcttttgagaaaggttactgtgacaggcaaccttactgacttctggcattagactcaaacaggcagtcagatagcagaaggatattcaagcaagcagaaagaaaaaggcttatattgtatatgttatttcaaacaaagatactcagataaaggcaaagaatagtctagttttaaaaaaataaaacagcaaagtaactcaaagaaaagaagctagatattagaaaataaccttaagtaagaggaagaggttgttgagacagcttagcagagacaaaaggcactgaagaacagagtcatccatattcccacactgtaagataaggcagataaaaagccaattaaactacgtacagaatttttttttttttttttttttttttttgagatggagtctcactctgtcgccaggctggactgcagtggcgcaatctcagctcactgcaacctccacctcccgggttcaagcgattctcctgcctcagcctcccgagtagctgggactacaggcgcatgccactacgcccagctaatttttgtatttttagtagagatggggtttcaccatgttgcccaggctggtctcgatctcttgacctcgtgatccgcccgcctcagcctctcaaagtgctgggattacaggcatgagccaccatgcccagttatgtagattttttaaagaaataatatagggaagataagttggctggcttgtctaaccagcaatgacaaatgatttggttttctataaaatttttttctactgaacatatgcttgtgtaaagtgtattattaacattgttcacctcaaattccctttccttacctgaagccaccatgttgtcctttctttagcatgctgtttactctatatttgctgttaatgttattctaaataagtcagcatgataaaagccatatgaagagagagatttcttatacaaaagctttatgaaaagctttatttcttacagagaatagcttatgctctggaaactttatattgttagcaaaggaataactgagactattcccaaatttacattctatgccatgagcctgggtttttagtttctttcataggtatggcttcagtgtacaatgaatactgtggtgaatgatatgcagacagtctatgttttggacatctgctctgccactgcggcaaacaatgaatcattaacttgctttttgtgcaaagtttatagtgccagattctgttctagatttcactgattattgcattatttaacaaaggttaattaaattacacttcacaaggaaacaaaataaaaactgtgttaaaagagccactaacacctaaactatttcaaattttccatatttctcatttttgaaaattgcctaggataacgctggctgagatcagttctgtaatactgacaaaggcaattgttctggaaatgtatagatgccaagacaaacagcacatagtcatcaaaaattggaaactgtgataaagtatatgtttagttatatgacactatgtcatataactagaacattaaaaacaatcttgaaattcttgtatagttgaaattataaaataaattatgaaaatgtaatacatataatagctttagctatttattctattaaatcaaaataatgaaggtaagaaggcagttacctaaaaataaatagtatcaaaaataaatacctttagttgattgttaaaagaatccatttctgacagcttagatgcagtttctttttcaagagcatctaactgttctttaagtctttggcataattcttccttttctaatgattttttatgaagtaaactgacccctgaatctgaaaaacaaacatcagacagtttacattttgcagaagttcgtatgtcattaccagcatgtcatttactgtttggtcagattgatgtaactagaccaatacgaaggatgtatacacaatgcagaccagtacaagagaaaacattcagttgttatttccacttcccagattatatgctggaaagagcatcagaggaaatggttgtaagccttggttctgcattcaaaaggactaggacctgaagtgaaattctactttaggaaagatgcttcaccaatcgaatcctcaggcttttcatctatacaatgagcatcatgctacattaaatgaggtgatggatataaagccattgtacactctggtccacagttaatactcaattaatagaaactatagttaaagtagctttccatttattcttagtgctcccaagaacagggaaatattcacagcaaagattcagtaagtattactaactggattatttagtaacattattttaggaggtaagaacagaaggtttcattttatattatctttttttacatattcatgcagggatgaagaaaccagatggaaatatataatgcagaatacattacaataaattaaaatagcaatattatctgtttaaatgtctgtttttaactttatcatatttttgaagtacagaagtacaaaatttaaataaaatgaaacatacagagtaaaaaattaaaacacctccatttcaactgcaagttcatcccccttttaggcatttacatttagatgtgtacatactcaacttttatttccatgggttttaacagaatcatattgtctacattgctatgcaacttgttttcaatttagtaagatatcttatcaatcaggacaaacagatctagttcattcttttaaattgctccatagtagtttacattatggctactgcataatttatataactacctttctgactggtatgggtagatgttggtctgaacccactgatcaacatctacccattttcccctccctctaacccctggtaaccactcttctactctcagtttctgtacaggagttcaacttttttagattttatatgaaactgaggtcatgcagtatttgtctttctgtaactgacttactgcatttagcataagggagcgcaaatatctctttgagacagtaattttgtttcctttgaatatatattcagaagtgagattgctggatcatacaagagttctatcttattttttttagaaaccttcatactgttttccttaacaactataccaatttacattcctccaacagtgtacatgggttcccttgttcccacatgctcactaccactcgttatctctgatctttttgataacagccatcctaccaggtgtgaggtgatattatatttcaatgtggtttagatttgcatttccctgatgattaataatgttgagtccctttttaaatatctctttaccatttttaggtcttctttggagaaatgtccactcaggtcctttgcccattttgaaattgggttgttttttggtattgagttatatatattccttgtattttggatataaaccacttatcagatacatggctcacaagtattttctcccattccacagactgccttttcatcttgattgtttcctttactgtgcagaaactttttagtttgatgaagtcccacttgtttatttttgtttcctgagcttttggtgtaatatccaaaaaatcactgccaaggccaatgtcaaagagcttttgtcaatgttttcttctaggagttttacggtttcatgtcttatgtttaatccattttgagctgatttttgagtatggtataaggctccaatttcattcttttgcaggtggatatccagttttcccaataccatttatcgaagaggctaccttttcccattgtgtcttcttgatacccttgtcaaaaattagttgaccatatacacttgggtttatttttgggctctctattctatttcataagtctgtatgtcttgtaattgacaaaaaattgtatatatattgtatgcatgttgttttaaaatatgtatacattgtaaattggctaaggagctaattaacatatgcataatttagctaattaacataatgtgtatgttaattagctaggctctctattctgtaaatctatgtcttttgtaatcaacaaataaaaacttgtatttatagtacgcatgttgttttgaaatatgtatacattgtaaaatggctaaattcagctaattaacctcacatacttacctcacatacttaccatttttgtggtgaaaacacttaaaatctattctcttagcaactttaaagaatacaatgcactattattaactatagtcaccaggttgtacaatagatttcttgaacttattcctcctatctaactgaaatgttgatttcctttgagcaaactctcagtgatccccttttctctcaccagccctggtagccaccattttattctctacttttatggataaatatatacactccacaaataaatgaaatcataccgtatttgtctttctgcgcttggcttacttcacttaatgtaacatcttgcaggttcatgttgtccctatgtctgtttttatgccagtaccacactgttctgattactatagcttcataatatttgcaaacaggcagtgtgatgcttccaactttgtttttctttctcaagattgctttggctatttgaagtcttctgtgattccatatacgttttaaaattgctttttctatttctgtgaaaatgctatttgaattctgatattgtgttgaatctgtatattgctttgggtagtacagataatttttaaaatattaattcttccaatacatgaacatggagtatctttccatttatttatgtctttttcaatttctcccatcaattagttttcagttacagatctttcccctccttggtcaaatttattcctaagtatttaattatttttgatgctgtcatgaataatattgtttacttgatctcttttttgaatagttattggtgtaaaaaatgcaactgatttttgtatgctgattttgtgtcctacaactttactcaattcatgtattagttctaagttttattgcagtctttagggttttcaacatataggatcatgtcatctgcagacagggataattttactactacttttacaatttgaatgtattttattcctttttcttgtctgagtagtcctgctagtacttccagcattacgttgaacagaagtggtaaaaagtgcgtatccctacctcataccagatcttagatcaagcttatccaacctgcaggccatgggccacatgcggcccaggatggctttcaatgtggcccaacacaaattcataaactttcttaaaacattatgagattttttttagcactcatcagctatcatcagtgttagtggattttatgtgtggcccaagacaactcttcttccaatgtgacccagggaagccataagattagacaccccgatcttagatgaaaagtcttcagtttacccccattgattatgatagctgtgagcttttcataaatggcctttattatgttgaagaaaattccttctatatctattttttttgagagtttttatcatgaaaagatgttaaaccttgtcaaatactcgttctgttatttatggagatgatcacgtggctcgtagatttttgtctttcattctgttaatgcacactttaaattctgacagaaattgccaaactactattccaaaaaagctgttatcaacttatgccaccaacaatacctgtttctgcaaaccctcatctatattggatattatcaatcttttttcatttttgctaattggcaaaaaagaaacctgattgttattttaatttgtattttcttgataaccagtgatgtcaaagaaacatctatttatgtttctggccagagtcttgaattgttaggtcttatcctttgccgtatttttctattgggctgtcttaatttttgatttgtagaagctctaaattcttgtattacatgtacttcaaattttttagtgtttatgctgtctttcattatgatgttttcatttttaatcatcaaatctgtaagtattttcttcatgactctatgtattgtttaaagagaccttcctcataccaagattataaaatattttcctgttttataatagtttttaagttgtttttatgtttagcctcctaatttatctagaatttatttctgtacatagagagcggtaaagagctcctctgcaactctttcagataatccactgtccctcaaatcacttactgaaagcccatcctttccccactgatgttaagtgccaactttatcttatcctacgttgccatacatgcatgggctttcttctagactctattcaattccattgttctacttttctatttctgatcaataacacactattttaggcactctaactttcatatcttatgtttcgatatctgatagggttagtctcctcccccctaccaaagtttttctttttcaagttttgcctaatcttgtacaatttattttctagatgaatttgtcagttatcttcccaagtttcattttaagaaacccaaaaagaactgaatatataaattaggagagaactgacatagtattgatgtatagtatagtataatattaagctagttcatttaggaacataaaatgtctctaattattcaggaatcttttttttttattttgttttgagacagagtctcactctattacccaggctggagtgcagtggcaccatctcggcccactgcaacctctgcctcccacgttcaagcaattctcatgcttcaaccttccgagtagctgagaccacagatgcgtgccactacccctactgatttttgtatttttagcagtgatggggtttcaccgcattggccaggctggtctcaaactcctggcttcaagtgatctgcccacctcagcaccctaaagtgctgggattacaggcatgagccacagtgtccagcctattcaggaatctttcacgtctattagcgaagtgttatagctgcatatttcttcttcttcctttttttttttttttttttgagacggagtctcgctctgtcaccaggctggagggcagcggtgcgatctcagctcactgcagcctctgcctcccaggttcaagtgattctcctgcctcagcctcctgagtagctgggactacaggcgtgcgccaccatgcccagctaatttttgtatttttagtagagatggcgtatcaccatgttggccaggatgatctcgatctcttgacctcgtgatccgcctgccttggcctcccaaagtgctaggattgcaggcatgagccactgcacccggcccatatttctgctttattcataacaatgtatattactaataatgcatgttttaataccaaatttgatgacatatatgagcactatgttgggtaactggaaaataagacaaagaaacaacatggtagtacagtgggctttacagttagacatgaatttgagtactatgattgtaccatcctgggtaactacttaatctctctgaacctcagttttcctgagctcacaatgggaataataactataccaaagggttattgtaaagattaaaggaaagaatgcatcaaaactgactcacacagtgcttggcacatggctggtaatcttaaatggcaattgttatacagagaggcatctaagggatacagggtacttttcaaagcccaaacaaaagcttcctattttgaattggactatggctaaataaataaataggtaacagctgcactgaattacattccacagagaaagaatagccccatcacgtcctcaataagacatattctacattttattcacaattcaaataggaacaatgacaacaatgatgacaataataaagatatatttctgccactgtgcatatcaggtgggttagctcaccctgactctggaatgcctgtgtaggggtgaggtgggggctaatatactttgaacaggaaagaaccaagtataaggaacactgtctgagcagggacatggatagaccacatcaatggaaggcaggagacacaataaaaatagttcacaagagtgaacttcatttctgatatttcttccacgtgaagggccctgcactagcccaacaatcccagcttctttccttcctttcactaactagtgagctcaagttaaagacctaggaatgtacagcctaggctcctcctaagccctcactctctagagacttaactgcccacaggaaacctgcattctactttgttcatgcatccagtgctttataggtgcaactataccacccacagataaaccacactgcctagaatcagcttcatcaataatgaggcagtgatttggtttctcatttgtcttgctcctttgccttatttcttaatttgttcagaacttgcgcaaagaaggggatactatttattgaactttgtaaacagccaaaactataataaagagacctacaatggaataattgacttgatagagactcaatgagtgacattttaggatactttagtcagttgtaacacaacatctgcagatttacttttctttaaataaaccttgtttctgctatgcttttattggtatagtatccaatacagagaatttttttcagttttctcattgggacctgagcaaaaacaaaaacagttactatcccataaattatcctggaatgttttgttccacaggtgtcagagggccaagatggtaaaattctttgtatgaagcacagagttagataatataaagggtctgggcagagcataccatcctgcttaagcctatgactgctgcacgctaacaccctagaatcccaggtgcggccccaccataaagcctcctcctgaacagttctttaaaatcagtgcaggacttttcaaaatgcacatgtagtcttgtgttagagccaaatttatatcttatagtctaacactttatttgatgtttcaattatatacataaaaatatcatcaagatatgaagtcataccacaatcattactattttatttttatctactttttatcactaaaaatgctctaacatctgggatatttttcactttattttgaaactttaaacttacaggcaaaaagtgttatttataacagaatactttttttaattttaaaaaagtaacaatgtgactgatacagtcattcagaaaaggataaaagtaatcagacaaaccttagagacttaccaggtgtgttactgaactgcatgtttttaattctttcatttaataattgcttctcaggtaccagatagataagcttattctgatattccttataaaaagaaaaaatagtacctgattacaatgttataatattgtccaagagttttttttgaaaactttaaaacaggatttactcatctttgaaacttattttagaaataatacatagttgtaaactgcttacaacttatgaatcaactagaatggaattatgccaagaaatatttaagccaaaatcaattttgagtgactggctgaaattaaaaggcagtgaagaaagcctttgtaaatggggtgtgtctagaagcctacaattttcagcttactgatgaatgacagcagacctgcgctagatggtatgtgtaagcatgccatgatacttcaggatgaatatgtgtatatcaaagagggactaaaagctgggtgcggtggctcacacctgtaatctcagcactttgggaggccaaggcaggtggatcacttgaggtcaggagttcaagaccagcctggtcaacatggtgaaaccccgtctccacgaaaaacacaaaaattagccaggcgtggtggtgggtgcctgtaatcccagctactcagaaggctgaagcaggagaattgcttgagcctgggaggcagaagttgcagtgagctgaggtcatgccactgcactccagcctgggtgacagagggaggaaaaaataaaaaggactaaaaactaggaaagcaggtttaaatcagacagaaaatatttttggcttttgtttatctctcctgtaacaaagcaaaaagactgattaattgccagtccatgcagtaagagaaattgggtaagagaactctagagatgcagaatgcttccacagccccattctgcaaatagtaattattgaaccagaccctactgcacaagtaaggaagagaattaccaggaccccaagggacatattcaagttctcatcataattttaaaaagaataactttaagtcaaaatttcctaaaattagtagcaataaccttattttaatgtatgatatggtctgaatgttggtatgtccccaacattcatatgttggaacctaactcccaatgcagtactattaagaagtagggctttaggaggctccacactcatgaatgagatgactgtccttataaaggaagttgaagggactgccttaccctttctgcatgtgaagacgcagcaagaaggcactagttttaaaggagacagcaagccctcatcggacactgaatctgctaacaccttgatcttggacttctcagtctctagaactatgagtaataaatttctgttgtttataaattacccagtctaaggtcgtttgttatagcaagtaatgaattaagaatgcataaacattgttaaagagttaaaactcaaagtgataaatgtccacttacgtatatatattaagcaaaacttaaccagacgtctagcagagttttagtaggtctatggacttcctgatattgtatacaggattgcgtgtatttagatcacaagcctatcaaagactcaaggttattgacccccaaaacaaaactctattagaagaactgtttcgttttgttttgttttgagatggaatctcgctctatcatccatgctggagtacagtggtgcgatctgggttcactgcaacctctgcctcccggaatcaagcgattctcctgcctcagcctcccgagttgctgggattacaggcatgcgccaccatacccagctaatttttttgtatttttagtagagacggggttttgccctgctgactgggctggtctcgaactcctgacctcaggggatccacccgcctcagcctcccaaagtgctagcattacagccgtgagccaccgtgcccagcccagaagaactattaattgtacatgtttaagaacaatttagcagtgaaggacttacctgaagttcctgttgaagttgcttgatttccataatttccaagtcacactgcttatccagaacttccagctcagtcttttgagtttgctttttgagtcggacatcctgaagtctgcctgagatctgctgatgtttgccattctataggaagatcatataaatatatagtaacataaaatgctaatagaaaatgtttctacaaggagaataatatttttagttaaattttaaaatctcagttatcattcatattcatcctgaaacaaatgcctaaaaccaagtggaatgtgtttcagagttgtgtctgttaactcgagttattagtgggaaacacatcattctcagagtgcaagagcccatatgttagtatgggaaagcagaaacataacacattgaatttttttctgaattcagcattagacaatattaattaacaatattaatatcagagacactctcaaagaatgatgaagaggaataaatgtttgcatgtgatgctcggcattaccttctctgaacttctatttctaccctaaatatggccatctaatttcctctaattaaaacagtgcccaggaggaacgttttggcaacagttctgttctatactaatattcttctccttttttcctcttcttctgtgaagaaatcaaacaaatagcagagattctcaatgggacctaagaagaagggtgacatggggggttatgggctgaactgtgtcccccaaaattcatatgttaaagtcccaagccccagtacctcagaatgtgacaatatttggagacagggcctttaaagaggtgattaaggttaaacaaagtcatacaggtggaccctaatccaatctaactggtgtccttattagaggtggaaatctgaacacaaaaggcaccagagataaaatacactcagagaaaacaccatataaggacacaatgaaagatggccacctgcaagccaccaaaagaggcctcacaagaaactaagcctaactaaccttggtcttagatcttaggagctgtgaaaaaattaatttctgttgtttaagccacctagcctatcgtattttgttacagcagccctaccaaactaatacagtggagtgaggggaaatgacatcctgggttaaaacttactgatgatgaaaagttttactgaagactgtttcatatttgaaatacatacactgaaaggaacatgtgtatctctgctggagctcacattcttatcctcaacatgggatacgtataggctctggacctttccagactctgcacattcacctgtgttactgtgcttcatgtgttgcaccagttcttgagggaaaaacaatcaatcttaaggtctcttcccattatatatagtcaagatgatatatatatataaaaatagtgcaagagagttaaaagttttttacaactgttttgtagtactctggcatgattaatacttgtggtatgtatgtctatccatttgaaggaataaaataatatatttctgactaaagatattgtgatgattaaaaaaataatttttaatgtaattcaagtcatcaaccaaataaaatgttagactatgatcacacaagatctaaatctggctctactacatgactaggtatgcatttttgtaaaaccctactatatgatcagggtaggctcatgggattctagggttgtggcagaatagtgccagatcttttataccttctcaccacacatttcaaacaaagtcttttaacaacttgaccctctaacatctgattggtaaaaactgcttagtggccagtattagctaagaactacaatcctgcagaactggaactgtaagagatcatttaggtcagcagtttcaaatcagttgtctttttaatagtagaatctttttttttccaagcaaatcttgagtgaaaccccaagaaacataaagcacataaatgtcaagcttctctgttgtgaagcgtgggaagaattagggagagaaaatcactgttctgctgcccgagcttcccctctcctgcctctgcttagtcctcctcagaccatcttacagagaccaatctgaaaactgaaaatcactcaactaacacaactctttatttcagacaagggaaaagtgaggcacagagaagggaaatgtcttgcccaggagtacatggttcatcagtgtctgaactgatgctacaacataattctcagcattttgagtcattatccttttctcagtaaaccatattgtacagtctgtttatatgaaaatgtgactaatgacattaagacataactaattcacgagagattttaaaacacaattacatttttcttttttttttttttgagatggcgtctcactctgttacctaggctggagtgcagtggtgcgatcttggctcactgcaacctccacctcctgggttcaagtgattctcctgcctcagcctcccaagtagctaggattacaggcacccaccaccacccaccacggccagctaatttttgtttgtttgtttgagacggagtctcactctgttgcccaggctcgagtgcagtggcgcgatctcagctcactgcaacctccgcctcccaggttcaagcaattcttctgcctcagtgtcccaagtagctgggactacaggcgcacaccaccactcctggctaatttttgtatttttagtagagatggggtttcactatattggccaggctggtcttgaactcctgacctcgtgatccacccacctcagcctcccaaagcgttgggattacagtgagccaccatgcccagcccacagctggctaatttttttttttagtagagatggggtttcaccatgttggccaggctggtttcaaactcctgccccagttgatctgcctgccttggcctcccaaagtgctaggataacaggtgtgagccaccacgcctggcccacaattacatttttcaacaggtagctccatcatcattcagataaatttcacttaaacttcagccataccagtgcttccaactcaagatgaagattcttctttttagagtttaacctgacaatttcttcttgttctctattcttttgattgagaagctcctgtcgccgaattctctcccattctaagcgacgttgtcgttcaagttcctgttttgctgcctgaaaaaaaaaaggaattatacttaatttttaaatcaaaaattttgcacgattcaaaaactgggaagacaacaataaaagtcaggcagagtttagcacttagtggctttagtgcctaagggtagctaggcaaatctagttttattaatgggcttaaagacttccaagaaagtggcttcatctatcatattttctcatttcttcacgagatcttttttttttttttttttttccagacagcatcttgctctgtcacccaggctggagtgcagtggcaccaccttggctcactgcaacctccaccacctgggctcaagcgattctcctgcctcagccccaccaagtagctgggattacaggcacacaccaccacacacctggctaatttttgtactttttgtagagagagggtttcaccatgttgcccaggttggaagaccatccttttgttacagtcatttttctcttaataagttacagaatgacttcataaatataaatgttaacaggaataattttccctctattctggtatctgggggaaaaattctatttatattatttcagtgtgcaataacttcctgtgctccatccctggccctttaaaacacagccagtcctcctaaggacccttctttcccagcaacactatcccaaaggcctgtgcaagcccatcctcttgattcctctctagagagactttcaatgcccagctctcatctttctgtctctccaattccttggactcttaatctggatcttaaacttgctttcgtctaatgacttgctcagttgcctaactaaccttagctcctcactcaacttagctctgcagtcgatcctcctttgattgagatatcacctgcagaggatgctttctctaccacgtaccagttctgaaaactccttataagcaagaagcctctttccctcctcaagggaaggaatgatcagatttgtatagggtaagaatgaaatgatgcagagcaaaaggcaaaacaaaaattcaaaaataagcattttttaatcaaatgaaatatagtcacttattaaatgtaatgattttcttaagaagtaaaaaacttaaaaataacctctcgtctttctatgtcttttctcctttcttcctctcgttgtctctccaattcccgttgcttctctaagcgtttttctaattcaagttgtttcttccattcttgttcttgtaattctctctgttttcgttcccactcttccttttctttctgggctttacgttctgcctccctttgttgctgctccatcaaggcttggcgtcgcttttccagctccatgttccctcgctcatagttggctttccgtttgtcctcaaaagtaactgaacaaggtatgcctatcagcatccacacacattaacagcctacagaacctgtaatctagtttctatatacttatgccttgtgatcatttgagtgctatcagtatttgaatacttctcctaaggataattttaactcaaatctaagtggaaaaatatctactttcttcaaggatattcaattttagaaaaacaaatttttaagtttgaatccaatcaagagagaaataatttttataaacttgccaataaaaatactttttcggttgggtgtggtggctcatgcctgtaatcccaacactttgggaggccaaggtgggcggatcacctgaggtcagcagttcaagaccggcctggccaacacggtgaaaccccatctctactaaaaataccaaaaattagccaggcatagtggcaggcacctgtaatcccagctactcaggaggctgagacaggagaatcgcttgaacccaggaggcggaagttgcagtgagccgggattgtgctgttgcactccagcctgggcaacaaggaaaaaaaaaaaaaactttttcaacttttttctcttcttcaaggacaatcaaagctgtgtggttatacatttgttttgatgtcattaacatcctaatatattaaaacagctacaaatgtattctttcaaccaatatttaaatgtttttaaaggtaaagatttcattacaaagtttcctctaataactcagcctaaattaggagaaatactttaactcagatgtctataatcctgtcaaatacatctaactgtctcttcttccttcacactcttctcattttgaccatcttaattttatcaataccaaaatacatcccatctatcaaatagttttttctcatatagcacatcaaatattaaaaatataaaaattctaaatattccattacatttaaaggtagaatttaaaagaactcagtataaatatacaactttgacactcagtgatacctggtaatttcttctgaggctcctcttcttgcattttctgatatgaaggcagagttccattaatggaatcaatttgctttcctcctctaaaaaaatcaaacaacaaagttagcatcatgtagtctggacattttcagactagattacacagactaccagtgattatggcaatttgatattgggaatacagtattaaagatatttaaaacagtttggtatgtcgttacaaaatacagtagtatatggatattcaagacagagaaatctggattcaaatcacagttcagctaattttggttcttgggcaagtttttctttatctctttagtcattagcctccttatgtataacataatgaaaacacatccacttctttttttttttttttttgaggcagggtcttgctctgctgcccaggctagagtgctgtggcataatcacaacttactgtagccttgaacttctatgctccagtgatcctcctgccccagcttccagagtacctaggactacaggcgcacaccaccacacctggctaattatttttatttttgtagatacggggtctcactatgttgtccacgctggtcctgaactcccggcctcatgtgatcctcccaccttggctcccagtgttatgattacaggcgtaagctgccacgcctggcccacacctacttctaatatgtacccttttcaagtataacttgttgaatactaaaatcaatggcagtgcaaatatttaactctcttctaaatcacatctgccaagttatcaaaaccatagttctccacctccaggcacactcacctgaaagatggaggaacaagctcaggaggtaaagtcagtggtaatggctgtccagctttggccatgtcagtaaggtgcattgcaagaataaactcttctgcttttagctgtccatcaccatcaacgtcagccagagtcctaaagaaaatgttaaaattcacaacttaataaagtctatttggagtaaaatattgccttaaaagttcaatttttattttacttttatttatttatttatttatttatttatttgagatggagtctagctctgtcgctcaacctggagtgcagtggcgcgatctcagctcactgcaagctccgcctcccgggttcacgccattctcctgcctcagtctcccgagtagctgggactacaggcgcccgccaccacgcctggctaattttttgtatttttagtagagacggggtttcaccgtgttagccaggatggtctcgatctcctgacctcgtgatccgcccgcctcagcctcccaaagtgctgagattacaggcgtgagccacctgggcccggccaattttttatttttaaaagaaggataatgatggtaaaactgctgggtacacttattttagtgaaatgtaaatacgtacatttacgtaactcactattgaatgtaagtatgtaagtatgtacttcaatagtgaattaattttttaccgttgattttcaagacataaaagagagggaagaaactttgaaacagaaagagaagtaactaccccttctgagaaagtggcttgtcttactccatggttaattcacctaccaaatcacatttacctatattaaaaacaagatattctctgattctccatagaagggattagatgaaagaaaacaacagtttttctagtaaaatatagtcatgaactgcataatgacatatcagtcaacaatggactgcatttataatggtggtcccataagattataatggagctgaaaaattcctaccacctaaggacactgtagctgtcataaagcaacgcattacctatgtgtctgtggtgatgctagtctgaacaaacatactgcactgccagctgtagaaaagtacagcatatacaattatctacagtacatacactcaataacaataaacatctgttaatatattactggattatgtatttactatactttatttttattgttattttagagtatactccttctacttacagaaaaaaaaaagttaactgtaagacagcctcaggcaggtcagtcaggagaaattccagaaggcattgttatcataggagacaatggctccatgcgtgttattgccccgaacaccttccagtgagacaagatgtggaggtagaagatagtgatactgatgatcttgaccctctacaggcctaagctaatgggtgtctttgtgtctcagtttttaccgaaagtttaaatagtaaaaataaattttaaaaacaagaaagagcttaaagaataggatataaatatctttctgtacaatgtgtttgtgttttaagctaagtgttattacaagagtcaaaaagttttaaaaaattaaaaggtttacaaagttaaaaagttattgtatgccaagattaatctattgttgaagaaaatattttttgtaaatttggtgtagcttaagggtacaacaacattctgcacaattacatttgcctccaagcttaatactaactttcaaatggctgcttttatagagcatctctgagtcacaaacttttacagaaacagtatctttcttgtaataggggagagagagtttaattaattaatgcatagttaaattaatcaaatgtaattaagggacaaacttaccaaatagtagccagctgagtttgagaaagatttgactgaagaagggcatttctagcttgaaaacctgattaagtggggaaaatcataaaggaattctttagcatctttaaagttatgcataacaaattagctgtatctgtaaaataacaatgctaccagggtatcctgggaacttttaacatcaaaatgtttttaccacgtgctaggtgctaagcattcagtagcaattaaacccagtcactgccccaaggaattttaaatctagaattagcagtatcaagtgctgtcccctgtcttttcagcaagataataatacacacaagtggctaacgtgaaagaacaagatatcaggcacacagagtatcagaggccaagactgtgggccctcttgtactcccagcaggtgcagcacttcccactcctacgtgactgagccgtgagtagcagaagagtcaggcgctactctgggttcagcctgagtcaaggcctgtccaaaacaactcttacacaagagattacatctgccaacactgcctcagcaacagctccaactacaacaaaagccagccaaatgcagctagatttattgtcccactaggctttcaacataggacttgataatcaaagcaaccatgtattacaacatgcagctaaatgtttatattttataacttttaaaatattttcattctatttttttaatctggacatttaacataaatcacataaaaacactggaaattaaactcacagcctcgccctattaattactcctcagatttcacttaggaaatttgatttgaggaggtctttgtgttaaaaggaagattcttctaaataagagagatggaaggctatttcaaacctgaaaaaaagttcaaaactactatttcagcttttggaccgaaaaaagatccttttggactgaaagaagatcccttagcatcaggcaatagagcaaacagaagagagaaggaggaggaatgtaaatggttaaaaatcatactcgtggagggctttatatgtgtgaggcaaagtctgagtaatacaaagggccatagagagccaacagagtatcttacttactaagtaaaactcatttgaacatgtatgtacactcttagtcggccaagcctctggatatcctatatcctctgcttagaatgccagaccctcaattctttactttgtagtctatcctctgaaatctggctctaatctcttttcttctgtgaaacattctctcttatatccttggagttagtcactttctcatctatattaatcacagcacttttaaacaagtaaccaaacaccttgattacatgagctcttcattatatgggctcttcaaagatatgaaccatgtcttgcccctgtctgtattcctgtgcctaagagagtgcccagaaagtatgtgattcaggaaacagttacatcaatgacttgatctaaataaatttttaaaaactatgtttagggggaggagaagagaagtaaaaaagggaaaaacagaccagtggacaggcgcggtagctcacgtctgtaatcccagaactttgggagaccaaggcgggcggatcacctgaggttgggagttcgagaccagcctggccaacatggcaaaacctgtctctactaagaaaaattagctgggcgtggtggcgtgtgcctgtaggaggcaggagaatcgctggaacccggggaggcagaggctgcagtgggccaagatcgcaccactgcactccagcctgggcaacagagcaagactctgtctcaaaaaaaaaaaaaaaaaaaaaaaaaggatcaccaactcctacacttattgaacaaaacaaacatataagtccaggttagcctcatcctcatgttcttggggctcatgctcagcttaaggacaccagcagcaactactctttttatagaaaaccttgtctttacctacagatatatagctttacccttgtaggtctcagaataataatgacattccctaaaaaacaccataatacacaaccttcgtacaatgtgacatatactaatgaagtaacattagggatcacttccccacagttggctccccattcactgcccttcatattccaatgcaaaatcacctctgtttatactgttatagttacagtacttatacaaagcgtactactcttaagtgtgctgcctaataattttttcttttttgagacgtagtctagttctgtcacccaggctggagtgcagtggcatgatctcagctcactgcaacctctgcctcccaggcacaaataattctgttgcctcagactccagagtagctaggattacaggcgtccaccaccacgcctggttaatttttatatttttagtagcgatggggtttcaccatgttgaccaggctggtctcaaactcctgacctcaagtgatccgcccgcctcagcctcccaaaatgttggaattacaggtgtgagccactgcacccggcctgcctaatgaatttttacacaggtatgcacatacacacctgtatcaagatgcagaatgtttccagcaactcagaaggtttgcacatggccccttccccacacagtaaccacattattctgatttctatcaccattaattaggtttcctgttcttcagcctcatataaatgggttaaatggtatggtccttttgggctgctttcattcaataccatacctgtgaaagtcattcatgttgttgcaggtatcagcagttcatttggttttatcgctttaaagtattctgttatgtaaatatactgtcatttatctattctcctgtcgatgaacatttaggttgtgaacatttttgtaaatgtctttttcatcaacttttgttcagttgaaaacaaataacttctttttattagagagatggggtctcactatgttgcccaggctggactcttgggctcaagcaatcctcttgccacatcctcccaagtagttgggactataggcacatgccgctatgcctagcaaagataaactttttttttttttttgagacagagtctcgttctgttgccaggctggagtgcactggcgcaatctcggctcactgcaacctccgcctcctaggttcaagcaattctcctgcctcagcctccagagtagctgggactacaggtgtgcaccaccatgcccagctaatttttgtatttttagtagagacggggtttcaccatgttggccaggatggtctcgatctcttgacctcatgatctgtctgccccagcctcccaaagtgctgggattacaggcgtgagccaccgcacctggccaaaattaactttttaaatgcaaaatgtagggtacaaagaagttaattttttcaaagaataggaattatgactttatattaatctccagtatggttcaataccatatttcacagaatctaaaattccactggctataagacatactattattttatgaataagaaagaaagcactgctaataaaactatgacacagtgctaagacatcactaattgtagcacacatcctaattttagagacattaaaatgtaaaaaaaaaaaagtgtcaaaaaagcataccttgtttcatgcaatttgataaaattacagaaaatcttagttatgtaatatgaaatacatgtaaaaatacaaagtatatatgtaagctaagaagtataataggtcacccgtgaacctaccacccatcttaagaactagattactactaaatgccttgaatctatccgtgttccttgacttatccccatgcttccacaagaggtaaccactatcctgaattttgtatgcataattcccttgctttaaaaaatagttatcacataggtatgtatctttaaataaaatactgtatatttttgcttgtccaatcgattccaaaagtcttactgctcgttcccttgcctctctgcataactacagaccctggactcctatttcacagactacttttcattctccaaataggccatgtattttttgctcttaatttctcctttgtcaccatcaaatgcccccacgttcaatctctgtcgaaatcctaactttttcatggagcttaaatgctcccttcctaaaagatacctcatctgaactcttcagcttcaatatatctcattctatgttccttagcacttaaagctctattatttttaaacacttattttactcggtcctaaatcataatttcttgctgagtgaagagggagtgggaaagttagaaggtgggaactctacttgcctattaccctctgtttatgtctcctttgctgttctcaattagtacagttcagatgatgttctggcctggactcaaatgttttacagtgaactaaggccaagttttacagtcacatttgggttagagcattaaagggtgagcaatgctcacttgaggttatataaacagagaaaaagcccaatgcagaggaggattctcaggaaaagtgagctgaggctaagttccacacactctctcttgtgacccgtggctctccattcactgcaaagcttagaggatgaggtctgatcttaagggacaggtcttttgccaaaaagttgggggtatatctggtgcccgacttgacagtaagaactttgaagaaagcaatcaagttgaatccatctttgaatccttatacaacttcaggtatttgtatttatcaaatgcctgctaaattttttggatgttaaaatgtcagatgagctacacaatacaaattcaaatgacagttcttcagtggaagtccacataaaagaccctttttcatgctcttcagcactgtatgctgcttacctgagagatatccactcatacttttgtcaagagtattaaatttttgccgatattttaatcttgtaggctgaggaactgcccactctgaggtcccagtcttgggtgagttccctgagagtgaagcagtcgaggaagttgagctataaaaaaatttatttaaaatttttatgttactaaataaaatatatttaattaaattttataagaccaaggcattaagaatcttatataccaggggtcctgaacccccgggccaccgacctgttaggaaccgggctggacagcggggctcggtgagtggcaggtgagtgagcactactacctgagctccagctcctgtccagtgagcagtggcattagattctcataagagtgcaaaccctattgtgaatggcacatgtgagggacctaggttggatgctccctttgagaatctaatgcctgatgatctgagatgtaacagtttcatcctaaaaccattgcttcaagtctgtgaaaaaactgtcttctatgaaaccagtccctggtaccaaaaaggttgaggatcgctgttacatactataatggtgactgccttttctctttttctggggaggagacagagtctcgctctgttgccagcctggagtgcagtggcacaatcctggatcactgcaacctccacctcccgggttcaagcaattctcctgcctcagcctctcaagtagctgggactacagtcacatgccaccacgcccggctaatttttttgtgcgcatttttagtagagacagggtttcaccatgttgccccaggctggtctcgaactcctgagctcaggcaatccgcccacctcagcctcccaaagtgctgggattacaggcgtgagccactgtgcctggccaatggtgactgcttttgcattttacatttttttaaattttaagcaattatcactattcttagtaaagcaaagaccataagaagtatagaactccatgagactaccgcatataaagaacctgctctgtgccagaccttatattgtactaaggcctttacaaatatttctaatcctcccaacaaacttaaaaaatactacagtccccatcttttagatgggtaaactatggctcagcgatgttaagaaaaaacaaggccacagaatcagtgagtgttcaagctaggatatgaatgttgttcttctgggtcaaatctaacactctccgtacactaccctgaagagtataatagtgatttatatgaagggtgattaatgtaatgaatactgatgcatttgtgctttgtaaaatttaaaagatatccaattagtagaatctgctcaagaaagaaattaacaatgtacaatgagtatgagacatcttgggaaatatacacattttttaaaggaaaagtacacagctttaggcaaagaaaaaattaaaatatagaatatttttagtttacatgaattattttttcaaaagtaaaatgccacagacacttaataattctaaaaataaaaaatttattttatgtgagttgtaagtagtaaatttaccttaagtatttgtacttggccattataaagtaaaacttaggtaagctcaaagctttaaaaaaatcatttgttaaataaagacttcttactgaaagcataaaaagttgtcagagttagctattcatacctactagatcctaaatcaatcagagactgcgctttctgtatactagcacctccaaatcctcccatcatcagactataagatgacccatgaggcaatgctaaaaaagaaaaagaaggaaaagtatgaaagaaatttgtatctgttcaaacacaaatagtttctttctttacatgaaataatgactctttagaaacaaagtactcacttgaagaagaataaggaatgggtaaaggctgaatgagactggcggttccatttggtaatgatgatgtgctaacagaaggcactaggggagtgggcatcattaagggaggaaggttggtccctgaagtcgcagaagacaatgatgttataggtgcagctggaggcaatggctgaggaatggacagattgggcatgcttcccattcctaaagtcaaaagaaaacattttttccagtgctagaaaatcaattataaaacacatgcaaaaaacaagtttacagtacagtgggcagactctatgtttaccaaaacacacagatgaattatccttaaaaaactcactactttgacccagcagtgagggaggtaaactgctgctcttaatactaatactctgatctgtatgaactaagaaaacacctagcaaagagttaaatattctcctctctcatcatgaataaaactaagcagccttttccaattgaatatgagtctcctcaaggaaagaatacattaccagatcaaatgaggtttttgtgaaaggataatacagtgctactaagttacttgactaatacacacacacacacacacacacacattcttcttctctctctctctcacatactccccccaaacaaaaaggttctaagtagtagatactttatgagatccatttatgcatatgcattatttgcaagaaagtgtgtcacatattttacttttcttgtaagtaacattcctatgaattcaaggacgagttcttaaaaggaacaaagtgatgacttttattcatttattaactgcagaatacttataaatatggtcacacaatgatttagtatttatctttagaattcactaaaatagtgaaataattttgtggagtctgttgtttgtttgagatgggggtctcactatgttgccccgactagaatgaagtggctattcacaggtgcgatcatagcacagtacaacctcaaactcctggactcaagcaatcctacccatagcctcccaagcagccagaactacaggcacacacccctataaccagctctagaattctatattctaagatctgtagtgaaggaacatgtttcagatacatagacatacctaattgaatgttccattcaaaatgagtgcttctcacatataattataagaaattgcctgatcaaaattaacagaaaacataccaaccggttatcgctgatgaatacgtgaacttattagcccaaagtctgcaacttttggccctaaatttagctggctaattaacctttaaaaaaattcaacttacataaaattttaaattatctcccaaatcgaaccatttcaagtgagtttaaaactgctcaaaattttttctgtattactcacatatatatagagagagaggaaactaagaatagtatttgggattggctatacctagggagaccatataattcatcacgcaactaggagttgtaaaaggagacactaactggaccagatgccaggacaaaaggcataaatcagaactgtccctagaaaaccagaacacatggatcccctacctgtgacagtgaatttaatatttattatctctaacatgaaaattaacttggaatctggggactgtcattttgtgctaacaaatccttttctaatactcaaatatgcctagggataaagtttaagtagcaaatacaggtatttaaattaatacatacttaccaaaacgagcagaaattaatggagaaaacatagggggttgcttcataataggagggagaaccacaggcaactgttggccttgaagcttcagtttgatgagtttcatagctatggagaactcttgctgatccatcttcccatccttgtttaggtctgataaagccctaaaaggagcatgaggtaggtagattgctatgtggtgtggtggtgggaaaactaacgttattttggggattgacaaagtaaaaatgatgatatggcattcacgtgtacatcatcactaaatttaaaatatctaacatgtaaaatatataataacaaaaagataaaacctacactttaagaaatactgaccagagataataactaataaaacactgcctgtcaaaacagaatctagagacctttgggctgaattccaccagtttaggtagaaaaaaattcaagattataatacttctaaatttaatttattcatctgtccaaatatttactgaatacttgctatgtgcctcgtactctaccaggcatgagaatattccaagtggaaagatgggacaggggttgttacttattgtaaacgtttttaaaaaaacagatattatagagaatagtttctttaaagaaggagcaggggaagcgaggactaatttggggtttatagattatgaaataaatgaaactacaaaataacagaaagaggattttgagattctgccaaattataaggaaatttttctcaatgataatgtatatatctttccttagaaaattctaatgaaattagaaatttgtcctagagaactaaacctgaattattttcaataatttgctcaataaaatttattttccaaaaaactgaagaaataccttttttttttttttttttctaaagagagtctcattctgtcatccaggctagggtgcagtgacacaatcatagttcactgcagcactgaattcctgggctcaagcaatccttccatcttggcctccctgagtagctgggactagaggtgtggccaccacacccagctaattttttttttaattttctgtagagacagggttctcactatgttgcccagcctggcctcaagcaatcctcctacctcagactcccaaagtgctggcagaaatattcttaataaccaatagaatgcaactaaaaacaattttatgttaacactatattacaaaaaaacaaaatactatcagaaaattaggttcatctacaaaacactttaccatatttcagctaaaacaggggccggcagacctgattgtaggaaaaaattacgtgcttgatcacctggaggtaataaaaacaaaacccaagcagcacattagtaaatgaaattattccaatgcttctgaataataatgggtatatgttaatgatttattataattttaataccaatcattaaagaataagtgaaatagaaacacataaaaattatttacataactttaataagacagatattttaaaacaaaagtcacatctgcacttctattgtatattaatcagtgatgaaagatgattcatctcagtttttccacaattggggtcttccttaaaaatacttccacttagtaaaatttatatttaaaaacactattccctaaaagagtttcaatataaaaagtaccaggtgttaggagagagagtcctccatgagtttcttcacactcctatgtgtcttgctctgtataccaataatgtaagaccctaattgctctctgcctgggtcacttctcagaattgggtttgtaatgagcaatcttaacgaatccggtaacgtttcccactgagacaagggacaaacttgctttactgcttgctacaaaagggtgggttccccaaattcagtgttcctctcctgtaacacaatcatagcatgtgtactattctcctgggctctctgcattgtctctgtgggacttagggaacactaaaggaaacagaaagatagatgccaatgctcattttgctagttatgctgttagtcataaggttctttgtctctgactcaggaatcttgggtcttccacccgtaatggacaaagttattaacctgtaagcagggtaatcaaatcctgataccaggtaaggtaattactatcatagcagtacaaataacatggttaagtagatggattccaaaatcagcccaaatggtttcaaagcccagattaacactaaccatctttgtaaccttaggcagttacataacgtctcttagtctcagtttcactatttgtaaatatagacaacaacagtgcctactttacagggttgttgtaaaggttaaataaaataatgcacttagcatagcatctggtatatagtaaaaattcaataaatatcattgttctcatagttactattattgtatgtaaagcactaagctactttggcacagaaaaaagtttaattaatagaaaaaaatttcaaaggcacacctaaattaatcccattttggctctggtggtctttctgcaaaacaagggctagcatcaacaatcagtgcttggtgtagcctcaaagacagagggctagcattaggaaaacagattccagaaaaaaaaagtctagattttccatgaaatgaatctaagaaataaactgaaaactttctagatataatgttaaaatgtgaaaccagacaattacacagaaattcttgactatcatttaggattcaggaaaaatcttccatatcccaaatttaaaacaacaaattaagacagttccaggaaaaataaagttagcatttctttaatttctagaattctgattgatatgaattttatcgtttattaacacaaatttgatggcagtcaaattaaaactaattcttagatatcacataaggaccataattcactaataaaactaattataaatacaaacctgttatgtaacctcctgaaggtttgaggttatcaaactgcctgtcatgcttagtacgttcttcagaggtaatagcccacatgtttggccctcctgaaacataagtggaagaaactatagtgtatacatgagaatgcttaaaatacaattctaaaatgtaaatagaaatcacaagtgttcattgtatgacagtatttaatatttgagtgacacaaagagtagagctctatcataaccatacatagcacagccctaaggcttttcactcattggctcaattaacgtctattgaacaagtgctatatcacactcactggaaatgggcatcaagctaaatactggcaataaaaagatgaagaaaatattcccaccctcaaggaattcatgctctagaaaacaacagtacttacagtattcacctgtgaaaaatcctaagcagaactatatactgccatagtttagccctgtgtccccaccagaacctcatttcgaactgtaatccccacgtgtcagaggaggggcctggtgggagatgactggatcatgggagttgatttctcccttgttgtttttgtgataatgagtgagttcctcacaatagctgatggttttaaagtgtggcacttccccccttgctgcttctctctctcctgctgccacgttaagatgtgctttgcatccccttcgccttacaccttaagtttcctgaggcctctccagccatgtggaactgtgagtcaattaaaccctttttttcataaattactcagtctcagctagttctttatagcagtgtgaaaacagactaatacagataccaaaacagctgtgccaattctgagttagaagcaccaaggatgagataacaggaaaggtaacactgaggcagagccttgaagcttggtttgaattttgccacgtgaagaggagggataagaacatttcacaccataagggcacagcatgagaagtcaaggcatgtgcaaggtgctgttaagtgcactgagcagactaataactagagttagtaataataaacaggtagggtggaattaactgtaaaaaggtcttaaataccatcctcaagagcctgaccccataccctggaagttatagagagccatctagtagtttttattattttattatttatttatttatttattttgagacaaagtcttgctctgtcaccaggctggagagcagcagagtgatctcggctcactgcagcctccgcctcctgggttcaagcaattctcctgcctcagcctcccaagtagctgggactacaggcatgcgccaccacacacccggctaatttttgtattattagtagagacagggtttcaccatgttggccaggatggtcttgatctcctgacctcatgatccacccacctcggcctcccaaagtgctgggattacaggcgtaagccaccacgcccagacagtttttaaataagcttttaatttggaataattttagatttacagaaaattcacaaagatagtacatggctcctatatacctttcacccaatttctactatgttaacaactgacacaaccatagtacatttgtcaaaacaaagacattaacagtctggtatataactactggctaaattaatacctccacctgcagtggtggctggtaaactccaacagaattaaactctgggtagtgaagacagcacaaggcactgtgactgatgattctgcccatcggagcctctagcaaaaggaagtagccttcacctagagataatccttgggatcagaaagcttgacccacgaaggcctagtgattctctagcctgatagtcccattttggggagggtcaacttgaattccacaaggtgggaataacctgaaaagccttgtttgtcaaatagaaatggtatatcaaagaagatatagacactggccccaacagtattttggctttacgttaaaaagtggcagtggccgggcgcggtggctcacgcctgtaatcccagcactttgggaggccgaggcgggcggatcacctgaggtcaggagttcaagaccaacctggtcaacatggcgaaacctcatctctactaaaaatacaaaacaaattagctgggtgtgatggtgggtgcctgtagtcccagctactcaggaggctgaggcaagaggatcatttgaacccgggaggtggaggttgcagtgagctgagatcacgccatagcactccagcctgcgccgacaagggcaagacgcaatctcaaaaaaaaaaaaaaagcggcaactatccctctgagggaaacctttatgcacattccactgcttatagtaaagctactggatcaatgaaggctcagatcagagaagctgcaagttgctggtgttcactgggctgcagtggctattcagcctcagaggcagctatgctgaactgaaaggagacatgggcagaacctggattcttgggctgctgccaatgacccagctgtttggtttgccacttggaaaattacagattgacagattaaagacaccctcctggggctacaaattgaaaacaaatctcaactgctaattgaattgtctgtgtcacctatgtagacacctacagtatgggcccagcctctgatttagactgaaatcaagtatgactaatgtgcagaggataccactgcatgccaaactgtgacttggggatggtgggggaggtctcattgcaggtggcattgttccctttgactcctggcagactgactatattggacctttgttccctctctcaggctatcagtggtgcctcaaactattgacagtatttttttgtttttcacatagactttttagagcagttttaggttcacggcaagattgagcagaaggtacaaacatttctcctataccttccaccccactgacacatagtccctcccattaaaacattcccctgttgacacttttttaggttaccaatcagcccacgatgcccacactgtcatggcccttgaaactaatctgtgtcatgtttcttttttaaaaaatttagagacagggtctcactctgttgcccaggctggagtacagagtgacccttggctcactgcagccttgacatcccaggctcaagtgattctcccacctcagccgcctgagtagctgggactacaggtacgtgcgactacagctggctaatttttgtattttttgtagagacggggtctcactatgctgccaaggctggtctcgaactcctgggctcaagtgatcctcctgccttgacctcccataatctgtgtcatgtttttggttttctggaccatatgcattctgacatggatgcacttttatcataaaagccattcaacaatgcactgacagcctgactctatttccatcacctcctcctggtccacatactttaaagtaagatagtgtggtcactgactgtagctgtctccagaaaggattcattgcttattagctgcttcctccctaatgatcagggctaaagggtggggtatcacaggagatatacagacctattgtgaaaattcaggattctactctgaccactcctggacatgatgcatctttctagcccctaacagcaactgtaggcaggcttggttcataaaccctccagctgggccactgaggtaaaaggggatctagagcaggaattcccaacccccaggccacggactggcactggtctgtggcctgttaggaacctggccgcacagaaggtgagcggtgggcaagtgagcactaccacctgagcggcacctcctgtcagatcagtggcagcattagattctcataggagcacaaaccctattgtgaactgtgtgtgtgagggatctgggttgcatgctccttatgagaatctaatgcctgatgatctgcagtggagcagtttcatcctaaaaccaaccccctcccaccaccctaccacaaatctgtggaaaaattgtcttccatgaaactggtccctggtgccaaaaaggttggggaccagtgatctagaggattcaaagttaattctggttagggtttatgaaaatgtccctcttacatctaactcttctggatcactaggaaatggtaaagttatggctctgaaatgagaaacccaggtttaatggcagtagagcaacaagaaggcacctgaggaagaaacgccttagaccccaggaggtatggtattaagagaggaattaatgatattttctcttgtagaactgcccctgtagccttcttctgcaagaaaaatgccttggtatggctctcctaaattgttggaagcaccttatgagtctgccatcccccatcaggagccttatcaagagtctatcaggaacatcaggaatgaccccagaaaatgtatctcctgtccatatcacttccagaggtcttcccccacccccaatctcagtaatggatgaattccacccagctggtggcgaggacaaacaaaacaagtgggactaatttgggcaatccctccaaaaacaaggactagactcaattactcaaactccactggaaaccctcagacttgccagtcatccaggaggctatgttagaggcactatcaacctgtgcccctcttctgatgtaggtcccacggcagtaggggttgcagggggaataactgtaaacattttctttccaagcataacccatgcacacccttgatcttctacttcttctgtggaaaccatgcattaacttgcctccctccaaaaacacagtaatgtacatgaagagatcttcaagtgtttaaaaaaacacttcctcagtcctggaaggcattcaggtcagcctcaactcactggctagggttgtcagagatttatcctagattttctttttttgcaggctaagataaagtgtgtgcaattatgaatacactctgctgtacccagattactgattcaggccaggtagaaaagttaaaataaaacttaaggagaggccggacatggtggtgcacacctaatcccagtattttgggaggctgaggcaggaggatcccttgagctcaggagtttgagaccagcctgggcaacatagtgagaccccatctctacaaaaaaacttaaaaaaattagccaggctgggcgcggtggctcacgcctgtaatcccagcactttgggaggccgaggagggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccaggaagcggagcttgcagtgagccgagattgcgccactgcagtccgcagtccggcctgggcgacagagcgagactccgtctcaaaaaaaaaaaaaaaaaaaaaaaaaaaaaaaaaaaaaaaattagccagtggtggtggctcacacctgtaatcccagctacttgggaggctgaggtagaaggattgcttgagcccaggagatcaaggctgcagggagcactgatcacaccactgtctgggttacagaacaagaccctgtctcaacaaaaaacaaacaacaacaacaaccaccaaaaaaaaaaaaaacaaaaaaacattgttttttaaggagaaagccacctggctttctaagggagacactgatgatttataggatttgtttagctgggaccctgcagagcacagctgagaacactgcaagctgagaccaacctgctgcttggagtcctgttgattagtcttaatcaaatgctgcataaaataaatcagacttagtcccagcccgttttgtcagattaatcggagtggccaacttagtggtatgtacactcatgagaaaatttgctagaagtcaagacaatggagaaacaagggagaggaacccttgggagacaattctccatgagtttctcatgtttctgtacatcttctaaagcaaaggattgatagcttttgttccagactatctctgaggatgtctgcattgcaaatacaggggtttcttcccgagcttgggattagctttttgttgtccgccagctctctgaggtttttgtaaagctctgcacattcaacatgactaatcaccatctatacttctgactacctttacaatttattccatttctgccaataaggaatcaaatacgtttaggtatataaactcatacataattcctgcttgtattgtataaaaatctgccttacaaagacaattttccaggaacgtatatcattgaaaagtaggtgctcactgtaatttttaacactaatatggatttaacaaattattcttagtcctaaatgactggattaaaaaatctataaatatcctctcttaaagagaagttttaagattatagttaaaaataaagaaacagatgtactgaagaactaaggacctaaaatagctaaacctacacactttctaaataaagaaataccacatatgtagtaaaaatcctacttgggttatcagtttatcagaaaataaataaataaacctgtcaggattcctgtcactaggaaggcaagtagtatagccacagaactgattttctattatatgacttcagaaaaattatgatgctgattttaaaaacaacaaaaatgacaacaacaaaggatgacaaagatggaagcagctcacctttattgaaccctgactattgtcagggactttatatgcagcaactcactgagcccccagcattaacctataaattaaagtactattattattctcattttataggtaaggaaactgaaaacccatggtaataaagtaacttgctcaaggtcatacagtaagtgacagagctgagattagaacctgggtagcctgactccaaagcctccatattgaactcagcactaactatgtaccaacatatatgggtaagatgctcatgttccttctaattcagatgccacctctataaactaggaatattatataactccacaggcctgttgtaaagattacatgtaatatacctccattatagctaacacttaatgaaactcaccctgtgtcaggtacttttctaagagctttacatgtattgcttcaagtaagtctcataagaatcccatgaggtaactattgctatcactgtttatcagagaaggaaacagtggtacagagatattaaataatttgcccaaggtaataaaattggtaagtgttgaaggcaagactagcgtctactcaggcttaattaagagtcttaaactatctgtcttgttggtaattaaacataaatacactcacaaatatattgtccattgatttccaacaacatgtggagataattcaaggtggaaaacagtcctttcatcaaatggtgctgaaagaactggatatccatatgaaaaaacaacaaaagaacctcaaccttccagcatatacatgaattaactctcaatgaatcacagaactagatataagataaaacttcctgaagaaaatatggaagaaaatgtttgtgattttggattatgcaatgactttttggaacacaaaaggcaaaaatcattaaaatattttgacaaactggactttataaaaatctaaaatttccactctcttaaaggacactcttaagaaaaggaaaagacaaactacaggctgagagaaaacatttgcaaaacatattcaataaatataggtcagcatatatacagaactattcaactcaaaaattagaaaataatcccccccctcaaaaaaaaggaacaaaagatttgaacagacacatcaaagatatacagatggcaaataagcacgtgacaagatgctcaatatcactatcatcagggaaatgtaaattaaaatcacaaaaaggtatcactgcatgtctattagcatgtctgaaaattaaaaaaaaaaacaacacggagtgctgataaagatgccaaacaaccgcaactcatatatgctggtgggaaagcaaatgtgacagtcactttggaaaacagtttgggaatttcttatgaagttaaatatatatttccacatgacccaacaatagactgagtattaacaaaagactcttgggtaaatacccaagagaaacgaagacctatttccacataaaaacctgttctctgatggttatagcagatttagtcataatcactaaaacctggaaataacccaaatgttctgcacctgaacggctgaatggataaataaattgtggtacacatttatacaatggactactattcagcagtaaacaggagaaatgcatgcaacattatgactgaatcacaaagatattttgctaagtcacagaagccagacaccaaaggctacatattgtgtattccatttatatgacattctggaaaaggcagaactgtaaggacagaaatctgattagtggttgccaataatacatggctaaaggtggaggtataagggtacagagaactttttaggtgatgcaaatgttttatatcctaatttatatgactatatatagttttagaaactcatcgaaccgtatactttaaaagggtgaattatacccccaataaacccaactttaaaataaactaaaacaaaaatataaagcatctaatacatgcctgccatattaggagtcctcaataaattagtttccttattcaacccaatcccagggaacaatataattaaaaagaagtcagagcattcaaatctttctcagggaatagcctgaaactaaggctctttagttagaaaccttaagactattttaagtctgaagagtttggttaagaaggcttaaaagctgctcggccaggcatggtggctcacacctgtaatcccagcactttgggaggccaaggcgggtggatcacgaggtcaggagatggagaccatcctggctaacgtggtgaaaccccatctctactaaaaatacaaaaacttagctaggcgtggtggtgagcgcctgtagtcccagctactcgggaggctgaggcaggagaacggcgtgaacccagtaggcggagcttgcagtgagcagagatcatgccactgcactccagcctgggagacagagcgagactccgtctcaaaaaaattaaattaaattaaattaaattaaattttttttaaaaagctgctctaacatacatgggtatatatacccccgggcagtgatggactctactgctatcctaagacaaaagagagttctgctgcatcaagattgatgcaccaatgctcatcacagtatgatgctttcttatatatattactatctcctgacatttccttggctatgtgttttcacaggggctaaactcaacccatctgtttgtttactgcttagttcctcatgtctccaatcagtaatcttgacaccttcatattcattcattcagtaaatgtttatggggtacaaagatgaataaaatgaaccacttgcctgggcacagcccagcacttcagaaggctagggcaggaggatcacttgagcccaggagttgagaccagcctggtcaacatagtgagacccctatctctaaaaaaaaaattcttttaagtagctggtcttggtggcacatgtctgtagtcccagttactctggaggctgaggcagaaggaattgcttgagcctggaggttgagattgcagtgagcaatgttcatgccactgtactccaggctgggttgacagagtaagaccctgtctcaaaaaaaaaaaaaaaaaaaaaaaaaatgaacaccttaaaagaactcacagactctaatattttaaagagactctaccagccaagaaaatcacacacaacaatcacggttacatattatcatgattaatgtaaccaagagaataaaaatgttctaaggcattttaacaaggaataatttttaagtagtgttcaaataaccttttaaaaaattaatcatattaaaacataaagtattaatgcaccaagaattttctaggaacaaaaagataacactggtcaggtgtgatggctcatgcctgtaatccaagcactttgggaggctaaggtggaggacttcttgagcccaagagttcaagaccagcttggacaagatagtgagacccccatgtctacaaaaaatctaaaaattagctgggtgtggtggctcacacctgtggtcccagctactcaggaagcagaggcaggaggattgcttgaatctagcaagtcgaggctgcagtgagctgtgttcataccactacactccaacctgggcaacagagtggagaccctgtctcaaaaaacaaaacactgcaataagaaaactgggcaatacgtgtaattcaaagccaattttaaaatagttaattcagtcctggctttcttatttaaatatatcaactaacagaaccctttgaaaaggcaaaagtttgttactttgaacttcaagtaaaaatctcccaatcttagtctatatttatctgtaagccttatcgaagaggcagaaaaatctaagtttaggggttgatgtctaatatttccctaaaaagctaacaaacttttacaatatgtaataatcgtgttagaaatacattaaaattctatccgcttcccctaactcatcactgatattgaaaatatgggattttcataaacatttctgttgcttattctcatctcacttgctggctctttcaaacaagttcttatagtcagtgaagaaaaaaattttcacatttacagaacatctactataggctagatctcattcagtaagtagtctcatctcggtttttacacacacacgtatatacatacacacacacacatacacacacacatacacattcacacacaggcatacttacagacaagtcccaatagcaatgggcatcaaaacaatttaacaatctatgtcaggattactagaggagcaaagttttgtactatacatgaatgctgctctcagtaacatcttaaaccctgaattgaacttaaattagatatgtctaagttatcgtcaatcttctaagtaggaaggtaccacagtctacatatgcaattaattcttcagaagtttaaaaaaaattactatctgtatgcctatatagcacttctaaatgcattttccaacattttagatgattattcacataatcattcttttgttattgaatagtccatttgttctcaatgttatattttatatataatgcaatgaactgcaaagtagatatataaatgtttatggaatggaagaagcagaataaagaaggaccgggactgtactgctttatgttcattttgcttataaaactgattaacatgttggctgaagtttacaattcaactgtttaatgcaaattcctttgtatggggcataaaaatcctcaaacttgagtagagcatgttactactacaatcactgccctaattttaaacttacatgtatcactcattatggaaaaattatttaattattaaaaattgtctgtggcatcaatgtttataatcccacaccattttcccaataggagcaatactcacattaatccttaaataataggttctgaaaaggtaaaacacgaaacaacaaaatctttacttcaagtctatccttaaatgacacatgacctcaccacacagaatttgattttactttttatacaaataattcacttctccaagattttcctaaatcctgagacataaaactttagatatacaacatgtattttcgttattaacaatgtaatgatttggtcctatgtctgaaaacaagtttaaaaaacaactgattaacactagacggtaatatcaaaacagaattgctttgtgaagatggtagaatggtgattcttccctcctttttttaaatgctctttaatattactgttttcaatttaaataataaagaattattgagtttattctctatttcctgatatttatctacaattagctaatacaatttaacataaaattaagaattcagaatctagatttctttagcgatttaaaaatataatgcatgtttttcaattaattataaatgacaaacacagtaacttaatacctactaagggtagttaattagtatttgggaaaagaattaaagctacaatcagaacaaaactttaaaaacttttcattattcaaattacctaagcattttctttttctttttctttttcttttttttttaaatggagtctcactctttcccaggctggagtgtagtggccctatctcggtacactgcaaccaccacctcccgggtagttcaagtgattctcctgcctcaacctcccaagcagctgggattacaggtgcccatgaccacactcggctagtttttgtatttttagtagagattgggtttcaccatgttgaccaggctggtctcgaactcctgacctcaagtgatctccctcctcagcctcacaaagtgctgtaattacaggcatgagccaccacacccggccagcactttcttttaaaatgtttgatattaaacaattatgtatgcaggcatacataatcttatctaaagggaaaacataatcttacataaatattactaaattaatctttattggcttcatcggtttacaatcatgttatgttatcaaaatacctttaatagtcaccttatagcactctgctatttgtcatccagttttatgcatcaaacacaatataccttttggttattcctaactgctcaatggcaaacacacgttccagaatatagtcatgggatttacaacataatattcttacagaagacatatgcagtgttccaaaatattttccaagaatacttcaagttttgtatttatacacttaaggaaaattatctacatgaatattttaaacctctaccaaaaaaaaaaaaaatccataacctcatcttgccacaagcacaaagctgcttaccattcatagctgtgggaaactgagccatcatggtcctgagttttccttgctagctctcagccatctgcaacataaaaatattgtgccgttgataatacaacaagggcaaatcacagtttagtgcacccgctaagcagtaggaatgtctgtccccttcagctcacacttccaacagaaaacaatgcagagcttctgctgctgctgaacaggcagaatttacatttgaggaagggtaagagattttgttgggtaatcgtgctgccttaatacagaaaaacagtcacatatttaatagtagatactgaataaagaaacccttggcatgaaccaacattcttgtagaaattaatttggaagagaaaaaaataaatcaactgtataaattaagtatataagaataacatggaaatccatacttttttttttttttaaatagagtctcactctgtcacccaggctggagtgcagtggtgcaatctcagctcactgcaacctctgcctcctgggttcaagcaattctcataccttggccacctgagtagctgggactacaggaatgctccaccacacctggctaatttttgtgtttttagtagggacagggttttgccatgttgaccagaatggtctcaaattcctggcctcaagtgacctgcccacgtcagcctcccaaagtgctgagattacaggcgttagccactgcacccagcccatagtatcattttttaaaaactcccaaacaagaaaaatattcaaaataaatgtagcgcagctgtttaaatgagctcaaggggtttataaaatagtctaaaagtaattattaaaacacacaaaattattaaaatacatatataacataactaaatgtgctgggcaagcactctaagagaagggactttggaaattcacagctctgggttcaaacccagctctgctattctcccagctgtgaccatggaaaagttatttaaccttttttgagactcagattactcatctataaaaaatactttgcagaagtattttttaaagtgttaaacataatccagtaaactgcctgccacatagggtgttcaacaaatggctgctattttgcaaacaaccagaaaaggagagtgcagtatcattttgaaccctgaattcattattcagctgtcaataaattcaaaaattgttccatgaatctttttgtgggtctgtttttttttttgtttgttttgttttcttgagacggagtctcgctctgtcgcccaggctggagtgcagtggcgcagtcttggctcactgcaacctcacctcccgggttcaagcgattctccagcctcagcctcctgagtagctgggtctacaggcgcacatcaccatgcccggctaatttttgtttgtttgtttgtttgttttagtagagacgaggttttaccatgttggccaggctagtcttgaactcctgagctcaagtgatttgcttccctcagccacccaaagtgctgggattacaggccactgtgtcctgcccgttccatgaattttgagagtaggaccagttaggaagtgaaggcctagcaaatttatagcaatgcacttagtaattaaaaccatggatcataatattgcaggaaaacactactatattaaaagatcatgccgtatctcatctatttacccaaatcatttaaatattaatatttttagaagcctaagaaaaatatttgcacagccattttaaacaaagaaggcattaagtagtacatacatcgtggtcaacgtttctcaccattttatagctagcttaaaaaatgaacacagaaggaagtcccatcaatcaagttatgactgcaacttcctcaaatacagaaatactgcaaacaaatataacatttttacttcttcaattttaaatcataagtaatgttaacccaaaataagctacatggctaaaaacaaactatctacttaacagatatgcagtagcaagggcccttattcattagttttctgtggctgagaccattttaaaacatgggagaaaacccactattgcaaataatgcattttctaactctgcataatagcatgtgaattataaagatggctctaacaacagaaaaaccaacgaggaatgggatcccatggacacaaggccttaatcagttgggatctaggtctaaaacttacaaatcatctgtctagaaccatttgttcgtcatcacgtattctgtgaatacaaaagaatgccaaatagagagcaacgtgaagaagaagacgcgagaacgaaccccggactgaccaaagcctgcatgccactgcatcctgtgccaagtgcttacctcctgccaccgttgccaccaccatgcccaagagaaagggtgaaggggatgctaaaggagataaagccaaggtgaagaacgaaccacagagaagacccatgaggttgtctgctaaacctgctcctccaacgccagagcccaagcctgaaaaggcccctgcaaagaagggagagaaggtacccaaagggaaaaagggaaaagcttatgctggcaaggaggggaataaccttgcagaaaatggagatgctaaaacagacggggcacagaaagctgaaagtgctggagatgccaagtgaagtgtgtgtattttttataactgtgtacttctggtgacagtagtttgaaatactattttttatcaagttttataaaaaatgcagaatttcattttacttttttttttttttagatgaattctcgctctatcgcccaggctggagtgcagtggcgtgatcttggctcactgcaacctccacctcgtgggttcacgcgattctcctgcctcagcctcctgagtagctgggattacaggcaggcgccaccacacctggctaatttttgtatttttagcagagatggcgtttcaccatgttggtcaggcttgtctcgaactcctgacctcaggtgatccacctgcctcagcctcccaaagtgctgagattataggcatgagccactgcacccggccacttttttttttttttttttttaaggcagagtttcgctcttgttgctcaagctggaatgcaatggcgcgatcttggctgactgcaacctccgcctcccaggttcaagcaattctcctgcctcagcttcccaagtagctgggattacagttgcgcatcatcacgcccggctaattttttgtatttttagtagaaatggggtttcactatgttagccaggctggtcttgaactcctgacctcaggtgatccacctgcctcagcctcccaaagtgctgggattacaggcatgagccactgtgcccagcctactttttttttttttaagctatgttgttagcacacagaacacttcattgttgtttttgggggaagggccatatgtcactaatagaatgtctccgaagctggactaatgtggaggaaacacctttcccttctagttttgagagagttcctcttggctcccaggaggagggattccctgactttaacacacatggccaccttggcacaaaagccttgtggtatggaaaacaaatttgtttttatgtcctcttctccctttccgtccttcagcagagacttaactcccttaaacccagacatctgttgagacctgaccccccaatcattagttaccagtgtgtcaggcaatctggactttccagtgatgccactgagacggcacctgtcaaaagagcagtggttcttcagataaattctgccattttcatttcacttcctgaaagtcagggtcggctgggaaaagttgttaaacaatatgctaaatgtgaaatgtcaaccctcactctaaactttccctgttcacagcatcagatgaagacttcattgggttttagagtggctttcaagaagggagtttgaaagttgttgtggccaggcgcagtggttcatgcctgtaatcccagcactttgggaggccaaggcaggcagatcacctgaagtcaggagttcaagaccagcctgaccaacatggtgaaaccccatctctactaaaaatacaaaattagccaggcgtggggcacatgcctgtaatcccagctacttgggtggctgcggcaggagaatcgcttgaacccaggaggtggaggttgcagtgagccaagatcaggccattgcactccagcatgggcaacaagggcaaaactccgtctcaaaaaaaaaggaaaattgttgtatactcaatgattgtctgcccatgtcctgcctgaaataccatgattgtttacggaaagtatctttaataaagctggatacagtttggcttgggaaaaaaaaaaagaatgccaaatagtagatgctcagtaatcacaggcataattctgaaataaaacctgagaatgaactaaatattaataatattactggcaataagggcaaatcccttgggtaaagctgaaggtactagtattacagaatctttatcatctggtatgtggaatttagccacccatgcacataggtaccatattatatgtaacatttatattgtatgtaacatctgattaactgtggtaacatctaaatatgggagtatattttgttggaaccaataagcttttaaaacatatcatttcatatctattacatttctattctctctgccccactgtggaataattacctaatgcttaacaattctactagtctatttgcagagtagtacttaacaattataattgaaattttgaaaatgcaacagataccaaaaactttgttttacatttttcaaaaagcaattaataaattaacatttactgtttaccattaattcaatacacttctgttgatcacagtagatgtactgtgtcatgctgagtattcattgagaatccaatgtttcaggttctgcagaaggagcttcagacactgacaagcttgtagacttatctaccaggtgccagatactgctaggcacctttgataatatggatactcctctcacaatatccccacaaggcagatgatactgtactcatttcacagaagaaactgaagaggttaaattacttgcccaaattcagtatgtcatgaagccagaatgcaatcccaagcctgtctaattcttaagcccatgaacttcccatgggctttatctgcctcttcctctcttaaatggagataatgcgtcacaggttcctacaaacagcaggagaacttactgttagcacatttgtccaggagaagaaaaacaagccagagatgactcccaacacactggacagcatcaatcacatacataaattagggagtgctaattgtttcttatctcttggtataactctctgaaaggaagaaaagggtaaccagcatctccccaggtacatgactggcgcctgtttcaggcaagtgcaactgaagtcagcatccaacaaacacccctttctactcttcacaggggatgaaatgtagtgacaggcaattttggcaaatttgcagtcatcatgtattttgaatactgttagttatgtatggtttttagaatgttcatatgattttcctgctcattaaaaattaatgcagaactggcattgttccctttgtagaaaccaagaaaatatattgggtaaatagtaggcataaggcaaagaacactgcttcaatttaatataattcagttgccatttggagtaattgccaaacgtactttagacaatgtagaaaatatactcacactaagacagaaaaaagtagaaatgctagaacaaaagcaggaaatcctgcttttacaaacggtcagtaagactcagaaaaagtcacagccattataagtgaaaagtcgcttaattaaggtttaggggtttttttgttttgttttttgagacagagtctcattctgtcactcagactggagtgcagtggcacaatctcggctcactgcaacctccacttcctgggttcaagtgattctcctgcctcagcctcttaagtagcggggactacaagcgcacgccaccacacctggctaatttttttttttcttttttttgagatggagtctccctctgtcacccaggctggagtgcaattgtgcgatctcagctcactgcaacctccgcctcccaggttcaagcaattttcctgcctcagcctcccaagtagctgggattacaggtgcccagcaccgcgcccagctaatttttgtattattagtagagaggaggtttcgccatgttggccaggctggttttgaactcctgacctcacgtgatccgcccgcctcggcttcccaaagtgttgcgattacaggcatcagccactgtgcccagcctgatttttgtatttttagtagagatggggtttcaccatcttggccaaaccccaaaccccttggcccagccaaggttaaagtttttgtttgttaagaagcacagttacagaaagaattacaattactttccgtgccaatagcgctcatgcaaacatggtgaacattcctaaaacccgcaggactttctgtaagaagtgtggcaagcaccaaccctgcaaagtgacacagtacaagaagggcaagaattctctgtatgcccagggaaagtggtgttatacaggaagcagagtggttatggtgggcaaactaagctgattttccagaaaaaggctaaaactacaaagaagattgtgctaaggcttgagtgcgttgagcccaactgcagatctaagagaatgttggctattaaaagatgcaagcattggccgggcgcggtggctcacgcctgtaatcccagcactttgggaggccgaggcgggcggatcacgaggtcaggagatcgagaccatcctggctaacaaggtgaaaccccgtctctactaaaaatacaaaaaattagccgggcgtggtagcgggcgcctgtagtcccagctactcgggaggctgaggcaggagaatggcgtgaacccgggaggcggagcttgcagtgagccgagatcgcgccactgcactccagcctgggcgacagagcgagactccgtctcaaaaaaaaaaaaaaaaaaaaaaaaaaaaaaagatgcaagcattttgaactgggaagagataagagaaagggccaagtgacccagttctaagtgtcatcttttcttttattataaagacaataaaatcttgagtttatgttaaaaaaataataattacaattatcatttagtccaaaaccctcaattttcaaggtgggaaaactaagaaacttgtaaaagatcacaagttagtagcaaaggtcccagaaactacatctctgatgtacatgtccagtgctctggttttttaagacaaagtatcaccctgccacgcaggctggaatgcagagacatgatctcagctcactgcaacctctgccacctgggcttgagcaatccgcccacctcagcctcctgaggagctaggactacaggcgtgtaccaccatgctcagctaatttttaaatttttttgtagagatgcggcctcactacatttcccaggctggtctccaactcctgggctcaagtgaacctcccaccttggcctcccaaagtgctgggattacaagcgaaagccactgcacccagccttccagggctgtttgtttgtttttgagacagagtctcactctatcccccaggctggagtgcagtgcgccatcttggctcactgcaacctccgcctccctggttcaagtgattctcatgcctcagcctcccgagtagctgggattaaggtgcctgccaccatgcccagctaatttttgtatttttagtagggacggggtttcgccatgttggccaggctggtctcaaactcctgacctcaggtgatctgcccgcctcccaaagtgctgggattacaggcgtgagcaaccacgcccagcccagtgctctgttcttaaaagtttcccttggccgggcatggtggctcaagcctgtaatcccagcactttgggaggccgaggcaggtggatcacgaggtcaggagatcgagaccatcctggctaacatggtggaaccccgtctctactaaaaatacaaaaaaattagccaggcatggtggcgggcacctgtagtcccagctacttgggaggctgaagcaggagaatggcatgaacccaggaggcggagcttgcagtgagccgagatggagccactgcactccagcctgggccacagagcgagactctgtctcaaaaaaaaaaaaaaaaaaaaagtttcccaacttgcccactcatatcacctgggatatttactaactgtacattatgaatagaacctaaataaatgttattggcttgagacccttccacacagctactagttttttcttaaagcactcattaatgcccctttcctgcttagaaaatcttccactgattacaagttaaagtccaaacttcttagtatgaaatacggccctcttcagtatctcactgtatcacatactccaggtactttccatttccatatgtcctaagtataccaatcttttttgaaacagtaacttttgttctctcctctactccttcataaagaggtgctccctttgtcatggtcatcacactttcttctccttctttgattcccaattcaaatgtcatcttgtctttgaaagacttctatcctcccaggtagttagtcactatctcctatgtgtgtccatacacttgtttacaccacaataacctcatttatcacactattttaatttcatgattgcctgtttcacatgtcctggggagagaccatttttatttacctccatatgcctggtttctaaaccagatcttccaaagaaaacactcgataaacatttgctgaacaaatgaattgggtaaataatatggttgagataccaaaaaagatgtgaataaagcaagcagggagaggcaacgatgaactgaatatacagaaaggaaaccagcaggaagcagaacaggctccaacctacttccattaaaccctgcagaaatcagagttgtgcaacatggctctcctgtaacttggcttttctttttttttttttgagtatacttttaaagaaaggtttatttcccattgacttctgaaggttttttatcgagagtgaggaaggcggctcaggttttttaattacttcatgattcaatattttgaatcattttgattaaataaatttgacgaatggtctgacattcaaaagcacaatcatcaatcatcatgttcctgcaggcgtgtgtgtctatatgtatgtatgtgtgtgtgtgtgtgtgtgtgtatacacaaaatatatatatatatatatatatatatatatatatatatgtaatttttttttttaagacagagtctcgctctatcacccaggctggagtgcagtggcatgatctcggctcactgcaacctcagcctcctgggttcaagtgattctcctgcctcagcctcccaagtagctgggattacaggcgcgcaccaccatgcccagctaattttttgtatttttagtaaagacggggtttcaccatgttggccaggctggtcttgaactcctgaccttgtgatctgcctacctcagcctcccagagtgctgggattacaggcgtgagccaccacgcctggcttttttttttttttttttttctagagacatggtcttgctacattacccaggctagactcaaactcctgatctcaagagatcctcctgctgcctcagcctctcgaatagctaggactacaagtgtgcaccactatgcccagcttcctgcaggtatattttataaaactttctctagtgtctctgccactcccagcatgtgctaggtacacacagccaacttccaaactatacttgctgatcagttgagaaaagtgttcctgtctcatttagttcccaaggagatcaaggtcagttctctatgaatgtaaaccaaaaataaaattctaaggccccccaaccttctgaatggacttccttctcatccagggcactgttaaaatttaacctgaggctggttcaggccgtgatgggaagtggggttcagacatactcattaaaccctcactggccttaacatcaacacagacttagtctgataagaagcatttacatctatcctctcagaagcctgccacccagaggcttcatctgcatgataaaactttagtgtttataacctcttatcaacataacccagtcttttcctttctattgatcccaggtctttagataaactcaagctattgtcaaccagaaaatttttaaatctacctataaactggaatcccaccctccccttcgagttgtcccacctttctggatggaaccaatgtatttcttaaatgtatttgattgaagtctcttgtctccctaaaatgtataaaaccaagctgcaccctgaccaccttgggcacatgttctcaggacctcctgaaggctgtgtcatgggccatggtcactcatatttggctcagaataaatctcttcatatattttagagagtttggttcttttcatcgacatgagaagagctggagcaaaattacctgctactttatagtttctgcagtaagatgaaatttacagaatacatatattctccacctatgcattcattcattctttcattctaccattcatttattcatcaaacatgaatggtcattataataaagggacttggccaggtgcagtggctcacacctgtaatcccaacaactcaagagactaaggcaggaggattgatgaggccagaagttcaagaccagcccaggcaacacagcaagaccccaactctacaaaaataataataaataataaagggatttggggaatgccaagagaacccagagaacagaacgaacactacttgagaggtaaatcaaagtaaggtacatgtaatcaaggaggtaatatttgtgtaagaattatctaacatgaggtcggtggcaaactgagtgaactccaagtgtccttggagtgaatgacattgtatagtgtgcagataggctctgttataaagaaaggaagtttctgagcctgagagaaggactagttaaaagaaggaaagcacaagagccagtgtaacaccaaaaccactcctactcgtattcaaaaactgtgcgatttgagagtgatgtaatttcaaagaagtcacttcatcttaagaggtacaagaggccaggtgtggtagctcacacctgtaatcccagcactttaggaggccaaggcaggcagatcatttgagtcctgggctacacaaggaaactccatctctacaaaaaacacaaaaattagccgggtgtggcggtgcatgcctgtagtcccagctactcaggaagctgaggtgggagggtcacttgaacttggaaggcgaaggttgcagtgacctgagattgcgccactgcactccagcctgagcgacagagtgagacgccgtctcaaaaaaaaaaaaaaaaagagttaaacctttagaaacccagtagtcttcaaattacgctccttggagttctaaaagtttcaaggaggtacaacagaggtggggtagggaggaaagagggaaggttggaagggataccaacttcagtgagactagctctgtttttgtgttttatatattgaagcttctctgtaagatttcacctgattttttcttaaagataaatgacaacacactgaattccatcctcttcatttcagaaacaactaaataggtcaggtgtggttcacggctcatgcctgcaatcccagcactttgggaggccacagtgggaggatcacttgagcctaggagctcaagactagcctgggcaacacagggagactctttctctacaaaaaattaaaaacttagttgggcatggtggcacacacctgtagttctagctactcaggaagtagctactcaggaggtgaaaggatcatttgagcccgggagttcaaggttacaatgagctatgattatgtcactgcactccagcttgggtaacaaagtgagacagtgtctctaaaataaaataatgtaaaaaaaaacaagtagaagccaaagagattaagtaaccaagatcacacaatttaagacaaacagtaagtcatgctattgattttggacattgctgtgcaagtcatggagagccagtatttaaaacacagtataaagttgaatgtacttggcagggcgcggtggctcacgcctgaaatcccaacactttgggaggccgaggcggcagattacctgaggtcaggagtttgagaccaccctggccaagatggtataaccccatctctactaaaaatacaaaaattagccaggcatggtggcacacgcttgtagtcccagctacttgggaggctgaggcaggagaatcgcttgaacccggggggtggaggttacagcgaactgagatcacgtcactgcactccagcctgggtgacagaacgaaactccatctcaaaaaaaaaaaaaagttgaatgtacttgtttacccagcatcaagatgaagaaagtcaaaatcgtcgcagtccccaaagtcccctcatgctcccttccagcctctgtcccaccagggaaacatgatcccaacttctaataccatagattcgttctgtctgctaaggtacttcatatgaatggaattatgtagcccgttgtgtctcttttgttcagcatttggtctataagttgtgtcattatagatcctgtgttctcaaaaaaggaaaaaaaacacacacacacacacacatatagtatatgttctagttagagacccacatttggtagttatcagagattgggaatacttgtaatgtcagtgaattacattatccagggaaagtacatataaaaaaatatataagaagactggtcttttaagaggagaggaagacaactctgacaagcagtataggaacaaactggattttgagtcttgagacaaacacaccaattatgaagtgactggcatagtccaggtggtgagaacttgaacttgagcaatggagaagaggtatttcaaaggtagaatagacaggattttctggtcagctaaatgtggaagatgaaagaggagcatcacagatgggtttctatcttgggtgactgtagagcagtaatattaaccaagatagaagctctaagaaagtaggaatctagatattagatttgagggatgaacaacaaaatgttcaattttgagcacacctaatctgatccacctacaaagacatctagatggaagtgtccaagatatagtgaacactctatctagaaacccagatttcgtagtcattagggattgggagtagttgtaatcatgtgggtgaatgacattatccagggaaatcatgtataagaaaaaagagacaagaatagtcagaaacagaggttcagaaacacgagaaatcgggatacagagttaagagtttcaaggagaaaatggtattgtcacagaagttaagactcagctattagtgttggcaatctggagtgagtgtagttctagcacagtgatggctatagaagccaaattgaagtagattaggcaataaatgtttaaaataaggggaagagcctgggtgtggtgcctcacacctataatccaagcactttgggaggctgaggcaggcagatgacatgaagtcaggagaccggtctcacggtcaacatggtgaaaccctgtctctattaaaaatacaaaaatgcgccgggcatggtggtgagtgcctgtgaggcgggagaatagcttgaacctgggaggtggaggttgcagggagccaagatcgcaccactgccctccagcctgggcgacagagcaagatttcctctcaaaaaatacataggaaaaaaggtaagatttaagaaagggaggcagagttattataaggctttagtttttaggtgacagaacaaaactatttttagacaaaaaaaagaaataaagatttaatttacaaaaaggagatgggagagaagttacctaatggaagttagggccagaaaaagaagtagtagacagctctagaacacgaagttagaacctgggacagatatttctgtctctaagaatgaagttcaggaaggggagtaagaatgaacaaaggcatacataagtttagaagcagaagaaagagcgattgagaaggtacagattttcttctaccatttttttttcttttagagatatataatctttttgagacagtcaatgttgccaaggctggagtgcagtggcataatcacggtgcactgcagcctcgacctcccaggctcacgtgattctcccacctcagcttttcaagcggctgggaccacaagagcacgctgccaagcccggctaatttttaaaatttcttatagaggtgcagtctccctatgttgcccaggctggtctcaaactcctaagctcaagtgatcctcccacctcagcctcccaatgcaagctttctttgtctctcttctttaggctcagacaacagtccaaagggcagagctaaggacagactccttgatctcgtaggccctcaagtgtctaagcacaaatttctctcctcttcaagccataaaagagaaagacacatgcaaatcagttcccatgactcaaccagatatgtgcatttcagcttgcattcaaatcagcttaggccctacacatcaaaacatttgttaaaatgaatgaatgtgaaggaaaacattctaggcagaggttactctgcaaaagcagagtaactagtgtggtctggaaaaatagaagattacttactcacatgaaatagtgaagggctggcctggcacagtggctcatgcctgtaatcctagcacttgggaggccgaggcaagtggatcaccttgagctcaggagttcaagaccagcctgggcaacacagtgaaacccctctctaccaaaaataaaaaaaatcagccaggcgaggtggcatgtgcctgtggtcccaagtactcaggaggctgaggagggaggactgcttgagtctgtaagatgggggttgcagtgagtcaagatcgtgccactgtactccagcctgagtaacagagtgagaccccatctcaaaaaaaaaaaaaaaagtgaaaggctaacaacaatgcaaggaaccataacaatagatacaaaaataagtacaatgttaatgcctagctgatacaaatgtcaattagcataagatccttaaaacaacctgaaaaattaaacattaaaaaatatatatataatagaaagtgaaagtccattaccaagaaaacaatcattagcagttttgaatagattgttccagatatttcctatttatacactagcaaataccacttttacacaaatgaagtcatacttcattgttctgcttttttcatgttaccaatttttcacagtgaataagtaatcttctatttttccagaccacactagttactctgcttttgcttgtactgtaaccactgcctagaatgtttcccttcatgttcattttaacaaatgttacaattaatgctacaataaacattcttcatacatgtgtgtaaatataggtctgtggacagatatgtgcttccaaagataaattctagaagtggaagtagcaggttagagagcatgaacattctaattttaatagataataccaaacagcctaaattggactttacctataaagtctctcaatacaggctgatagcataataccaataagatgcggtttagagacacaaccctctaactctgacttaattcaaaagacattttagagtacctataccagtaatatactccatttcctctaagcaattttccacaaacattatttcccttaactaagctttcctctccaaataaatgtaatttataagcacatgctccacaaaaatctcaaacatgaaaaacttactaagcggactccacagacaggggaggaggggtgaacctgaagacccagtcctgattaccacagttaacagtttggtatttgtttttccagatttattttatgcatatataaacaaacatgttatttttcaaacccaaataaaattatgctagccaattaatattctattattttcattacacatattacagatatccttccatagcaatatataatacatcaatcatatccttttaaataggtgtacagcattttattatatggatataccagaaattaagctatcttccactggtggacattaagacggtttccagttttttgcctaacaaaccatactactttgaacatcctcatcctcatatatatactgagtatttaggtaggacaatacttctagaagtagaattaatgggtatcaagttgctttccaaaatttattaatagtaccattttatattcccattggtgtgtaaacatacttgtttctgtataatcttgccaatatttggtatgaacaattattttatgtattgccaacctgagaggcaaattttttctaaattttcatttctctgatcattagggaactcagcatttttcatatatctatcatgtatatttctcctatgaattgcctattcatttattttgcccattttctatagcatgctgttcaatggaaatgcaacacaaactacataatgtaattttaaatgttctagtagccacattttaaaaagtaaaattaggccaggtgcagtggctcacgcctgtaatcccagcactttgggaagctgaggcaggtggatcacctgaggtcaggagttcaagaccagcctgtccaacatggtaaaactccatctctactaaaaatataaaaattagctgggcgtggtggcgggcacctgtaatctcagctacgcaggaagctaaggcaggacaatcgcttgaatctgagaggcagaggttgcagtgagcccagattgcgccagtgcattccagcctggataatagagtgagactacatttcaaaaaaataaataaaaagtaaaaataaacgggtaaaatctgtattaatatattttaattagttcatatctaaatattatcacctcaacatatgatcagtataaaaattcttatgacattttacatttttgtactgtcttcaaactccagcttttacacttattatacacttagagtacttctcaatatagaactagccacatttcaagtgctgattaaccacatattaaaggctactgtatgggatagtgtggttctataggatctttatatgtgagagctcagatttcccccatttcagccttttttcccctatgtttttatttttactgtacaaataatttaaaagcaaaggcttcaaataatgtacaattatgaagagcaaaacatgacagtcattctttattacctcactcacagtaccatctccaagataaccatatcagccactgaagtacattctcacagcctatttttacatattatataaacgtatatatacccatatgtattttacattgtctaaaccttcttctaagataatacccatcagaaataccacattcgattctacataatattcaacaggatgggtagatcaaaatttattttttaatagacacataatacattaatactctcattgtaaaaacttaaaacatacaaataaagccaattcttttgaccatccttccccatcagtctctgaaaatacccagtgctgttaacaacatgacctgtatccacggatctttttctatgcattacaataatagatattatattaatagtaagcttttacctgtaacatatgctataaatgcttttaatctagcttgtttgtcttttaattttagggcatctttcattataccaatttaaatttgttggtctttcttttatgactagtgagtgtcttgtcatacaaagaaaggcctgtctcataccaggtcttataccagaaaattgtcctatattttattctagtacctctatgatttaagggttttatgtatatatttgatctacgtggattttattttggagtgaagaaatggatatgagtccaaattgtttgcgctacccttctaccaccaccacttgcgatgtctagcagtgtctacccttcttatctctatgacctctaagactgtatcccagcccacaaagatggaaaggcagaaggctacgtagagtatagcacagaaaggagggtgggggattaactgtagagaggaaaaacttgacaaacactactttagccagctggtcaaggtcaacatcaacagtcataaagcatgcagacagtatgtgctcttgataagatgaaagtatcattttgcctttgtcatcttcctcctaaaaattcactaacttagtccaagcatgacaaatcatcaaattccaatatacttacaatatatttatatatctcctacaatatctgtccagtaacctctcaaaactgtcaaagtcatcaaaaacaaggaaagtctaaggaactgtcacaactaagaggagcctaaggagacatgacagctaaatgtaatgtggtgacctggaacagaacaaggatattaaataaaaactaaggaaactgaaataatgcatagacttcagttaatcataatacaatcagtattgttcattattcctaacatatgtaccatactgatataagatattaataatagtggaaactatgtgtggggtacatgaagggatatatgggaactctgttctactcgctccatttttctgtaaatttaaaactgtttaaaaaataagcctatcaattttataaaaagcaaatacctcagaagtagaagagtataggtaaatatgtgcctctaattttgaccacattcattaaaaacaaaatacccacttgatccacatggaaatttatcttttttttttttttttttttttgagatggagtctcgctctgtcacctaggctggagtgcagtggcatgatctcggctcactgcgacctccacctcccggtttcaagtgattctcctacctcagcctcccgagtagctgctactacaggcacccgccaccacgcccagctaattttttttgtactagtagagacagggtttcaccatattggccaggctggtcttgaactcctgaccttgtgatctgccgacctcagcctcccaaagtgctaggattacaggcgtgagccaccgcaaccagcagaaatttatcttaagaaaatatctaaagaacaaaaatagattgcaaggatgcatagtacagttttaccaatattagaaaaaatacaaataagctaatttatccaaaaatagagaaagaagcaaaaaattaaagttacattcactcagaatattatttacctattacaaatgacaatttcaaggctataggagataggatatgtttattatataatgtaattaaaaaaaaaatacaaattgtaggccaggcactggggctcacgcccgtaatcccagccctttgggaggctgaagcaggtggatcacctgaggtcgggagttcgagaccagcctgaccaacatggagaaaccccgtccctgctaaaaatacaaaattagccatgcgtggtggcacatgcctgtaatcccagctactcggtaggctgaggcaggaaaatcgcttgaacccagaaggcgtaggttgcggtgagctgagatcgcaccattgcactccaccctgagcaataagagcgaaatgtcatctcaaaaaaaaaattgtagaatatgaatgtaaatttgggttttcttttttttttaatcttacatgaaccacatataccaaaatgttaaacaattaaaaacagataaggctaaacacggtggctaatgtttgtaatcctagcgcttttgggaggccaacgcgggagaatcattcgaggctgggagttcaagaccagcctaggaacatagtgagaccccatctctaccaataattttaaaattagctgggtgtgatgggtggtgtgcatctatagtcctagctactcaggaaactgaggtgggaggatcacttgaacccaagagttcgagattacagtgagctatgaacatgagactgaactccagctggacaacagtgagaccctatatctataaaaataaataaaaattaaaagtgaaaaacaaatactaagatctcagtaaagatcttactcttcagtaaagagaaggctatggtaaacttacaactagtttttcaaatactatgatttttttttttttttttttttttgcccaagctggagtgcagtggcgcgatatcagctcactgcaacctccaccttctgggttcaagcgattctcctgcctcagcctcccaagtagctgggattacaggtgcctgccaccatgcccaactaattttttgtactttttgtagagacattttagtagagacaaagtttcaccatgttggccaggctggtctcgaactcctgacctcaagtgatccacccgcctcagcttcccaaagtgctaggattacaggcatgagccacagcacccggcagcccttgtctatttttcagtctattataaacaataataaataacaagtctcttttactaaaagcatttaactgaaattaccatttcatctcaaatccagtcatgctacatccagtgctaaaaactacagaggaaaagtacactacaacaaacacaccctattgcaggggcagacagagcctggcatctaagctgatgccataccccataagggcctgcatgggaataacttttatctgtgattggtagtttcacatctcaaccaaaaggctaacagaataaaagagtaaagaaattcaaagtagcagctaacgggcagaaaagcattcgtccattttcctatgctatcaagccaatttgaagttttttaaaaaattaccaatatacttcaattactacaaataaagtatactatcgctgcaaaaaaaatagcacttttgaatataatatcaaaagaatcatccaagaaagcaaacataaaataataataaatgtgggccagttgcagtggctcacccctgtaatcccagcactgctggaggccaaggcaggatgacagcttgagctcaggagtttgagaccagtctgagcaacatagtgagattctgtctctacaacaacaataatcatcatcatcatcatcattatcatcatcatcaatatgcaatgagaatttttttaaagcaaactccaaaatctaacagggaaaaaaattaccaggaaaaaataaaatagagatattgtaacatggaatttgttacactaaaaccaatagcatacccagaaaacatccttcactcacaacaccacctaaccaaagcaaggtctcacttcccccaaatatttcaaaccacaaatttacaaattcttttcatcaacctgaattatttaatttgagtggtcatagacttttttattttaatctgataaaacctatggttgttctccctggaaaaacacaaatgtacaaaatatggcacataattctgaaggtttcacacatccaaagccaactgtagactttcagacagttcatgtgttccatagcttaaatgtttaatgataacatacacaaaccctcattcttaaaaaaagataatgaagtgggaaagacccttccaattatgtaatccactcattcccaaactatttttttaaaggaataaaagaatggctactccataggccgagcagcagcctcattcccaaactattctaaccatcacccacctaagtaagacaagagatccagcctacctacctcctcccattttctagtgcaaaaataactccctaaggaagaattgtagcaatgtaacaagtacacaagagcaaaacggtccacaaaaatttaaatgtaacattaattctacaattgtattaatccaaaaataacagcaactggaaccacagccaatttgagacaacaccactgatgtagtgaaaatatcttctgagtgtgggcatgcatagtactaattttctagtgctgccaaagcatggtatagctgacagatttcttagaagaaaactaaactagagccctcggtaagttctagaaaccagctaattttagttgtgaatactaaatttcagtaatccttagtaactcagattattggtaggtagcctattctaatacataaatatcagaggttatgggaatggaataacaatagcccctgagaactgaggagacggcttgtatttctggttcatgatccattaggaaaagcttctgatctagtgagtgtcttggaccatactgaggaagcattaatctaagccaataattttcaacaatttttccactgtgattctgagtaatggctcaccaatagtataaaattaacctcctaaactggaacccacatacattgctggtgggaatataaaatagatcaactgctttggaaaacaattcagaatttcctcaaaatgttaaacataggttaccatgttaagtcagcaattccacccctcagtatgaacccaagataaataaaaacatgtcccaaaacctgtacacaaatgctcacagcagcattattcacaatagccaaaaagtagaagcaaccgagtggaagcaaatgtccatcaactacagatggatgaatgaataaacaataaacaaaatgtggtatatccatataatccataaaatattatttggccataaaaaggaatgaagtactgatctatgctataacattgatgaatcttgaaaacactatggtaagtaaaagaagtgagtcacaaaagaccatatattgtataattccatttatatgaaatgtctaggataggcaatttcatagacacagaaagtagactagtggctacctagagctagcggtgttgagggagatggaaagtgactgccattgggtataggaggttcttttaagaacgacgaaaatgttctaaaattagatagtgatactggttgcacaagtctgtgaatatactaaaaaacactgaactgtaaactttaaaagggtgaattttacaatatgtatctcaataaagctgtttttaaaaaatctattcacgtgacatacaaggtgttttaggctctatcttccgcctaccctaccaggtatttcaacctccccacctccacctccacttgatcttattcccatgcctcctctctttgcacctgtggaactacctgccttctgagtgacacttctactaataatagcttcctttgccacagtcccattttgtcttgtattatctcattaaactacataccagctagtattgttacttttgttttcacgcctgccccgcttctattagactgtgagctcctgaatggctctttaacttcatatacctagtgcccagcagtcactcacatggtaggcactaaaatattctttaataagcacaggttagcattctttcaactgcacagaagacaaacccagcaacttgagtttgaatcccagtgcaagtacttcctagctttgtggacttgcacatgacatagcttcaatttcctaaccaaataatgtggatacagtagacccccttatctgcagtttcactttctgaagtttcagttacctgtggtcaaccatggtctcaaaatacaaaatggataattccagaaataaacaattcataaatttttaattgtgcaccatcctgagtagcatggtaaaatcctgcattgcccgcatctgtcccaaccaggatgaaaaccatccctttgtccagggtgtatccactgtgtctatgctgcctgcccattagtcacttagtagctgtctcagttatcagaccgactgtcacagtatcacagtgcttgtgttcaagtaacccttattttacttaataatgaccccaaagtgcaagagtagtgaggctggcaattcggatatgccaaggagaagccacttccttcaagtgaaaaggtgaaagttctcaacttaatatagaagggaaaaaattgtatgctgaggttgctaagatctacagtaagaacaagtcttatatctgtgaaattgttaacagtatattgttataattgttcaattttattattattaatctcttactgtgcctaatttataaattaaactttatcataggtatgtatatataggaaaaaacatagtgtatataggtttctgtaccatccatggtttcaagcaaccactaggggttttggaatgtattccttgcagacaagcaaagtactactgtaatcgtacctaaatgccaggttattttaaggcttagatgtcatgtctggaaaacatctggcacatagaaggtgtccataaattatgattattacaacaattatttcaacattattttaattataatcactaatcaacttttagttgtaatcacaatcactaatcactaatctaatttgttttactgaaacaaattagagttgtgccaattattaataaaaggacatgtttttctcactttaatcaatatttgagaaaaaagttatcatttctatctagaggcttagggtcccaaatatacaaagcattaagacctaaaagcctcaaagaggataacttctctatacaaacttagttcttaattctagttctgcaatttagcaacctcagtttagatttttaaacacaaattataagctcagatttttataaatattgagtttagccttcaaaaaaatcaaccaataagccaggagacataaaaggacaggaatagcaaactaatactgaagtggttagtactcaaattctattgaagatttaaatcaaaccaatttttgaagaatagtcaacaactctgaacaagacaattcacccacacaaagggggataaaaatacctaagaatagcttgtgactcagcctgcattcctataaggggtcccagggggactgataatatttagcctattgtcatctgtctcatatcagaactaaatattacagcaaaactatttacttgacatgaataaaaagtacagagggaaagaaattcagacagatgcttcactttcaagtaaaacatcacctctttgaaacaaagacaacttttaagttttgaagccatacaagaaaacaaaagaaagaataagcagattctatatcatctatataacaaatatttaaaacttccttgaaaacaaacttaaaaggtaaatggggaaaaatcacaacacatgataagcagttgatatttttaatgtacatagggctattaaaatagataacgaaaacactaagacctcaaataaataatctacgaaagaagaaacagaagaaataaaagtagttaataaatgttaacatcactaataattaagaaaacgaggctacccacagtggctcatgcctgtaatcccagcactttgggaggctgagtgggggcgaatcgtctgaactcaggagtttgaggccagcctgggaaacatggtgtaaacctgcctcaataaaaactacaaaaaaattagttggtcccagcgggaggctgaggtgggaggatggcttgagcccaggagaaggaggttgcagtgagctgagatggcagtgagctgagatcccgccactgcactccagcctgggcaacagagccagaccctgtctcaaagacaaaacaaaacaaaacactggccaatacccagggctagcaaaggtgaattaaatagggtgcttgcaggtacagcccatgggaatacgtattggtatcactcttcagaaggcactgtgaaaacatatatcaagagtcccaccaacattcatatcctataaagcaataatttcatttctgggaatctgtcataaggaaataacagtaaatgtgggaaatgctttaattacaaagatatggcagcattagtaatcattgaaaaaaactaaaaatgaatgtccaaaaataaaggaatatactaagccaagtatcatgcttccacttaaaatcaaattcatatgatatgtgaattaaatctcaataaagctattttgtgatcaagttcagttagaccacataataacatggaaactgcttatgttcttacaatttaaaacttacattttgatataaatgtgcatatttattatgaaaattaaaacagcagccatcaatcatcaatatttactaagtgccaagccctacactacaagttgttacatgttatcatggttacctcattatcactgataccatcaccaggcccatcctggaagggtctcaggcccaaggccatcaccaactgtggggctggcccaagataaaccacactttaaagaaggcttcactaaacattttcataggccccttgagaatgttaaaaacaaatttggaaattgagcccagtgggattgtgggtctgtactaccctacttttcagccttcttatatagattattccgatggtaagattaaaaattaagggcaaaaggctaatttcctttccagtcacggtgtaaaacaaagaccaaaataagaactatgttaggttagtttgaaatttctcactgaaccaagttaaaacaacaggtaacattaggcacttacactaagcagaagtcactgtgctaagcactttatattacatataacaacactaggaactagctaatatttccccatttcacacataaggaaacagaagctgaagagaattaaagtaacttgcccaagattatacagttatttggtgtcagagctggaagcaggtctaacttcagaggctgtactcttatcctctatggttatgatgaaaataaatgaaatttttattaaaatcacatatactttatctaaaatgaatacgcattcgtgaagaaaatgatcttaaaaatatgaaacagttaaataaaacaaatgtttaccgtctggtaatagtcccctaatccactaaatgtctgccataatccactgctgaatagctccacaagtaaataaatcatttaatgtcctgatgtatctatgaaattatattttaagtgaaccttttgaaacaatactatacattctgcaaatgaaatatgctgccctcttggagctgtgaaaatacatatttcttgatctattaactgtcctaattctgttcagtttcctcccttcctctcccacttcctctttgctctcatatcctttaagaccagttcagttcctcctcctcaagaatacctatattcacactttacccaagagaactctaacattagtttctgcgctccacagctgtaggatgttacaaaatccaaaaaatgaactcaagtaaaaaatacagtatttctgatgtaccttcaactttagatctatccacttacagaattaattataaacattcttatttttctacttcacacttggaatcctgtctttaaaatcagcacacagtaaccaaaacagcatggcactggtaccaaaacagacatataagccaatggagcagaacagagacctcagaaataacaccacacatctacaaccatctgatcttcaacaaacaagacaaaaacaagcaatggggaaaggatctcctattctgtaaatggtgctgggaaaattggctagccatatgcagaaaactgaaactggaccacttccttacaccttatacaaaaattaacttgagatgaattaaagacttaaatataaaatccaaaaccataaaaccctagaagaaaacctaggcaataccattcaggacataggcatgggcaaagacttcatgacaaaaatgccaaaagcaattgcaacaaaagccaaaattgacaaataggatctaattaaactaaagagcttctgcacagcaaaagaaactatcatcaggctgggtgcagtggctcatgcctataatcccagcactataggaggccgaggtgggaggatcacctgaggtcaggaattccagaccagcctggcctgcatggtgaaaccctgtctctatttttaaaaaattacaaaaaggccaggcatagtggctcacatctgtaatcccagcactttgggaggccgaggcgggtggatcacctgaggtcaggaatttgagaccagcctggacatggtgaaaccccatctctactaaaaatacaaaaattagctgggcatggtggcaggcgcctgtaatcccagctactcaggaggctgaggcaggagaatcacacttgaaccccggaggctgaggttgcagtgagccaagatcgcaccattgcactccagcctgggggacaagagcgagactccatctcaaaaaaaaaaaaaatagctggacgtggtggcacatgcctataatcccagctacttgggaggtgaacctggtaggcagagattgtggtgagccaagatggcaccacggcactccagcctgggagacagagcaagaccctgtctcaaaaaaaaaaaaaaaaagaaagaaaaaaagaaactatcatcagagtgaacaggcaacccacagaacgggagaaaatttttgcaatctatccatctgacaaaggtctaatatccagaatttacaaggaacttaaacatatctacaagaaaaaaaaaaccccaccaaaaagtgggcaaaggatatgaatagacacttctcaaaagaagacatttttgaggccaacaaacatgaaaaaaggctcaacatcactgatcatcagagaactgcaaatcaaaaccacaatgatggccgggtgcagtggctcaagcctgtaatcccagcactttgggaggccaaggcgggtggctcatctgaggttgggagttctagaccagcctggccaacatgtctctactaaaaagacaaaaattggcagggcgtggtggcaggcgtctgtaatcccagctactcaggaggctgaggcagaagaatcacttgaacccaggaggcggaggttgcagtgagttgggatcgcgccattgcactccagactgggcaacaagagtgagactccgtctcaaaaaaaaaaaaacacaatgagataccatttcatgccagtcagaatggtgattattaaaaagtcaggaaaacaatagatgctggcaagtctgtggcgaaatggaacgcttttacactgttgctgggaatgtaaattggttcaaccatagtggaagatagtatggcaattcctcaaggatctagaaccagaaatatcatttgacccagcaatctcattaatgggtatatacccaaaggaatagaaatcattctactctaaagacacatgcacacgtatgtttactacagcactatttacaatagcaaagacaccaaaccaacccaaatgcccgtcaatgatagactggataaagaaaatgtgatatacatacaccatggaatactatgcagccataaaaaggaatgagatcatgtcctttgcagggacatggacgaaactggaagccatcatcctcagcaaactaacacaggaacagaaaatcaaacaccctatgttctcactcataagtgggagttgaacattgagaacacatggacacagaggggaacaacacacaccaggacctgttgtgggggggcaatgagggaaggggacttagaggacgggtgaataggtgcagcaaaccaccacggtgcacgtatacctatgtaacaaacctgtacgttctgcacatatatcctgttttttttgtaagaaataaaaaaaaatcggcacacaagaaagtctgcctttcttcaaaaacagttttttcacaaattttttccataaataaaaaaggtactaaaaaaacttgaatccaaaaaaagaaaaagaaaatgcaccgttagatggtaataaatatatcacatttttggtaatgtaactcgtttattctgaatcatttctggaacttgttaatataaatgttttacaagtaaatacaatatgtaaaaatgctacttaatggactaatatgtactttcactcattcactaaacacatattttttactgaatgcccatataactttttttttcttttttttgtttgagacggagtctcactctgtcgcctaggctggagtgcagtggtgcgatctcggttcactgcaacctccgcctcccgggttcaacgattctcctgcctcagcctcctgagtacctgggactacaggcgcacgccaccatgccaggctaattttttgtattttttagtagagacaggatttcaccttattggtcagtctcaaactcctgacctggtgatccgccctcctcggcctcccaaagtgctgggattacaggcatgagccagggcacccggcacatagataactcttttttaaatgtatgaaccaagatgactctaccagataaggcacaggtgctgcagttaaaaggatcttggtttgaaacctggctattgtacttactagctcagagacctaaagtagtcaaacttcaggttaacatttcacttacctttttgatgggaagataataattactcctagggccttagtgagctttaaatgattatgtaaaacacttagcatagagtctaacatgcagttacgtgctcgataaatgacaaccatggtaaacatattttatactgaagaaagtatagttgaaggagacagccaatatgtgacccttttgtcttactaaagatggaaatttgtgaaactctacattaaaactaaaaatcctaaggttacatgattttctactttttaaaaaagatatactaactacataaggttaaaggattttttaaaataagaaagaaaaaaagaaaagcttcttgaaagctgctgagtttgggtgatgggtacatgctatttttgtgaaaatacaaattttttaacactattaatccaatccccaaaacatgcctaacacacctcctcatattcaggagagatcaagattttagccttgagatgtaccgaacaatggtaactccctgcttagtaattctgtacaggtcaagttttcttggacgagtttacctttcattacaaaggtgggcacagggaatagttatcaatgcatggaagggtgaaaaaatgcaagcttttcaactgcttattaatattacatcaaaatagcagcaatgcacattttttccacgttttcaaaaacataaaatacatccactttatttacttttgaaattacaagagagtcacaggcacagccaaaaaaagctaaaggaaaacacatcagagttgtcagtatctttaaatttggaaggacgtcattattaattcgcgtaaatgttttatgcgatgtttctaggtagcttttaggttttatcactgattaacaatatagcaaaccagcacagggagagaggcaatttttcgaaacgcttaagaagctttaaactacaagagctatgctacctaaactgagctcactaacaacgtaaaatttcaagtcacaccttgcctatttctgagtaagcaagcaaacactagtgagacaaactagaagcatggagcaaagcaagtcatttctatgctaaccttaattcctatcgtaaaggggttggctccatcaaaaaatattcctatttcagtattaacacaagtttcaaataaagcacacttgccattggtaattctagagcgacaaggcgcataattaataaatccaaacggagcatctttctatagaatacaaagccatctgcagtttcagcctcggtttacccactcactatgcatatgcagacgtctttaaaaataaataaataaatacacaaataaactttatctggcctgagagattacatctctcggtgcttcctgtatattctggaagtcaataacgctgaaggtaaatttaacatttccaactccggaggaacgcgagcggtagacgccaagcatccgcccactgtcctctcgtgactcgggctactttgacgcaccgggatgcggctcacctgacattcggcaccaacccttgccaggaaggaaaaccaactccgcgaaaataaaatgggtccccgaggaggcgtgcgggtgcccccagagctctcttctgctcacaccccgaaagcgagggggccacgccacccccgaccctcgccggcgtccgccacctgccagacgaggccgcggccagggacccgggctcggccgcaaggaaggggcagcccagcccaggccccctcggcgtctgtcccggcccggcagcagaggaaggaacccggggccggaggtttccgccccgcacggccgagcccgccaggggcctagctcgggggccgcccgtactcccgaggacccgtccccatcgtgcggagcgcacagccgcctcagcccgacccgcagagcctccgggcagcgggcgcggcgcccgcacctgccccgcgccttgctgcagccccgctagcggcttcacccacctggcgccctcgccgcgcctcccgctcgtcacagcgcgactccgcgtccctcagcaccggcagcctgggcgcgggcaggcgcggggagaccctgctctgccgccgtcgccgccactgcagctggcttggtcgtcaggccgccgcccgcgaacctgttgcgtagcctgtcacagccgctcagggctccgccggcgccgcctcagccccacaacaacatggcggccg

SEQ ID NO: 1832 - DNA, 157663 bp, Homo sapiens; identical to SEQ ID NO: 1831
  source 1..157663: mol_type = genomic DNA

SEQ ID NO: 1833 - DNA, 140210 bp, Homo sapiens
  source 1..140210: mol_type = genomic DNA
tagtagaaatggaaagtcttcttttgttcactcaagcacaaatcattttaaagtgctactcgaataaggatagctgtcatcagcgtagaggtcactggtataaacaaacagtagctatatgatatttgggaactattttacaatatgctcccattgggttttccaaactgatacaaccatgaggtgaacactttcactgtttcacagttcctccagagataccagtttatgaaaatgtcagatgttaaaacagatattaggcaaatatccaaggaagctacggtctgccataggcccttcccatccactctatccccgtccttccttgatggggctcctgccacatccaacgaagccatgcgaatgccctcttgttctcccgcttcactctgagtgacctcatctgggggaaagagctcattagagactttcaatctcaagcattatccggcaggcagagacagcatttggaggatgtgagagcttccgtcactatttgtgaattcacacatcaaaagtgatgccttgctttgactctgcgtggaggcagccctgagtctgatgcccaccatctctcatgagagacagcagataccccgagagctagccagcagcagcctcctcacctcgacgacgagctgaaggtcagccatgtaccgctcttcggtctgaatcagctcatgaatatagccctgtcttttcctctcaattggctgcattgtgtccagggtttgcagatcagcacaccctgtggaaaaaacagggtagtttaaaatattactttagtcaactttgtagaaaatagacatttgtcagcagatgtgctgggtttacaaatgctgctttgaaagaatgacgcagccttaaaaaggacgctgctaacttctgcagagcagcatgcgtacgcggagagttggcattaatgagccggcactcacagctccaaagtggcaaatcagcaatgtctgtaacatttcaatgtgctcctaatttcttttcagaactgtgcagagcgtgtgaagaatctcaccacctcaagacatttttcgaagttactgaaatgattaaatgaatcagatgcttcagaccactccaaactgcaggtcatgagccattagtgggtcattatatcattttggttttaaaatgctggtcaggcccagcattaaaaaataaataaatagaaattaccatgcatatggctttggtaaatattgtgaaatgtttagttatgtatgtattcgaaatgtaaaatgtatttctcactgtgagctactgttaaaaaaatgtttgagaaacagtctctagatttcttaaaggaaagttctaaggttataaaacctgaaattcccagatcccagcaattcccagaagaccactgcctcatctcactagaacaaataactcctggtacactgcagatatccagccacaaatgacaggaaagtcacaagcaaccttgcatcagggtgagaggtactgcattcactatggatcaattcacaggcacatcacagctgaactagatgtcaaactatgaagtgacataattccagagtcacttaacaagtagctgagggcttgcctatacacagtgatgtggcgaaatacctcaggaaacccttcttagaaaaaaaagcaaaagcagccgggcatggtggctcacacctttgggagtaatcccagcactttgggaggccaaggtgggtgtatcacgaggtcaggagatcgagaccatcctggctaacacggtgaaaccccgtctctactaaaattacaaaaaattagccaggcgtggtggtgggcgcctgtagtcccagctactcaggaggctgaggcagcagaatggtgtgaacccaggaggtggaggttgcagtgagccgagatcgcaccactgcactccagcctgggcaaaagagcaagacttcatctccaaaaaaaaaaaaaaaaaaaaaagcaaaagcagtggaagttgtcagaatcaaaatggagtcacttgtgttaaaaatcctgacaaagggccagggaaggccatgaagagagagttctcatccatgaatacttgataactagaactatcacaaaagactgcaaaaccacaaacttacataaaggccatggtgacctgacacaaaaaaatagtcctgcaaggttatctgcccagcaactgcctgtccaacctcggacaagtgccacccttattgattctcacggccaaggataattatatatttaaaaaaattatgtgatcctcttcatttttcctttaaaaacttttgtcctcctttagttctctgaatatgcacctgttggtatgcatattcccattacaataactatttttcttttctttttttttttttttttttttttggagacagagtctccctgtgtcagccaggctggagtgcaatggcgcaaatctcggctcactgcaacctctgccttctgggtgcaagtgattctcctgcctcagcctcctgagtggctgggattacaggcacacaccaccacgcccagctaatttttgtatttttagtagagatggggtttcaccgtattggccaggctggtctcgaactcctgatctcaggtgatccgcccaccttggcctcccaaagtgctgggattacaggcatgagccccatgcccggtgcaataactattcttaaataaatatcactttcttttagagagtctccctctccgttatttaggttgacagcatgtaggtacccagcaagctacaacatgaggcagcaagtggcttgtgtcagaaaactgggaaagagacgaatgaagtagggaagaccttctgtagctaaggcaaccaagaagggcagcagagcgaaggcgcaccctgcacctgccaggacactgtccatccagcagggcgtgttgctctttccaatttcctttgcatttgtatacattttgtatagatctgggcttacagacagttctaaggaagacagcttttctatattctacagatgttgccaacagctttaaagaaattactcccacagagaacaaaaaaataaatgaataaggcaggttatgtttggtgtttctaaaaagaaatcatagactgtggtgcctgtaatcccagcactgtgggaggctgaggcgggaggatcacttgtgcctaggagttgaagaccagcctgggcaacaaagtgagactctcatctctaccaaattaaaaaaaaaaaaattagccaggcgtggtggcatgtgcctgtagtcccagctacttgggaggctaaggctgggaggactgcttgagtctgagagttcaagtttgcagtgagctgtgactgcaccactgtactccaggccagataagagtgagaccctgtttcaaaaaaaaaaaaaaaaggaaaagaaaggaacagggagaaggaaggaaaaagtgaatgtaaggggaaagggaaggggaggggaggggaggggagtgagggaagaaggaaggagtgaaagaaggaagggaagggaaggaagggaaaaaaaggaaagaaacaagaaaaagaaagaaagaaaggaaagaaagaaaaaaaagaaagaagaaaaataaagaaaagaaagaaataaatcataatgccactgtcatgttcaaaattgttacgcttttagggagatagtattttattatcttctgccagggggaactgcagagggtaactgagtgttaaaaaaaatcactgaggctaatccaaatgtctgcttgacgaggcttttgtggagcaaggagaggcttggtgaccagacacctggcgaaatggcactgatcctgatatgatccagtggtgctactcggtgtggccaggtgattgatggagggaactcagaccagtttccaaggttgccccacctcccacaccactgtcttacaaacttcatgttctgctttcaagacttttgccatatccacattccatctctattattatttacttaatatttttctctaaacgtactcgtgtttgaagttaagtgtgctcattatgtttcttctaataatcattaaagcaaatatataatcattcgaatgaaacaggtccattttgtgtaccagtgcgttgagcaccacaaggatacaactatcacaccttgggaaacaatgatttacattaaaaaccacaagtattggccactgtatctggaataataccttggaataatagcaagaacctcagatatttgtttctaaaactagactatacattgcattagctgtagcaggataatgtggggacacccctggcatgccatgcctagctgacccttttgcatttcatcatgacggctcttcaactttttttttttttttgagacggagtctcactgtgtggcccaggctggagtgcagcggcgcgatctcggctcactacaacctccgcctcccgggttcaagcgattctcctgcctcagtctccgagtagctggaactacaggtgcccaccacacccagctaatttttgtatctttagtagagacggggtttcgccatgttggccaggctggtctccaactactggcctcaagtgctctgcccatctcggcctctcgaagtgctgggattacaggcgtgagccaccacgcctggcctgctcttaaatttttaccctctgtttaagtttccaacccagctcctaccctcacttccagatgctcttacctctgatgtcagggaaaaaataaagacacgaggcctctcttcctccccttctgtctgtccatttgtccctgtgtgtccttcctgagttagggaaggaggggtcctgtttctttctaaagccactgtctgtagtcagcctctcctccagggcccctccctttccttcacgcttctatgttcactcttcgccatttccttcttagcccataaacattgctaagtgtccctcctatcccactgtttgaaaccaaccaacaagcacacttctccaaccctgccccctcctcagcaccgcctgcctttggtctcattggcaaatgtcactagaggggtttacacccatggccaactctcgctagctttccctgtcacatctccactcgggattctggtttctgccccactgcccgacactgctctcgggaaggtatcgatgaccttggcattgccaagttcagtgacctcttctgagcttgcaccctcccctgccggcccacagcacaggcgccttggatgggaggcttttttggagacttgagtctgcctttctcagcccttgagcctctcctcttcttggtgtttccttctgtcttctgcctcttgcctgctgcctggctctctgctccccccagtccagcaaatgccaaaataggctcctgatgctcctgtcctgtgcggtcagatgaatccagacaatgctgcaggctgtatatctcactcgcagggccccagtgcacattagcctattaggcagtgagaaactctgtgctacagaaaaatttgatgagctcagggttcccaacacgtatttgaccacagaatcctctttttttgagaggagggagggtaacatcttttttgtcctgagaaaagtcctgatgaactgaggaattcgggttttatggataggatacacccctttgccactctctatacctgcattgtcaatagagtagcccttagcaagctgtgaccgctgaacacatgcagtgtttccatggtactggtttgtatctgtcttttaacattacacatcgtctaactggtgctgttgttaatctgtgtagttacggtgtcagtggctctgactgcagaccagggactgtgtctaacacatttctgtaatagcaagctgagcacagcgtgttggctacctgcagtcagggaatatttgttaggggatagaatattgtgttggtcctaggcctgtttgtgcccaggtccatttctcaccttttccctgttctgctctgggctgcaaaaaagccaatcctgcaggctgttttttctaagcttctgttctatttggcctctgcctgggtttggccaatgagaggaaactctggcaggagactgaatgttacagggtggagtaggaaaaatgtcctctctccagaagagtgacatgattaaaaagttttttgtctgttaagtaatgaatggaaatgctgggcttgcatcttacacaaacttggagttcaagaattcagatgaattaacacaaaaattggccaggtatggtggctcacacctgtaatccaagcactttgggaggccgaggtgggcagatcacttgaggtcaggagttctattagcggtaaatgtgctcagactttgtctgaaaatgtatttatttctctgtcatccatgaattagatttctagctggacagttattttttctctgtgttgtgtgttatgtgcagccagtctaattgctgttcatgtggttattctggtttttcttggtgctcacttgaggtctgagcacaaaggaatcaatattactgtagaaaaatgtttactgaatgtagctggaaaattacacatttaacattattttcagatatttcactttaaagaaaaagaacttcctaatctccccaggtagcctcctctgttattttactggacctattgctaacatttagtagagatgaaaccccatctctattaaaaatacaaaaattagccaggggtggtggcgtctgcctgtagtcccagctacttgggaggctgaggcaggagaatcacttgaacctgggaggcagaggctgcagtgagctgagatcgtgtcactgcactccagcctgggcgatacagcaagactccatctcaaaaaaagaaaaagaaaaacaaaaaacaacacaaaaattggtcactagctggtgatacccttagggtgactggccaaaggaatggtgcaactggcctggagggtcacactcacaactgtggctccatgagattccacagaaaaaccaagtctcattaaagatgagctcaaagtaaaaaaaaaaaaaaaaaaattacaaaaaacgggaaaaatccaccataaattgaaaaatgaggattagaacaccaagaacatatgacagtagaacaaaaatacacatggagatgtaaaatatatatgtttaacattactcaagacacataatgaagggcttgaagccataggtagtctattaaaagaaagaataaggagagttgaaaaagaataaaaatggcaaatattgtcatggaaatgataaattaatagattaaatagcagattaaacacatcctaggaattagtaaacctaaaaacagatgtgaagaattatttagaatgtagcccagaaagaaacagagatggaaggctgggcatggtggctcacacctgtaatctgagcactttgggaggccaaggcgggtggatcacctgaggtcaagagttcaagaccagcctggccaacagggtgaaccgtctctactaaaaatacaaaaaattagcggggcatggtggcgggtgcctgtaatcccagctactcaggaggctgaggcaggagaattgcttgaacctgggaggcagaggttgttgtgagccaagatcgtgccattgcactaaaaaaagaaaaaaaagatggaaaacataaaacggaagttaagagacacagaggacagaatgacaaggcccaacatacatctgacaggtagtccaggagaagggaatagaaagaattgagagaggtaatattgagattataatggctgagacttttctagaattgaagaatgatacaatgcctcaaattcagaacaatggcttctgattaggaaaaaaataaatccataccagaacaccaaggagggaagaaaaaacatgattaaacagtcagaaagaaaaatcagaataaccacatgaacagcaattagactggctgcacataacacacaacacagagaaaaaaataactgtccagctaaaaatctaaatcacagatgacagagaaataaacacattttcagacaaagtctgagcgcatttaccactaatagacatgactggaaaaactattaaaagacgtatttcaggaagaaggaaattacataagaaggaaaaagaaaagagatatgagaaatggtgagccaaaatactagtaaatgtgtaagaaatcaaaataatcattgactgtataaaacaacaataatactaagttggcaggtataaatacaaggtgaagttaaaacacaaaaatgtaataacatgaaagacataagagaatcattagagataaatcatcctccttgcattgatcagcagaaggaagagatattgatcaaaggcaaacaggtatgttaaaaatggaaaggtaaccactcaaagaacagacatagactacataatttcccaaccagtagagggcaataaaagaaacaaagaaacttgatcagtgcgacagaagtccctgtgtcagcagaacaaaaaggggcaaagaaaatgcctggtaaatagaaaatacataataaaatagatacaaataaaagtattaaattgttttaatcaatgtaaatggcttaaatctgtcagtgaaaagagaggctctggattaaaaatcaggtcatagaagtgttggaagtagtgggctagaaaaagctatccaaataaaaattctaaaagcaactggggaggttttattacaacagacaaattaggctttaaggacccgtatgagatggtagaaacattcaccaggaagaagaataattctgatcttatttgcaactaacaggaaagcctcaaagtgtaaaataaaaaaacaactaacaggaaagcctcaaagtgtaaaataaaaaactaagacccataccccacctccctccaaaaaaaagaaaaaactgacatatctataatcgtagtagagtttaatatagttctctcaatgaaaattaatgagaatatgaaagatttgaacactattaacaaggttaacatatgaacacacatacaagagactatacattctttttccatagaaccaggctgggcgtgctggctcactcacgcctgtaatcccagcactttgggaggtcgaggtgggcagatcacttgaggtcaggagttcgagcccagcctggctaacatggcgaaaccccatctctattaaaaacgcaaaaattagctgagtgtggtgacaggcgcctgtaatcccaactactcaggaggctgaggtgcgagaatcacttgaacccaggaggcagaggttgtagtgagccaagattgtgccactgcactctagcctgggtgacagagtaagacactgtctcaacaacaacacaaagaacccacagaaccaatttcaacaaacaccaaggaatcaatattactgtagaaaaatgtttactgaatgtagctggaaaattatacatttaacattattttcagatatttcactttaaagaaaaagaacttcctaatctccccaggtagcctcctccgttattttacttgacctatcgctaacatctgtgattgctgatgactcgatcctcatgagatcctttttcactcgtcttccaggtcaccacctctcctctcctcatatcctcccacctcactggtctgcccttccacggctcctttgctcgttcctcctcaactctccagacttctaatgtcgcagtgccctaagattcagtccttggaactttcctcgacatactcagagccttggtgacccagttcattctcatggcttatttatgtactgataggctcccaaatttacactccagcctgaacatcttccctgaacttcttcacacgttctgctgtatactcagtatccccattcagatgtctaaaaggcacatcaaagtaacatcaaaagccaaacccctaatcatctcccaacctgctcctctataattttccacctcagtggatggcaatatcatctctccagctgctcacgccacctgatacttctcacacttcacattcaatccacctgtgggatccctcttcacaatacatccagaccacttctcacacgtcccccatggctgttctgatccaagttatcatcatcttgtgcttggattactgaagtagctttccaatggatctcctggcttctgatcccttcccctctttaatctggcaaggcagagcagtactgttaaaacacaccagatcatgtcactcctttcattaaaacccttggctgggtgcggtggctcacgcctgtaatcccagcactttgggaggccgaggtgggtggatcacctgaggtcaagagttggagaccagcctggccaacatggtggaaccccgtctctactaaaaatataaaaattagctgggcatggtggtgggcacttgtaatcccatctacttgggaggccgaggctggagaattgcttgaacccaggaggcagaggttgcagtgaccggagatcatgccattgcactccagcctgggcgacaagagtgaaactccatctcaaaaaaaagaaataaaaataaaaataataaaaaccctccaatgggttcttctcactccaaacaaaagccaaagtttataaatagcccacaagaacctaaacaacctccttcatttcctaggtcacacccagaccctcgcttcctccttctctcctgctcttccctcttcccaccgcacaggcctccgcactattcctcaggcaccacaggatgctcctgctgcagggattttgcaggtgcaaaatctgcccagaatgatcttccagatatccgcatggctccctccagatatcctcacacccctccagtctctgcctgccgtcactatctcagagaggttttatctgagtattttattcaaaataaaatccctctggatccacctcccttgcagaactcccattcctcttccctgcttcatttttctaagatgctacacacttcacattctcattttgttcgttttctgttttagcctactcaaacaccagctccaagatggcagaaatttttgtcttataatttgccacatccccagtgtctgacacacaggagggcttcgataagcatttatggaatgtgatgtgaagatacactctgagcttcaggagacagtacagcagtgttgactacaggcagtcagagaaattgatgaaaacttcctggtaggtcctttttggtagacaagaagagtgggcaaagaagaaagatgagagatcatggctactatcaggttgatgttcccagaggaataattagtagtgggctgggccacaagacccacccccacactgtgggaggatgtggagactgagagacaagttatgaatcataggtatgtcgcaccatagttgggaagcactattccaagttacagtgcaagcaagaataagaagcaaacaagagatgcctaagaaaggagaggggaaagatctgggcagattccaggaggtaaaggacaaaagacaatctgtgatgacgaacacagagagtgcttgttcagattatgtcacaagtcccacaaaagtccttgcccatttggaggggagcagtgccggtgaacaatgctattctctgtgtgcccacttatgcggccagagtatcacataatggtttccagttatactgtagttaagctcagtgaaaagatgagatttttaacagtaaatctagatgaataaactgcattttctgaaggctgcctttttattgaagttttatcaggacactagaaagttacaagatattttatgttgtaaaagaatagcttttcatccacttggcaaatatttattgagtaccgggtagcatgcttccaccacaaagatatttgtttttacttttggaaatttaaataattactggacaaatttctaaattcatgtctttttgaggcctgtcaagttctactccattaggagctatgttgctcctgtaagcacaaaaaggaaagaagttgaaatcatattctaatgttgcagaccatcagaaagcaaactatttgcctatcagaaaatagtcatattctagaatttccaaaagcaactatattgacaagtgcaaccagataaagacaaattttattggttttatttttacttttgaatctactgtaaaaggtcataagcctaagacagcaatgacctcctaatgatagacaaaagcgcagacctggccccagagagcagttagttcaggctaaaatctgcattaccttctaacctgccagacttgtaccatgactcaattgagggagttaatgtgagatgcaggatatagactattataaagagatatgaaatagtagtttcatcatgttagaactttcaattctaacaataaaaataactataccaatatgtgtatgatgattttcaaaccctgatcaatcctccgaataactgataacagctctgacccctgctctataagtaaatagataatctgaagcttagtggtgaagagacttaccagataaattagagctactacatatctaaatctaggtaacttgattcaagtcttatactttccaatggcaggccatttaagatgatgcttacactgcaattactggagattccatgtataaacctaccaggtcctatgcttggtgaactgaattctaaaggcaaaaaaggtttaggataaatattctgaatgccaattagcccaaagcaatgaaaaagcaaacaaggcccttactctaactcttttttatgtctaagtgatataattattcccttacacacccttctactctgtcacacacacaattaggaccttgtatctaatagccagttccaaagagactgttccatgcactgtagcactttgtatcagtgcactgattactacagttctgtccttgggcaatacgggtttcatatgcacatatatattttttcttagtattactgaacagcttattacaccattaatctcccccaatggtatgttcatataactcatgttttccacttgtttatgactacatacataattggagactttgccccaaattgctgagtttaggacacacaaattctatagcactggctgactctgacttcaggtggctaatggatgaccaccggtgacacagggatcccagtggcaggttcttcggtaccttggaatgtaacttgaccagcttggattcatttaaagcagttaattttctttaccctccatcttgcaattaactgatgactgttctgcttttgtggttgggagttaagagcagctcccagttaatggaaagcagcatgtgggggtggctaagagaatgagttctgaagtcagatctggacttgagttccaactctactacttactcagacaacccaaagattagttcatgacttggtacacagcaaatatttactaaatgttagctgttatttctagtatctattatgtgtcagacattaaacttgtgctttacaaaccccttaagcctcatgtgcaatgtgggtattattattctcacttatacagaccaggctaaggctcggaggggtgagctagctgagacaggaatcaaagcaatcctcccactatacttcccactacactcatttatcgttctctttgaaagagtaagtgatttttgccttttgacaagcttaaaacatctctcttaagaatgtccttcataatttgttgttctttaaagcaaagtttaaaaagtgattctaaaactgattctaaaagtttatacggagaggcaaaagacccagaatagccaacaaaaaaattaaaggagaagaataaaactgaagaactgacactacctgacctcaagacttactagaaagctgcagtaatcaagccagtgtgatactggccaaagaatacacaaatagatcaatgaaacagaatagagcccagaaatagacccatataaatagagtcaactgacctttgacaaaggagcaaaggcaatacaatggggcaaagatactcttttcaacaaatgatgctggaacaactggccatccaaatgcgaaaaaaaaaaaagaaattgtctttaaaatgaaatatagacacaggtctctactgttcgcaaaaatcaactcaaaatgcatcacaaacctaaatctgaaacacaaaactataaagctcccagaaaatagtgtaagcgaaaatctagataaccttgggtttagtgatgactctttagatatgataccaaagacacaatccatgaaagaaagagttgataagctggacttcattaaatgtaaacactttcattctgcaaaagatgtggtcaagagaatgagaagacaaggcacagactgaaaaaaaatttgcaaaagacgtatctgataaagaactatttttcaaaatatggaaaggactcttttaacagttcaacaataagaaaacaaataaaaaaatgggccaaagaccttaacagatgcctcatggaaaaagatatgcagatggcaaataagcatataaaaagatgctttgcatcatacgttgttgggaaaatgcaaattaaaacaaaaatgagataccactacacacctgttagaatggccagaatctgtaacactgacaccaccaaatgctggcaaggatgtggaacaacaggaactttcattcattgctggagggaatgcaaaatggtacagccactttggaagacagtttgccatttacaaactaaacatactcttaaaccatatgatccagcagcaatcacacaccttggtattgattcaaaggaaatgaaaacttatgtccacaaaaaagcctgcacacagatatttgtaacagcttcattcagaattgccaaaacttggaaggaatcacaatatctttcagtgagtggataactgtggtatacccagacaacggaatattatttagcactaaaacgaaaggatcaagccatgaaaagatatggaggaaacttacatgcctattactaagtaaaagaagccaatctgaaaaggctatgtactgtgtgattccaatcatatgatattctgggaagggcaaaactatggagacagtaaaaagatcagtggttgccaggggatgggagggagggagagctgaacaggtagagcacagaagatttttagggtagtgaaaatactctgtatgatactgtgatggtagctgtatgtcattacccatttgtacaatcccacagaatgcacagcaccaagactgaaccctaatgtaaactacagactttgataatgacatgatgtaggtgcatcaattgtaacaaatgtactgctctggtgggggttgttgttaatgggggaggctatgcctgtgtcggggcaagggacatatgggatatctctgtgtcttcctctcaattttgctgtgaacctaaaactactctaaaaaatgaagtcttttaaaaaagtgattatgaagacaaataattttaaaacgggcaaaggatctgaatagacatatctccaaaggaggtatacaaatggccaacaagcacatgaaaagatgcccaatatcattagtcatcagggaaatgcaaatcaaaaccacagtgagatgtcactttatgtccactggatggctataataaaagtcagataataacaagtgccggtgaggatgtggagtaacagaaagccctgtacactgctggcggaaatagaaaatggtgcagccagtgaggcaggtcctcaacaaattaaacatagatttgccatttgacctgggaattctactcctagatatatatccaaaagaaacatggacatatgttcacacaaaaacttgtagacaaatgttcacagcagtattattcacaatagccaaatggttgaaacaacccaaatgtccactaaataatgaatgaacaaaacgtggcatatccacacaatgggatgttaatttggccataaaaaggaatgatgtacagctacatgctactacatggatgaaccttgaaaacattatgctaagtgaaataagccaatcacaaaatgctacacattttatgattccatacatatgaaatgttcagaatagacaaacatggagacaaaagattagtgcctgctcagggctgaaggctggaggggggcttagggaaatgggggtgatagctaaattgtacagagattcattttgaggtgataaaaatgtcttataagtgactgtggaaatggttggacaactttgttaatacactaaaaaccaccaattgcatggcaagtgaattgtatctcaatgaagctgttaccaaaaaaagtgattacattcagctttatccttctggatactattgtcatagagtcttgtccttgtttattatgttcagtctttgactccttgactcttctctgtgtgtcctttttacatagagaaaagcctgtgcaatctctgatttttcctgtgtttttttttctttttttttttttggacatagggtctcattctgtcactcaggctggagtgcagtggtgtgatctcagctcactgcagcctcgatctcccaggctcaattgaactgcctgcctcagcctcctgagtagctaggactacaggcgtgcagcagcaccactcccagctatctatctatctatctatcttttattttttatttttttttgtagagacaggtttcaccaagttgctcaggctggcctcaaactcctaggctcaggtaatcacccaccttggcctctcaaaagtgctgggattacaggcatgagccaccatcctgtttttgtttcactggtatgagtaacagttgtagtgccgaagttcattattaggagatggtggcaatatcagcacactagtgtagaggctaacagcatggacttgggagccagaccatggaccacctctaccgcttactagcaggttccacttggacaaattatctaatctgttttaatttctgtatctcaaaaaagaaaacaatgaagaggtaatacattcaaggaccttagaaaagtatctaaactaagaagtcctcaaaaaagagcacttttcctcttttatttttactggtgtgagagatggttgcagagccaaaatttcattattttttaaaaatcatgaaaatagcaaaataatctctttctcatataacctgtttcccatctttgtgagttcctttcactatccaacccttaactgctgatcttctaggaggtctgatcttcttcccaagtaatctcatctactttcactggttcaacaactaccaatatgtatgtcattccaccaggtggtgtacatctgatgttgtctatcttatctgaccacctgcttgacaactctatgtggacatcccataggtgctccaaactcctcttcttcccccaactctaattcttcactgcagttggtggcaccattatcccatcctgtccctcaagacacaaatctggaaataactgacttttccaccgacactcatattccatctatctccagttcctgccaattttccctcagaactccgtttcatcattttttgctccaccttgggtgcatatcagaatcatatgggaggctttgaaagatccccacgatcaggccgaacttcaatccatttaaattaggaccctggaaactatagatttttcaagtttcccaagtgattccaacatacagctgagctagagaatttctgacttagcccttggcctgcctctcaagcctcaacttttatagttcctggctctgtatttccattctgacgatactgaaatgcttataattacacttccccaccatgccatttcttgtctttatcatacactccaccatcctacccaccaaatctggcttattgctacttatcttatggacctggcagttgcttcctccagcaagtctctcgttcaccaatctatggctgaatttggtattccttctctgtagtccttaagtgcctggcaaatatctatcactgtgctgaatatgctgttttataattatctgcatatgggcctaatcccctcaaagaactatgtaccacctaagacaatggccacttgacactcagttttgtatccccagcacctgcttagccttatgtaaacacttcatacatgttagttgaataagtttccggagatgaggaaaggctttttggaaagaggttgtttgtgctagatgttgacagatggactggatttagatccatatctttctttccacccaagggcttatacgaccaccaacatgattaactttaacactgcttaactttgatacctccaagcattcactgctgtttcttttacataaactcttattttgtactaaaagtcttactctacatttgcaatgagtattaatttgtaagttccatccaatctttttagaaaaaagttgcagtaaaacttataaaaacacaagtctattaccctagattatgttttccttacttttgtgagcaacaatgtattaaaatcaaactttatttcacttttgagatacatatgattatctccaatcaaattatcttcatcttgaccacttatacatttattttgccccctatgatataaaacaatttgctggcctgttctcatgagactacattaaggaaaaagagacattccaaagacatttaatcatgactaaataaaaacaattaaaagtaagttttaaagaatgtttcaaaagaaatacacaatacaactaatatagtttgtgttcttttaataaacacacttgcatagttatattacaattttgtaaaaataaaaacagattatctcatgccaagcgtgcccagcatttgcacaatctcaatacctttaatactataattttcaagacacacaaaataaaattttaaggcaaaaacagcactttgcaacaatttaataatttattacattacagtagcatcacagcagcattcaataatgccactttaggcaaaagtctttcagtatttccattatagattctgtttacaagaattcataaactggtaaaagtcattctaagaaaacctggcaaataaagctttggactggaattggtatttctttctctacttttctttcccccagtttctttcttttaaactacagtatttatattttaaaatgttttatttcaaaacatttaaatatcagttacatttttaatagttatattattttaaaatgactctttaagataaagttttagagaaactatattatggatagggctgatttacattctcaaattttctaaaaatcagctttggttttagaactgatttttttcatttctggaaaacctaaaaggtttaatcaaataatttaaaagtgattattatacattgcaattgcaatctttaaacaggtattttgattctttacctcctacagaaattcaaatttattcagttgaactcacattttaaaattctatgtttctgatgaactctaaccttctaatgttgccttctaagcaaattgaaagctgacttatactgaatgaggaagagaacaaatacttggctgaatgaggtattgcaaaagacagcatgcacttttaagaaagacttaagttattatgtcatatgatttccattctttttatctttttcttaaatacatgacaaaatacctacacaaagagtggtatttcagttaatatagtaaatttattttccagactgacattcagcttaaatacgccagtatatgatttaatccataggtacctgatgaacatattattttcaggttggttacagatgctaaacgctgtctgaaggtcattcccagtaatttatatttatcagtgtaaaagtgaagtgatttgaactataaaaatacgtttgaaataattcatcaatgtattagataaactcagtttcagaattataaagaaaaaaccttagaccaaataatgtggctgattaacagtggtatgatttctaccccgagggtttaaaaatggatttaaagtaactgtctttgaactcaaaagaatgcaaaagcagcaagttcagaaaataaaaggcaagaacaggtaattaatacaatttgggagagtcagttgaattcacaaggacccagtctttgcactctttcagtgaatgcaggcaaatctgttattctatctgtaaaatgaaattattgctttcctattaatgtcatatttataaaagtatcatgaggatgccaaatgctaaaaatagaggtggtctagtaactagaaattgccaccctagggagcacacatacttatctccctacatcctaataatgtgatgtattttggaacacagacattataactttatgaagttttaactgttgattctttcccaagcatcataaagttatgatttaggcaatgtatgactgaaataattcattcataatgtataggcacattaacataaatattgcacaaaatatgcctctaactgaaactgagaggtacaaaaacatatttcactctttgtaaataactttgtgaggaaatatgactctgtgattgtatatacacttttcctgatactttgacattcacaaacagtagattgcactgcagtttgtaaacattttaagttgcataaaattctccttgattttcaaatatagtataatactgtctactaaaactcctttttgtatcaactaagtactctcacatatattagtttataataatgtttgttattattttttaaagtgttttccattccaggaaaagaagtaaattcttatgtcaaagtagccaatatggttgaagaacaggtattagagaagtctgatggtaaaatcaatcttagagcctcaaagaagctccatgaacacagaggaatgccaggtgttacacagctttccttcactctaattcattcttgactagagcccacatgtctgttttggggacatttaaactcttaaaggatttcttatgatatttactaaatacattaagaagaatgtcaaccagtgcccctttgtatactgggacatgtagtcacctgattaaaacaggtaacaatgaactctgactttaaaatggattaagatataaatgctctaagctaggaaaggtttttcccatctcacagtcaatgatgggagcctttcattcctcaaaaataatccctttataggtcatcgaaaaagaatacacacgctgcagcacatgatgcagtaccttcattagcccagagcacataaagatcctaagcgaactaccataggacagtgctcattcttgggactggaacaaatgaaacactgcacatacctgccagagcaggccactttcctcttctctgagatttaaaaagctcccccaaaatgttgttattcccatcccaaatacacagaaaacagggcatggctgtttccagttcttggcctttaaacaaatctaaatgtcagtactcatagtggcatattacaaagtaataaacagtgcacacttgagggcaaaccacatattgagctaattaagagctcactgtgattaggattagatcaaacataatagcagaacataagcaaattttatctgaattctgtaaatgaatacacatgttgcaataacattaaaaaagcatggcagcctattccaaaccagtaagaatagtttgtgcaaatagtgggtctttgtgtgtttgaactcccaccacataagggcaaactcaatatgcatgctaatgacctacaattatcaaattaaaaaagaagaaaaatgctaaagatgccagagtgaacagcagggaaagccacacaaagacccactatcctttaactttttacaaataaatttaaactgtaagttagaaacacaaaaaaataatcacaagtggctctaacattcaaacgaagtaaacgaattgtgtaggagatatttgatcagggctgcctgccctgcctccacgctagagtgaaacttggatagtgggtctctggggtgctttcacaactggaagacaacattgggtcctaaaaaaagaaaatgaggaataaaatgaacataatgcaaattaggtgggtgagataaaatttgactagtaacaacatgcaacatcaactaaacaaatttgaactgttaaaattctctatcttaaaaaaagttctaattatgtaacaaaatgaaaaataatacttaaaagggccaaagaaacacaaatggtaatctataatttaactagctttcattgactattacaagaactacaaacaggtgattcatctataaaaagctgggtaggtacaacaaggatctcgtatctattcctgactttaaggattaagcattttctgaaccatatcctattaaaattataggtttatataaacaatgtgagttcatagctaccaacacaattaacattaatcttcatcttctttgaaaaagcaattatgattcttcaatttctgataaataattacttcaagtaaacaaaatcggtacgcctcactttcctagataatttaaacagttgttttatagaaacaataaaccatctcagaggaacctctttagaatttatccttagaattacagaattgagagcccttttattccaggatagatgacaagcctttagccattcatttaggcaaaacaataaaagtattcagtttttagatctgattaaactaaaaaaaacccacatatacccgccagaaacaaggtaataggtaagttactggtaataactttataacaaagagaaattcgaaactactcttattttataaaataacctcttgaacattttgttttcccagctgtcagtatgtaaaatgaccaagaaaatgatgagttcctccttgcatccccaacatttgcccttccagcaaacaattagtacttatccttcatgtaccagctcaaatatcttctgttgtatctttcacaacatgccttctttctccacaaagatttagggggtctttttccaaaacatatttgtataaatattcattgcagcaattgttatatttatctgaatgttgttccccactaacctctaaagctacttcagagaatggattgtcttgtcttgtttgtattcccagtactcctagtcagtacagagtagacactcaagtaataccaaatgatgaatttcttaaatgaacagtgggaagaatgttaacatagaatccaaaaccccccaaaagagtaaaacctgaaacacataggagctataaaatcattgcgtaggtcaataatgaccgaaagacgattattctttttcttcttattttaatctttcaatatttccttgtttgttttgagacagggtctcactctgttacccaggctggagtacagtggcatgaccatggctcactgcagcctcccacctcagcctcccaggctgctgggactatagggatatgccaccacactcagctaattttaaaaatttttctgtagagatgaggtctccctatattgacgatcagtcttcctgcctcggcctcccaaagtgttgggattataggtgtgcgccactgtgcccagccctgctatttccatgttttatttcagggagggcttgcattacaattggttgtcttctagaggcatgctgtctaatacaggagccacaggccacaagtggctatttagcttaaaattaaagttaaattaaattaaaaattgagtttctcagtcgtattagccacactccaaataatcaaaagtgactagtggccgctgtattggagagtggagatatagactgttttctgtattgcataaaattctactggatagtgctgtttagattgggtatctctctcaactacaggcagactaaggctctgccagttccacctatactaaaatagcagacgaagcattttctgggcaaaagtaatttgcatgacaaatgtgtccttgaataataactaacagatgatatcaatctattttctgtatcattagtgtattaaacatttactgacaaccagaaactatgctgcttctttttggaataaaaaattgtcactcaattaactctctgggaaagttacttttctaggagactgttactgccttgaagtagatttctctagagtaatttttaaattatctgcagaggggaaactgaaaggaccttcataaaataggcgggggaaaggtataagacctggggccatggtcctgtccttcctttcaaacagcttttatctgttctttatattccctattctatgaggcttaattggaaaaagtgtttcaaaccacaacaacatattcagaaaaccatcactttagatcatagatgctatagaagccaaatgtactgacacaccggcatgccttcagggatcactagccaaagatcttccaaacccagtaggtctgaaaagtcttttccattctcaacaccaagaaagatgccacagctagttagataaactggtttctaattaatcattgtgaactgccaaaccatcagcagagcttaaaaatgatcatttattaggcaacccaagttacaattttctttatcacttctgaaaccctccaatatttttgggactattcaaatcacaaaaaactggattcctcccatctccaagttgggaaacttagttgctttatgtaaagggaaggtttctcccagggtcagaactatctttataagctctaaagtgagaatgcacaaaattatagatatggtataaattcataatccttatactgaatcataagtgtatctgagttttgtttgggttaccttttatatattctcagcaactgaatttaaatgaaaggctaagtattttaaatttcataagagatatatcatgagatattttaaaaataaaactaaaaattaaaagagtgggaaaaagtgacaatcatttcataaaggtaaaaagttatttccaagtactattcattccctaatttattactaatgctatatttactgtcaaccaaaagaacggctagataaatacagagagataattttatatagtaccaaacttcacacttcgagatctggacccttgttctgaaaataatgaaatagaccttgattgatacatcccttgtggaaaaaggtgactatctaaagaatcacctgacaagaattttgcaacagtcaaatatttaatttttaattttcttccaacatggatgatatgtaaacagcgagaaataaatgagaaggttagaaatgtaatggcttctgtacactaaaagagtaattttgaataggtgaatagggtaattgctggctacttttttttttttttctcttgagacagggtttcaccttgttgcccatgctggagtgcagtgtgtgtgatcatgacttactgcactcttaacctcccgggttcaagagatctcccacctcagcctcccaagtagctgaaactacaagcacgtgccaccacacccagctaattttgctattttttgtcgagatggggtttcgccatgttgcccaggctagtctccaattcctgggcttaagggatcctgcgtgccttggcctcccaaagtgctgggattatgggtgtgggccattgcgcccagccactagctactttttattaaaccaaaaaagaacatgggacactgaaaaagaggatgatagtaaaaagaagctgcagtatagatggcagtcataccaaagaactcataggaaaaattatatactctcagattaagtctaatacgaaagtctggagctagcaagtatttaaaataaagctgtataacttctgaccttgtaaaaagtttccttttgtttcttctcactttaaacactaatctacatttgctgtgagtgctgagtttaagatctaatccagaaaaggaataaatgcagtgctgtatattgaagtttcacactaggtgagagaaaaataatttaatattactcacactgttgacttggatctgagtctgtcgtcatcttaacgtagtttgaaggaaagagaccagtcaccccgttgatctctccttgccaccaatcaggatcatctttgttcataacattaatgagttgtcccttggagaaactgagctcatcttcattatttgctgcatagtcatacatagcaatcacctgacatactatcacaagaataacaaaataacacattaaacaaattaattattcctgcaagggtcaatcatttgtaatctccctaggatttaaattattttaatattaaatattaaaattaggctaaaatttcccttgaactgctctttctcaccctccttcccctattcctggtcttacaaaaacaagaatttcccaactgcagttaacaatccaagtgaagtacttcactttaagtatgatggtgtaacaatttcacattgaaagatttcaaagagtcgaagtggttcaagtatcagtgaataagctggctgttcctacactgaacttttcagaaaggaaattctcagtggcatgtcccttttaagcagacataaggaaagaacacatttttaatgttttccaaagattgagctaatctaagaagttgctgagttttaacaaactcctctaaaatgaaatacaaattaacccacttccataccaggatgaaaggcaggtgtggctctttcactacttggacccaaaagtttaacatgactggcaggaaaccatcctttctgtcgcttttttcctctggcctaaaaattagcaaaagaaatacataattgaaagatgagattaaaaacaatcattgagacataacttaaaaattagaaaaaccataaatgtgtagtaaataatttaattttgcctaaagagaggtctggtttttgccctcagctcctggaaagtaatctctaaatccttggactatcctgactggtcagagtgtcttagtttacctgtgggtactgggtcatgccaaatctaacaatgtgatgtgctttgggtcatgcagtatcagctctaccttggtaggggatggagactgagttcagaaaaacgggcaatcaactgtatctatgtgaggaaccccagtcaaaactgcacaccaaggctttgctgactggcaatactctgtgtgtattgtcacacatcattgccaggaggagttaatactgttcatgactctgccaggagaggacaactggaagctctgtttttggaactctactgcactctgccccatgtgtctcttcccttggctgactttaatctgtatcctttcattgcaataaactgcaacatgagtgtaatagctgtagtgagttctgtaaagtccttctagtgacttacagaacttgagagtagtcttgaagacccccaaatttggaattggtttcaaatatgagcatgatcttgggggcctcgaactcagcattagcctttcaagtaaacattaaacaactggaagacacactaaaacatgcatctcaaactactgctgaaaacagcatctgaagaagtctatgtggaggtctttcaggctcagagttctcggaatatttcacaaaaatatttatattctaaaaagacatttctagagttctcctaacccttaaaatggtgcagccgactacaaatacttcttggagctttgttaatcattaatcaggaggtcagaagtaaaatttgtaaagagtcatgtttcccacttagttcggtccatcttcaaagtaaatcagaaggtggaatttcagggggttattcaagaaggtattaaatttgaacccccatttttcttcaggaatcctaagactcctgatttgcaagaatgaagctatgtttatcctccatactacaattatatatcactcatataaaaatatagctattatatctcttgtcatcttttaatccctaaaatgctttttagttttaactagtaaggaaataatagaagtgagagaagaacccttttcctgtatcaaaacatatgcaataaccatctattaacgttttagggaaaaaaaaaaggttcatctatgtctgtattgtctttaattgcactgctgtttcaaaaacctaagaccactagcggacagcccaattagtagtattttctcagcacaccatctagattatgtctttctcctagaggctatactgcaagcctgggactatcccagggaaagatgatgctgtttctttaagaacatgatctgtgaattataaaggaatgcattattggaaaacaattatgtctttggagaaaattattccttaaattgttacttataacatcaactcaactgtgctaaaaatgtacacacaagagactaaaggaaatataatgcagtaaaatattgatattgattacctctaagtggaatgattatgggtgatctaaaaatttttattaattttatcttttttatggagcatgcagtacttttataataaaatttatagatgctatttaaagaatattacctgtaactctccttgccaccacccacttgtatttttctttagaattaatattaactgtcctggtgcaaggctaagttgttcagaaccagaagcaacatatgctgaagttacctgagcaatctctgaaaagacaaagaagaaactatgaattcaagattgcgacagagcaaacacgttagtaattttttaagatcactactatacgtaccaggttttttatttgatgctccagacttgctagcactcccaaaactctacaaggaaaagataccgtgttgttttattatttccaacaatccaaatgtaaaagtataaaggttaatgggaattagagatttcaaattcccaggattcttttctctttaaatgaagatgaaaatgacaatgaacctcatgcagtattaacaaataagtgaaaaatccaacacttatgaggagatctggtctgctaatgtaatacattatatacgagtggctgtcatcgtcaaccattgactcaacaggaagagctcgttttctgaaacctaaatattaaacatgaccctccaggccaaatgcactccatttatcaatggcgttagcaccaatgcccactatgcacaacatatgtgtcctggatatgtcaaggtatacgttattttgctcctgctttctctaagggatcctgacttatctatggatcttgatgaacaggagacaatgtttttatttttatttattttaccatcctccccccaaactgactgaatctgacctaagaacaaaaaatccctatcctgtgtagcaactattacttctgtttcactttaaaggataaactggcccaaccacatttcctctttataggaatttgaacaacaaaagggatgggattaaaaagaattttgttctgttagtgaacatagctgcagtacaagtattaagcagagtggatggtagttaaaagctaacattttctgagtactgtataacagacactgctctaagaggttccatatattctgctatttaattttcacaataacactattaagtaattatgattatccccattttacagagaaggaaactgaggcacagaaaggtacagtaacttgtccaaggtcacccaggctctaagtgttacagctaagagtcaacccaggcagtctgattctactacaccaatggctctcagcatgtggtttgtagaacctggaaatagtccttgagcctctttcaggggtctgtgggataaaaactatcttcataaaaatactaagacattatttgtcttcttcactgtgttgacatttacagtggtgggtaaaatcattggtgctttagtgtgaatcatggcagtggcaccaaatgacactgaagtatggtagtgttcttcaccgccatgcactcacagtaaaacaaagccagtttcacttaataatgtctttaatgaaacagcaaaaattttattaaatcttaatcttcaagtccataccttttaaaagttctgtgtgactaaacagaagtgtgcctaaaacatttgtgctgcatactaaagtatgacggttgtcttaaggaaagtatttgtgtgactaaattgtccactcaactaggtttttcatggaacaacatttttacttcaaagaaccaacagaaaaactatttagacttgggatttagcgaacattttcttaaaaatgaagtaagcctgtcccttcaaggaaaacagctggcaggattttttgccaatgataaaattcaagatttccagggaaaattaaaattttagaaaatttgtacctaccactatgagtctgacagtttcctagtattgaaaaacttttctgatgagtggtggtattaacacatacgatttttcagatactgtgtaatgaaatgtgtccacacagggaatatctgcataactcagtgattcaatattttccaaataaacaacaaataatgttatcacatcatgcacgggtaaaagatccactcaacatgcaaaacagactagtgaattttaatgtaacagtaagaactgttcaccgatagggcttcagattccatgttgcaactaacctataacgattcagcatttgtcaagttttagtgtggtagaataaaaaagaacattggtagatatctgcaaatgctattaaaatacttcttcattttctctcatgtatgtgtgaggatgaatttttttatacttcaaccgaaaaaaaaaatgtcaccgactgaatacagaaacagacatgagaaagtagctgacttaattaagtcagactaaagagatttgcaaaaatataaaacagcctgtaatcccagcactttgggaggccaaggcaggtggatcactggaggtcaggagttcaagaccagcctggccaatatggtgaaaccccgtctctactgaaaatacaaaaattagctgggtgtggtggctcatgcctgtaatcccagcactttgggaggctgaggcaggcagatcacttgaggttgggagttcaagaccagcctgaccaacatggtaaaaccccgcctccactaaaaatacaaaaattagccaggcatggtagcggatggctgtaatcccagctattcaaggggctaaggcacgagaattgcttgaacctgggaggcggagctgtagtgagccgagatccagcttgggcaacagaactaaactccatctcaaaaaaaaaaaaaaataaaatatatatatatatatatatgtgtgtgtgtgtgtgtgtgtgtgtatatatgtatgtgtatatatatgtgtatatatatatgtgtgtatatatatgtgtatatatatgtgtgtatatatatgtgtatatatgtgtatatatatgtgtatatatatgtgtatatatatgtgtatatatatgtgtatatatatgtgtatatatatgtgtatatatatgtgtatatatatgtgtatatatatgtgtatatatatgtgtatatatatgtgtatatatatgtgtatatatatatacacacacacatatacatatacacatacatatgtatgtatacgtatatatacgtgtgtgtgtcttgctaaactttgttttcatgataaatacggctgtttttcataaaagcacgttatttatgttaccatgtaatggatttaattattgttattttaaaatgaataaatatataatttcgcttttcaaatttctgatacggtaaatatcattagctatactgaacatactttaaaaaagcctatggggttcctcaataatttttaagactgtaaagttcctgaaaccaaaaagagaacttctgcactataccatactggtggtggatgaaatgaggcaggagctcatgtaagctgagtcacattaatgttacagtcttaaagtgaaaattggcgaactacttcaaggtggtcctttttgtgtttctctgaatccagatctacttcctagcagttatcatgaagctcaaccctaccctacaactcttgttcttagaatttcatgaaatcttgccccctttatctaactggagccatataataaaccctattttaccggagctactgtgaacagtttctttgtaaccaaagcaacctgatcaaaaccataaacatgatctctaagtataaatcttgattaacaagaatgggttgattttatttttaataccaaaataatttaagtataaacctgattaaccagaatgggttgattttaatatcaaaatacctcttgatcctttggtttgacatagtttgatggaaaaattccacttctatctccaatacttcctgtccaccactctccatctttctgggtcaccaatatttcttcaccttctgtgaaagtcaaatctccaggttccacacttgaatatggataaagtgcaatatattctgtagggaacaaagcaaaaagaagtagattctggttttaagattacagaagtgaaaaagaaattaggttattctccaagacattgtataagtttgctgtaaaagaccttgtgccttcaggaaacctaacataaaaagatctaaaggtagaaaaaggaacgaagcaattatttaataattccttagaaaaaagttatttgacttaacataaaactttagagtttcttttattcccaattgtttatttttttatcacaaagaattacccaaaactacaaacagataatagtatctctatagataaatacactgaggcttagtgagattaagtcactcagttattcagataatggagtcaagataggaaaatatattttttaacttttttataccagaaatagtttaatctgctatattattttctctttaattcttttaagtacacagttatggaaacactcaatacccagaagacagcagcactagaagccaagctccatcctgatgacccagctcctagcacagtgcttgacttggagtagacgctcgataaatagttgttaacaaatgacctcaagggaaatatctaaatttttatatcgcctttgatttttgtttctgtgattgtcactgcttagaagaaacagttggtgacttggttttctaagtctttttctttctttctagttttatttatatttggccaacatggaatttgatcttaatatcataaacttgagacgatgagaaacaccacctacaacctatttactattcgcattcccagtattactcaattaatttaacaaaattcaaagtgattacaaggtttaggtacgctgcaataaaagtcgggtcctttccaacatgctcctcactactttcctaggctcagctcagagcactcattccacagtacacctatgattcagcttcactggtgacatgacgttcccccgttccttggctcatgccattccctctgtctagaagtgcattctcatcctttgtcactctgctagatcctactcattgtttaggatgatgcaacactgccatctctgtggattcatatgtcctactctaaattggttttgttcgctcattaaagaatttatcacaactgtatgctccattctattgtgagcactttggaaacttttattcatccttgtattttccaggctctagcatagaatcttcaacgtaacagatactgaataaattgtttaacattaaactgatatttttagcaaaacataaaatgtacctcaactattcaactaactttataatggacttatacatttcatttataaatgtatgtaactattaaataaaaatatcctctgaaattagggtaatctttcatttttcaacacattaacaaaatcaaaataatttactaatcaaacaacccaaagggatatagaaaaaaattctttgcaatacttatgataaagtataccttggtcctccttaatgattcatatggtacattgtaattaaaatgtataagcaatgaaatgtattgaaatttccttacctcctaaacatctataatcaataattgcaacactttttatttatgatgttattcatcaaaccagtctatgctgaattttcatagcactgcctttctaaagtgccaagtattttcacccatattttttctatattctcaatattcatgtgaaatagataggggcaggttttcctaatctcactttaatactgcagacacagaaatggggagaatatgcaactatgtgaagaacagcaactatgtgaagtcaggtagttagtcaagagctaaattgattaccatctaatttacaaattgccaaaagcttaccttctccaactgaataggctgccgaggtaggtttcttatttacagctgcatacaaagcttctggtctaccaaatatataaacaaacaaacaaacaaacaaacaaatacaagcaaaaataagaaaggtgatttgatgcacagcaggttttagtagtgcattttttagggctttctcaaattaaatatagtcttagtacacagaactgggaagacttatacacaacatcctgcaggattaagaacagcctaattataaacttctacatttttaaatatatttttaaaatttcaatatgatttacaaatagtttttcaaatgtgagatatttcgcctttctaaagaaacttaaaagacacccacaaattgttaagtggtaagcacatatagggcttagtttagtgtaggaaaaaataaaggcaatatatacattttattatttgtttagaatgcactacattaaaaaaataaaaataataaaactttgtttttattatctcagaacagctataacattaatttccattttaacccaggaatctgttttcaaaaatctagaagactgtcctgtttaactagacacctgtgggatgcaccaggcctccctaggacctgtgagtaaattacactgtgaggcagtttttaaataaacagaaggggaaccttattacaactactggtcacaactgaatggactgtcttgtttaatgctaaattctccattactgcaggttttcaagttatatgccttatctgttagaaaacactagtaactgaatgcatagttagaagaaatgccctctaaaacactgaaacaatctgtttttgcttaagttttcttctctgtaaatgttatggacataaaataagacaatttctataaaggaattgtctataaagggcctagcacagtgcatgcatacaaatgccagctatatatggttgttgttactgttattatattcttctaaatccaaaattcggccaggtgtggtggcaaacacctgtaatcccagcactttgggagaccgaggcgggcagatcaactgaggtcaggagtttgagaccagcctggccaacatggcaaaaccttgtctctactaaaatacaaaaattagcccggtgtggtggtgcattcctgtaatcccagttacttgggaggttgaagcaggagaatcgcttgaacacaggaggtagaagttgcagtgagctgagattgtgccactgcattccagcctgggctacagagtgagactctgtcttgaaaaataaataaaaagggctgggcatggtggctcacgcctgtaatcctagcactttgggaggccaaggcaggcagatcacctgaggtcaggagttcgagaccagcctggccaacgtagtgaaaccctgtctctactaaaaatacaaaaattaggctcatgcctgtaatcccagcactttgggaggccaaggcaggcagatcacctgaggtcgggagtttgagaccagcctgaccaacatggagaaaccccgtctctgctaaaaatacaaaaaaatttagccgggcatggttgcacatgccagtaatcccagctactcaggaggctgaggcaggagaatcgcttgaacccgggaggtggaggttgtggtgagctgagatcgggccattgcactccagcctgggcaacaaaagcgaaattccatctcaaaaacaaaaaaaaacaaaaattagccgggcatggtggtggatgcctgtaatcccagctacttgggaggctgaggcaggagaattgcttaaacccaggaggtggaggttgcagtgagccatgattgcgccactgcgctccagcctggccgaaagagcgagactccatctcaaaatcaatcaatcaatcaatccaaaattccatgtcaggctgaaaagcaaatttttagaaacagcactaccttccagaaacacagaaactcagcagtgaaagggtctttaaagattatttggcttaaccttttcattcagtcaattagaaaactgaagattaagtaggttattccttacagcctggcaaaaatagcagagccaaaactcaagcctcttgattgcaaaagaccagcatcttttcatcaaatcagactgcttttctaccaacttccatataaaacacaagagacagttacccatagctatattatagtacttatttccttgtattattatattcgacaacttgactccctacagagtaggaaataaaggtcagagacctatctagtttttagcttttttcatttgaaaattcattcaattgttcattcattcacgcctctcttcattcactcagctaatatgattgagcagctactatgcatgaggattagaacaggcatgaagaaactgaaaaatgaacaaataaaaaaaaagacatgcatcccagcctcattgagcttatgatctaataagggacattggtttaaaaaaatcagtaactataatgcagagtgctataagcaataagagaagttatattcagggaatcttggagactcagaaatgggaatgccccaatttggcaaagaggaggccctcagtaaagagttacttaaatattgacaatttatagtaaacaggggagaaatgcttgaaagaaaatgaaaagtaacttttctaactgatttatggtacaaagaagtggccaggtgaggtggctcacacctgtaattccagcactttgggaggtggaggcaggaagatcgcttgagcccaggagtttgagaacacagcctggggtaacacagcaaaaccccacctctacaaataatttaaaaataagccaggcatggtagcgtgcacctgtggtcccagctagccgggaagctgaggtgggaggatcgcttaaggctgggtggtcgaggctgcagtgagccatgatccaccactgcactctagcctaggcaacagagtgagaccctgtctcaaaaacaaaaaaagcaacagatctataattttgagtagcttgaaaattttatgaaatctgaaataactagaatgaaagatattctaaactgaaacaaatacctgaggtatgcttttttcatcctaagaattacctttcttttttctttttttttttaatacggggtatcactctgtcacccaggctagagtgcaatggcgtcatcttggctcactgcaacctctgcctcctgggctcaagagattctcctgccttagcctcccaagtagctgggactacaggcatgtaccaccatgcccggctaatttttgtattttttgtagagacagggtttcaccacgtcacccaggctggtctcaaacccctgggctcaagtgatctgcctgccttggcttcccaaaatgctgggattacaggtgtgagccaccacggccggccagaattacctttctgatattcaaactcaagtataaaattgttattttattatacactcaatcagaccatggctgactcattagtgaaaataccaacatccacatctcatgaaaacacataaagatgcttactcttcccgttttacttcactcccaggaatgatcttgacataagatttgggaaaccatcctcttcctccatgcacctccccaaaccaccaattttcttgctgctccaagacagtaataatgtcatgttttgagaagttcaagtggttatctttctttgcagtccaggaacaaagggcctgtgcttttaagttttctaccacttgtccctatgaatacaaaaccaccaaaaatttttaaaaggcaatggtaactatgatttctgtttctgtgtatataacatacttactgttcaaacagcagaccagttttgtgtcgtggtgacttaagataaccttagtctactaactgactttaaattatacatgatagacaactatgtgactagccttctgttaagacagactgaaaacccaccattcaaagaaacctcatcacatcactggtagagaaggtaaataatgtgtactcaagaaatgtattcacacatccatgaaatacatatcatggaacaaatgaaaaaggaatgttactgtaaatcttttttctcttccagcttgcaatgtaattctgtttactccactagggaaggaaattggcatgcttggctccctctgtttctctgcttttctcttaacttcctcctattctattctattcattcttctttctttccctcctctctcaaaggaaggagtgttttgttcctttaataaggctaaactcttcacttattctccaagtcttctattataccctttcattttctaaaaatatttaagtccttctcttcaatctacttctctacttgcttctacttctgaattccttaaatgatagtcttaaactttttttccaatttcactccttgatcacttctaatttaggttcagcactcatcacactactgaacctcttccagacaaggttattaataataacatcaaagccaaatgcttcttccaaacccttattcctcttgatctctaaacagctaacatcaagccttgtagttcctgaagctgactctctggtgattgatggctcctcttttgtccaacccttttcccttactgttccacaggacttccctaaatactcttaattatgcctatgacttctcaaacctatattttcagtgtaattttatctcctgatctccagacttgtatatcaaactgcctactgggtgtttctaccaagctgtccctaatacacatagcttaaacttagcatggctgaaacataatcatttttagaacctaccaaacccattcctcctgcactgtctaccaaagacaaggatactactatccttttggttgctcacgctaaagactgaagaattatctttaactcctatttcttcctcactctccacattcaatggattatctatttaatatcatttcctaataatcttctaaatctatctcctctttcttatatcttaattaccatagcacttgttcaaaccatcatctcttgttatttagctattgtaatatccttccttaactggttgttttcttctgctaatccagactttatgttagtgccagaattatctttctaaaacatacacaataactccactcttaaaaatcctcagggactttccactaccaagttgcctagcacggtattaaatgcttcccaaataaacctcaacctctctctccaacttcgcttaaccctttctccatgaatcctgtattccagccatattattaacaatgcttgtttcctgcaaatatcttgtgttaacatgccttggtgactttccccaaattgttctttcatgggaataactttccttctttgttgggtgaaatcttatctttgaagaccctactcaaataccttgccctttgtgaaggctgctccaattctcaccaattgagtaagatgatctcttctatatataccccctacagaccttgtagatatctttaatacagcatttctcatgctttacagttatttatatgtctgtcatgttcattagattatgatctactgaatggtgagtttctggtttttaaaaattgttttagagacggggctcactctattgcccaggctggagtacagtgatatgatcataattaattgtgcctcaaactcctggtctaaagtgatcctcccacctcaacctcccaagtagctagtactacaggcacatgccactatgcccggctaatttttaaattttttgtagagatgaggtcttgctgtattgcccaggttgatcttgaactcctggcctcaagcaatcctcccatcttggactcccaaagagctgggattataggcactgagtcactgtgcctggtgtcaatgtcaggtattttttgacttattttttccttaaatttctagcacataataaaatgcctggaacctatggccatggcattttttgagtgaaggtgaaatctggaggactttggactttattctgatgaagtctgcaatttaaaaaaataatgttaatgtaaccctattgcaatagttatatctaaatcagaggctaaatatacgttaaaaagttctaacgttcccaaataactttaagaaaaaaaaaaaaaaaccgtcaagcccaagtctctcatcttcttattataataactacaaatcaagaacaatatatcatgagatttgtaaaaataacattttgagcttagaaaccttagctgctagcaacttggtattatggaaaagaattgttgagaaacctaggccgggcgcagtggctcacgcctgtaatcccaacattttgggacgccaaggcaggtggatcacctgaggtcaggagttcgaggccagcctggctaacatggtgaaaccccgtctctactaaaaatacaaaaattaggcatggtggcaggcacctgtaatcccagctactcaggaggctgagtcaggagaatctcttcaaccagggagccggaggttgcagtgagccgagactgcaccattgcactccagcctgggcaacagagtgaggctccgtctcaaaaaaaaaaaaaaaaaaattgttgagaaacctctaagtaatagtcatttcttcaacttcacatcacatgtgaataagaaagaaactgaatgctacaaactctggttaaatgagtgaatggtcctttgtatataattttcattctattttaatcaggagcaaattcaaagaataaagcccacaaaaataacagacaacatacctgtccatgaataggtgatacagatccaggggacacagttcgagtgaaggctgattttttctgccatgatgtatttacagttaggtttgaaaaagatacattttgataatcagtcactgatgctggttgatttgaagaaagtggtctgcaaatataacactttgatataagtatatttatttgtttagaacttaatgaagtactaccaatttatcaacttacatattatatacactgtgcttacacacaatttgtgggaaaagaaataattattaacaaactactgacccatgttttcacttactaaatttcagtattaaatctggaacaaaaagtagtcttgaagagtacaacccggattacactatgatgaagtagtaggctgacaccattatatattaggtatttacacatttgcagatctatataaactttactgttagctaaaaacttactcagaggaagttgaggtagcagataaagaaactgtaggaggaagtaaggccttctttggagatacagctttttcattttcacttgatggcattttttctacataattgcatggaaaccagccaaaatttccttgaaaactaccataaagccaaccaggttctcctacggttttttcatcaacctacggaaataaaaagaaggattaacagtgcttagaaattcacacatttacaatggaaagagatgaaaactattgtatagtattctcattttcagaattaagcccatctaactaaacagctaaggcattttctacaaattaacagctactatttccagtgactggcaagttgtctttttaattttaattttatccaagttacatgaaaatattttacaaagacaaatagcattcattatatatggctaatgagggaaaacaatcctcccctatctcatggctccttatgccctgattttcactcctgacctgccattcttcctggtttcttctatatcaccatttatatttctgaataacatatttatactgctttttcttgaattttttcaattttagacattactggcttttggctatgggaaatgaagattgacctctctttcactgtagcctcttactctaccaatactgttatagcttaatctttatttaaatttatttaatgtttataatattatgattatgtttaaatatttcacatctgagtcatgcagcatgctgctgattaaatttccttttttgtaaactttttattctcctataatcattactttttttgtttttggcttacttttttctgttcctgttacacagtttttttgaactctctaacagaacaataagatcttctctgaatactattttccaactggtaaacatgtcaggtgatttatcaatttcattgcttctcccagacattttcatcctacagtgtgacatcctccatcctcacagtgtttctccctctgcttcttggtccttgttccttaaacactaaggacagcctcaagtttcatcactggctttctttcctcattctatacccttcctgaataagcccacttactcctatagtttgatcagtcctctgtgcaataatgaatccaagagctatgatctcagtgctgacttcttcccgaagcaacatgcctatactttcaactacttgcaagatatcttcaagtggatgtcccatgggaacttccaagtcaactttaaaactgaacttttctcctccatcccctccttctcctaaattcctctattattcacaccaccaaaaatttagtcattctaaataaaaaatctttggctcttacctcttttacacttccacatccaaactactgaatttgtcattaaagactcttctaatttgtcaacccaccctcactgccctacttcaggctttttttcatttcacactcaagattattatgatttttactcatccttcaagattctaacttcccccaacccaagccagagttatttcatacataactgtcataattagcattatatacattatatatgcataatgacacttaattatgtagctaatacataagtatatgtacttactacagataaattatttatatgtaaataatgacttatttacatatctctcttccatttgtccgtgagctttattgacccccactgtctagcatagtagaaatcacttaactcactgaataaatgaatatggtagttgtgtctctgttctccaatccattttccatacctttctaaaacacagacttgacagtgttatatatctattaaaatcatgttgaatccattcatatttttaaaaactgctttctcagatatcattaatataaatttcatgtttaaggtgttaaatttgatgttttgacatatgtatatacctgtgaaaaatcaccacaatcaagatagccaacacttccatcacccccaaaagtttcctcttgttccaccataagtcctccagcttgcccctccccatgaccttccctgccatctctacgaaaacactggcctgttttctgtcctatatattagtttacattttctaaaattgtatataaataaaatcatactatatgtatcctttttgtctgcctttttccactcaaggcatccatacagtaagaacagtttgttctttttttattgctaagtaatattatatcatatgaatataccacaatttgtttatcctttcaaatgttggtagacattaaagttttttctagtttttggctattacaaataaagctgctatgaacatttgtcttcatacggacatatgttttcaattctcttgtgtaaatacctaagagtggaatggctgagtcacatggtaggtacatgttttaacttttttaacaatggcttatggagatataattcacattccacataatccttccatttacagtacacaattaaatgcattttagaatattcaaagagttacagaatcattaccacaataacttacagaactgttttcctcaaaaagaaacactaggctgggcacggtggctcatgcctgtaatctcagcactttggaaggccgaggggggcagatcacctgaggtcgggagtttgagaccagtctgaccaacatggaaaaaccctgtctctagtaaaaatacaaaattagccaggcatggtggcacatgcctgtggtcccagctactcgggaggtggaggcaggagaatcgcttgaaccaggaaggaggttgcagtgagccaagatcacgccattgcactccagcctgggcaacaagagcgaaactctgtctcaaaaaaaaaaaagaaagaaagaaagaaacactatttattagattgtcatagctaagaaactgaaaaactttgagtaacccgaagttgttaagattttctctgttttcttctagaaattctacagttataggttcacatttgacatcatattttacctattttgagttaatctgtgtatatgttgcaaggaacaaattgaaattcatttttttgcatatgaatatccattgttccaataccatttgctgaaaagactgttctttttccactgagttgcttttgcacctctgtcgaaaatctgttgtttatacacacacacacacacacacacacacaaacacacgtagcatgaatctatttacctactctgttccattgatctattttcctgtctagatgctaatatcacaactgttttgactgctgtaacttttataataagccttaaattcaggtactaaaagatttccaactttgttcccttttcaaagttgttttgcttttgaatcatctcgtcatttgctacaaaaacaaaaagaaacaaaaaaaaaaaacaaagcctgctgagatttttgttgttgttgtagagatgaggtcttgctttgctgcccgggttgatctcgaactcctggtctcacgcaatcttcccattttggtctcccaaagtgttagggttacagatgtggatcacagcacctggctgcctgttaaagttttgatgtaaattgctttgagtctgtgtaagaatttgagaagaacagacttcttatctttttctaaaaaatttgtttacacaggacttaagagaagaactgacttcttatcaatactgaatcttccaatccatgaacactatatatctttccatttatttcggacttcaatttttctcaataaaactttgtaactttcaataaacaggtcttgcaaatcttttatcagttttatctgtatttcatatttttatgcaattgtaaatggtattttaaatttcaatttctgaatagtcatcgtttctatacagaactacaactgattttgttatattgatcttgtattctgcaaccttgctaaactcatttaaatagttctagtagcttaatagattctatgggactttttacatagattatcatgtcttctgcaaatcaatacagtctgtcttctccttttccaatcttgatgccttttactctatggtaagccactttagacccattaggatttttctcctagcagatgttgtctctctagtttaaagctcttaaaagttcaaacttcttagtgtagaatttgaatactctgaaattacagtttctttgtcaggtttcaacttacctttctagcttcatctcttaccatttgttcgatattctaggcaaatagttatatgacattctttaaaaacacctggcacatgcaagcctcaatgtttttatttaaggtattctcttctgcccagaatattacatggtttagaggaaatactacagacttgagagttaaaagaaccacatttcagtcttagccatgctacctggttatccttcgttaagataatgaatgctatcttgtgtgctttgtcatctacaaatttggggggaaatacctgtgctgccctcctctagggtatctttcagaattaaattgagtatatttatgaaggcgctttggaaactgtaaagcactaagcaaatataaggcataatccttcaaggccttcctccatcctatccttgggaaaaatgttccccaattctatttggttgtttttccttcattctctgggttcccacagtacttactcatataaattagtattgaaatttatcatgttatattttgtacagtaatacacatttcttttttttcctagactgtggtctccttattcatttttgtatgtcaccagaggcacatggttacaaactcaacaaatgttaacttgaatggattattctaaatttgattaacaatagacttaaagcttaattagtaataaatggattattagggcaacttcatttatgtttatggtaaataattctcattttaatgttatatgtctggctatttattacatcatgaatgaaatatttagaaaactcctaaaccagagctgctatggctaaactgtatgatgtcacagtaatgtagctcccataaaatggtgttctaaaatagttagaatgaaagcaaacacttatgaaatattatcctgtaaatctagtttaagactagtttaaaatagttaagtctgccaggcacggtggttcatgcctgtaatcacagcactttgggaagccaaggtaagagggttgcttgaggccaggagtttgagacaagcgtaggcaacatagtgagaaactccatctccacaaaaaaaaaaaaaaaaaaaaatagccaggtgtggtggtgtgtgcctgtagtctccactactcaagaggttgaggtgggaggatggcgtgagctcgggtggtcgaggctgtagtgagccatgatcccgccactgcactccagcctgggtaacagattgagacccagtttcaaaaataaataaataaataaaataaaatagctaagccagagcaatataaattcagacaagaatacaataaaccctgaggaattacacaaaccaaagtatttcaatgctgcaaaatgctcagcattgtacctgatttaaatgtattgtcttggacatggatgacgctgaaaaccatcattcccagcaaactaacacagaaacagaaaaccaaacaccacatgttctcactcacaagtgggagttgaacaatgagaacacatggacacagggaggggaacatcacacagcgggacctgtcagggggtgggggactaggggaggaaagcattaggagaaatacctaacgtagatgacaggttgatgggtgcagcaaaccaccatggcacatgtatacctatgtaacaaacctgcacgttctgcacatgtatcccagaacttaaagtataaaaaaaaaaaaaaagtatggtcttaaggaaaggaatcaccgtaagctatgagtattggctatatataggtacacatatgtacatacatacatacacacacacacatttaccacatttacttacatgcccttcctactttcctttctacctcccttcactgacggacttggctggctggctgacttttcagacagggtcttactctgtcacccaggctactagagtgcagtggtgcaatcacagctcactgtagccttgacctcctgggctcaagtgattctgccacctcagtctccacagcaggtgggactacaggtgcacaccaccaagccccgctaatttttttttactttttgtagaaacagggtcttcctatgttgcccaggctggtctctaacgccagtacctacgtgatactcctgcctcggcctctcaaagtgctgggattatgggtgtgcacctgcacctggccaaaagcttttaaaagtattaatttctagatacactttttcctagtgttttcaacctaatcaagaagaaaaatctcgttcatttattctgtagttaggccaagttgttttagtaagaggtcaattttaatctctttcacatctgtcatttatagttgtaattaatttttagttgttaatttacatactgagttaaactgaacattttatataaattctcacaggcctagcaaaactacttattacttcttcttaactacttattaattaatgttagcaaaatagcattaacagattagaaggctagaaaaacatttcagcttgtcatcgaaaatgtggccaagactcagtggaatttctaatccttttcactttcaatgaaacctccggtaacaccctcatccattaagttgatcagaccttgcctcctatcttaccgggaatttggaagtcctgggacctgacttcatcttctacttcagcaaaatttactttaatccctcccaccctttcttcctgccctctaatgacaaaggataaggtattcaatccttctaccactctcttccagggctccagattccagccttctagccttttcaagaatcttcctcatctccatctattagtcagaacagggaggtttgacaaggaacatgaagtgccttcctgatgctgtacgttctacacactgatctgaggggggcttcacagatacacagatgtgtacacattctttgagctgtatacttatggttgtacactttgctatatataaattatactttaataagaaaaaacaatctttatcagttatttatactctttccattatcattaacctgtttcctctctgcagatcctttctactattatttaaacttgctcaagcttcagccaactttaaaaaaaaaaaaaacttccctcaacccacatttctcattatttactaccttctctccttctccctttcaaagccaagctcattcaaagagttttatatattcactgtctcctcttcctctcttccaatttattccaactcactgaaatctggcttctcgctctactagtccacttaactgatactgctgtcctcaagttaacaacacctgtgctattgctaatctaataatttttttagtccttgttttatttcacttgcagatcactcttctcaaagttccctaacattaaactctcctgtttttttttttttcctactactagtcactccttttaaggctccacttcctctaataattccttcagtgtccatgtttctcaggaactgcatcctcaatcctcttctctctcacgttactactcccctggatgagctccattactctcatgtcttccaacaccatcacatcacactggcgacatccagatttacatcctcagcccagaccgctgcctgacatctctctaggtactctggagatccaactactactgcctggacatctgaaactcatacaaaactgaactcataattctacttatatattccccctctgattttccctcttaggaaatgacaccatcattaaccaatttgttcaaatcaggcaactcatgactgacagtagtaactcatgactaatacttcatgttaatgattcagcagagtacacaagcacccaagacacacagctaactttatgtttctgttgtcactgccaccagaatggctctctgaccatgggagaggtctgtgctaaagctggtagcagtctacaaccttttccttaccttccttcctctactgctttaggttgtcacgctttttcattagcctacaagcgtgttaagagcagagataatgtcttattcactaaatccctagtctaacatagtcagccctcaaaaaatatttgttgaaataaataaaaaatataaccaaaaatataagtaaactcttgaccaaacacgcccagagattggttgtatctcttcatccagacaccatcaccaacaaggagaggaggaatggtaggaagagcagacagtggacttgggctggttgtagaacaaacctctccccctgctcgggcacagctccggtactactaatagcggcaatggcaagagcaggaatgtgtgtttagggtttatcttgggtgctagcgttttggtaaatttttttccctagtatcattaaacatttgccacctaactgataaatcacactaactggtgacagtgcagggggagcgggggaaagaggcactggctagatactctggctagatactctggttaacattagtttaacaagaagaaaacagaagcagagactaaaatccaagtttgtgtgcttctaaagcctgtactctttccattatgtcctactggctctatcaaacactactcctgggatcttctcttattcatgtattttatatggattgtgataacacaataaagactttcgttccaaggaacaaattgcctgtatccagttagggctgtggaatctaactccttcaattcttttaacagttgctgtatggcatagcagaaacaacgctggatttggaaataaaaaaacacataactgcatcccattctggcactgcaatgctgacagttacaacttgtgtgagtttaagcttccttggctagaacttagttagtaataataactgtcctatgcagctctgaagtatgttgtaaagtccaaatgaggtaatgtttaagaaacattttacaaaggtaaatatatgaaattaatggtcaacattactacagaaactaatatattacaatgtatttaggttattcatgattaaaaaaaaaattcatttcctacctgaattatatctccagaattaaaactcatctcatcatggttccttgcttcaaaggggtataatgctctataattcaccaaaacactagctgtctcacctaaagagaagacaattgtcattatttgcaacttacatgtatacatctttgctatgactcaataaagagctctaaaacctaaaagaaaaaatcaagcaccaaatactacaatgaaaatccacttgatacagacttgctaggatttcagtatcttgactagtcatctaataaaaaagcaaacaaggatgctcatcttaagtaaggtaggaggcagcaaaacaaagagatgacttgcgggatgaagcacacacatgggtagaaaggaaagtgcaggagtgggggccaggctgagctgtacaaagtggaaggagaccaagcaaagagaggcttggtttgatctgtggaggtctgaatataacagggaagtaaaggacaaaaaggggggtctcaaaagataagaatagcaagttaacagggatggctgaagaaaaatctatacatctatcagaatggttctaaaaggaaaacagtggaagagtacacaaatatactgaatttgataagaataaaattgtttactttgttcatctttagaatgttttaacttataaaatttcaacaaactgtatcattaataatgattcaaagggttcatgtatctaaaagagatacaatactactaaaagtattgtggaaatggactgaggtgtatcaaaattttactgttgtttcattaaaataaatagcttagttatagtggttgaataaaatatttaaaactattttacttcaattatgaaaaccatgtctgagtcttttcacaatcagtagtaactatcttcttttctcctgctgtgctaagatttctactgctgtgttaagatttcagtctgttttaataagcctactgctttttatccaagtttaatttataaaaaggttttttctgactctacaattagtatctttctaattttcttccctttttttgtctcttatcaggtcatttttttcttgttgcatttgttctactgtctcaaagtatccttatccttacgttttttctcctcagctttcaaagtatccttatccttacgttgtttctcctcagctttccgttcctcttcttgaattttttcttgtgttttttcttcctggagtcgcttttgtttttcttcttcctcctttctaagattttctttccataagttttcttttccttgctttgctttcctttacataaaagaaaaagagtttgtataatgtcctagaaattttttacactaaataaaaacatactaagatctggttcctgtcaaggtgaagaactagcaatgaagtattagtacaggggtggggagaaactgctgagatcagaggtgaaaggaaaacaaatcaatcaatcaatcaagaaaagctttggaagctttggattgattagtggatgcactggggtgtatgactgacaatttcccacacccaaaaattccctcctgctaaccaacctccaaactcaagaaaaaaagaaaaaggttgaaatggaaccattcagcaaataaatctaaaaattacatctaagtttccttcctttctctccagatatttgacaagaactgtcttccagctgttattcccactgtcctatctaatctttgtttcaggggtttagtcattgttgctgtggaaataggaaatgcttctagaaaaacaacctacttttttttttttttttttttttaaagagagagggtcttactctatggcccaggctagagtacagtggttcaatcacaggtcactgcagcctggatctcctgggctcaagtgatcctcctgcctcagcctccaaagtagctagcactacaggcacatgccactatacctagccaactttttaatttcttttttataaagacagggtcttgctatgttgcccagtctggtctggaactcctggcctcaagtaatcttccctccttggcctccaaagtgctgagattacgggcatgagccactgcgcccagtctactttttatattattacttcaaaaagtcttttttgtttgcttagataatagagcatttctcctctctaggtccacgtgctttggtaaacatttcaatgaaatctaacacagctacagtttggtttccagccagtcaaggtgatctgtgatcaattattttagtattagaactcatgcatcttatagttctcctttgcatgtattttcacaaccttactcagaggtagagctgccaccacttaaatttagcaccttctccaagcctcagcactatcagggcagtgaagattacagctggaaacattcctgagatttgtcagcatatatacccttccaaagtgggaaccttggcataattccacatctctattccttaattcctgaaggaatctcgaaatcctggataattcaaaatattgtaggcccttagtcatcaatgctttctccttatctctcaactgtttcagacttcatactgctggttcactagcccatttactagattccttccaacaatttccaaacctccttcatcctctatcatgtcatagaatgcttcctccggcaactttcaaaacggacttctggttctcctgtgaggaaaatgcttctcttgcagtcctcacttaatttcaactaatatcccctttctcagttcctctgtaactttccgggacacttttccaagcctagtaattaatacccaattagctttcatttgaatttttatagcattataaatatcactatcagagtacttagcacatatttagcacaacaaaaaaaccagagggctcattaaattaaaattttctatatattttttaagctcttcattctttccatcaactcctcctgccaggtaatcatggccacataagtatgagactaggacaacctggataaggctccttgtttaatttaaggaaaggatgtcaggcccctctactctaggcttactgaggggtggtacttggctgagctcaacctgcaggaaatcatgccagaattctggtaaactttatgtaagagttagtagttgagaaaccggtccagtgccacaggatgcctcagaagctgggcaaagggcaaagaggccacaactaaaatgtgaaaacctattaccaataccttggggaaaagaagggaatatacctgggcaaatggccaatcaatccaagatgtggtactaagacccagcttcagactgagtaggtcctatatgcacttccgctctctttgatttctcttctctactacctaatgtgcaaggatgatgaatgaaattaaacgcatataactagtataatcttttggcctgaaaggaattgtgaacacgatgaagaaagattaaggtaactgcatatgtcaatagaaagttctgacataaggattagctgtggaaccactgcacagctcccttatgtaattaagtggtacaagttaagcagtaaataagagctgtaagagctacttcgtttgaactttactttctctacttctatattattctattatctcgttaggaggccacaaaaacaggggtctagatcaccaggcgcagtggctcatgcctataatcccagcactttagaaggccaaggtgggcagatcgcttgagcccaggagtttgagaccggcctgagcaacacagagaggcctcatccctattaaaattcaaaaaaaattagcagggagtggtggtacatgcctatattcccagttactcagtgggagcttaggcaggaggattgcttgagcccgggaggtcgaggctgcagtgatccctgatcataccactgcaatccagcctcggtggcagagcaaggaccctgtctcaaaataaagaaatgggggtctaggagtaaacaatattatagttattcgtttaactgtctgaatctcctattagaattatgaggagtaatccaaagtctaccagcatcacagccaacaatagccactcaaaaaaatgtgttggaggtggctactttgaaaccattaagaatagaggcctgccaaatggtaatgtgtcttccttgcctccctagtaactattagctttttcatagaaattactcatctactctttaccaaggcaaaaaaatactggttcatccatatttgttaactaattatactactttctgatactagaaaacttggaagaaagagaagaatgtattagaaaaagaatctcaatggcagaaaaataccatgcaaagtttctaaatgaataattctaggcttcagataccacaaatgtcttacttctccttactataaatggaggcaattaatatatctcaagtgataaaaagagaaatgcatcaatgtggcattctacattcagtattactatatacaattaagtattctgcttttatgatctttcaggaaactaatagatttaccaaggaaagatggaatgaatgagtgtttactatgtgcaacaaattatacttggctctttagctacattattttattttttaacttaagagacaaggtcttgctatgttgcccaggctggccttgaactcctgggctcaactcatcatcctgcctcagcctcccaaatagcttgggactacaggcgtgtgtcaccacgcccagttccagctgtattattttatttaatacatttacctatgagatatgcattattgtctctattttcagatggagtaactgaggttcagaaagataaaaataacttaaccaaggtcacccaggtagtaagtggaagagcaagaattctaatacaggtttgactccaaagtctgttatttttcactagtagaaaataaaatcagttactgcaaacttgatccctaaaaggactgaacttatgagatccagaatctgattaggataatccctttattttccttaaattttcataaactaaagatatgagcaacaaaattacaattctaatggcaatatagcacaataaatatatcagctatattaccttgcagcctcatcttctagtttctttttctgcattagttctaatcttttcctttcaatttccttcaacttgtcacgtttgatcttataaagctgttcaagggctaactgctgtgtgttgtaggtttctctcagttcctaaggagaaaaagaaaataagtcaatacgtgaatgatttaaatatgcttgtcatatgtattaatgtggcatttgcattaaaagataaaaatcctatagcaagttgaactaaatttaaaatatttaaagttttaaaaaatatctagatgataaaaaaaaccttaagtatttaaaccatatagctcctgagataaacacattaaaataatctacttttccatcagttcatttctacggaacacagaatctttaacaagccgatgctttgatttggtacatcattttcaattaaaaaaagcaatccattaaaaatatgggggaataatttgcttgttataacatctgaagagaaattttgttcagtcatgtttttgacatatgtaatttaaccaagttatttttatccaatatcatcttgaactaaacacagaattattaaataatttagttcaaaactaaaaatggaaaagatgtctgcctaaaatcatgaccaccatgagccaaaataatgaaaagcattccaaacaggagttgaaataaacaactgcttattgaacatctagttgtatgctaagtgctataaagcgttccaagaggatccaatacaaggctgactcccacgtctacagactttgtctttaaagagttcacaatctcaatgtagaggcaagtgtcaacatgcagggcagaggtaaattccttagcaggaacttgtgattatctgttcagcattttctcttcctcttcttcaacagcaccctgccttcctctaggaaactgatctttccaccttcctcccaacatcttacgtggttttaaaaggtctgccaaactcagagctcctcccattcccatcaggcacaattgtttactcctgacctaaacaatcacagcaccttacttccctgctcagaaacgactggtccaaaggacataagcataatccaagctggcccagaatattttcctgggattcacatatgttgaagtggggagaaagaaacctttctgcagctcattaaactgggataaagtaaacctggagctgcctcacaaccaaataagacctggggataggaataaaatcaactcagaaaaaagagaagtacagattagagactgagctggagagaaagggtactatagaagctgaatgttcaatatcatggctcggagacctaggaactgcccctgtccagcagcccttccatggattcagttagtggtcctaggatgcttctaataatcactcattagcttaactattttgaactagatttctttcatttggaatctacagaatcctgaacgagagagtagaaaaaggaggctggaggaaagaagtgggggcggggggacttaagagtaatcaaaagaaacttcatggcaaaggtgagagctggacaatatttgggtagaatgttttggtaaaaaatgttttttggtatcaacctatacacaataacacaactccaaactccatttcttttcagagataactattttataagtgaaccttttacttgattgaaatagtagatttgatctaagtacagcatgctgtccagagactatgtccaacatgtctgagcaaaacatttacaacttaagccaatagtaatgcatactgcttttatagcagaatttccacagctctcagcttctagggttttatttgttgtacctttctctaaattctattgaaaagcagaagaatatagtggttacaatatatagagaagcaaggtggtttagtgatgaggagcatgggtctggaataagactaacaaggcttgactcaggctctgtatactagctgtataaccttaggaaagttattttatagtttcctcatcagtaaaatgaggttaattatggtacaagggtgtccaatcttttagcttccctgggccacatggaaagagggaaaattgtcttgtgccacatgtaaaatacactaacaatagctgatgagctaaaaataaatacataaataaataaaattgcaaaaacaaatctcataatgttttaagaaagtttacaaatttgtgtagggctgcattcaaagctgtcctgggccgcatgtggcctgtggaccacgggttggggaagcctgttatgatacgtgcctcacagagttgttgtgaggataaaatgagttaatacatataaagtgcttattatagtgcagagcacctaggttctcagtaaatcttagttattattattggatgaagtcaaaaatgaggagagtactcagtctaaaaggagagtaaaaaggagccaaattaatgtctgatctcaacaaggctgcaggcttagccctccaacttgtcctttaaaatagagctctaagtattcctttactaaccctattccctgcagtgtcagagttaatgagcttccttgtgccattctgtatattcctctatcatagtgtcttctcttccaactatatgattgcctcctccactgaagtgagtttcttgacaagactgtctttcatcaaggtgtctccagccaacagagagtctagtacaacatggatatttaataaatatttattggacaaatgaaaaatgcataaacaatagtctatgcaaattagtaagatttaaagagcaccacaaagcttgccaagtatttcctctatttgactatggtgatgtaaaaattcctatccttagacctattcctctgggttaagtcactacttccaggaggtccttgctacacataatagttaagcaagaaaaaaataaaccaatcagaattcattaagagttgttctcaatcttttttttttttttttttttttttgagatggagcctcgctctgtcgcccaggctggagtgcagtggcgcgatctcagctcactgcaacctccgcctcccgggttcaagcaattctcctgcctcagcctcttgagtagctgggattacaggctcatgccaccacgcccggctaatttttgcatttttagtagagacggggttttaccatgttggccaggctggtcgtgaattgttgagctcaggcaatccacctgcctcggcctcccaaagggctgggattgcaggtgtgagccactgcacccagccaagttgttctcaatcttaacagaatgatagattatctcttttacgttaaggaacttctattactagtttgctaataagttttacttttaaaatcataaatggatattaaattttatcaaaaacctttcctgtatctaatgagatgagcataatctttttctcctttagtctgtttatatagtaaattacattaaacttttctgtatgttaaatcatctttgtatggctgaggtaaatccaacttggtcatggcaggttatgccacctgcaggggtattactaacgtagattactccagatccttggaagcatagggttaagacctaactccttgaaggaaaccacaattctaccattaacagattctactttccctctatggacaagcatttccccaatcattatctcaagtcaacactggttgactttccaaaatactaaagatattttggagattctgacaacccctttcttaagaagagtgagggaaagtaattttgttttttcacaaataacaaaaatatttgtatattcgtatataagagtttacaaagcatttccatctatatgcgatctcatttaatcacaagactttgcaaagaagacaggcagataatgtcagcatgttttgtaaaggaagaaagcaaatttggagggtaaatgacagatcgttacacaactggcaagtggcatggataagactagagttcacttttttagattcctaggccaggagttttcgttgcacttcactgctaaagatgtgtgaattttcttttttttttttttttttttttttgagacggagtctcgctctgttgctcaggctggagtgcagtggcccaatctcacctcactacaacctccgcctcccgggttcaggtgattcacctgcctcagcctcccaagtagctgggactataggcgtctgccaccatgcccggctaattttttgtatttttagtagagatgaggtttcactatgttggccaggctggtctcgaactcctgatctcatgatccacccgcctcagcctcccaaagtgctgggattacaggcgtgagccacagtacctggccagatgtgtgaattttcttaatggtataatggcctgtcaaatgtctcacttttgaatccactggctttgtcttagtataacttgaccaaaagagtaaaaatcattaattctgtacatgcatattgcaggttccagtaaaacataacattctaaattaaataattgaaatattttacttctgttgtcactacaagtagcctaaaggagtggtggttaaccccggtgctctactatcacaaaggaccacagcatcagaactaagtgcctgtcctgctccaacactaccaggaccagttccatctcacctactgataagacacagcctttcttctcattccttatcacctgaattcttatctctacagtgctgtttatcccttaatctgacccaatcccctactcattctctcctcaaacctctccactctcctggaacttcctctatgtgatcaggaaactatcatacagctaccaatcttctctgaacgaaaattctcttccctcgtcactttcttggctgatccctccggatactacttttctgctagtcctctctcagtttattatcatatactccatttacatcagggtcagaggataactacagtattttccttgctcttcactgccactttcagatggttatttccccctcactcttagcaactccatgcttttctggggctcctaccatccagcaataccattctctccttcctttttattgttatctattagtcacctggtcattcactcacctcactattctctaagtctttgacatccacataaatgatgcaatccaaacctcaagtctcaggctgatctcttcatcaatgacctttttaactctacttaatccatcactcccattattacaccctgagtcttactaatcagaaacagaactaccattgaccaaatatcccattcttcaaacgtaagttcttacccttcgaacttttcttatacctggtacatctatatcaatagggtttgtttgtttgttttttctgagacagagttttgctcttgttgccctggttggagtgcagtggtgtaaccttgcctcactgcaacctccacctcccagattcaagcaattctcctgcctcagcctcccgagtagctgggattaaaggcgcgtgccaccacacccagctaattttttgtatttttagtagagacggggtttcatcatgttggccaggctggtctcaaactactgacctcaggtgatcaacccgcctcagcctcccaaagtgcagggattataggcgtgagacaccacgcccagccatcaataggttttcaacctcactgagaccattctgttgactcccatcattctctttctttattaacaccccttcctctcttcacatccttcatgtctagttcatgtttcagagctcatcttgatcatagtgcttttgtcaagatctgtaactcttctgtccctctctctttgtgcatgtctattaaaacctcaaacctgtatgaaccatgaacctatttcatcagctttctctgtgcttatacctaaacagctgaacattggtgaggcaaaatcacacaattaggcatactgttttcaatttaaatacatcacctccaacttcaaaaagacattcaacattgctcagcacacttaggttttcctctactaagcttgcatatctgcactgagatgtctatttcatgcctatttctctcctgaaacttcctaatcttccatccattctcctcactaccagctataaaccttgcctcattaggccatcagactgcagccctctcaactttccatctcaaaaaaccaatagcactttctgcatctccacccctcttcttctggcctaggctgagttatatcatgtcctcctctacccaggaagattctttctgatggtccaacttacctctgattttaagtcttgaagctgtcgatatgggagtgggccagggaagtactgggtagagaaaggcgggtccctggctagggcttcagcctcgggcctatgcccatgaacctaggtgaggacaggcactcctgcctttgcacccaaatgttgcatcttccaagaccaccctggcctgccacgccaccatcctgtgcctacaaaaacccgagatcctaaaaaggcagaggcataagtggctggacgtcatgaggaccacatcggcagaagacgacacaagcagctggtcatcaagagcacgccggtggaagagcatgtcaacaggcaccagcaggccagcaggccactgaccagaggaacaatgcggagtttggccagagcagtgagaaatcaggttgcggcccgactccagggtaaaaccgtctcccttctggctcccccatctgctgagagctacttctactcaataaaaccttgcattcattctccaagcccacgtgtgatccaattcttccagtacaccaaggcaagaaaccctgggatacagaaatccctctgttctgtccttgtgataaggaagggggtctaactgagctgggtaacacgaaccgcctatagacggcaaactaaaagagcactctgtaacacacccccactggggcttcagctgtaaacattcacccctagacactgccgtggggtcagagccccacagcctgcccatctgtatgctcccctagaggtttgagcaggggagcactgaagaagtgagccacatccccatcacctgcccttcaagggggacaagggaacctttcccgttttactgtcaacttcctactctctaccaacaaatttaactgcattcataaccatcttctccccgtatgttacactgaaagtattctttttatctaatcctttaatctgtgctctccattccatcttaatctgcttcttcagggactttgctccatcaattaccacaatctcaatctttctctctttccccctgcctcctcctttcttttctctttactatttccttcaagtctttcttaaaccaaaaaaaaaaaaaaaaaagattttcctttgacccccatgcttttttcttttcattctaagagttgttgctactcacttaacccttcctcaactcttactcattcctgatccactgcaatccagcttctgcttatcactcaagtgaaatggcacttttagcaaggtcttcaaaagttttctttttgacaaattcaatggatatttttctttttctttttttttttgagacagagttttgctcttgttgaccaggctggagtgcaatggtgcgacctcggctcactgcaacctccgcctcccgggttcaagcgattctcccgtctcagcttcctgagtagctgggattacaggcatccgccactatgcctagataattttttgtatttttagtagagacggggtttcaccatgttggccacgctggtctcaaactcctgacctcaggtgatccgcccgcctcggcctcccaaagtgttgggattacaggcgtgagccactgcgcctggccaatattttttagcactatgttaactaataactctgtatcattttctagtaactacagaagacctcttttcttgctttctgtgacaacacagtctcctgactgctctgacagtatagatttcatatctctttagtttcctaaattgctctgatgaaagtatcaataagcagtgtaagtctggaaggcaggaagcagaaggaacaaagtaaaacaagggacaagaataactgctggcctgtggagaatcaaatgctaactcaaagaatcagactctgtgagggagaacagtccacaaatcatcattaaacttcactttacagatgaggaaacttagtttagtttctatgcaatccgtagcaaaagttctaaaaaccatataatctggccattcatgccataaccataaaggctaaaatatgggtcccctgctgctaccatctttccaatttgccctacttcgctcaggtaacaaatgaactctacttatcatgtttctgtcttcactgtggaatatatatgcatataggcaactgccctattgctatccattttagtactgagtaaaatgtgtagtcaaaatctactagagtcagcaagcagtaaacataaagcacatttctttaagctctattaaaatatttttaataatctacgttatacatggcaaagagaaatatttatataatttaaacatttttatctgatgtgcaagcatgtctaaatatgagcctggtaactagacctgactaaagttgcccctgcattattggttctttaaaattgtccttacaacagtattaggaagcagcttggtgcatatatgacataaacttgccctagatttcataaagtattaagttttattttaaacactgattttcagtgatatgggtaagtgatttaatctcacattttcctttgaattgagttagtaatcatctttatcagttaacccactcccagggatgttgtaaaggaaccaggttatatttctaagtgtcctggacttcttttgagaaaggttactgtgacaggcaaccttactgacttctggcattagactcaaacaggcagtcagatagcagaaggatattcaagcaagcagaaagaaaaaggcttatattgtatatgttatttcaaacaaagatactcagataaaggcaaagaatagtctagttttaaaaaaataaaacagcaaagtaactcaaagaaaagaagctagatattagaaaataaccttaagtaagaggaagaggttgttgagacagcttagcagagacaaaaggcactgaagaacagagtcatccatattcccacactgtaagataaggcagataaaaagccaattaaactacgtacagaatttttttttttttttttttttttttttgagatggagtctcactctgtcgccaggctggactgcagtggcgcaatctcagctcactgcaacctccacctcccgggttcaagcgattctcctgcctcagcctcccgagtagctgggactacaggcgcatgccactacgcccagctaatttttgtatttttagtagagatggggtttcaccatgttgcccaggctggtctcgatctcttgacctcgtgatccgcccgcctcagcctctcaaagtgctgggattacaggcatgagccaccatgcccagttatgtagattttttaaagaaataatatagggaagataagttggctggcttgtctaaccagcaatgacaaatgatttggttttctataaaatttttttctactgaacatatgcttgtgtaaagtgtattattaacattgttcacctcaaattccctttccttacctgaagccaccatgttgtcctttctttagcatgctgtttactctatatttgctgttaatgttattctaaataagtcagcatgataaaagccatatgaagagagagatttcttatacaaaagctttatgaaaagctttatttcttacagagaatagcttatgctctggaaactttatattgttagcaaaggaataactgagactattcccaaatttacattctatgccatgagcctgggtttttagtttctttcataggtatggcttcagtgtacaatgaatactgtggtgaatgatatgcagacagtctatgttttggacatctgctctgccactgcggcaaacaatgaatcattaacttgctttttgtgcaaagtttatagtgccagattctgttctagatttcactgattattgcattatttaacaaaggttaattaaattacacttcacaaggaaacaaaataaaaactgtgttaaaagagccactaacacctaaactatttcaaattttccatatttctcatttttgaaaattgcctaggataacgctggctgagatcagttctgtaatactgacaaaggcaattgttctggaaatgtatagatgccaagacaaacagcacatagtcatcaaaaattggaaactgtgataaagtatatgtttagttatatgacactatgtcatataactagaacattaaaaacaatcttgaaattcttgtatagttgaaattataaaataaattatgaaaatgtaatacatataatagctttagctatttattctattaaatcaaaataatgaaggtaagaaggcagttacctaaaaataaatagtatcaaaaataaatacctttagttgattgttaaaagaatccatttctgacagcttagatgcagtttctttttcaagagcatctaactgttctttaagtctttggcataattcttccttttctaatgattttttatgaagtaaactgacccctgaatctgaaaaacaaacatcagacagtttacattttgcagaagttcgtatgtcattaccagcatgtcatttactgtttggtcagattgatgtaactagaccaatacgaaggatgtatacacaatgcagaccagtacaagagaaaacattcagttgttatttccacttcccagattatatgctggaaagagcatcagaggaaatggttgtaagccttggttctgcattcaaaaggactaggacctgaagtgaaattctactttaggaaagatgcttcaccaatcgaatcctcaggcttttcatctatacaatgagcatcatgctacattaaatgaggtgatggatataaagccattgtacactctggtccacagttaatactcaattaatagaaactatagttaaagtagctttccatttattcttagtgctcccaagaacagggaaatattcacagcaaagattcagtaagtattactaactggattatttagtaacattattttaggaggtaagaacagaaggtttcattttatattatctttttttacatattcatgcagggatgaagaaaccagatggaaatatataatgcagaatacattacaataaattaaaatagcaatattatctgtttaaatgtctgtttttaactttatcatatttttgaagtacagaagtacaaaatttaaataaaatgaaacatacagagtaaaaaattaaaacacctccatttcaactgcaagttcatcccccttttaggcatttacatttagatgtgtacatactcaacttttatttccatgggttttaacagaatcatattgtctacattgctatgcaacttgttttcaatttagtaagatatcttatcaatcaggacaaacagatctagttcattcttttaaattgctccatagtagtttacattatggctactgcataatttatataactacctttctgactggtatgggtagatgttggtctgaacccactgatcaacatctacccattttcccctccctctaacccctggtaaccactcttctactctcagtttctgtacaggagttcaacttttttagattttatatgaaactgaggtcatgcagtatttgtctttctgtaactgacttactgcatttagcataagggagcgcaaatatctctttgagacagtaattttgtttcctttgaatatatattcagaagtgagattgctggatcatacaagagttctatcttattttttttagaaaccttcatactgttttccttaacaactataccaatttacattcctccaacagtgtacatgggttcccttgttcccacatgctcactaccactcgttatctctgatctttttgataacagccatcctaccaggtgtgaggtgatattatatttcaatgtggtttagatttgcatttccctgatgattaataatgttgagtccctttttaaatatctctttaccatttttaggtcttctttggagaaatgtccactcaggtcctttgcccattttgaaattgggttgttttttggtattgagttatatatattccttgtattttggatataaaccacttatcagatacatggctcacaagtattttctcccattccacagactgccttttcatcttgattgtttcctttactgtgcagaaactttttagtttgatgaagtcccacttgtttatttttgtttcctgagcttttggtgtaatatccaaaaaatcactgccaaggccaatgtcaaagagcttttgtcaatgttttcttctaggagttttacggtttcatgtcttatgtttaatccattttgagctgatttttgagtatggtataaggctccaatttcattcttttgcaggtggatatccagttttcccaataccatttatcgaagaggctaccttttcccattgtgtcttcttgatacccttgtcaaaaattagttgaccatatacacttgggtttatttttgggctctctattctatttcataagtctgtatgtcttgtaattgacaaaaaattgtatatatattgtatgcatgttgttttaaaatatgtatacattgtaaattggctaaggagctaattaacatatgcataatttagctaattaacataatgtgtatgttaattagctaggctctctattctgtaaatctatgtcttttgtaatcaacaaataaaaacttgtatttatagtacgcatgttgttttgaaatatgtatacattgtaaaatggctaaattcagctaattaacctcacatacttacctcacatacttaccatttttgtggtgaaaacacttaaaatctattctcttagcaactttaaagaatacaatgcactattattaactatagtcaccaggttgtacaatagatttcttgaacttattcctcctatctaactgaaatgttgatttcctttgagcaaactctcagtgatccccttttctctcaccagccctggtagccaccattttattctctacttttatggataaatatatacactccacaaataaatgaaatcataccgtatttgtctttctgcgcttggcttacttcacttaatgtaacatcttgcaggttcatgttgtccctatgtctgtttttatgccagtaccacactgttctgattactatagcttcataatatttgcaaacaggcagtgtgatgcttccaactttgtttttctttctcaagattgctttggctatttgaagtcttctgtgattccatatacgttttaaaattgctttttctatttctgtgaaaatgctatttgaattctgatattgtgttgaatctgtatattgctttgggtagtacagataatttttaaaatattaattcttccaatacatgaacatggagtatctttccatttatttatgtctttttcaatttctcccatcaattagttttcagttacagatctttcccctccttggtcaaatttattcctaagtatttaattatttttgatgctgtcatgaataatattgtttacttgatctcttttttgaatagttattggtgtaaaaaatgcaactgatttttgtatgctgattttgtgtcctacaactttactcaattcatgtattagttctaagttttattgcagtctttagggttttcaacatataggatcatgtcatctgcagacagggataattttactactacttttacaatttgaatgtattttattcctttttcttgtctgagtagtcctgctagtacttccagcattacgttgaacagaagtggtaaaaagtgcgtatccctacctcataccagatcttagatcaagcttatccaacctgcaggccatgggccacatgcggcccaggatggctttcaatgtggcccaacacaaattcataaactttcttaaaacattatgagattttttttagcactcatcagctatcatcagtgttagtggattttatgtgtggcccaagacaactcttcttccaatgtgacccagggaagccataagattagacaccccgatcttagatgaaaagtcttcagtttacccccattgattatgatagctgtgagcttttcataaatggcctttattatgttgaagaaaattccttctatatctattttttttgagagtttttatcatgaaaagatgttaaaccttgtcaaatactcgttctgttatttatggagatgatcacgtggctcgtagatttttgtctttcattctgttaatgcacactttaaattctgacagaaattgccaaactactattccaaaaaagctgttatcaacttatgccaccaacaatacctgtttctgcaaaccctcatctatattggatattatcaatcttttttcatttttgctaattggcaaaaaagaaacctgattgttattttaatttgtattttcttgataaccagtgatgtcaaagaaacatctatttatgtttctggccagagtcttgaattgttaggtcttatcctttgccgtatttttctattgggctgtcttaatttttgatttgtagaagctctaaattcttgtattacatgtacttcaaattttttagtgtttatgctgtctttcattatgatgttttcatttttaatcatcaaatctgtaagtattttcttcatgactctatgtattgtttaaagagaccttcctcataccaagattataaaatattttcctgttttataatagtttttaagttgtttttatgtttagcctcctaatttatctagaatttatttctgtacatagagagcggtaaagagctcctctgcaactctttcagataatccactgtccctcaaatcacttactgaaagcccatcctttccccactgatgttaagtgccaactttatcttatcctacgttgccatacatgcatgggctttcttctagactctattcaattccattgttctacttttctatttctgatcaataacacactattttaggcactctaactttcatatcttatgtttcgatatctgatagggttagtctcctcccccctaccaaagtttttctttttcaagttttgcctaatcttgtacaatttattttctagatgaatttgtcagttatcttcccaagtttcattttaagaaacccaaaaagaactgaatatataaattaggagagaactgacatagtattgatgtatagtatagtataatattaagctagttcatttaggaacataaaatgtctctaattattcaggaatcttttttttttattttgttttgagacagagtctcactctattacccaggctggagtgcagtggcaccatctcggcccactgcaacctctgcctcccacgttcaagcaattctcatgcttcaaccttccgagtagctgagaccacagatgcgtgccactacccctactgatttttgtatttttagcagtgatggggtttcaccgcattggccaggctggtctcaaactcctggcttcaagtgatctgcccacctcagcaccctaaagtgctgggattacaggcatgagccacagtgtccagcctattcaggaatctttcacgtctattagcgaagtgttatagctgcatatttcttcttcttcctttttttttttttttttttgagacggagtctcgctctgtcaccaggctggagggcagcggtgcgatctcagctcactgcagcctctgcctcccaggttcaagtgattctcctgcctcagcctcctgagtagctgggactacaggcgtgcgccaccatgcccagctaatttttgtatttttagtagagatggcgtatcaccatgttggccaggatgatctcgatctcttgacctcgtgatccgcctgccttggcctcccaaagtgctaggattgcaggcatgagccactgcacccggcccatatttctgctttattcataacaatgtatattactaataatgcatgttttaataccaaatttgatgacatatatgagcactatgttgggtaactggaaaataagacaaagaaacaacatggtagtacagtgggctttacagttagacatgaatttgagtactatgattgtaccatcctgggtaactacttaatctctctgaacctcagttttcctgagctcacaatgggaataataactataccaaagggttattgtaaagattaaaggaaagaatgcatcaaaactgactcacacagtgcttggcacatggctggtaatcttaaatggcaattgttatacagagaggcatctaagggatacagggtacttttcaaagcccaaacaaaagcttcctattttgaattggactatggctaaataaataaataggtaacagctgcactgaattacattccacagagaaagaatagccccatcacgtcctcaataagacatattctacattttattcacaattcaaataggaacaatgacaacaatgatgacaataataaagatatatttctgccactgtgcatatcaggtgggttagctcaccctgactctggaatgcctgtgtaggggtgaggtgggggctaatatactttgaacaggaaagaaccaagtataaggaacactgtctgagcagggacatggatagaccacatcaatggaaggcaggagacacaataaaaatagttcacaagagtgaacttcatttctgatatttcttccacgtgaagggccctgcactagcccaacaatcccagcttctttccttcctttcactaactagtgagctcaagttaaagacctaggaatgtacagcctaggctcctcctaagccctcactctctagagacttaactgcccacaggaaacctgcattctactttgttcatgcatccagtgctttataggtgcaactataccacccacagataaaccacactgcctagaatcagcttcatcaataatgaggcagtgatttggtttctcatttgtcttgctcctttgccttatttcttaatttgttcagaacttgcgcaaagaaggggatactatttattgaactttgtaaacagccaaaactataataaagagacctacaatggaataattgacttgatagagactcaatgagtgacattttaggatactttagtcagttgtaacacaacatctgcagatttacttttctttaaataaaccttgtttctgctatgcttttattggtatagtatccaatacagagaatttttttcagttttctcattgggacctgagcaaaaacaaaaacagttactatcccataaattatcctggaatgttttgttccacaggtgtcagagggccaagatggtaaaattctttgtatgaagcacagagttagataatataaagggtctgggcagagcataccatcctgcttaagcctatgactgctgcacgctaacaccctagaatcccaggtgcggccccaccataaagcctcctcctgaacagttctttaaaatcagtgcaggacttttcaaaatgcacatgtagtcttgtgttagagccaaatttatatcttatagtctaacactttatttgatgtttcaattatatacataaaaatatcatcaagatatgaagtcataccacaatcattactattttatttttatctactttttatcactaaaaatgctctaacatctgggatatttttcactttattttgaaactttaaacttacaggcaaaaagtgttatttataacagaatactttttttaattttaaaaaagtaacaatgtgactgatacagtcattcagaaaaggataaaagtaatcagacaaaccttagagacttaccaggtgtgttactgaactgcatgtttttaattctttcatttaataattgcttctcaggtaccagatagataagcttattctgatattccttataaaaagaaaaaatagtacctgattacaatgttataatattgtccaagagttttttttgaaaactttaaaacaggatttactcatctttgaaacttattttagaaataatacatagttgtaaactgcttacaacttatgaatcaactagaatggaattatgccaagaaatatttaagccaaaatcaattttgagtgactggctgaaattaaaaggcagtgaagaaagcctttgtaaatggggtgtgtctagaagcctacaattttcagcttactgatgaatgacagcagacctgcgctagatggtatgtgtaagcatgccatgatacttcaggatgaatatgtgtatatcaaagagggactaaaagctgggtgcggtggctcacacctgtaatctcagcactttgggaggccaaggcaggtggatcacttgaggtcaggagttcaagaccagcctggtcaacatggtgaaaccccgtctccacgaaaaacacaaaaattagccaggcgtggtggtgggtgcctgtaatcccagctactcagaaggctgaagcaggagaattgcttgagcctgggaggcagaagttgcagtgagctgaggtcatgccactgcactccagcctgggtgacagagggaggaaaaaataaaaaggactaaaaactaggaaagcaggtttaaatcagacagaaaatatttttggcttttgtttatctctcctgtaacaaagcaaaaagactgattaattgccagtccatgcagtaagagaaattgggtaagagaactctagagatgcagaatgcttccacagccccattctgcaaatagtaattattgaaccagaccctactgcacaagtaaggaagagaattaccaggaccccaagggacatattcaagttctcatcataattttaaaaagaataactttaagtcaaaatttcctaaaattagtagcaataaccttattttaatgtatgatatggtctgaatgttggtatgtccccaacattcatatgttggaacctaactcccaatgcagtactattaagaagtagggctttaggaggctccacactcatgaatgagatgactgtccttataaaggaagttgaagggactgccttaccctttctgcatgtgaagacgcagcaagaaggcactagttttaaaggagacagcaagccctcatcggacactgaatctgctaacaccttgatcttggacttctcagtctctagaactatgagtaataaatttctgttgtttataaattacccagtctaaggtcgtttgttatagcaagtaatgaattaagaatgcataaacattgttaaagagttaaaactcaaagtgataaatgtccacttacgtatatatattaagcaaaacttaaccagacgtctagcagagttttagtaggtctatggacttcctgatattgtatacaggattgcgtgtatttagatcacaagcctatcaaagactcaaggttattgacccccaaaacaaaactctattagaagaactgtttcgttttgttttgttttgagatggaatctcgctctatcatccatgctggagtacagtggtgcgatctgggttcactgcaacctctgcctcccggaatcaagcgattctcctgcctcagcctcccgagttgctgggattacaggcatgcgccaccatacccagctaatttttttgtatttttagtagagacggggttttgccctgctgactgggctggtctcgaactcctgacctcaggggatccacccgcctcagcctcccaaagtgctagcattacagccgtgagccaccgtgcccagcccagaagaactattaattgtacatgtttaagaacaatttagcagtgaaggacttacctgaagttcctgttgaagttgcttgatttccataatttccaagtcacactgcttatccagaacttccagctcagtcttttgagtttgctttttgagtcggacatcctgaagtctgcctgagatctgctgatgtttgccattctataggaagatcatataaatatatagtaacataaaatgctaatagaaaatgtttctacaaggagaataatatttttagttaaattttaaaatctcagttatcattcatattcatcctgaaacaaatgcctaaaaccaagtggaatgtgtttcagagttgtgtctgttaactcgagttattagtgggaaacacatcattctcagagtgcaagagcccatatgttagtatgggaaagcagaaacataacacattgaatttttttctgaattcagcattagacaatattaattaacaatattaatatcagagacactctcaaagaatgatgaagaggaataaatgtttgcatgtgatgctcggcattaccttctctgaacttctatttctaccctaaatatggccatctaatttcctctaattaaaacagtgcccaggaggaacgttttggcaacagttctgttctatactaatattcttctccttttttcctcttcttctgtgaagaaatcaaacaaatagcagagattctcaatgggacctaagaagaagggtgacatggggggttatgggctgaactgtgtcccccaaaattcatatgttaaagtcccaagccccagtacctcagaatgtgacaatatttggagacagggcctttaaagaggtgattaaggttaaacaaagtcatacaggtggaccctaatccaatctaactggtgtccttattagaggtggaaatctgaacacaaaaggcaccagagataaaatacactcagagaaaacaccatataaggacacaatgaaagatggccacctgcaagccaccaaaagaggcctcacaagaaactaagcctaactaaccttggtcttagatcttaggagctgtgaaaaaattaatttctgttgtttaagccacctagcctatcgtattttgttacagcagccctaccaaactaatacagtggagtgaggggaaatgacatcctgggttaaaacttactgatgatgaaaagttttactgaagactgtttcatatttgaaatacatacactgaaaggaacatgtgtatctctgctggagctcacattcttatcctcaacatgggatacgtataggctctggacctttccagactctgcacattcacctgtgttactgtgcttcatgtgttgcaccagttcttgagggaaaaacaatcaatcttaaggtctcttcccattatatatagtcaagatgatatatatatataaaaatagtgcaagagagttaaaagttttttacaactgttttgtagtactctggcatgattaatacttgtggtatgtatgtctatccatttgaaggaataaaataatatatttctgactaaagatattgtgatgattaaaaaaataatttttaatgtaattcaagtcatcaaccaaataaaatgttagactatgatcacacaagatctaaatctggctctactacatgactaggtatgcatttttgtaaaaccctactatatgatcagggtaggctcatgggattctagggttgtggcagaatagtgccagatcttttataccttctcaccacacatttcaaacaaagtcttttaacaacttgaccctctaacatctgattggtaaaaactgcttagtggccagtattagctaagaactacaatcctgcagaactggaactgtaagagatcatttaggtcagcagtttcaaatcagttgtctttttaatagtagaatctttttttttccaagcaaatcttgagtgaaaccccaagaaacataaagcacataaatgtcaagcttctctgttgtgaagcgtgggaagaattagggagagaaaatcactgttctgctgcccgagcttcccctctcctgcctctgcttagtcctcctcagaccatcttacagagaccaatctgaaaactgaaaatcactcaactaacacaactctttatttcagacaagggaaaagtgaggcacagagaagggaaatgtcttgcccaggagtacatggttcatcagtgtctgaactgatgctacaacataattctcagcattttgagtcattatccttttctcagtaaaccatattgtacagtctgtttatatgaaaatgtgactaatgacattaagacataactaattcacgagagattttaaaacacaattacatttttcttttttttttttttgagatggcgtctcactctgttacctaggctggagtgcagtggtgcgatcttggctcactgcaacctccacctcctgggttcaagtgattctcctgcctcagcctcccaagtagctaggattacaggcacccaccaccacccaccacggccagctaatttttgtttgtttgtttgagacggagtctcactctgttgcccaggctcgagtgcagtggcgcgatctcagctcactgcaacctccgcctcccaggttcaagcaattcttctgcctcagtgtcccaagtagctgggactacaggcgcacaccaccactcctggctaatttttgtatttttagtagagatggggtttcactatattggccaggctggtcttgaactcctgacctcgtgatccacccacctcagcctcccaaagcgttgggattacagtgagccaccatgcccagcccacagctggctaatttttttttttagtagagatggggtttcaccatgttggccaggctggtttcaaactcctgccccagttgatctgcctgccttggcctcccaaagtgctaggataacaggtgtgagccaccacgcctggcccacaattacatttttcaacaggtagctccatcatcattcagataaatttcacttaaacttcagccataccagtgcttccaactcaagatgaagattcttctttttagagtttaacctgacaatttcttcttgttctctattcttttgattgagaagctcctgtcgccgaattctctcccattctaagcgacgttgtcgttcaagttcctgttttgctgcctgaaaaaaaaaaggaattatacttaatttttaaatcaaaaattttgcacgattcaaaaactgggaagacaacaataaaagtcaggcagagtttagcacttagtggctttagtgcctaagggtagctaggcaaatctagttttattaatgggcttaaagacttccaagaaagtggcttcatctatcatattttctcatttcttcacgagatcttttttttttttttttttttccagacagcatcttgctctgtcacccaggctggagtgcagtggcaccaccttggctcactgcaacctccaccacctgggctcaagcgattctcctgcctcagccccaccaagtagctgggattacaggcacacaccaccacacacctggctaatttttgtactttttgtagagagagggtttcaccatgttgcccaggttggaagaccatccttttgttacagtcatttttctcttaataagttacagaatgacttcataaatataaatgttaacaggaataattttccctctattctggtatctgggggaaaaattctatttatattatttcagtgtgcaataacttcctgtgctccatccctggccctttaaaacacagccagtcctcctaaggacccttctttcccagcaacactatcccaaaggcctgtgcaagcccatcctcttgattcctctctagagagactttcaatgcccagctctcatctttctgtctctccaattccttggactcttaatctggatcttaaacttgctttcgtctaatgacttgctcagttgcctaactaaccttagctcctcactcaacttagctctgcagtcgatcctcctttgattgagatatcacctgcagaggatgctttctctaccacgtaccagttctgaaaactccttataagcaagaagcctctttccctcctcaagggaaggaatgatcagatttgtatagggtaagaatgaaatgatgcagagcaaaaggcaaaacaaaaattcaaaaataagcattttttaatcaaatgaaatatagtcacttattaaatgtaatgattttcttaagaagtaaaaaacttaaaaataacctctcgtctttctatgtcttttctcctttcttcctctcgttgtctctccaattcccgttgcttctctaagcgtttttctaattcaagttgtttcttccattcttgttcttgtaattctctctgttttcgttcccactcttccttttctttctgggctttacgttctgcctccctttgttgctgctccatcaaggcttggcgtcgcttttccagctccatgttccctcgctcatagttggctttccgtttgtcctcaaaagtaactgaacaaggtatgcctatcagcatccacacacattaacagcctacagaacctgtaatctagtttctatatacttatgccttgtgatcatttgagtgctatcagtatttgaatacttctcctaaggataattttaactcaaatctaagtggaaaaatatctactttcttcaaggatattcaattttagaaaaacaaatttttaagtttgaatccaatcaagagagaaataatttttataaacttgccaataaaaatactttttcggttgggtgtggtggctcatgcctgtaatcccaacactttgggaggccaaggtgggcggatcacctgaggtcagcagttcaagaccggcctggccaacacggtgaaaccccatctctactaaaaataccaaaaattagccaggcatagtggcaggcacctgtaatcccagctactcaggaggctgagacaggagaatcgcttgaacccaggaggcggaagttgcagtgagccgggattgtgctgttgcactccagcctgggcaacaaggaaaaaaaaaaaaaactttttcaacttttttctcttcttcaaggacaatcaaagctgtgtggttatacatttgttttgatgtcattaacatcctaatatattaaaacagctacaaatgtattctttcaaccaatatttaaatgtttttaaaggtaaagatttcattacaaagtttcctctaataactcagcctaaattaggagaaatactttaactcagatgtctataatcctgtcaaatacatctaactgtctcttcttccttcacactcttctcattttgaccatcttaattttatcaataccaaaatacatcccatctatcaaatagttttttctcatatagcacatcaaatattaaaaatataaaaattctaaatattccattacatttaaaggtagaatttaaaagaactcagtataaatatacaactttgacactcagtgatacctggtaatttcttctgaggctcctcttcttgcattttctgatatgaaggcagagttccattaatggaatcaatttgctttcctcctctaaaaaaatcaaacaacaaagttagcatcatgtagtctggacattttcagactagattacacagactaccagtgattatggcaatttgatattgggaatacagtattaaagatatttaaaacagtttggtatgtcgttacaaaatacagtagtatatggatattcaagacagagaaatctggattcaaatcacagttcagctaattttggttcttgggcaagtttttctttatctctttagtcattagcctccttatgtataacataatgaaaacacatccacttctttttttttttttttttgaggcagggtcttgctctgctgcccaggctagagtgctgtggcataatcacaacttactgtagccttgaacttctatgctccagtgatcctcctgccccagcttccagagtacctaggactacaggcgcacaccaccacacctggctaattatttttatttttgtagatacggggtctcactatgttgtccacgctggtcctgaactcccggcctcatgtgatcctcccaccttggctcccagtgttatgattacaggcgtaagctgccacgcctggcccacacctacttctaatatgtacccttttcaagtataacttgttgaatactaaaatcaatggcagtgcaaatatttaactctcttctaaatcacatctgccaagttatcaaaaccatagttctccacctccaggcacactcacctgaaagatggaggaacaagctcaggaggtaaagtcagtggtaatggctgtccagctttggccatgtcagtaaggtgcattgcaagaataaactcttctgcttttagctgtccatcaccatcaacgtcagccagagtcctaaagaaaatgttaaaattcacaacttaataaagtctatttggagtaaaatattgccttaaaagttcaatttttattttacttttatttatttatttatttatttatttatttgagatggagtctagctctgtcgctcaacctggagtgcagtggcgcgatctcagctcactgcaagctccgcctcccgggttcacgccattctcctgcctcagtctcccgagtagctgggactacaggcgcccgccaccacgcctggctaattttttgtatttttagtagagacggggtttcaccgtgttagccaggatggtctcgatctcctgacctcgtgatccgcccgcctcagcctcccaaagtgctgagattacaggcgtgagccacctgggcccggccaattttttatttttaaaagaaggataatgatggtaaaactgctgggtacacttattttagtgaaatgtaaatacgtacatttacgtaactcactattgaatgtaagtatgtaagtatgtacttcaatagtgaattaattttttaccgttgattttcaagacataaaagagagggaagaaactttgaaacagaaagagaagtaactaccccttctgagaaagtggcttgtcttactccatggttaattcacctaccaaatcacatttacctatattaaaaacaagatattctctgattctccatagaagggattagatgaaagaaaacaacagtttttctagtaaaatatagtcatgaactgcataatgacatatcagtcaacaatggactgcatttataatggtggtcccataagattataatggagctgaaaaattcctaccacctaaggacactgtagctgtcataaagcaacgcattacctatgtgtctgtggtgatgctagtctgaacaaacatactgcactgccagctgtagaaaagtacagcatatacaattatctacagtacatacactcaataacaataaacatctgttaatatattactggattatgtatttactatactttatttttattgttattttagagtatactccttctacttacagaaaaaaaaaagttaactgtaagacagcctcaggcaggtcagtcaggagaaattccagaaggcattgttatcataggagacaatggctccatgcgtgttattgccccgaacaccttccagtgagacaagatgtggaggtagaagatagtgatactgatgatcttgaccctctacaggcctaagctaatgggtgtctttgtgtctcagtttttaccgaaagtttaaatagtaaaaataaattttaaaaacaagaaagagcttaaagaataggatataaatatctttctgtacaatgtgtttgtgttttaagctaagtgttattacaagagtcaaaaagttttaaaaaattaaaaggtttacaaagttaaaaagttattgtatgccaagattaatctattgttgaagaaaatattttttgtaaatttggtgtagcttaagggtacaacaacattctgcacaattacatttgcctccaagcttaatactaactttcaaatggctgcttttatagagcatctctgagtcacaaacttttacagaaacagtatctttcttgtaataggggagagagagtttaattaattaatgcatagttaaattaatcaaatgtaattaagggacaaacttaccaaatagtagccagctgagtttgagaaagatttgactgaagaagggcatttctagcttgaaaacctgattaagtggggaaaatcataaaggaattctttagcatctttaaagttatgcataacaaattagctgtatctgtaaaataacaatgctaccagggtatcctgggaacttttaacatcaaaatgtttttaccacgtgctaggtgctaagcattcagtagcaattaaacccagtcactgccccaaggaattttaaatctagaattagcagtatcaagtgctgtcccctgtcttttcagcaagataataatacacacaagtggctaacgtgaaagaacaagatatcaggcacacagagtatcagaggccaagactgtgggccctcttgtactcccagcaggtgcagcacttcccactcctacgtgactgagccgtgagtagcagaagagtcaggcgctactctgggttcagcctgagtcaaggcctgtccaaaacaactcttacacaagagattacatctgccaacactgcctcagcaacagctccaactacaacaaaagccagccaaatgcagctagatttattgtcccactaggctttcaacataggacttgataatcaaagcaaccatgtattacaacatgcagctaaatgtttatattttataacttttaaaatattttcattctatttttttaatctggacatttaacataaatcacataaaaacactggaaattaaactcacagcctcgccctattaattactcctcagatttcacttaggaaatttgatttgaggaggtctttgtgttaaaaggaagattcttctaaataagagagatggaaggctatttcaaacctgaaaaaaagttcaaaactactatttcagcttttggaccgaaaaaagatccttttggactgaaagaagatcccttagcatcaggcaatagagcaaacagaagagagaaggaggaggaatgtaaatggttaaaaatcatactcgtggagggctttatatgtgtgaggcaaagtctgagtaatacaaagggccatagagagccaacagagtatcttacttactaagtaaaactcatttgaacatgtatgtacactcttagtcggccaagcctctggatatcctatatcctctgcttagaatgccagaccctcaattctttactttgtagtctatcctctgaaatctggctctaatctcttttcttctgtgaaacattctctcttatatccttggagttagtcactttctcatctatattaatcacagcacttttaaacaagtaaccaaacaccttgattacatgagctcttcattatatgggctcttcaaagatatgaaccatgtcttgcccctgtctgtattcctgtgcctaagagagtgcccagaaagtatgtgattcaggaaacagttacatcaatgacttgatctaaataaatttttaaaaactatgtttagggggaggagaagagaagtaaaaaagggaaaaacagaccagtggacaggcgcggtagctcacgtctgtaatcccagaactttgggagaccaaggcgggcggatcacctgaggttgggagttcgagaccagcctggccaacatggcaaaacctgtctctactaagaaaaattagctgggcgtggtggcgtgtgcctgtaggaggcaggagaatcgctggaacccggggaggcagaggctgcagtgggccaagatcgcaccactgcactccagcctgggcaacagagcaagactctgtctcaaaaaaaaaaaaaaaaaaaaaaaaaggatcaccaactcctacacttattgaacaaaacaaacatataagtccaggttagcctcatcctcatgttcttggggctcatgctcagcttaaggacaccagcagcaactactctttttatagaaaaccttgtctttacctacagatatatagctttacccttgtaggtctcagaataataatgacattccctaaaaaacaccataatacacaaccttcgtacaatgtgacatatactaatgaagtaacattagggatcacttccccacagttggctccccattcactgcccttcatattccaatgcaaaatcacctctgtttatactgttatagttacagtacttatacaaagcgtactactcttaagtgtgctgcctaataattttttcttttttgagacgtagtctagttctgtcacccaggctggagtgcagtggcatgatctcagctcactgcaacctctgcctcccaggcacaaataattctgttgcctcagactccagagtagctaggattacaggcgtccaccaccacgcctggttaatttttatatttttagtagcgatggggtttcaccatgttgaccaggctggtctcaaactcctgacctcaagtgatccgcccgcctcagcctcccaaaatgttggaattacaggtgtgagccactgcacccggcctgcctaatgaatttttacacaggtatgcacatacacacctgtatcaagatgcagaatgtttccagcaactcagaaggtttgcacatggccccttccccacacagtaaccacattattctgatttctatcaccattaattaggtttcctgttcttcagcctcatataaatgggttaaatggtatggtccttttgggctgctttcattcaataccatacctgtgaaagtcattcatgttgttgcaggtatcagcagttcatttggttttatcgctttaaagtattctgttatgtaaatatactgtcatttatctattctcctgtcgatgaacatttaggttgtgaacatttttgtaaatgtctttttcatcaacttttgttcagttgaaaacaaataacttctttttattagagagatggggtctcactatgttgcccaggctggactcttgggctcaagcaatcctcttgccacatcctcccaagtagttgggactataggcacatgccgctatgcctagcaaagataaactttttttttttttttgagacagagtctcgttctgttgccaggctggagtgcactggcgcaatctcggctcactgcaacctccgcctcctaggttcaagcaattctcctgcctcagcctccagagtagctgggactacaggtgtgcaccaccatgcccagctaatttttgtatttttagtagagacggggtttcaccatgttggccaggatggtctcgatctcttgacctcatgatctgtctgccccagcctcccaaagtgctgggattacaggcgtgagccaccgcacctggccaaaattaactttttaaatgcaaaatgtagggtacaaagaagttaattttttcaaagaataggaattatgactttatattaatctccagtatggttcaataccatatttcacagaatctaaaattccactggctataagacatactattattttatgaataagaaagaaagcactgctaataaaactatgacacagtgctaagacatcactaattgtagcacacatcctaattttagagacattaaaatgtaaaaaaaaaaaagtgtcaaaaaagcataccttgtttcatgcaatttgataaaattacagaaaatcttagttatgtaatatgaaatacatgtaaaaatacaaagtatatatgtaagctaagaagtataataggtcacccgtgaacctaccacccatcttaagaactagattactactaaatgccttgaatctatccgtgttccttgacttatccccatgcttccacaagaggtaaccactatcctgaattttgtatgcataattcccttgctttaaaaaatagttatcacataggtatgtatctttaaataaaatactgtatatttttgcttgtccaatcgattccaaaagtcttactgctcgttcccttgcctctctgcataactacagaccctggactcctatttcacagactacttttcattctccaaataggccatgtattttttgctcttaatttctcctttgtcaccatcaaatgcccccacgttcaatctctgtcgaaatcctaactttttcatggagcttaaatgctcccttcctaaaagatacctcatctgaactcttcagcttcaatatatctcattctatgttccttagcacttaaagctctattatttttaaacacttattttactcggtcctaaatcataatttcttgctgagtgaagagggagtgggaaagttagaaggtgggaactctacttgcctattaccctctgtttatgtctcctttgctgttctcaattagtacagttcagatgatgttctggcctggactcaaatgttttacagtgaactaaggccaagttttacagtcacatttgggttagagcattaaagggtgagcaatgctcacttgaggttatataaacagagaaaaagcccaatgcagaggaggattctcaggaaaagtgagctgaggctaagttccacacactctctcttgtgacccgtggctctccattcactgcaaagcttagaggatgaggtctgatcttaagggacaggtcttttgccaaaaagttgggggtatatctggtgcccgacttgacagtaagaactttgaagaaagcaatcaagttgaatccatctttgaatccttatacaacttcaggtatttgtatttatcaaatgcctgctaaattttttggatgttaaaatgtcagatgagctacacaatacaaattcaaatgacagttcttcagtggaagtccacataaaagaccctttttcatgctcttcagcactgtatgctgcttacctgagagatatccactcatacttttgtcaagagtattaaatttttgccgatattttaatcttgtaggctgaggaactgcccactctgaggtcccagtcttgggtgagttccctgagagtgaagcagtcgaggaagttgagctataaaaaaatttatttaaaatttttatgttactaaataaaatatatttaattaaattttataagaccaaggcattaagaatcttatataccaggggtcctgaacccccgggccaccgacctgttaggaaccgggctggacagcggggctcggtgagtggcaggtgagtgagcactactacctgagctccagctcctgtccagtgagcagtggcattagattctcataagagtgcaaaccctattgtgaatggcacatgtgagggacctaggttggatgctccctttgagaatctaatgcctgatgatctgagatgtaacagtttcatcctaaaaccattgcttcaagtctgtgaaaaaactgtcttctatgaaaccagtccctggtaccaaaaaggttgaggatcgctgttacatactataatggtgactgccttttctctttttctggggaggagacagagtctcgctctgttgccagcctggagtgcagtggcacaatcctggatcactgcaacctccacctcccgggttcaagcaattctcctgcctcagcctctcaagtagctgggactacagtcacatgccaccacgcccggctaatttttttgtgcgcatttttagtagagacagggtttcaccatgttgccccaggctggtctcgaactcctgagctcaggcaatccgcccacctcagcctcccaaagtgctgggattacaggcgtgagccactgtgcctggccaatggtgactgcttttgcattttacatttttttaaattttaagcaattatcactattcttagtaaagcaaagaccataagaagtatagaactccatgagactaccgcatataaagaacctgctctgtgccagaccttatattgtactaaggcctttacaaatatttctaatcctcccaacaaacttaaaaaatactacagtccccatcttttagatgggtaaactatggctcagcgatgttaagaaaaaacaaggccacagaatcagtgagtgttcaagctaggatatgaatgttgttcttctgggtcaaatctaacactctccgtacactaccctgaagagtataatagtgatttatatgaagggtgattaatgtaatgaatactgatgcatttgtgctttgtaaaatttaaaagatatccaattagtagaatctgctcaagaaagaaattaacaatgtacaatgagtatgagacatcttgggaaatatacacattttttaaaggaaaagtacacagctttaggcaaagaaaaaattaaaatatagaatatttttagtttacatgaattattttttcaaaagtaaaatgccacagacacttaataattctaaaaataaaaaatttattttatgtgagttgtaagtagtaaatttaccttaagtatttgtacttggccattataaagtaaaacttaggtaagctcaaagctttaaaaaaatcatttgttaaataaagacttcttactgaaagcataaaaagttgtcagagttagctattcatacctactagatcctaaatcaatcagagactgcgctttctgtatactagcacctccaaatcctcccatcatcagactataagatgacccatgaggcaatgctaaaaaagaaaaagaaggaaaagtatgaaagaaatttgtatctgttcaaacacaaatagtttctttctttacatgaaataatgactctttagaaacaaagtactcacttgaagaagaataaggaatgggtaaaggctgaatgagactggcggttccatttggtaatgatgatgtgctaacagaaggcactaggggagtgggcatcattaagggaggaaggttggtccctgaagtcgcagaagacaatgatgttataggtgcagctggaggcaatggctgaggaatggacagattgggcatgcttcccattcctaaagtcaaaagaaaacattttttccagtgctagaaaatcaattataaaacacatgcaaaaaacaagtttacagtacagtgggcagactctatgtttaccaaaacacacagatgaattatccttaaaaaactcactactttgacccagcagtgagggaggtaaactgctgctcttaatactaatactctgatctgtatgaactaagaaaacacctagcaaagagttaaatattctcctctctcatcatgaataaaactaagcagccttttccaattgaatatgagtctcctcaaggaaagaatacattaccagatcaaatgaggtttttgtgaaaggataatacagtgctactaagttacttgactaatacacacacacacacacacacacacattcttcttctctctctctctcacatactccccccaaacaaaaaggttctaagtagtagatactttatgagatccatttatgcatatgcattatttgcaagaaagtgtgtcacatattttacttttcttgtaagtaacattcctatgaattcaaggacgagttcttaaaaggaacaaagtgatgacttttattcatttattaactgcagaatacttataaatatggtcacacaatgatttagtatttatctttagaattcactaaaatagtgaaataattttgtggagtctgttgtttgtttgagatgggggtctcactatgttgccccgactagaatgaagtggctattcacaggtgcgatcatagcacagtacaacctcaaactcctggactcaagcaatcctacccatagcctcccaagcagccagaactacaggcacacacccctataaccagctctagaattctatattctaagatctgtagtgaaggaacatgtttcagatacatagacatacctaattgaatgttccattcaaaatgagtgcttctcacatataattataagaaattgcctgatcaaaattaacagaaaacataccaaccggttatcgctgatgaatacgtgaacttattagcccaaagtctgcaacttttggccctaaatttagctggctaattaacctttaaaaaaattcaacttacataaaattttaaattatctcccaaatcgaaccatttcaagtgagtttaaaactgctcaaaattttttctgtattactcacatatatatagagagagaggaaactaagaatagtatttgggattggctatacctagggagaccatataattcatcacgcaactaggagttgtaaaaggagacactaactggaccagatgccaggacaaaaggcataaatcagaactgtccctagaaaaccagaacacatggatcccctacctgtgacagtgaatttaatatttattatctctaacatgaaaattaacttggaatctggggactgtcattttgtgctaacaaatccttttctaatactcaaatatgcctagggataaagtttaagtagcaaatacaggtatttaaattaatacatacttaccaaaacgagcagaaattaatggagaaaacatagggggttgcttcataataggagggagaaccacaggcaactgttggccttgaagcttcagtttgatgagtttcatagctatggagaactcttgctgatccatcttcccatccttgtttaggtctgataaagccctaaaaggagcatgaggtaggtagattgctatgtggtgtggtggtgggaaaactaacgttattttggggattgacaaagtaaaaatgatgatatggcattcacgtgtacatcatcactaaatttaaaatatctaacatgtaaaatatataataacaaaaagataaaacctacactttaagaaatactgaccagagataataactaataaaacactgcctgtcaaaacagaatctagagacctttgggctgaattccaccagtttaggtagaaaaaaattcaagattataatacttctaaatttaatttattcatctgtccaaatatttactgaatacttgctatgtgcctcgtactctaccaggcatgagaatattccaagtggaaagatgggacaggggttgttacttattgtaaacgtttttaaaaaaacagatattatagagaatagtttctttaaagaaggagcaggggaagcgaggactaatttggggtttatagattatgaaataaatgaaactacaaaataacagaaagaggattttgagattctgccaaattataaggaaatttttctcaatgataatgtatatatctttccttagaaaattctaatgaaattagaaatttgtcctagagaactaaacctgaattattttcaataatttgctcaataaaatttattttccaaaaaactgaagaaataccttttttttttttttttttctaaagagagtctcattctgtcatccaggctagggtgcagtgacacaatcatagttcactgcagcactgaattcctgggctcaagcaatccttccatcttggcctccctgagtagctgggactagaggtgtggccaccacacccagctaattttttttttaattttctgtagagacagggttctcactatgttgcccagcctggcctcaagcaatcctcctacctcagactcccaaagtgctggcagaaatattcttaataaccaatagaatgcaactaaaaacaattttatgttaacactatattacaaaaaaacaaaatactatcagaaaattaggttcatctacaaaacactttaccatatttcagctaaaacaggggccggcagacctgattgtaggaaaaaattacgtgcttgatcacctggaggtaataaaaacaaaacccaagcagcacattagtaaatgaaattattccaatgcttctgaataataatgggtatatgttaatgatttattataattttaataccaatcattaaagaataagtgaaatagaaacacataaaaattatttacataactttaataagacagatattttaaaacaaaagtcacatctgcacttctattgtatattaatcagtgatgaaagatgattcatctcagtttttccacaattggggtcttccttaaaaatacttccacttagtaaaatttatatttaaaaacactattccctaaaagagtttcaatataaaaagtaccaggtgttaggagagagagtcctccatgagtttcttcacactcctatgtgtcttgctctgtataccaataatgtaagaccctaattgctctctgcctgggtcacttctcagaattgggtttgtaatgagcaatcttaacgaatccggtaacgtttcccactgagacaagggacaaacttgctttactgcttgctacaaaagggtgggttccccaaattcagtgttcctctcctgtaacacaatcatagcatgtgtactattctcctgggctctctgcattgtctctgtgggacttagggaacactaaaggaaacagaaagatagatgccaatgctcattttgctagttatgctgttagtcataaggttctttgtctctgactcaggaatcttgggtcttccacccgtaatggacaaagttattaacctgtaagcagggtaatcaaatcctgataccaggtaaggtaattactatcatagcagtacaaataacatggttaagtagatggattccaaaatcagcccaaatggtttcaaagcccagattaacactaaccatctttgtaaccttaggcagttacataacgtctcttagtctcagtttcactatttgtaaatatagacaacaacagtgcctactttacagggttgttgtaaaggttaaataaaataatgcacttagcatagcatctggtatatagtaaaaattcaataaatatcattgttctcatagttactattattgtatgtaaagcactaagctactttggcacagaaaaaagtttaattaatagaaaaaaatttcaaaggcacacctaaattaatcccattttggctctggtggtctttctgcaaaacaagggctagcatcaacaatcagtgcttggtgtagcctcaaagacagagggctagcattaggaaaacagattccagaaaaaaaaagtctagattttccatgaaatgaatctaagaaataaactgaaaactttctagatataatgttaaaatgtgaaaccagacaattacacagaaattcttgactatcatttaggattcaggaaaaatcttccatatcccaaatttaaaacaacaaattaagacagttccaggaaaaataaagttagcatttctttaatttctagaattctgattgatatgaattttatcgtttattaacacaaatttgatggcagtcaaattaaaactaattcttagatatcacataaggaccataattcactaataaaactaattataaatacaaacctgttatgtaacctcctgaaggtttgaggttatcaaactgcctgtcatgcttagtacgttcttcagaggtaatagcccacatgtttggccctcctgaaacataagtggaagaaactatagtgtatacatgagaatgcttaaaatacaattctaaaatgtaaatagaaatcacaagtgttcattgtatgacagtatttaatatttgagtgacacaaagagtagagctctatcataaccatacatagcacagccctaaggcttttcactcattggctcaattaacgtctattgaacaagtgctatatcacactcactggaaatgggcatcaagctaaatactggcaataaaaagatgaagaaaatattcccaccctcaaggaattcatgctctagaaaacaacagtacttacagtattcacctgtgaaaaatcctaagcagaactatatactgccatagtttagccctgtgtccccaccagaacctcatttcgaactgtaatccccacgtgtcagaggaggggcctggtgggagatgactggatcatgggagttgatttctcccttgttgtttttgtgataatgagtgagttcctcacaatagctgatggttttaaagtgtggcacttccccccttgctgcttctctctctcctgctgccacgttaagatgtgctttgcatccccttcgccttacaccttaagtttcctgaggcctctccagccatgtggaactgtgagtcaattaaaccctttttttcataaattactcagtctcagctagttctttatagcagtgtgaaaacagactaatacagataccaaaacagctgtgccaattctgagttagaagcaccaaggatgagataacaggaaaggtaacactgaggcagagccttgaagcttggtttgaattttgccacgtgaagaggagggataagaacatttcacaccataagggcacagcatgagaagtcaaggcatgtgcaaggtgctgttaagtgcactgagcagactaataactagagttagtaataataaacaggtagggtggaattaactgtaaaaaggtcttaaataccatcctcaagagcctgaccccataccctggaagttatagagagccatctagtagtttttattattttattatttatttatttatttattttgagacaaagtcttgctctgtcaccaggctggagagcagcagagtgatctcggctcactgcagcctccgcctcctgggttcaagcaattctcctgcctcagcctcccaagtagctgggactacaggcatgcgccaccacacacccggctaatttttgtattattagtagagacagggtttcaccatgttggccaggatggtcttgatctcctgacctcatgatccacccacctcggcctcccaaagtgctgggattacaggcgtaagccaccacgcccagacagtttttaaataagcttttaatttggaataattttagatttacagaaaattcacaaagatagtacatggctcctatatacctttcacccaatttctactatgttaacaactgacacaaccatagtacatttgtcaaaacaaagacattaacagtctggtatataactactggctaaattaatacctccacctgcagtggtggctggtaaactccaacagaattaaactctgggtagtgaagacagcacaaggcactgtgactgatgattctgcccatcggagcctctagcaaaaggaagtagccttcacctagagataatccttgggatcagaaagcttgacccacgaaggcctagtgattctctagcctgatagtcccattttggggagggtcaacttgaattccacaaggtgggaataacctgaaaagccttgtttgtcaaatagaaatggtatatcaaagaagatatagacactggccccaacagtattttggctttacgttaaaaagtggcagtggccgggcgcggtggctcacgcctgtaatcccagcactttgggaggccgaggcgggcggatcacctgaggtcaggagttcaagaccaacctggtcaacatggcgaaacctcatctctactaaaaatacaaaacaaattagctgggtgtgatggtgggtgcctgtagtcccagctactcaggaggctgaggcaagaggatcatttgaacccgggaggtggaggttgcagtgagctgagatcacgccatagcactccagcctgcgccgacaagggcaagacgcaatctcaaaaaaaaaaaaaaagcggcaactatccctctgagggaaacctttatgcacattccactgcttatagtaaagctactggatcaatgaaggctcagatcagagaagctgcaagttgctggtgttcactgggctgcagtggctattcagcctcagaggcagctatgctgaactgaaaggagacatgggcagaacctggattcttgggctgctgccaatgacccagctgtttggtttgccacttggaaaattacagattgacagattaaagacaccctcctggggctacaaattgaaaacaaatctcaactgctaattgaattgtctgtgtcacctatgtagacacctacagtatgggcccagcctctgatttagactgaaatcaagtatgactaatgtgcagaggataccactgcatgccaaactgtgacttggggatggtgggggaggtctcattgcaggtggcattgttccctttgactcctggcagactgactatattggacctttgttccctctctcaggctatcagtggtgcctcaaactattgacagtatttttttgtttttcacatagactttttagagcagttttaggttcacggcaagattgagcagaaggtacaaacatttctcctataccttccaccccactgacacatagtccctcccattaaaacattcccctgttgacacttttttaggttaccaatcagcccacgatgcccacactgtcatggcccttgaaactaatctgtgtcatgtttcttttttaaaaaatttagagacagggtctcactctgttgcccaggctggagtacagagtgacccttggctcactgcagccttgacatcccaggctcaagtgattctcccacctcagccgcctgagtagctgggactacaggtacgtgcgactacagctggctaatttttgtattttttgtagagacggggtctcactatgctgccaaggctggtctcgaactcctgggctcaagtgatcctcctgccttgacctcccataatctgtgtcatgtttttggttttctggaccatatgcattctgacatggatgcacttttatcataaaagccattcaacaatgcactgacagcctgactctatttccatcacctcctcctggtccacatactttaaagtaagatagtgtggtcactgactgtagctgtctccagaaaggattcattgcttattagctgcttcctccctaatgatcagggctaaagggtggggtatcacaggagatatacagacctattgtgaaaattcaggattctactctgaccactcctggacatgatgcatctttctagcccctaacagcaactgtaggcaggcttggttcataaaccctccagctgggccactgaggtaaaaggggatctagagcaggaattcccaacccccaggccacggactggcactggtctgtggcctgttaggaacctggccgcacagaaggtgagcggtgggcaagtgagcactaccacctgagcggcacctcctgtcagatcagtggcagcattagattctcataggagcacaaaccctattgtgaactgtgtgtgtgagggatctgggttgcatgctccttatgagaatctaatgcctgatgatctgcagtggagcagtttcatcctaaaaccaaccccctcccaccaccctaccacaaatctgtggaaaaattgtcttccatgaaactggtccctggtgccaaaaaggttggggaccagtgatctagaggattcaaagttaattctggttagggtttatgaaaatgtccctcttacatctaactcttctggatcactaggaaatggtaaagttatggctctgaaatgagaaacccaggtttaatggcagtagagcaacaagaaggcacctgaggaagaaacgccttagaccccaggaggtatggtattaagagaggaattaatgatattttctcttgtagaactgcccctgtagccttcttctgcaagaaaaatgccttggtatggctctcctaaattgttggaagcaccttatgagtctgccatcccccatcaggagccttatcaagagtctatcaggaacatcaggaatgaccccagaaaatgtatctcctgtccatatcacttccagaggtcttcccccacccccaatctcagtaatggatgaattccacccagctggtggcgaggacaaacaaaacaagtgggactaatttgggcaatccctccaaaaacaaggactagactcaattactcaaactccactggaaaccctcagacttgccagtcatccaggaggctatgttagaggcactatcaacctgtgcccctcttctgatgtaggtcccacggcagtaggggttgcagggggaataactgtaaacattttctttccaagcataacccatgcacacccttgatcttctacttcttctgtggaaaccatgcattaacttgcctccctccaaaaacacagtaatgtacatgaagagatcttcaagtgtttaaaaaaacacttcctcagtcctggaaggcattcaggtcagcctcaactcactggctagggttgtcagagatttatcctagattttctttttttgcaggctaagataaagtgtgtgcaattatgaatacactctgctgtacccagattactgattcaggccaggtagaaaagttaaaataaaacttaaggagaggccggacatggtggtgcacacctaatcccagtattttgggaggctgaggcaggaggatcccttgagctcaggagtttgagaccagcctgggcaacatagtgagaccccatctctacaaaaaaacttaaaaaaattagccaggctgggcgcggtggctcacgcctgtaatcccagcactttgggaggccgaggagggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccaggaagcggagcttgcagtgagccgagattgcgccactgcagtccgcagtccggcctgggcgacagagcgagactccgtctcaaaaaaaaaaaaaaaaaaaaaaaaaaaaaaaaaaaaaaaattagccagtggtggtggctcacacctgtaatcccagctacttgggaggctgaggtagaaggattgcttgagcccaggagatcaaggctgcagggagcactgatcacaccactgtctgggttacagaacaagaccctgtctcaacaaaaaacaaacaacaacaacaaccaccaaaaaaaaaaaaaacaaaaaaacattgttttttaaggagaaagccacctggctttctaagggagacactgatgatttataggatttgtttagctgggaccctgcagagcacagctgagaacactgcaagctgagaccaacctgctgcttggagtcctgttgattagtcttaatcaaatgctgcataaaataaatcagacttagtcccagcccgttttgtcagattaatcggagtggccaacttagtggtatgtacactcatgagaaaatttgctagaagtcaagacaatggagaaacaagggagaggaacccttgggagacaattctccatgagtttctcatgtttctgtacatcttctaaagcaaaggattgatagcttttgttccagactatctctgaggatgtctgcattgcaaatacaggggtttcttcccgagcttgggattagctttttgttgtccgccagctctctgaggtttttgtaaagctctgcacattcaacatgactaatcaccatctatacttctgactacctttacaatttattccatttctgccaataaggaatcaaatacgtttaggtatataaactcatacataattcctgcttgtattgtataaaaatctgccttacaaagacaattttccaggaacgtatatcattgaaaagtaggtgctcactgtaatttttaacactaatatggatttaacaaattattcttagtcctaaatgactggattaaaaaatctataaatatcctctcttaaagagaagttttaagattatagttaaaaataaagaaacagatgtactgaagaactaaggacctaaaatagctaaacctacacactttctaaataaagaaataccacatatgtagtaaaaatcctacttgggttatcagtttatcagaaaataaataaataaacctgtcaggattcctgtcactaggaaggcaagtagtatagccacagaactgattttctattatatgacttcagaaaaattatgatgctgattttaaaaacaacaaaaatgacaacaacaaaggatgacaaagatggaagcagctcacctttattgaaccctgactattgtcagggactttatatgcagcaactcactgagcccccagcattaacctataaattaaagtactattattattctcattttataggtaaggaaactgaaaacccatggtaataaagtaacttgctcaaggtcatacagtaagtgacagagctgagattagaacctgggtagcctgactccaaagcctccatattgaactcagcactaactatgtaccaacatatatgggtaagatgctcatgttccttctaattcagatgccacctctataaactaggaatattatataactccacaggcctgttgtaaagattacatgtaatatacctccattatagctaacacttaatgaaactcaccctgtgtcaggtacttttctaagagctttacatgtattgcttcaagtaagtctcataagaatcccatgaggtaactattgctatcactgtttatcagagaaggaaacagtggtacagagatattaaataatttgcccaaggtaataaaattggtaagtgttgaaggcaagactagcgtctactcaggcttaattaagagtcttaaactatctgtcttgttggtaattaaacataaatacactcacaaatatattgtccattgatttccaacaacatgtggagataattcaaggtggaaaacagtcctttcatcaaatggtgctgaaagaactggatatccatatgaaaaaacaacaaaagaacctcaaccttccagcatatacatgaattaactctcaatgaatcacagaactagatataagataaaacttcctgaagaaaatatggaagaaaatgtttgtgattttggattatgcaatgactttttggaacacaaaaggcaaaaatcattaaaatattttgacaaactggactttataaaaatctaaaatttccactctcttaaaggacactcttaagaaaaggaaaagacaaactacaggctgagagaaaacatttgcaaaacatattcaataaatataggtcagcatatatacagaactattcaactcaaaaattagaaaataatcccccccctcaaaaaaaaggaacaaaagatttgaacagacacatcaaagatatacagatggcaaataagcacgtgacaagatgctcaatatcactatcatcagggaaatgtaaattaaaatcacaaaaaggtatcactgcatgtctattagcatgtctgaaaattaaaaaaaaaaacaacacggagtgctgataaagatgccaaacaaccgcaactcatatatgctggtgggaaagcaaatgtgacagtcactttggaaaacagtttgggaatttcttatgaagttaaatatatatttccacatgacccaacaatagactgagtattaacaaaagactcttgggtaaatacccaagagaaacgaagacctatttccacataaaaacctgttctctgatggttatagcagatttagtcataatcactaaaacctggaaataacccaaatgttctgcacctgaacggctgaatggataaataaattgtggtacacatttatacaatggactactattcagcagtaaacaggagaaatgcatgcaacattatgactgaatcacaaagatattttgctaagtcacagaagccagacaccaaaggctacatattgtgtattccatttatatgacattctggaaaaggcagaactgtaaggacagaaatctgattagtggttgccaataatacatggctaaaggtggaggtataagggtacagagaactttttaggtgatgcaaatgttttatatcctaatttatatgactatatatagttttagaaactcatcgaaccgtatactttaaaagggtgaattatacccccaataaacccaactttaaaataaactaaaacaaaaatataaagcatctaatacatgcctgccatattaggagtcctcaataaattagtttccttattcaacccaatcccagggaacaatataattaaaaagaagtcagagcattcaaatctttctcagggaatagcctgaaactaaggctctttagttagaaaccttaagactattttaagtctgaagagtttggttaagaaggcttaaaagctgctcggccaggcatggtggctcacacctgtaatcccagcactttgggaggccaaggcgggtggatcacgaggtcaggagatggagaccatcctggctaacgtggtgaaaccccatctctactaaaaatacaaaaacttagctaggcgtggtggtgagcgcctgtagtcccagctactcgggaggctgaggcaggagaacggcgtgaacccagtaggcggagcttgcagtgagcagagatcatgccactgcactccagcctgggagacagagcgagactccgtctcaaaaaaattaaattaaattaaattaaattaaattttttttaaaaagctgctctaacatacatgggtatatatacccccgggcagtgatggactctactgctatcctaagacaaaagagagttctgctgcatcaagattgatgcaccaatgctcatcacagtatgatgctttcttatatatattactatctcctgacatttccttggctatgtgttttcacaggggctaaactcaacccatctgtttgtttactgcttagttcctcatgtctccaatcagtaatcttgacaccttcatattcattcattcagtaaatgtttatggggtacaaagatgaataaaatgaaccacttgcctgggcacagcccagcacttcagaaggctagggcaggaggatcacttgagcccaggagttgagaccagcctggtcaacatagtgagacccctatctctaaaaaaaaaattcttttaagtagctggtcttggtggcacatgtctgtagtcccagttactctggaggctgaggcagaaggaattgcttgagcctggaggttgagattgcagtgagcaatgttcatgccactgtactccaggctgggttgacagagtaagaccctgtctcaaaaaaaaaaaaaaaaaaaaaaaaaatgaacaccttaaaagaactcacagactctaatattttaaagagactctaccagccaagaaaatcacacacaacaatcacggttacatattatcatgattaatgtaaccaagagaataaaaatgttctaaggcattttaacaaggaataatttttaagtagtgttcaaataaccttttaaaaaattaatcatattaaaacataaagtattaatgcaccaagaattttctaggaacaaaaagataacactggtcaggtgtgatggctcatgcctgtaatccaagcactttgggaggctaaggtggaggacttcttgagcccaagagttcaagaccagcttggacaagatagtgagacccccatgtctacaaaaaatctaaaaattagctgggtgtggtggctcacacctgtggtcccagctactcaggaagcagaggcaggaggattgcttgaatctagcaagtcgaggctgcagtgagctgtgttcataccactacactccaacctgggcaacagagtggagaccctgtctcaaaaaacaaaacactgcaataagaaaactgggcaatacgtgtaattcaaagccaattttaaaatagttaattcagtcctggctttcttatttaaatatatcaactaacagaaccctttgaaaaggcaaaagtttgttactttgaacttcaagtaaaaatctcccaatcttagtctatatttatctgtaagccttatcgaagaggcagaaaaatctaagtttaggggttgatgtctaatatttccctaaaaagctaacaaacttttacaatatgtaataatcgtgttagaaatacattaaaattctatccgcttcccctaactcatcactgatattgaaaatatgggattttcataaacatttctgttgcttattctcatctcacttgctggctctttcaaacaagttcttatagtcagtgaagaaaaaaattttcacatttacagaacatctactataggctagatctcattcagtaagtagtctcatctcggtttttacacacacacgtatatacatacacacacacacatacacacacacatacacattcacacacaggcatacttacagacaagtcccaatagcaatgggcatcaaaacaatttaacaatctatgtcaggattactagaggagcaaagttttgtactatacatgaatgctgctctcagtaacatcttaaaccctgaattgaacttaaattagatatgtctaagttatcgtcaatcttctaagtaggaaggtaccacagtctacatatgcaattaattcttcagaagtttaaaaaaaattactatctgtatgcctatatagcacttctaaatgcattttccaacattttagatgattattcacataatcattcttttgttattgaatagtccatttgttctcaatgttatattttatatataatgcaatgaactgcaaagtagatatataaatgtttatggaatggaagaagcagaataaagaaggaccgggactgtactgctttatgttcattttgcttataaaactgattaacatgttggctgaagtttacaattcaactgtttaatgcaaattcctttgtatggggcataaaaatcctcaaacttgagtagagcatgttactactacaatcactgccctaattttaaacttacatgtatcactcattatggaaaaattatttaattattaaaaattgtctgtggcatcaatgtttataatcccacaccattttcccaataggagcaatactcacattaatccttaaataataggttctgaaaaggtaaaacacgaaacaacaaaatctttacttcaagtctatccttaaatgacacatgacctcaccacacagaatttgattttactttttatacaaataattcacttctccaagattttcctaaatcctgagacataaaactttagatatacaacatgtattttcgttattaacaatgtaatgatttggtcctatgtctgaaaacaagtttaaaaaacaactgattaacactagacggtaatatcaaaacagaattgctttgtgaagatggtagaatggtgattcttccctcctttttttaaatgctctttaatattactgttttcaatttaaataataaagaattattgagtttattctctatttcctgatatttatctacaattagctaatacaatttaacataaaattaagaattcagaatctagatttctttagcgatttaaaaatataatgcatgtttttcaattaattataaatgacaaacacagtaacttaatacctactaagggtagttaattagtatttgggaaaagaattaaagctacaatcagaacaaaactttaaaaacttttcattattcaaattacctaagcattttctttttctttttctttttcttttttttttaaatggagtctcactctttcccaggctggagtgtagtggccctatctcggtacactgcaaccaccacctcccgggtagttcaagtgattctcctgcctcaacctcccaagcagctgggattacaggtgcccatgaccacactcggctagtttttgtatttttagtagagattgggtttcaccatgttgaccaggctggtctcgaactcctgacctcaagtgatctccctcctcagcctcacaaagtgctgtaattacaggcatgagccaccacacccggccagcactttcttttaaaatgtttgatattaaacaattatgtatgcaggcatacataatcttatctaaagggaaaacataatcttacataaatattactaaattaatctttattggcttcatcggtttacaatcatgttatgttatcaaaatacctttaatagtcaccttatagcactctgctatttgtcatccagttttatgcatcaaacacaatataccttttggttattcctaactgctcaatggcaaacacacgttccagaatatagtcatgggatttacaacataatattcttacagaagacatatgcagtgttccaaaatattttccaagaatacttcaagttttgtatttatacacttaaggaaaattatctacatgaatattttaaacctctaccaaaaaaaaaaaaaatccataacctcatcttgccacaagcacaaagctgcttaccattcatagctgtgggaaactgagccatcatggtcctgagttttccttgctagctctcagccatctgcaacataaaaatattgtgccgttgataatacaacaagggcaaatcacagtttagtgcacccgctaagcagtaggaatgtctgtccccttcagctcacacttccaacagaaaacaatgcagagcttctgctgctgctgaacaggcagaatttacatttgaggaagggtaagagattttgttgggtaatcgtgctgccttaatacagaaaaacagtcacatatttaatagtagatactgaataaagaaacccttggcatgaaccaacattcttgtagaaattaatttggaagagaaaaaaataaatcaactgtataaattaagtatataagaataacatggaaatccatacttttttttttttttaaatagagtctcactctgtcacccaggctggagtgcagtggtgcaatctcagctcactgcaacctctgcctcctgggttcaagcaattctcataccttggccacctgagtagctgggactacaggaatgctccaccacacctggctaatttttgtgtttttagtagggacagggttttgccatgttgaccagaatggtctcaaattcctggcctcaagtgacctgcccacgtcagcctcccaaagtgctgagattacaggcgttagccactgcacccagcccatagtatcattttttaaaaactcccaaacaagaaaaatattcaaaataaatgtagcgcagctgtttaaatgagctcaaggggtttataaaatagtctaaaagtaattattaaaacacacaaaattattaaaatacatatataacataactaaatgtgctgggcaagcactctaagagaagggactttggaaattcacagctctgggttcaaacccagctctgctattctcccagctgtgaccatggaaaagttatttaaccttttttgagactcagattactcatctataaaaaatactttgcagaagtattttttaaagtgttaaacataatccagtaaactgcctgccacatagggtgttcaacaaatggctgctattttgcaaacaaccagaaaaggagagtgcagtatcattttgaaccctgaattcattattcagctgtcaataaattcaaaaattgttccatgaatctttttgtgggtctgtttttttttttgtttgttttgttttcttgagacggagtctcgctctgtcgcccaggctggagtgcagtggcgcagtcttggctcactgcaacctcacctcccgggttcaagcgattctccagcctcagcctcctgagtagctgggtctacaggcgcacatcaccatgcccggctaatttttgtttgtttgtttgtttgttttagtagagacgaggttttaccatgttggccaggctagtcttgaactcctgagctcaagtgatttgcttccctcagccacccaaagtgctgggattacaggccactgtgtcctgcccgttccatgaattttgagagtaggaccagttaggaagtgaaggcctagcaaatttatagcaatgcacttagtaattaaaaccatggatcataatattgcaggaaaacactactatattaaaagatcatgccgtatctcatctatttacccaaatcatttaaatattaatatttttagaagcctaagaaaaatatttgcacagccattttaaacaaagaaggcattaagtagtacatacatcgtggtcaacgtttctcaccattttatagctagcttaaaaaatgaacacagaaggaagtcccatcaatcaagttatgactgcaacttcctcaaatacagaaatactgcaaacaaatataacatttttacttcttcaattttaaatcataagtaatgttaacccaaaataagctacatggctaaaaacaaactatctacttaacagatatgcagtagcaagggcccttattcattagttttctgtggctgagaccattttaaaacatgggagaaaacccactattgcaaataatgcattttctaactctgcataatagcatgtgaattataaagatggctctaacaacagaaaaaccaacgaggaatgggatcccatggacacaaggccttaatcagttgggatctaggtctaaaacttacaaatcatctgtctagaaccatttgttcgtcatcacgtattctgtgaatacaaaagaatgccaaatagagagcaacgtgaagaagaagacgcgagaacgaaccccggactgaccaaagcctgcatgccactgcatcctgtgccaagtgcttacctcctgccaccgttgccaccaccatgcccaagagaaagggtgaaggggatgctaaaggagataaagccaaggtgaagaacgaaccacagagaagacccatgaggttgtctgctaaacctgctcctccaacgccagagcccaagcctgaaaaggcccctgcaaagaagggagagaaggtacccaaagggaaaaagggaaaagcttatgctggcaaggaggggaataaccttgcagaaaatggagatgctaaaacagacggggcacagaaagctgaaagtgctggagatgccaagtgaagtgtgtgtattttttataactgtgtacttctggtgacagtagtttgaaatactattttttatcaagttttataaaaaatgcagaatttcattttacttttttttttttttagatgaattctcgctctatcgcccaggctggagtgcagtggcgtgatcttggctcactgcaacctccacctcgtgggttcacgcgattctcctgcctcagcctcctgagtagctgggattacaggcaggcgccaccacacctggctaatttttgtatttttagcagagatggcgtttcaccatgttggtcaggcttgtctcgaactcctgacctcaggtgatccacctgcctcagcctcccaaagtgctgagattataggcatgagccactgcacccggccacttttttttttttttttttttaaggcagagtttcgctcttgttgctcaagctggaatgcaatggcgcgatcttggctgactgcaacctccgcctcccaggttcaagcaattctcctgcctcagcttcccaagtagctgggattacagttgcgcatcatcacgcccggctaattttttgtatttttagtagaaatggggtttcactatgttagccaggctggtcttgaactcctgacctcaggtgatccacctgcctcagcctcccaaagtgctgggattacaggcatgagccactgtgcccagcctactttttttttttttaagctatgttgttagcacacagaacacttcattgttgtttttgggggaagggccatatgtcactaatagaatgtctccgaagctggactaatgtggaggaaacacctttcccttctagttttgagagagttcctcttggctcccaggaggagggattccctgactttaacacacatggccaccttggcacaaaagccttgtggtatggaaaacaaatttgtttttatgtcctcttctccctttccgtccttcagcagagacttaactcccttaaacccagacatctgttgagacctgaccccccaatcattagttaccagtgtgtcaggcaatctggactttccagtgatgccactgagacggcacctgtcaaaagagcagtggttcttcagataaattctgccattttcatttcacttcctgaaagtcagggtcggctgggaaaagttgttaaacaatatgctaaatgtgaaatgtcaaccctcactctaaactttccctgttcacagcatcagatgaagacttcattgggttttagagtggctttcaagaagggagtttgaaagttgttgtggccaggcgcagtggttcatgcctgtaatcccagcactttgggaggccaaggcaggcagatcacctgaagtcaggagttcaagaccagcctgaccaacatggtgaaaccccatctctactaaaaatacaaaattagccaggcgtggggcacatgcctgtaatcccagctacttgggtggctgcggcaggagaatcgcttgaacccaggaggtggaggttgcagtgagccaagatcaggccattgcactccagcatgggcaacaagggcaaaactccgtctcaaaaaaaaaggaaaattgttgtatactcaatgattgtctgcccatgtcctgcctgaaataccatgattgtttacggaaagtatctttaataaagctggatacagtttggcttgggaaaaaaaaaaagaatgccaaatagtagatgctcagtaatcacaggcataattctgaaataaaacctgagaatgaactaaatattaataatattactggcaataagggcaaatcccttgggtaaagctgaaggtactagtattacagaatctttatcatctggtatgtggaatttagccacccatgcacataggtaccatattatatgtaacatttatattgtatgtaacatctgattaactgtggtaacatctaaatatgggagtatattttgttggaaccaataagcttttaaaacatatcatttcatatctattacatttctattctctctgccccactgtggaataattacctaatgcttaacaattctactagtctatttgcagagtagtacttaacaattataattgaaattttgaaaatgcaacagataccaaaaactttgttttacatttttcaaaaagcaattaataaattaacatttactgtttaccattaattcaatacacttctgttgatcacagtagatgtactgtgtcatgctgagtattcattgagaatccaatgtttcaggttctgcagaaggagcttcagacactgacaagcttgtagacttatctaccaggtgccagatactgctaggcacctttgataatatggatactcctctcacaatatccccacaaggcagatgatactgtactcatttcacagaagaaactgaagaggttaaattacttgcccaaattcagtatgtcatgaagccagaatgcaatcccaagcctgtctaattcttaagcccatgaacttcccatgggctttatctgcctcttcctctcttaaatggagataatgcgtcacaggttcctacaaacagcaggagaacttactgttagcacatttgtccaggagaagaaaaacaagccagagatgactcccaacacactggacagcatcaatcacatacataaattagggagtgctaattgtttcttatctcttggtataactctctgaaaggaagaaaagggtaaccagcatctccccaggtacatgactggcgcctgtttcaggcaagtgcaactgaagtcagcatccaacaaacacccctttctactcttcacaggggatgaaatgtagtgacaggcaattttggcaaatttgcagtcatcatgtattttgaatactgttagttatgtatggtttttagaatgttcatatgattttcctgctcattaaaaattaatgcagaactggcattgttccctttgtagaaaccaagaaaatatattgggtaaatagtaggcataaggcaaagaacactgcttcaatttaatataattcagttgccatttggagtaattgccaaacgtactttagacaatgtagaaaatatactcacactaagacagaaaaaagtagaaatgctagaacaaaagcaggaaatcctgcttttacaaacggtcagtaagactcagaaaaagtcacagccattataagtgaaaagtcgcttaattaaggtttaggggtttttttgttttgttttttgagacagagtctcattctgtcactcagactggagtgcagtggcacaatctcggctcactgcaacctccacttcctgggttcaagtgattctcctgcctcagcctcttaagtagcggggactacaagcgcacgccaccacacctggctaatttttttttttcttttttttgagatggagtctccctctgtcacccaggctggagtgcaattgtgcgatctcagctcactgcaacctccgcctcccaggttcaagcaattttcctgcctcagcctcccaagtagctgggattacaggtgcccagcaccgcgcccagctaatttttgtattattagtagagaggaggtttcgccatgttggccaggctggttttgaactcctgacctcacgtgatccgcccgcctcggcttcccaaagtgttgcgattacaggcatcagccactgtgcccagcctgatttttgtatttttagtagagatggggtttcaccatcttggccaaaccccaaaccccttggcccagccaaggttaaagtttttgtttgttaagaagcacagttacagaaagaattacaattactttccgtgccaatagcgctcatgcaaacatggtgaacattcctaaaacccgcaggactttctgtaagaagtgtggcaagcaccaaccctgcaaagtgacacagtacaagaagggcaagaattctctgtatgcccagggaaagtggtgttatacaggaagcagagtggttatggtgggcaaactaagctgattttccagaaaaaggctaaaactacaaagaagattgtgctaaggcttgagtgcgttgagcccaactgcagatctaagagaatgttggctattaaaagatgcaagcattggccgggcgcggtggctcacgcctgtaatcccagcactttgggaggccgaggcgggcggatcacgaggtcaggagatcgagaccatcctggctaacaaggtgaaaccccgtctctactaaaaatacaaaaaattagccgggcgtggtagcgggcgcctgtagtcccagctactcgggaggctgaggcaggagaatggcgtgaacccgggaggcggagcttgcagtgagccgagatcgcgccactgcactccagcctgggcgacagagcgagactccgtctcaaaaaaaaaaaaaaaaaaaaaaaaaaaaaaagatgcaagcattttgaactgggaagagataagagaaagggccaagtgacccagttctaagtgtcatcttttcttttattataaagacaataaaatcttgagtttatgttaaaaaaataataattacaattatcatttagtccaaaaccctcaattttcaaggtgggaaaactaagaaacttgtaaaagatcacaagttagtagcaaaggtcccagaaactacatctctgatgtacatgtccagtgctctggttttttaagacaaagtatcaccctgccacgcaggctggaatgcagagacatgatctcagctcactgcaacctctgccacctgggcttgagcaatccgcccacctcagcctcctgaggagctaggactacaggcgtgtaccaccatgctcagctaatttttaaatttttttgtagagatgcggcctcactacatttcccaggctggtctccaactcctgggctcaagtgaacctcccaccttggcctcccaaagtgctgggattacaagcgaaagccactgcacccagccttccagggctgtttgtttgtttttgagacagagtctcactctatcccccaggctggagtgcagtgcgccatcttggctcactgcaacctccgcctccctggttcaagtgattctcatgcctcagcctcccgagtagctgggattaaggtgcctgccaccatgcccagctaatttttgtatttttagtagggacggggtttcgccatgttggccaggctggtctcaaactcctgacctcaggtgatctgcccgcctcccaaagtgctgggattacaggcgtgagcaaccacgcccagcccagtgctctgttcttaaaagtttcccttggccgggcatggtggctcaagcctgtaatcccagcactttgggaggccgaggcaggtggatcacgaggtcaggagatcgagaccatcctggctaacatggtggaaccccgtctctactaaaaatacaaaaaaattagccaggcatggtggcgggcacctgtagtcccagctacttgggaggctgaagcaggagaatggcatgaacccaggaggcggagcttgcagtgagccgagatggagccactgcactccagcctgggccacagagcgagactctgtctcaaaaaaaaaaaaaaaaaaaaagtttcccaacttgcccactcatatcacctgggatatttactaactgtacattatgaatagaacctaaataaatgttattggcttgagacccttccacacagctactagttttttcttaaagcactcattaatgcccctttcctgcttagaaaatcttccactgattacaagttaaagtccaaacttcttagtatgaaatacggccctcttcagtatctcactgtatcacatactccaggtactttccatttccatatgtcctaagtataccaatcttttttgaaacagtaacttttgttctctcctctactccttcataaagaggtgctccctttgtcatggtcatcacactttcttctccttctttgattcccaattcaaatgtcatcttgtctttgaaagacttctatcctcccaggtagttagtcactatctcctatgtgtgtccatacacttgtttacaccacaataacctcatttatcacactattttaatttcatgattgcctgtttcacatgtcctggggagagaccatttttatttacctccatatgcctggtttctaaaccagatcttccaaagaaaacactcgataaacatttgctgaacaaatgaattgggtaaataatatggttgagataccaaaaaagatgtgaataaagcaagcagggagaggcaacgatgaactgaatatacagaaaggaaaccagcaggaagcagaacaggctccaacctacttccattaaaccctgcagaaatcagagttgtgcaacatggctctcctgtaacttggcttttctttttttttttttgagtatacttttaaagaaaggtttatttcccattgacttctgaaggttttttatcgagagtgaggaaggcggctcaggttttttaattacttcatgattcaatattttgaatcattttgattaaataaatttgacgaatggtctgacattcaaaagcacaatcatcaatcatcatgttcctgcaggcgtgtgtgtctatatgtatgtatgtgtgtgtgtgtgtgtgtgtgtatacacaaaatatatatatatatatatatatatatatatatatatatgtaatttttttttttaagacagagtctcgctctatcacccaggctggagtgcagtggcatgatctcggctcactgcaacctcagcctcctgggttcaagtgattctcctgcctcagcctcccaagtagctgggattacaggcgcgcaccaccatgcccagctaattttttgtatttttagtaaagacggggtttcaccatgttggccaggctggtcttgaactcctgaccttgtgatctgcctacctcagcctcccagagtgctgggattacaggcgtgagccaccacgcctggcttttttttttttttttttttctagagacatggtcttgctacattacccaggctagactcaaactcctgatctcaagagatcctcctgctgcctcagcctctcgaatagctaggactacaagtgtgcaccactatgcccagcttcctgcaggtatattttataaaactttctctagtgtctctgccactcccagcatgtgctaggtacacacagccaacttccaaactatacttgctgatcagttgagaaaagtgttcctgtctcatttagttcccaaggagatcaaggtcagttctctatgaatgtaaaccaaaaataaaattctaaggccccccaaccttctgaatggacttccttctcatccagggcactgttaaaatttaacctgaggctggttcaggccgtgatgggaagtggggttcagacatactcattaaaccctcactggccttaacatcaacacagacttagtctgataagaagcatttacatctatcctctcagaagcctgccacccagaggcttcatctgcatgataaaactttagtgtttataacctcttatcaacataacccagtcttttcctttctattgatcccaggtctttagataaactcaagctattgtcaaccagaaaatttttaaatctacctataaactggaatcccaccctccccttcgagttgtcccacctttctggatggaaccaatgtatttcttaaatgtatttgattgaagtctcttgtctccctaaaatgtataaaaccaagctgcaccctgaccaccttgggcacatgttctcaggacctcctgaaggctgtgtcatgggccatggtcactcatatttggctcagaataaatctcttcatatattttagagagtttggttcttttcatcgacatgagaagagctggagcaaaattacctgctactttatagtttctgcagtaagatgaaatttacagaatacatatattctccacctatgcattcattcattctttcattctaccattcatttattcatcaaacatgaatggtcattataataaagggacttggccaggtgcagtggctcacacctgtaatcccaacaactcaagagactaaggcaggaggattgatgaggccagaagttcaagaccagcccaggcaacacagcaagaccccaactctacaaaaataataataaataataaagggatttggggaatgccaagagaacccagagaacagaacgaacactacttgagaggtaaatcaaagtaaggtacatgtaatcaaggaggtaatatttgtgtaagaattatctaacatgaggtcggtggcaaactgagtgaactccaagtgtccttggagtgaatgacattgtatagtgtgcagataggctctgttataaagaaaggaagtttctgagcctgagagaaggactagttaaaagaaggaaagcacaagagccagtgtaacaccaaaaccactcctactcgtattcaaaaactgtgcgatttgagagtgatgtaatttcaaagaagtcacttcatcttaagaggtacaagaggccaggtgtggtagctcacacctgtaatcccagcactttaggaggccaaggcaggcagatcatttgagtcctgggctacacaaggaaactccatctctacaaaaaacacaaaaattagccgggtgtggcggtgcatgcctgtagtcccagctactcaggaagctgaggtgggagggtcacttgaacttggaaggcgaaggttgcagtgacctgagattgcgccactgcactccagcctgagcgacagagtgagacgccgtctcaaaaaaaaaaaaaaaaagagttaaacctttagaaacccagtagtcttcaaattacgctccttggagttctaaaagtttcaaggaggtacaacagaggtggggtagggaggaaagagggaaggttggaagggataccaacttcagtgagactagctctgtttttgtgttttatatattgaagcttctctgtaagatttcacctgattttttcttaaagataaatgacaacacactgaattccatcctcttcatttcagaaacaactaaataggtcaggtgtggttcacggctcatgcctgcaatcccagcactttgggaggccacagtgggaggatcacttgagcctaggagctcaagactagcctgggcaacacagggagactctttctctacaaaaaattaaaaacttagttgggcatggtggcacacacctgtagttctagctactcaggaagtagctactcaggaggtgaaaggatcatttgagcccgggagttcaaggttacaatgagctatgattatgtcactgcactccagcttgggtaacaaagtgagacagtgtctctaaaataaaataatgtaaaaaaaaacaagtagaagccaaagagattaagtaaccaagatcacacaatttaagacaaacagtaagtcatgctattgattttggacattgctgtgcaagtcatggagagccagtatttaaaacacagtataaagttgaatgtacttggcagggcgcggtggctcacgcctgaaatcccaacactttgggaggccgaggcggcagattacctgaggtcaggagtttgagaccaccctggccaagatggtataaccccatctctactaaaaatacaaaaattagccaggcatggtggcacacgcttgtagtcccagctacttgggaggctgaggcaggagaatcgcttgaacccggggggtggaggttacagcgaactgagatcacgtcactgcactccagcctgggtgacagaacgaaactccatctcaaaaaaaaaaaaaagttgaatgtacttgtttacccagcatcaagatgaagaaagtcaaaatcgtcgcagtccccaaagtcccctcatgctcccttccagcctctgtcccaccagggaaacatgatcccaacttctaataccatagattcgttctgtctgctaaggtacttcatatgaatggaattatgtagcccgttgtgtctcttttgttcagcatttggtctataagttgtgtcattatagatcctgtgttctcaaaaaaggaaaaaaaacacacacacacacacacatatagtatatgttctagttagagacccacatttggtagttatcagagattgggaatacttgtaatgtcagtgaattacattatccagggaaagtacatataaaaaaatatataagaagactggtcttttaagaggagaggaagacaactctgacaagcagtataggaacaaactggattttgagtcttgagacaaacacaccaattatgaagtgactggcatagtccaggtggtgagaacttgaacttgagcaatggagaagaggtatttcaaaggtagaatagacaggattttctggtcagctaaatgtggaagatgaaagaggagcatcacagatgggtttctatcttgggtgactgtagagcagtaatattaaccaagatagaagctctaagaaagtaggaatctagatattagatttgagggatgaacaacaaaatgttcaattttgagcacacctaatctgatccacctacaaagacatctagatggaagtgtccaagatatagtgaacactctatctagaaacccagatttcgtagtcattagggattgggagtagttgtaatcatgtgggtgaatgacattatccagggaaatcatgtataagaaaaaagagacaagaatagtcagaaacagaggttcagaaacacgagaaatcgggatacagagttaagagtttcaaggagaaaatggtattgtcacagaagttaagactcagctattagtgttggcaatctggagtgagtgtagttctagcacagtgatggctatagaagccaaattgaagtagattaggcaataaatgtttaaaataaggggaagagcctgggtgtggtgcctcacacctataatccaagcactttgggaggctgaggcaggcagatgacatgaagtcaggagaccggtctcacggtcaacatggtgaaaccctgtctctattaaaaatacaaaaatgcgccgggcatggtggtgagtgcctgtgaggcgggagaatagcttgaacctgggaggtggaggttgcagggagccaagatcgcaccactgccctccagcctgggcgacagagcaagatttcctctcaaaaaatacataggaaaaaaggtaagatttaagaaagggaggcagagttattataaggctttagtttttaggtgacagaacaaaactatttttagacaaaaaaaagaaataaagatttaatttacaaaaaggagatgggagagaagttacctaatggaagttagggccagaaaaagaagtagtagacagctctagaacacgaagttagaacctgggacagatatttctgtctctaagaatgaagttcaggaaggggagtaagaatgaacaaaggcatacataagtttagaagcagaagaaagagcgattgagaaggtacagattttcttctaccatttttttttcttttagagatatataatctttttgagacagtcaatgttgccaaggctggagtgcagtggcataatcacggtgcactgcagcctcgacctcccaggctcacgtgattctcccacctcagcttttcaagcggctgggaccacaagagcacgctgccaagcccggctaatttttaaaatttcttatagaggtgcagtctccctatgttgcccaggctggtctcaaactcctaagctcaagtgatcctcccacctcagcctcccaatgcaagctttctttgtctctcttctttaggctcagacaacagtccaaagggcagagctaaggacagactccttgatctcgtaggccctcaagtgtctaagcacaaatttctctcctcttcaagccataaaagagaaagacacatgcaaatcagttcccatgactcaaccagatatgtgcatttcagcttgcattcaaatcagcttaggccctacacatcaaaacatttgttaaaatgaatgaatgtgaaggaaaacattctaggcagaggttactctgcaaaagcagagtaactagtgtggtctggaaaaatagaagattacttactcacatgaaatagtgaagggctggcctggcacagtggctcatgcctgtaatcctagcacttgggaggccgaggcaagtggatcaccttgagctcaggagttcaagaccagcctgggcaacacagtgaaacccctctctaccaaaaataaaaaaaatcagccaggcgaggtggcatgtgcctgtggtcccaagtactcaggaggctgaggagggaggactgcttgagtctgtaagatgggggttgcagtgagtcaagatcgtgccactgtactccagcctgagtaacagagtgagaccccatctcaaaaaaaaaaaaaaaagtgaaaggctaacaacaatgcaaggaaccataacaatagatacaaaaataagtacaatgttaatgcctagctgatacaaatgtcaattagcataagatccttaaaacaacctgaaaaattaaacattaaaaaatatatatataatagaaagtgaaagtccattaccaagaaaacaatcattagcagttttgaatagattgttccagatatttcctatttatacactagcaaataccacttttacacaaatgaagtcatacttcattgttctgcttttttcatgttaccaatttttcacagtgaataagtaatcttctatttttccagaccacactagttactctgcttttgcttgtactgtaaccactgcctagaatgtttcccttcatgttcattttaacaaatgttacaattaatgctacaataaacattcttcatacatgtgtgtaaatataggtctgtggacagatatgtgcttccaaagataaattctagaagtggaagtagcaggttagagagcatgaacattctaattttaatagataataccaaacagcctaaattggactttacctataaagtctctcaatacaggctgatagcataataccaataagatgcggtttagagacacaaccctctaactctgacttaattcaaaagacattttagagtacctataccagtaatatactccatttcctctaagcaattttccacaaacattatttcccttaactaagctttcctctccaaataaatgtaatttataagcacatgctccacaaaaatctcaaacatgaaaaacttactaagcggactccacagacaggggaggaggggtgaacctgaagacccagtcctgattaccacagttaacagtttggtatttgtttttccagatttattttatgcatatataaacaaacatgttatttttcaaacccaaataaaattatgctagccaattaatattctattattttcattacacatattacagatatccttccatagcaatatataatacatcaatcatatccttttaaataggtgtacagcattttattatatggatataccagaaattaagctatcttccactggtggacattaagacggtttccagttttttgcctaacaaaccatactactttgaacatcctcatcctcatatatatactgagtatttaggtaggacaatacttctagaagtagaattaatgggtatcaagttgctttccaaaatttattaatagtaccattttatattcccattggtgtgtaaacatacttgtttctgtataatcttgccaatatttggtatgaacaattattttatgtattgccaacctgagaggcaaattttttctaaattttcatttctctgatcattagggaactcagcatttttcatatatctatcatgtatatttctcctatgaattgcctattcatttattttgcccattttctatagcatgctgttcaatggaaatgcaacacaaactacataatgtaattttaaatgttctagtagccacattttaaaaagtaaaattaggccaggtgcagtggctcacgcctgtaatcccagcactttgggaagctgaggcaggtggatcacctgaggtcaggagttcaagaccagcctgtccaacatggtaaaactccatctctactaaaaatataaaaattagctgggcgtggtggcgggcacctgtaatctcagctacgcaggaagctaaggcaggacaatcgcttgaatctgagaggcagaggttgcagtgagcccagattgcgccagtgcattccagcctggataatagagtgagactacatttcaaaaaaataaataaaaagtaaaaataaacgggtaaaatctgtattaatatattttaattagttcatatctaaatattatcacctcaacatatgatcagtataaaaattcttatgacattttacatttttgtactgtcttcaaactccagcttttacacttattatacacttagagtacttctcaatatagaactagccacatttcaagtgctgattaaccacatattaaaggctactgtatgggatagtgtggttctataggatctttatatgtgagagctcagatttcccccatttcagccttttttcccctatgtttttatttttactgtacaaataatttaaaagcaaaggcttcaaataatgtacaattatgaagagcaaaacatgacagtcattctttattacctcactcacagtaccatctccaagataaccatatcagccactgaagtacattctcacagcctatttttacatattatataaacgtatatatacccatatgtattttacattgtctaaaccttcttctaagataatacccatcagaaataccacattcgattctacataatattcaacaggatgggtagatcaaaatttattttttaatagacacataatacattaatactctcattgtaaaaacttaaaacatacaaataaagccaattcttttgaccatccttccccatcagtctctgaaaatacccagtgctgttaacaacatgacctgtatccacggatctttttctatgcattacaataatagatattatattaatagtaagcttttacctgtaacatatgctataaatgcttttaatctagcttgtttgtcttttaattttagggcatctttcattataccaatttaaatttgttggtctttcttttatgactagtgagtgtcttgtcatacaaagaaaggcctgtctcataccaggtcttataccagaaaattgtcctatattttattctagtacctctatgatttaagggttttatgtatatatttgatctacgtggattttattttggagtgaagaaatggatatgagtccaaattgtttgcgctacccttctaccaccaccacttgcgatgtctagcagtgtctacccttcttatctctatgacctctaagactgtatcccagcccacaaagatggaaaggcagaaggctacgtagagtatagcacagaaaggagggtgggggattaactgtagagaggaaaaacttgacaaacactactttagccagctggtcaaggtcaacatcaacagtcataaagcatgcagacagtatgtgctcttgataagatgaaagtatcattttgcctttgtcatcttcctcctaaaaattcactaacttagtccaagcatgacaaatcatcaaattccaatatacttacaatatatttatatatctcctacaatatctgtccagtaacctctcaaaactgtcaaagtcatcaaaaacaaggaaagtctaaggaactgtcacaactaagaggagcctaaggagacatgacagctaaatgtaatgtggtgacctggaacagaacaaggatattaaataaaaactaaggaaactgaaataatgcatagacttcagttaatcataatacaatcagtattgttcattattcctaacatatgtaccatactgatataagatattaataatagtggaaactatgtgtggggtacatgaagggatatatgggaactctgttctactcgctccatttttctgtaaatttaaaactgtttaaaaaataagcctatcaattttataaaaagcaaatacctcagaagtagaagagtataggtaaatatgtgcctctaattttgaccacattcattaaaaacaaaatacccacttgatccacatggaaatttatcttttttttttttttttttttttgagatggagtctcgctctgtcacctaggctggagtgcagtggcatgatctcggctcactgcgacctccacctcccggtttcaagtgattctcctacctcagcctcccgagtagctgctactacaggcacccgccaccacgcccagctaattttttttgtactagtagagacagggtttcaccatattggccaggctggtcttgaactcctgaccttgtgatctgccgacctcagcctcccaaagtgctaggattacaggcgtgagccaccgcaaccagcagaaatttatcttaagaaaatatctaaagaacaaaaatagattgcaaggatgcatagtacagttttaccaatattagaaaaaatacaaataagctaatttatccaaaaatagagaaagaagcaaaaaattaaagttacattcactcagaatattatttacctattacaaatgacaatttcaaggctataggagataggatatgtttattatataatgtaattaaaaaaaaaatacaaattgtaggccaggcactggggctcacgcccgtaatcccagccctttgggaggctgaagcaggtggatcacctgaggtcgggagttcgagaccagcctgaccaacatggagaaaccccgtccctgctaaaaatacaaaattagccatgcgtggtggcacatgcctgtaatcccagctactcggtaggctgaggcaggaaaatcgcttgaacccagaaggcgtaggttgcggtgagctgagatcgcaccattgcactccaccctgagcaataagagcgaaatgtcatctcaaaaaaaaaattgtagaatatgaatgtaaatttgggttttcttttttttttaatcttacatgaaccacatataccaaaatgttaaacaattaaaaacagataaggctaaacacggtggctaatgtttgtaatcctagcgcttttgggaggccaacgcgggagaatcattcgaggctgggagttcaagaccagcctaggaacatagtgagaccccatctctaccaataattttaaaattagctgggtgtgatgggtggtgtgcatctatagtcctagctactcaggaaactgaggtgggaggatcacttgaacccaagagttcgagattacagtgagctatgaacatgagactgaactccagctggacaacagtgagaccctatatctataaaaataaataaaaattaaaagtgaaaaacaaatactaagatctcagtaaagatcttactcttcagtaaagagaaggctatggtaaacttacaactagtttttcaaatactatgatttttttttttttttttttttttgcccaagctggagtgcagtggcgcgatatcagctcactgcaacctccaccttctgggttcaagcgattctcctgcctcagcctcccaagtagctgggattacaggtgcctgccaccatgcccaactaattttttgtactttttgtagagacattttagtagagacaaagtttcaccatgttggccaggctggtctcgaactcctgacctcaagtgatccacccgcctcagcttcccaaagtgctaggattacaggcatgagccacagcacccggcagcccttgtctatttttcagtctattataaacaataataaataacaagtctcttttactaaaagcatttaactgaaattaccatttcatctcaaatccagtcatgctacatccagtgctaaaaactacagaggaaaagtacactacaacaaacacaccctattgcaggggcagacagagcctggcatctaagctgatgccataccccataagggcctgcatgggaataacttttatctgtgattggtagtttcacatctcaaccaaaaggctaacagaataaaagagtaaagaaattcaaagtagcagctaacgggcagaaaagcattcgtccattttcctatgctatcaagccaatttgaagttttttaaaaaattaccaatatacttcaattactacaaataaagtatactatcgctgcaaaaaaaatagcacttttgaatataatatcaaaagaatcatccaagaaagcaaacataaaataataataaatgtgggccagttgcagtggctcacccctgtaatcccagcactgctggaggccaaggcaggatgacagcttgagctcaggagtttgagaccagtctgagcaacatagtgagattctgtctctacaacaacaataatcatcatcatcatcatcattatcatcatcatcaatatgcaatgagaatttttttaaagcaaactccaaaatctaacagggaaaaaaattaccaggaaaaaataaaatagagatattgtaacatggaatttgttacactaaaaccaatagcatacccagaaaacatccttcactcacaacaccacctaaccaaagcaaggtctcacttcccccaaatatttcaaaccacaaatttacaaattcttttcatcaacctgaattatttaatttgagtggtcatagacttttttattttaatctgataaaacctatggttgttctccctggaaaaacacaaatgtacaaaatatggcacataattctgaaggtttcacacatccaaagccaactgtagactttcagacagttcatgtgttccatagcttaaatgtttaatgataacatacacaaaccctcattcttaaaaaaagataatgaagtgggaaagacccttccaattatgtaatccactcattcccaaactatttttttaaaggaataaaagaatggctactccataggccgagcagcagcctcattcccaaactattctaaccatcacccacctaagtaagacaagagatccagcctacctacctcctcccattttctagtgcaaaaataactccctaaggaagaattgtagcaatgtaacaagtacacaagagcaaaacggtccacaaaaatttaaatgtaacattaattctacaattgtattaatccaaaaataacagcaactggaaccacagccaatttgagacaacaccactgatgtagtgaaaatatcttctgagtgtgggcatgcatagtactaattttctagtgctgccaaagcatggtatagctgacagatttcttagaagaaaactaaactagagccctcggtaagttctagaaaccagctaattttagttgtgaatactaaatttcagtaatccttagtaactcagattattggtaggtagcctattctaatacataaatatcagaggttatgggaatggaataacaatagcccctgagaactgaggagacggcttgtatttctggttcatgatccattaggaaaagcttctgatctagtgagtgtcttggaccatactgaggaagcattaatctaagccaataattttcaacaatttttccactgtgattctgagtaatggctcaccaatagtataaaattaacctcctaaactggaacccacatacattgctggtgggaatataaaatagatcaactgctttggaaaacaattcagaatttcctcaaaatgttaaacataggttaccatgttaagtcagcaattccacccctcagtatgaacccaagataaataaaaacatgtcccaaaacctgtacacaaatgctcacagcagcattattcacaatagccaaaaagtagaagcaaccgagtggaagcaaatgtccatcaactacagatggatgaatgaataaacaataaacaaaatgtggtatatccatataatccataaaatattatttggccataaaaaggaatgaagtactgatctatgctataacattgatgaatcttgaaaacactatggtaagtaaaagaagtgagtcacaaaagaccatatattgtataattccatttatatgaaatgtctaggataggcaatttcatagacacagaaagtagactagtggctacctagagctagcggtgttgagggagatggaaagtgactgccattgggtataggaggttcttttaagaacgacgaaaatgttctaaaattagatagtgatactggttgcacaagtctgtgaatatactaaaaaacactgaactgtaaactttaaaagggtgaattttacaatatgtatctcaataaagctgtttttaaaaaatctattcacgtgacatacaaggtgttttaggctctatcttccgcctaccctaccaggtatttcaacctccccacctccacctccacttgatcttattcccatgcctcctctctttgcacctgtggaactacctgccttctgagtgacacttctactaataatagcttcctttgccacagtcccattttgtcttgtattatctcattaaactacataccagctagtattgttacttttgttttcacgcctgccccgcttctattagactgtgagctcctgaatggctctttaacttcatatacctagtgcccagcagtcactcacatggtaggcactaaaatattctttaataagcacaggttagcattctttcaactgcacagaagacaaacccagcaacttgagtttgaatcccagtgcaagtacttcctagctttgtggacttgcacatgacatagcttcaatttcctaaccaaataatgtggatacagtagacccccttatctgcagtttcactttctgaagtttcagttacctgtggtcaaccatggtctcaaaatacaaaatggataattccagaaataaacaattcataaatttttaattgtgcaccatcctgagtagcatggtaaaatcctgcattgcccgcatctgtcccaaccaggatgaaaaccatccctttgtccagggtgtatccactgtgtctatgctgcctgcccattagtcacttagtagctgtctcagttatcagaccgactgtcacagtatcacagtgcttgtgttcaagtaacccttattttacttaataatgaccccaaagtgcaagagtagtgaggctggcaattcggatatgccaaggagaagccacttccttcaagtgaaaaggtgaaagttctcaacttaatatagaagggaaaaaattgtatgctgaggttgctaagatctacagtaagaacaagtcttatatctgtgaaattgttaacagtatattgttataattgttcaattttattattattaatctcttactgtgcctaatttataaattaaactttatcataggtatgtatatataggaaaaaacatagtgtatataggtttctgtaccatccatggtttcaagcaaccactaggggttttggaatgtattccttgcagacaagcaaagtactactgtaatcgtacctaaatgccaggttattttaaggcttagatgtcatgtctggaaaacatctggcacatagaaggtgtccataaattatgattattacaacaattatttcaacattattttaattataatcactaatcaacttttagttgtaatcacaatcactaatcactaatctaatttgttttactgaaacaaattagagttgtgccaattattaataaaaggacatgtttttctcactttaatcaatatttgagaaaaaagttatcatttctatctagaggcttagggtcccaaatatacaaagcattaagacctaaaagcctcaaagaggataacttctctatacaaacttagttcttaattctagttctgcaatttagcaacctcagtttagatttttaaacacaaattataagctcagatttttataaatattgagtttagccttcaaaaaaatcaaccaataagccaggagacataaaaggacaggaatagcaaactaatactgaagtggttagtactcaaattctattgaagatttaaatcaaaccaatttttgaagaatagtcaacaactctgaacaagacaattcacccacacaaagggggataaaaatacctaagaatagcttgtgactcagcctgcattcctataaggggtcccagggggactgataatatttagcctattgtcatctgtctcatatcagaactaaatattacagcaaaactatttacttgacatgaataaaaagtacagagggaaagaaattcagacagatgcttcactttcaagtaaaacatcacctctttgaaacaaagacaacttttaagttttgaagccatacaagaaaacaaaagaaagaataagcagattctatatcatctatataacaaatatttaaaacttccttgaaaacaaacttaaaaggtaaatggggaaaaatcacaacacatgataagcagttgatatttttaatgtacatagggctattaaaatagataacgaaaacactaagacctcaaataaataatctacgaaagaagaaacagaagaaataaaagtagttaataaatgttaacatcactaataattaagaaaacgaggctacccacagtggctcatgcctgtaatcccagcactttgggaggctgagtgggggcgaatcgtctgaactcaggagtttgaggccagcctgggaaacatggtgtaaacctgcctcaataaaaactacaaaaaaattagttggtcccagcgggaggctgaggtgggaggatggcttgagcccaggagaaggaggttgcagtgagctgagatggcagtgagctgagatcccgccactgcactccagcctgggcaacagagccagaccctgtctcaaagacaaaacaaaacaaaacactggccaatacccagggctagcaaaggtgaattaaatagggtgcttgcaggtacagcccatgggaatacgtattggtatcactcttcagaaggcactgtgaaaacatatatcaagagtcccaccaacattcatatcctataaagcaataatttcatttctgggaatctgtcataaggaaataacagtaaatgtgggaaatgctttaattacaaagatatggcagcattagtaatcattgaaaaaaactaaaaatgaatgtccaaaaataaaggaatatactaagccaagtatcatgcttccacttaaaatcaaattcatatgatatgtgaattaaatctcaataaagctattttgtgatcaagttcagttagaccacataataacatggaaactgcttatgttcttacaatttaaaacttacattttgatataaatgtgcatatttattatgaaaattaaaacagcagccatcaatcatcaatatttactaagtgccaagccctacactacaagttgttacatgttatcatggttacctcattatcactgataccatcaccaggcccatcctggaagggtctcaggcccaaggccatcaccaactgtggggctggcccaagataaaccacactttaaagaaggcttcactaaacattttcataggccccttgagaatgttaaaaacaaatttggaaattgagcccagtgggattgtgggtctgtactaccctacttttcagccttcttatatagattattccgatggtaagattaaaaattaagggcaaaaggctaatttcctttccagtcacggtgtaaaacaaagaccaaaataagaactatgttaggttagtttgaaatttctcactgaaccaagttaaaacaacaggtaacattaggcacttacactaagcagaagtcactgtgctaagcactttatattacatataacaacactaggaactagctaatatttccccatttcacacataaggaaacagaagctgaagagaattaaagtaacttgcccaagattatacagttatttggtgtcagagctggaagcaggtctaacttcagaggctgtactcttatcctctatggttatgatgaaaataaatgaaatttttattaaaatcacatatactttatctaaaatgaatacgcattcgtgaagaaaatgatcttaaaaatatgaaacagttaaataaaacaaatgtttaccgtctggtaatagtcccctaatccactaaatgtctgccataatccactgctgaatagctccacaagtaaataaatcatttaatgtcctgatgtatctatgaaattatattttaagtgaaccttttgaaacaatactatacattctgcaaatgaaatatgctgccctcttggagctgtgaaaatacatatttcttgatctattaactgtcctaattctgttcagtttcctcccttcctctcccacttcctctttgctctcatatcctttaagaccagttcagttcctcctcctcaagaatacctatattcacactttacccaagagaactctaacattagtttctgcgctccacagctgtaggatgttacaaaatccaaaaaatgaactcaagtaaaaaatacagtatttctgatgtaccttcaactttagatctatccacttacagaattaattataaacattcttatttttctacttcacacttggaatcctgtctttaaaatcagcacacagtaaccaaaacagcatggcactggtaccaaaacagacatataagccaatggagcagaacagagacctcagaaataacaccacacatctacaaccatctgatcttcaacaaacaagacaaaaacaagcaatggggaaaggatctcctattctgtaaatggtgctgggaaaattggctagccatatgcagaaaactgaaactggaccacttccttacaccttatacaaaaattaacttgagatgaattaaagacttaaatataaaatccaaaaccataaaaccctagaagaaaacctaggcaataccattcaggacataggcatgggcaaagacttcatgacaaaaatgccaaaagcaattgcaacaaaagccaaaattgacaaataggatctaattaaactaaagagcttctgcacagcaaaagaaactatcatcaggctgggtgcagtggctcatgcctataatcccagcactataggaggccgaggtgggaggatcacctgaggtcaggaattccagaccagcctggcctgcatggtgaaaccctgtctctatttttaaaaaattacaaaaaggccaggcatagtggctcacatctgtaatcccagcactttgggaggccgaggcgggtggatcacctgaggtcaggaatttgagaccagcctggacatggtgaaaccccatctctactaaaaatacaaaaattagctgggcatggtggcaggcgcctgtaatcccagctactcaggaggctgaggcaggagaatcacacttgaaccccggaggctgaggttgcagtgagccaagatcgcaccattgcactccagcctgggggacaagagcgagactccatctcaaaaaaaaaaaaaatagctggacgtggtggcacatgcctataatcccagctacttgggaggtgaacctggtaggcagagattgtggtgagccaagatggcaccacggcactccagcctgggagacagagcaagaccctgtctcaaaaaaaaaaaaaaaaagaaagaaaaaaagaaactatcatcagagtgaacaggcaacccacagaacgggagaaaatttttgcaatctatccatctgacaaaggtctaatatccagaatttacaaggaacttaaacatatctacaagaaaaaaaaaaccccaccaaaaagtgggcaaaggatatgaatagacacttctcaaaagaagacatttttgaggccaacaaacatgaaaaaaggctcaacatcactgatcatcagagaactgcaaatcaaaaccacaatgatggccgggtgcagtggctcaagcctgtaatcccagcactttgggaggccaaggcgggtggctcatctgaggttgggagttctagaccagcctggccaacatgtctctactaaaaagacaaaaattggcagggcgtggtggcaggcgtctgtaatcccagctactcaggaggctgaggcagaagaatcacttgaacccaggaggcggaggttgcagtgagttgggatcgcgccattgcactccagactgggcaacaagagtgagactccgtctcaaaaaaaaaaaaacacaatgagataccatttcatgccagtcagaatggtgattattaaaaagtcaggaaaacaatagatgctggcaagtctgtggcgaaatggaacgcttttacactgttgctgggaatgtaaattggttcaaccatagtggaagatagtatggcaattcctcaaggatctagaaccagaaatatcatttgacccagcaatctcattaatgggtatatacccaaaggaatagaaatcattctactctaaagacacatgcacacgtatgtttactacagcactatttacaatagcaaagacaccaaaccaacccaaatgcccgtcaatgatagactggataaagaaaatgtgatatacatacaccatggaatactatgcagccataaaaaggaatgagatcatgtcctttgcagggacatggacgaaactggaagccatcatcctcagcaaactaacacaggaacagaaaatcaaacaccctatgttctcactcataagtgggagttgaacattgagaacacatggacacagaggggaacaacacacaccaggacctgttgtgggggggcaatgagggaaggggacttagaggacgggtgaataggtgcagcaaaccaccacggtgcacgtatacctatgtaacaaacctgtacgttctgcacatatatcctgttttttttgtaagaaataaaaaaaaatcggcacacaagaaagtctgcctttcttcaaaaacagttttttcacaaattttttccataaataaaaaaggtactaaaaaaacttgaatccaaaaaaagaaaaagaaaatgcaccgttagatggtaataaatatatcacatttttggtaatgtaactcgtttattctgaatcatttctggaacttgttaatataaatgttttacaagtaaatacaatatgtaaaaatgctacttaatggactaatatgtactttcactcattcactaaacacatattttttactgaatgcccatataactttttttttcttttttttgtttgagacggagtctcactctgtcgcctaggctggagtgcagtggtgcgatctcggttcactgcaacctccgcctcccgggttcaacgattctcctgcctcagcctcctgagtacctgggactacaggcgcacgccaccatgccaggctaattttttgtattttttagtagagacaggatttcaccttattggtcagtctcaaactcctgacctggtgatccgccctcctcggcctcccaaagtgctgggattacaggcatgagccagggcacccggcacatagataactcttttttaaatgtatgaaccaagatgactctaccagataaggcacaggtgctgcagttaaaaggatcttggtttgaaacctggctattgtacttactagctcagagacctaaagtagtcaaacttcaggttaacatttcacttacctttttgatgggaagataataattactcctagggccttagtgagctttaaatgattatgtaaaacacttagcatagagtctaacatgcagttacgtgctcgataaatgacaaccatggtaaacatattttatactgaagaaagtatagttgaaggagacagccaatatgtgacccttttgtcttactaaagatggaaatttgtgaaactctacattaaaactaaaaatcctaaggttacatgattttctactttttaaaaaagatatactaactacataaggttaaaggattttttaaaataagaaagaaaaaaagaaaagcttcttgaaagctgctgagtttgggtgatgggtacatgctatttttgtgaaaatacaaattttttaacactattaatccaatccccaaaacatgcctaacacacctcctcatattcaggagagatcaagattttagccttgagatgtaccgaacaatggtaactccctgcttagtaattctgtacaggtcaagttttcttggacgagtttacctttcattacaaaggtgggcacagggaatagttatcaatgcatggaagggtgaaaaaatgcaagcttttcaactgcttattaatattacatcaaaatagcagcaatgcacattttttccacgttttcaaaaacataaaatacatccactttatttacttttgaaattacaagagagtcacaggcacagccaaaaaaagctaaaggaaaacacatcagagttgtcagtatctttaaatttggaaggacgtcattattaattcgcgtaaatgttttatgcgatgtttctaggtagcttttaggttttatcactgattaacaatatagcaaaccagcacagggagagaggcaatttttcgaaacgcttaagaagctttaaactacaagagctatgctacctaaactgagctcactaacaacgtaaaatttcaagtcacaccttgcctatttctgagtaagcaagcaaacactagtgagacaaactagaagcatggagcaaagcaagtcatttctatgctaaccttaattcctatcgtaaaggggttggctccatcaaaaaatattcctatttcagtattaacacaagtttcaaataaagcacacttgccattggtaattctagagcgacaaggcgcataattaataaatccaaacggagcatctttctatagaatacaaagccatctgcagtttcagcctcggtttacccactcactatgcatatgcagacgtctttaaaaataaataaataaatacacaaataaactttatctggcctgagagattacatctctcggtgcttcctgtatattctggaagtcaataacgctgaaggtaaatttaacatttccaactccggaggaacgcgagcggtagacgccaagcatccgcccactgtcctctcgtgactcgggctactttgacgcaccgggatgcggctcacctgacattcggcaccaacccttgccaggaaggaaaaccaactccgcgaaaataaaatgggtccccgaggaggcgtgcgggtgcccccagagctctcttctgctcacaccccgaaagcgagggggccacgccacccccgaccctcgccggcgtccgccacctgccagacgaggccgcggccagggacccgggctcggccgcaaggaaggggcagcccagcccaggccccctcggcgtctgtcccggcccggcagcagaggaaggaacccggggccggaggtttccgccccgcacggccgagcccgccaggggcctagctcgggggccgcccgtactcccgaggacccgtccccatcgtgcggagcgcacagccgcctcagcccgacccgcagagcctccgggcagcgggcgcggcgcccgcacctgccccgcgccttgctgcagccccgctagcggcttcacccacctggcgccctcgccgcgcctcccgctcgtcacagcgcgactccgcgtccctcagcaccggcagcctgggcgcgggcaggcgcggggagaccctgctctgccgccgtcgccgccactgcagctggcttggtcgtcaggccgccgcccgcgaacctgttgcgtagcctgtcacagccgctcagggctccgccggcgccgcctcagccccacaacaacatggcggccg

SEQ ID NO: 1834 - DNA, 3761 bp, Homo sapiens
  source 1..3761: mol_type = genomic DNA
cagagacagaggggccggaagttctcttcacggagccgcgcggctgcgggggcgcaaatagggtcagtgggccgcttggcggtgtcgttgcggtaccaggtccgcgtgaggggttcgggggttctgggcaggcacaatggcgtctcgagcaggcccgcgagcggccggcaccgacggcagcgactttcagcaccgggagcgcgtcgccatgcactaccagatgaggtatgaagtgaggcgaggagcacggaggctttctcccccgctggagcctgcggggcttggggagcgacgccggcccggcctcagggtcttgctccccagccagcccccgctcacctgccaagtcccctcctcccgtgacggcttcgggcctgtcccccatcctggaaagccccgtggcccccgcgagctccaccccttgttccgcccggtgccttgaggggatccagccccgcgtgggctcccgccctgcgtgggctcccgagtcacgtcgatgctggccccgctgtatcaccttcgaaaccgaatttctaatttgagcctcagcttcctcatctgtagagggagagaataatctgccttttaggttttggtgaaagattaatcagtaattcgtgtaaagaaagtagcataaggcctaccacgtaatatatggtaggtgttatattttgggccgtttggggggatatagacagtaaaaggcagcctttcctaaggacgccttgcctaaaatgaattttataaacactcccacgtaaggggtatttctacattcaattactagttcgacaaatactgagcttccaaacatcatacactgctagacactaggttataatagtgagcaaaagcagacgtggtctttgtatacatgttataccttcaataaacaattttattaaagaaaaaaaaaactgttccctgccttcatggagcttgaagtctagagatgactgttttttttttccaacctttccacattttctacaataaatatttttaaataaaaattttaaaatttttacttccttaaatccattgatctctcccagaatgttcttcacatctctctctccagagttttaaagaatgacaagctctttgaactctcatttgtttcacatctctaggccccggctgaaagggccctcacaacttaagcaggtgttttcatgccagcccagagtagaaacattgcctttagggatatgaggaggatacgtttgggacgtgagagaattagaagaataagataagtatgtacttcttttggatgaaaaaatctagctggagaagtatgggcggcctgagtacgtttcctctctgccaataccttctcccgccagactttaatcctatggtgcagtcagcgtcctcttgctaaacacagctctgagctacccttctgcctttattattattattaatttatttatttatttttgagacggagtcacggtctgtcgcccaggctggagtgcagtggcgcgatctcagctcacttgtaagctccgcctcccgggttcacgccattctcagcctcagcctcccgagtagctgggactacaggcgcccgccaccacgtgctgctaatttttttgtatttttagtagagacagggtttcaccgtgtcagccaggatggtctcgatctcctgacctcgtgatctgcccgcctcggcctcccaaagtgctgggattacaggcgtgagccaccgcgcccagccctgcctttttattagtagtattgttgttgttttttttttttatggagatggggtctcattttgttgccaggctggtctcgaactcctgggctcaagcagtcctcctgcttcagcctaccaaagtgcttggattagagttgtgagcccagcctcttctacttttaactctcatagtctttgtgattcatatcccactacccctctccccctaacaatatgttcctgccacacataaccacttgctttcctggaacacaaatacttgggcctttttgtctgcatgctcctgcatgggatgcccatcttcactcattcctgagcctagttcagatatcacctgcctctagatagccatctctgacattccatgccaggcagagttgattcctccttcctgtgatcccatatatctgggaacatatatttactagaactttttcacttcattttctaattactttttcctcctctgttctttgtgtccggcttctaggctgttttattcaaatttgtatcccagtgtccagtacagttgtctggcatatagttggtggtaagaaaaatttgaaagatacttctccctctgctctgccccacagtgtgactctcaagtatgaaatcaagaagctgatctacgtacatctggtcatatggctgctgctggttgctaagatgagcgtgggacacctgaggctcttgtcacatgatcaggtggccatgccctatcagtgggaatacccgtatttgctgagcattttgccctctctcttgggccttctctcctttccccgcaacaacattagctacctggtgctctccatgatcagcatgggactcttttccatcgctccactcatttatggcagcatggagatgttccctgctgcacagcagctctaccgccatggcaaggcctaccgtttcctctttggtttttctgccgtttccatcatgtacctggtgttggtgttggcagtgcaagtgcatgcctggcagttgtactacagcaagaagctcctagactcttggttcaccagcacacaggagaagaagcataaatgaagcctctttggggtgaagcctggacatcccatcgaatgaaaggacactagtacagcggttccaaaatcccttctggtgattttagcagctgtgatgttggtacctggtgcagaccaggccaaagttctggaaagctccttttgccatctgctgaggtggcaaaactataatttattcctggttggctagaactgggtgaccaacagctatgaaacaaatttcagctgtttgaagttgaactttgaggtttttctttaagaatgagcttcgtccttgcctctactcggtcattctccccatttccatccattaccccttagccattgagactaaaggaaatagggaataaatcaaattacttcatctctaggtcacgggtcaggaaacatttgggcagctgctcccttggcaggctgtggtctcctctgcaaagcattttaattaaaaacctcaataaagatggccctgcccacactgtgccttgtgtttggggcttgatagagtgtgaaaggtgtgttgcttgaaaggtgtggccttagacactaggagatgatgggtagaagctccttgagaaacctagcagtggccatagagaagtagactgggtatggggaacctaagtcatagttgtaacctacagctgattggtaagaactatgggccagacatttaatctctccatctatgaaatagtccattctcatttatctaccttaggttatgggctcttcttttagttggatattcacatttatctttcagtgttaactgggtatcagttatgagtctactactgtataatggcatccaaaagaattttaaagtacctcggtttatagggatttacaattcagtagaaacttgttattcatgtgaaacagtgaacataatatctaatgatgtggagcaagtacattaaaaacaggaaggaagagatctgtgattaaactaaaggccctttcacacctaa

SEQ ID NO: 1835 - DNA, 23249 bp, Homo sapiens
  source 1..23249: mol_type = genomic DNA
ttccactgaattcctttattcagtcaacaaacatttccagagccccctctgtactgaggcctcagcccagcccccaaggaaccctgaggtcaggggagacagctggacacagacacttccccagccccagggccagagtggggctggagggaaggacagggctacagtagtagtgggggtatatgagggaaggctgcaaggatgtggtagctggagttttgagagatggataagagttttccaaggaggcaaaagtggcagaaaagctttgcaggtgaggaggagcagcagaagcttaacctgcatgagaatccctctcaccagtcagaaagttgaccctgcacagccaaggggtaagctctgaccattttgcaggggacagaactgagacccagagagggaaaggaacttgcccactgtcacactgcatggaaggggcaaaactgtaggctccaatacttgggctcttaacctccttactctgagccttctcacgcttggcatgctgttccctctgccaggaatgcctttccttcccttgattgcgtgaaaagttcctgccaggtttggtgtcatccctttgtgccccttgtagggtgaggacagaaagggtcccattggacaggtgggaaaactgaagccctaggacactcagataccattagggtggactgggaccccagcctttcctgccccctttcaggatcccaaagagatacacgggctcccctaaaaggcagagtcccagccacagcaactgctcttgtccttggcttcctccagagaaacagagatcggggagcagaagtcagatcatacatttaaagctacatgagggccgggcgcagtggctcatgcctgtaatcccagcactttgggaggccgagacgggcagatcacgaggtcaggagatggaaaccatcctggctaacaaggtgaaaccccgtctctactaaaaatacaaaaaattagccgggtgtggtggcgggcgcctgtagtcccagctacttgggaggctgaggcgagagaatggtgtgaacccaggaggcggagcttgcagtgagcctagattgcgccactgtactccagcctgggcgacagagcgagactccgtctcaaaaaaaaaaaaaaaaaaaaagctacatgaatgtccccattggaaataagacaggaaactcaaaactaggtgctgtagtcccagctatttaggaggataaggcaggaggatcactgtagcccaggagttcaagaccagcctgggcaacgtagcaagatcctgtctcttaaaaataataataataaatttaaaaaaaaaaaagcctgggtgcagtggctcatgcctattattccaacactttgggaggctgaggtgggaggatcacttgaggttaggagttcgagatcagcctggccatcatggtgaaacctcatctctattaaaaataaaaaaaattagccgggtgtggtggtgcacacctgtaatcccagctactcgggaggctgaggcaggagaatcgcttgaacctgggaagcagaggttgcactgagccgagatcgcaccactgcactccaccctgggtaacagagcgaggctctgtctcaaaaataaaaataaaaataaaaaaaataaaaagagagagacagaaaaggaaactcagggggccagggcttaaggggttgggaagatgcgagagtcttaaatttggttccttgcttctttgggccaggactcagagagccccactgacacatatgcccatctgtcttgaaccttaacaaattgcaaaggccacaggctattctacaggccacgggagcccccccaaatgcaatgtcatgggggtgttcctgaagtagaggaccctcataaggcctctgaggcccagagaggggcagctccgggcctaaggtcacacagccagtcaacagagacctaatccagaggtctgcgggcaggagctatgaaaaggacagggagtggtgtttgccctctgggtgagcagtgaaggcatgagtctcacacccccggcttccgctccacagcatgtccagctgggggcccagggcgctgaatgatggccggtcctgtgggctaggggcccagcacagcttcatgagctcgtgaacctgaggggcgggggacagataatggggtcgtgcctgagcagtccaaaggacacaactcccattcagcgtatttgtttttgtttttttgagacggagtctagctctgttgtccaggctggagtgcaatggcatgatctcggctcactgcaacctccgcctcccgggttcaagcaattatcctgcctcagcctcctgagtagctgggattataggcacgtgccaccacgcctggctaattttgtattttgagtagagacagggtttcaccatgttggccaggttggtctcaaattcctgatctcaggtgatccacctgtcttggcctcccaaagtgctgggattataggcatgagccaccgcactcattcagttttaaaacacaaattaaattccatcccatctctgctccaaaaactcccatggctccctatggatcttacttatttatttatttgagataaagtttcgctcttgttgcccaggctggaatgcagtggtgcgatctcggctcactgcaaaccctgcctcctgggttcaagcgattctcctgcctcagcctcccaagtagctgggattacatgcacacaccgccacacctggctaagtctgtatttttagtagagacggggtttcaccatgttggtcaggctggtcttgaactcctgacctcatgtaatccacccacctcggcctcctaaagggctgggattacaggtgtgagccaccgcgcccagcccttatggattttacaacacacttctcctttcgagactaccctgaccaacatggagaaaccccatcttaactaaaaaaaaaaaaaaaaaaaaaaaaaaaaaaaaaaaaaaaaaattacaggtggcgtgtgcctgtaatcccagctactcgggagtctaaggcaggagaattgcttgaacctgggaggcggaagttgtggtgagccgagattgcgccattgcactccagcctggccaacaagagcaaaaccacgtctcaaaaaaaaaaaaacaacaaaaaaacaccacctctccctgatgccctccttcgctcatctccatccctccttccctcatttgttccgggcagtcacatctgcctccatcgcactggtgcttaaaggcacccagctcattacctccccaaggcctttttcccttccgtgtcctccactggaaatttcttctcctagctttactcatgggtaggctcctcctccttccagcgtcggccccgtaagaggccctctttgaccacccccaccccaccatttccctctgttcatctctttcaaggcacttatcactaccataattttgtctttgttttgttttgttttgttttgttttgttttgttttgttttgttttgagacagggtgtcactctgttgtccaggctggagtgcagtggtacaataatggctcactgcagccttaacctcctgggctcaagcaatcctcctgcctcagcctccctggtagctgaaaccacaggtgcatgtcaccacaccggctattgcttgtattgtttgtagagacaaggtctcactatgttgcccaggctggtcttgaactcctgggttccagtgatcctcctgcctcagcctccctagtagctgaaaccacaggtgcatgtcaccacaccggctattgcttgtattgtttgtagagacaaggtctcactacgttgcccaggctggtcttgaactcctgggctccagtgatccttctgcctcagcctcccaaagtgttgggattataggcatgagccatcgtgcccagcctagaatgttcttatcagattttgctagttactgggaggacagggtcttcagcacccaacaagtcctggcacacagttggcactcaataaatgtttttggcctgagcaaattaatttatcaatgaccaactgcatgtcagacacttccacaaaggttatgattatatgattataaaccatgagagggtgggatgtggtggctcacgtctgtaatcccagcactttgggaggccgaggcaggaggatcacttgaccccacgagctcaagaccagcctaggcaacacagagagaccccatctctttaaaaaaattttttaaaattagccaggcacagtggcttatgcctgtaaatctcagcactttgggaggccaaggcaggaggatcgcttgagcccaggagttcaagaccagcctgggcaacatagcgagaccttgtctcttaaaaaaattatttttatcttatttgtttgtttatttatttatttatttattttgagatggaatcttgctctgtcgcccaggctggagtgcagtggcatgatcttggctcactgaaaccttcccctcccaggttcaagcaattctcctgcctcagcctcgcaagtagctgagatcacaggcacccacacatgggtaatttttgtatttttagtagagacagggtgtcaccatgttggccaggctagtctcgaactcctgacctccggtgatctgaccgcctcagccttcaaaagtgctgggtttacaggtgtgagccaccacacctggccaaaattatttttaaattagccaggcatggtgatgtacacctatagtcccagcactttgggaggctgaggcaggagaatcgcttgagcccacgagttcaagaccagcctgggcaatatagtgaggctcccatctctaaaaaattatttttaaattagccaagtgtggtggtgtacacctgtagctcctgctactagagacactgaactaggggaatcacttgagctcaggagttggaggctgcagtgagctataattgcaccccagcctgggcaacagagtgagcccccatctataaaaaagaaagaaagaaagaaaaaaaaaaaccatgaacgtcaccaccatttatggagcatcgactgtgtgctcggctttgagctgagccctcataggcacaggtgttcaggagtctaatcttccctcaccctataaggcattactattctcattttggaaaagggtaaactgaggctctgaaagtgctctgacttgccacacagtgagagagtagccaagtgggggccaggatcctcatcggcctcacactctagcctttcttctcagtacagagactcaggcgccagctggcttgcccgagaccccggcccaatctacagactgggaaactgaggctagccctgcggcgctcacctcagcagggcaggcaggaggcgccggcagcctctggccctcctccagcagttccaagaggcggcagagggcggggacatcccgctcacatcccatcatccgcaggaactcctggagccaaggaggagcgcatgtggtgggggaggagcctccgtgggtggagggggaggggccacccgtggtgggggtaggggccatctgtgatggagcggggaggggctgcctgaaccgtgaaggggtcagaaaggtgaggaagcgtcctccccactggggcctatgatgctgggaccaggtgaccccatgctaaagagggacgcaggcgcagacaggttggagattggccacgaggggcgtggagggagaagaaggctgggggctctgggaagccgactcacggccgaggggctgcagcttttgtcgcagtaggtgaagagctcgtacaggacgaccccgaagctccagacgtctgactggcgagagaagatgttgtccgagagggattcgggggcatacctggagaggggacaaggtcttgagatgcgagggtgtagaaaggacaggaagaggggggcagccttggaatggggaactggtcagggtaggtggggactgtgagcaggtcagtcccgtctccagggtctcggtttccctggctgtgggataggtggattctccagccctgggaggtgcctgggaagagctaaggctgtggggaggaggcgggggcagcacggaggggcggagatgggggcggggccagagccgtgggagggggaggggccagaactgggcggggggaagggcggaactaagagggggccagccctgaggggcggagccagcgtgttggaggggtggggttctgaagcttgggcggggcgagagctgagagaagggcggggctaaggctgggggccgctgacagcagggcagcgggagacagaggagccagtgctgttgagggggcggggctctggggagtgggaggggccaaagctgcagcggaggaagggcggggctaaggctggggagcaaagcagcgggagggggcgggggcatggctgggggcggagccagagccgtggggaataggggcggagcctaggcgcgggttccccaccagaaaatggggctctggcctggctcgcggaccacgtagtagtctttgtcaagcggcagcagcttagctaggccgaagtcagcgatcttgacgtgtgcctcgctctccacgaggatgtttcgggcggccaggtcgcggtgcacgcagcggcgggagcccaggtactccatgccctgcgggcgggcggtgtgagcgtgcagagaggatcccaggataatccggcaggtaccccaagcgtgacctggcaccccaacccagaccccaactataaccctacccccgagccatcctccactgaagttctgatcctgagccctaagccaaccccaccactcccgagacctggaccccaaaccactcctcagccttcaccgcgacctccaagcagacccctgcccaggccgtgccagctgaatccccacaagtcccggggcgccccctcgcaccttgcagatctgcgaggaatagagaaggaggcggctggcatcgaggcgcgcgcggtgccgctgcaggaagtcgcgcaagcagccgctgggcaggtactccatgaccagccgcaggctctggcggcctggagaaggcaggatctgtcacagcagggcccagccctgctcgtccccccattcttcccccctttcacagtgggaccttgtgtccctctcgacctcagttttgctgactgtaatatgggaaccgcaacaatgacacattgctaatatctcttgagtactttctacaacatacattgatgtgtttatatatcacggccaggtgcagtggctcacgcctgtaatcccagcactttggaagcctcacttgaggtcaggagttcaagaccagcctggccaacatggtgaaaacccatctccactaaaaacacaaaaattagccgggtgtggtggcacgctcctgtaatcccagctactctggaggctgaggcaggagaatcacttgaacttggaaggcagaggttgcagtgagccgagattgagccactgcctccagcctgggtgacagagcgagactctgtctcaaaaaaacaaacaaacaacaacaacaacaaagtaaatatcacaatggcccatttttcagctggagaaactgaggctcagaaaagttaaggtttcacaactggtaaggggtagagtcaggattcaaacctgtaacccatgtgaatctggatcaataatcacgttcccagcctacctaaagtggcctggcaggagggtaagaatgtgcactttgaaaagcacccatacgtcttggttcactcatccgggagctggctcacccgggccatagctgacaccacgatacttgacaatgaaatcactgtgcagtgctttgaggatctgaatctcccgctgaaagtccctctgctggtctggcccgctgtgctgcagctgtttcacggccaccagggcacctgtattgtcgcctagcgggtcatagcggcacagctccacgctgccaaagttgccctgggggatagcgggactgatgtccaggcacctggatgctgccctgccctctccaacccaccctggccctgcccaccttaccttgcccagctgtgagatgtacttgaggtgtctctcctcgaagatcgtggggtcttggcaggcatagagctgggcaccattccacagcccatcacgaggtgccagggcaccaggtgtggggtctgagaggagctcatagtctggggtgggggcatgggcagtggtaagcagcgcctctcatcctgggccccactcctgagttgacttgctgtgcaacctccatctgcatattgaccctctctgtgcattatggcagggccattgcaagccaaagggtaccttgtggagactggaaaaaggtgtctcccactctgtcccaggcaaaggaagcctcctcgtgcagtgcacaccctgtgcaactccacatggctacaaagatggaggacataatgagaactcatttccccagttccactgctatgaaatgtggccacatgactgagctcaggctgatggacaagatatgctgggtgcccctccagtcctgacccatggaaacctaatacggggccctccacactctctcttttatctgcagaggatccaacggggacccaacgcctgaggtgagtgcagccactaagtgagaggttcctgtgggcctggacaccctcattgaatgaagactaaatatcacactgggcatggttgtgtgtgcctgtaatcccagctatttgggagactaaggcaggaggattgcttgagccagtaattcaagaccagcctggggaacatagcaaaaccccatcacagaaaaaaaaaaaaaaaaaaaaaaaatccagcctggtgtggtggctcatgcctgtaatcccagcactgggtggctgaggtggacggatctctttgagaccaggagttcaagactagcccggccaacatggcaaaaccctgtctttactaaaaaatacaaaaatttagccgtgtttggtggcacgcccttgtaatcctagctacttgggagtctgaggcgggagaattgcttgaaccagggaggcagaggttgcagtgagccaggatcacgccactgcactccagcctaggtgacagagggagatagtgtctcaaaaatataaaataaaataaaataaaaatgcatacaggcatgcatcaccatgcctggctaattttctgtttgtttgtttgtagagatggagttttgccatgttgcccaggctggtcttgaactcctgggctcaagcgatccacctacctatagctggaactataggcatgagccactgcgcccagccaaacatttttttaaaagaatgaaatagaccagacatggtggctcacacctgaaatcccagcactttaggaggtagaggtgggcggatcacctgaggtcaagagttcgagaccagcctagccaatatggtgaaaccccatatctgccaaaaatacaaaaattagctgggcgtggtggcacacactgtaatcccagctactcaggaggctgaggcaggagaatcgcttgaactagaggttcaaggaggtagaggttgcagtgagccgaaattgtgccactgcactccagcctaggcaacagagcaagactctgtctcaaaaataaataaataaataaaatatcatcatgttgaaccttgaactgaggggactgttcgttacagtagctgttgaagctcacactgactgtcacagtcaccaacccctccaacctcaccagacacacagggcgtggcctgctgcaaaccacgctccttccactgggcccaatatgacatcacagccctccccacccaacccgtcccagcgggcacctgaagagatgaggctattgaggtcacgaatgacggctcggaaggagggcctctggaccggctcataggccatgcactgttgaatcagcagggccagctctgtccacttgggggccggcagctgctgccggtcctcataaaattggagtttctgagggtgagaggagcagtcggtaatccccaacccaatagacccaccccaatctccccagactggatgtcagtctgcccttctgtcaaagtgggggttcggagaccgatgccgggtgaggggctctgaccttagcaggatccagggcactgatgggcatggtgacgccactaaacacttcccagaccgtggcgccgaagccccacttgtcagcttccaagctaagtgtctgcgcctcccggagacactcgggggccacccaggggatcctgtcggtgagcactgagggaatgaaagtgggatcagggatccacttccttgccctgctcagcccctccctcctccacctccaggaacttactctccaggcttaacacagcggggctgaccccagggtcactcagcttgatgaagggcgggctcccatcagccccctcccgagccaggagcaccttccgggcagagacattgccatggggcaggcctttgtcctcctaagggggccagacacaggaaaatgcccgggagggtttgatgaatgaagagtctgtttggcaaactcctatacatccttcaaaacccacttggtactgctcagacatgctccagcatcgtccctgactcctgacatcctgtcttgcccctctagttcaccccctacactgacctggctatgtccctccccttctcaaacaccaccccatcctgtgactccccagtgcctttgacacaaagtgaaagctcctcagcctggcattcaaggcccttgctcaagcttccaatgaacttcccttccacacttgcaccctggtctcctgccaacagaactgcctgataggccccaggggatgcaacacactatctagcctgcaggcctttgcctaggctgttccctcagcctgacattccttccttcctttcttctcttgatgaacttctactcaacttttaaggccctatctccaatgttccttcttctaggaagcctttcttcctgcccagcctcgtcattcaccacacgccctgacatccaagaatgacttgttctcttctagtgttctcacaacctgaacctaaaatgccctcccctcgaacccttaccaaactcctatgcatactacagagcccactcccaattcctcttccacccagagaaagccttccctgggaatggagggtggagcaggcagaggagcactcaccagatagttgagggcgtaggccagctgtttgaccacctgcagcttccagctggctggcaccaggtggccacgttttcgcagatacatgtctatggcccccaggtgtacaaattcctgcaccatggtgcctggttggcagcagggagaggcggggttgggagactgaactgcacttgtgttgaggaggttctgccaacaccctggctctcagggtctctcaaactctcatctctgtctgttccctcccctgctgcctctgttcatacagtactcacctctcctcccacctccatctctgaatgatttgcctggaatgcctggaaggtgttgagccctgtctgtatctgtatctcacttttttttttctcttttcttttgagacagagtcttactctgttgcccaggctggagtgcagtggtgcgatctcggcttactgcaacctctgcctcccgggttcaagtgattctcctgtctcagcctcctaagtagctggaactacaggcgcatgccaccacacccggctgattttgtatttttagtagagacggggtcttgccatgttggccagactggtcttgaactcctgatctcaggtgatccactcgcctcggcttttcaattacaggcatgagccaccacgcccagcctctgtatctcacttctaaccctttgcatattctgtgtcctctgcctagaacacccctcttcctttcctaatccacacttgtccttatctttccaggttagaatgcatctctgtcttcccacaagcattgcccaacccccaggctggcccagcagcctctctgaccatccacagtgctccgtgctgccctcctcacacctcatcacaccctgcctgtcacattctaggctctgtcccagctcctggcccatcctagactcccaaccaatgaaaccaaggctcagaaaggttacgtgacctgtacaaagctgcagagattagaaagccaggtttgtctgacttcaggtcattctggggctggatatgggtgagaacctggagccgctttccaaggagtgatgatggagagacataaataaagggtaatgaacacggctcccatccagggtggcccagtgtgttgctggggctgtcatatagcggctcagaacagaggtgggaagaacagcctagacttgggtgaggcaggggtggggtgggtgggtggggggctctcactgtctccagccatgcacacgccgtggagcagcacgagatgccggtacgacacttggctcatcaagctcgctgcttccaggaatgactggggaaggtgggaagggagagaagatgcgtgggtttcttccactccaataatcccaaattttgtgctcacagacctgccttaggggaacacctggccacaggtcacctttggccctggagtctgccattagtgcacacagcactaccatgattttctgatacgggacagaagttcccactatcatctatggttttttgttttgttttgttttgtttttgagacagagtctccctctgtcacccaggctggagtgcagtggcgcgatcttgactcactgcaacctccgcttcccagattcaagcaattctcctgcctcagcctcccgagtagctgggattacaggcatgcaccaccacgcccggctaattttgtatttttagtagagacggggtttctccatgttggtcaggctggtctcgaactcccgacctcagatgatctgcccgcctcagcctcccaaagtgctgggattacaggcgtgagccaccgcgcccggcctaaaatttttttgtcaagacgaggtctcgctatgttgcctaggctgttcttgaactcctggcttcaaaccatcctcctgcctcagcctcccaaagtgctgggatgacaggcatgagccaccacgcccaggtccctgtgtgtttttaaatttctctgcatccacgaccccctctccagccagccccgactccaaaagtctggtccacattgctctcacctccatgcagttcttgtgcttggcatccatgaccttcagcagcacctctgtctttcgggcctccccatccaccacctcatggcgacagccccggtaaatcttggtgaaggacccatggcccaggttctcatgctgaatggtgaggggacagcagaagaggccagtgagggggttcctgcaggatcccagcccaagcgagacatagctgctggccccattttacagatgggaaaaccgaggcaaggtaaaattatagcatatgcctgaggccacgcatctgagtctctggaccccagactgaggtatcgcctcatttcccagggcctcttacccactccaggctgtcagcagggatcttgtgaaatgtcatctgactcagctggtattgggattggggctgaaccaaggatgatgtgggtgggctgtgacctctctggaccacgatcaggttggacttttctatggggagaggatgagggagaaaaaccagaaatcagaggtgaaaagtccccaagggttagctaactcatgccttagtttgaggtaccctctagaagccgaccctgagatgaagacttcagggcacatggctttttgttgttgtttttgttttgttgttgctgctgctgttgagacggagtctcactctgtcatccaggctgggtgggcagtggtgcgatctcagctcactgcaacctccacctcccaggttcaagcgattttcctgcctcggcctcccgaatagctgggactacaggtgtgtgccaccgtgcccggctaatttttttttttttttttttttgagacagagtctcgctctgtcacccaggctggagtgcagtggtgtgatctcggctcactgcaacctctgcctcctgggttcaagtaattctcctgcctcagcctcccaagtagctgggactacaggagtgtgccagcacacccagctaatttttgtatttttagtagagatggagtttcaccatgttggccacgctggtctcaaactcctgacctcaggtgatccatctgcctcagcctcccgaagtgctggtattacagacgtgagccactgtgcctggctggcacatggtttatttgaaaggagatccagaaagcccccatagggatttgggatgagcgacaaggaaggaaggagccctgcagggggctttaatgagcaagtggcactgtggacaaccagggatcggttctaccagggattctgggagactcagaagaactcacatctcagaattgtcccatcagaggggtttgtccaggagtgaaattcacccagaggaagagctgagagctggagagagactaggtgcagatgacatggctcacatctagctgtgcctagatcaagccagacctaaaggttatatatctctaacttcctgagccaacaaatcaccttttcttccctaacccaccttgacctgcagtttctgccacttgccacccacacaggagctgtcacagacatagaaagccagggtcccagatcagccactcattccaggggaggaaggggctcacctttgggtctggggatacagcaggaagtgagggtcactgccaccccatctacgtgcagccccccatcccagcaggttgccaggagctctcgaagactgctgtggggtcggctgaggccaaccagaaggaaggttcctgtggggctgcgccggatgaggcagcccttataatcaggaccaagggggttctgcaaagaagagtggcccctgagtgggactgagcgacagacactctccttctcagtccttcttccttttttttctttttttttttttttttttggagacggagtctggctctgtcacccaggctggagtgcaatggcgtgaccttggctcactgcaacctccgcctcccaggttcaagcgattctcctgcctcagcctcccgagtagctgggactacagatgcccactaccacgcccagctaagttttatatttttagtagagacagggtttcaccattttggccaggatggtttcgatctcttgatctcttgatctgcctacctcagcctcccaaagtgctgggattacaggcgtaagccactgtgcccagcctcagtcctttctcctaaagcaccatgaactcattccagtctttagacctttgaatatgctgttctgttcaccgggggtgtcttttccctcctattcttcaggaaccaaatgctgactgatcttttaaatctcaattcaaacgtcacctcctccaggcagccctccactacccaccctagcagtagaccgacctggacacagacagtgaggaggaagctgtcaaagtcctgggggctgcggcggagaacataggagccaggacgtgagcccccagtcttgagcttgttgatggcaaagtccagactgtgggggaaggtgagagggaatggggaggagtcagagatagaagaagacagagagacctgggctcaaattcaggtacctctgtagccctgggatccttgccaggtgacaccctccccccatttataaaatcagccatgggccaggcgccgtggctcacgcctgtaatcccagcattttgggaggccgaggcaggtggatcacgaggtcaggagatcaacaccatcctggctaacaccgtgaaaccccgtcgctactgaaaatacaaaaaaatagccgggcgtggtggcgagcacctgtagtcccagctactcgggaggctgaggcaggagaatggcgtgaccctgggaagcagaggttgcattgagccgagatcgtgccactgcactccagcctgggcgacagagccagactccgtctcaaaaaaaaaaagaaaaaagaaaatcagccgtaagtcttggcctcttctgggagattgtttgtttgtttgtttgttttaatagagacagggtcttgcttggttgcccaggctggagtgcaatctcagctcactgcagcctccaactcctgggctcaagtgatcctcctgcctcagcctccggagtcgctgggactacaggtcaaccaccacacccagctatttttttttctttttttgtagagatggggtctctcctgttgcctagacttgtctccaactcctgagttcaaacaatcctcctgccttggcccctcaaagcgctgcgattgcaggtgtgccccactatgcctggcccttcctgggagattaaacaagaggctgtaggtgaaggtgggcgacttgtccatctccaggaaatggccctggggtcagagagagagagagtagtggtcgccctgtgaagcagaaggaatacttcagcttcactgagcgctgactgtgcggcaggtgtggtttgaaaacttgacccctgtccagggctcctggaaggtgaggacactgaggcatagagaaggggaggggccctgagtggccacagaggccgggaatgggggacaggtccttacgtgatggggccgtggcactgctcggccacttcctccagcagcctcggcggtgccacctccttgcagaagaagtgctgggagtccgtggtcagccggaagtagccgtccacgagcgccacgaacgacagagcctcgggcagccctgggaactcggcctcctgcgagggacaagcgtcagagcccagtgaaacccgagggtgccggtcccgccctcggggtaaggctgaaggggaggggaatcctgcacccactaaaatctggttgtctgtcctggtaacagtgaccaggcggtgctctccggccgggccaacgcgcggggcctgcttgatgctaatgtctacgatttctggaaagtcgcagaagggctggaggacctgggaaggagggggagtaccgaagtgggggcccagctggaccccgccaaaccacgcccatgaacccacccccaagccacaccatccactccctatccctttgccattcaacccttccaagccgcgccccctcctatcaactccaacctctcaacacctcccctacccatccccaaacatctcccacccgctctgccaatccccgcctccttctctctgccggaccccgccccttgatccctgccccgcttcgcagcctcccagctctcggagcctcactctgcctcttagtcttgcctcgttccagcgcccacccacccactcctcaacccctcccattttcattcccgggtcgctcagcccaacccttcactcagtttgcccctcccattcccgcagtctcctccctcactaagccccgcccctcattaagcctcgcccacttccccaagtctttcgttttggctccgccccacatcccctaccactctccggcccctccccgagccccgcccccacgttggccccgcccagcgggggagtccgccctcacctcctgttctccctgggtccaggcgatgccgccgtcaccagccacgcggagcagccccagcccgtcgtggccaccaagggccccagggaggcccacgtggaaggtctcggcggccccggctggatccagccgctccaggtccatgatgtacttggccatgagcgagtgccggtctgcctggcaggcggccacgcggcgcagggctctgcgcaccgtcctccgaatacgcctccgcgtcacgaagctcaggccctggatcaggtcgcgcaggcttgggggtaggcaggccttgtagctgcaggggttggaggggagggagccggccctcagcgtcgggaggggtccccgcggggacacacacaaacccaggctttagcccaggggctggggtgcggccctagttggggcaccaggcacacacagactctcattcagggtcaggtatgaggaccggacctcagagtaggggagggccattggcgcccacaggtcggacagggaccccacaggccttttagctgggggaggtcaggtgtctgtccagctggagcctgggggtggagagggctgggttcgtgggaggccctgggtcataggaacaccctgaaagcttgcaggagaactccatggtgggagcccggcaaagccccgatggagcccacgttgctcactcccaagcagaggccgtccccacagcctggtggctctcacctgacagtcttcagcagctctcccggccgctgggcctgctctcgcgccatccgggccaggtccaacacggccaggctgagacactcaccctgctccttgagactgaggcccacggggaggcgcccactcaccaggtcactgcggtgctggggggccgccacagggagcatcagctgaggccacccaacttcaagccctgttgttaacctgcagacccccccaatcctgggctgacccccacccctggactgccacagggagggtcagacgaggccccacctgattgcatgccagtcctcatgttgccccttggacccccaaccccctgggtcaaaccccaggcagaaccccacctgggcaaagaggtgctccaggactggcaggtcaaggatagcactggccaaatccttgcgtagcccgaagcggtggcacttctccagcccaaaccaattggggaagtaaaagctgtgaggagaggagagaaccctgggatgaaagtgcaacccagcctcagtaggagtgacattatggtgggggcgagggacagattctgcggaggcctcacagagcccagcttgtacctttaacttgctgtgtgaccttgggcaagtgacccaccctctctggtctgtttcctcatctgagaaatgggtagtgaccatacctccctggggcaggggtgtgggcacctcgaaatgcaaggagatgataaaattgtacaatccctgggggctggggggcacttcctaccgaatcctgtacagcaggacttgggtgctggcatcctccacggagaagatgtggctcggggggaaccagcaggacaggtcctccgtggccagagcaaagagggagtggtacacaggcaggatgcctacaggggatggtcccatcagctccctcctgagtcaccccatctgtgcccttcaggagtgccagcatcatacccaaccgtccagatccttccatacctcaaggtatgaccagctgttcccttcatgtgccgtcacacctctccgtctgcacaggccattccctctgcctcagaagccaaccctgcacacccttctccattacaaaactcctactcatcccccaaagccccagctccgatgctgacttctgcaggcaactattccagcttccaatcttggccccacacagccccatccttccctctggcccgatccactagggatgcactcaccgctggccttggcagcctgcacgcacaggtcctcagccaagtggtccccaaaggagaaagataggcgctgggggggcccggggccccgagcgggcagcagcacatgcagggcaccagcctccgtggacaagaggctgcatgaacgctgagggatcaggggcgtctcttcacttggaggtgccatgagtgcaacttgcctggggcacagagagaaaaagcccctcagtcctggtcagaggggattggacttctgagcagggagggcatggaaaggagtgctggaggccgggtgcggtggcttatgcctgtaatcacagcattttgggaggccgaggcgggaggatcacttgaggtcaggagtttgagacctgcctggccaacatggcgaaaccctgcctctaaaaagtgcaaaacttagccgggtgtggtggtgcgttcctgtaatcccagcaactcgggaggctgaggcaggacaatcacttgaacctgggaggcagaggttgcagtgagccaagattgtaccactgcactccagcctggacaacagagtcagactctgtctcaaaaaaaaaaaaaaaaagaaagaaagaaagaaagaaagaaggaaagcctccctgggatgggcccaggaggaaactggccccctgcttccagcccccaacacctcccacccgctcgctcacttgccctgagaaacctcagcactcagggccctcagctgggtggggccaggggtggggcttcgagtcccctgagaaaaattggggagaaaaaggaggtcactcaaattgacctgaatgaagaagatctgaagaaagtgttgggaaaaacaaacaaaaacctaagttccagcagggcgcagtggctcatgtctgtaatcccatcatttccggaggccaagaaggaaggatagcttgagaccaggagtttgttttatgttttttgcttttttgagacagagtctcgcgctgtcacccaggctggagtgcagtggcgcaatctcagctcactgcaacctccgcctcccaagttcaagagattctcgtgcctcagccaccccagtagctgggattacaggtgggcaccaccacgcccagctaattttcttgtatttttagtagagatggggtttcactgatctcaaactcctggcctcaagtgatcagcctgcctcagcctcccaaaatgctggattacatgtgtgagccaccgcgcctggccgagaccaggagtttgaaaccagactgggcaatatagtgagacctcctctcaaaaagaaaaaaaagccttgtaatcccagcactttgacaggccgaggcaggtggatcacttgaggctaggattttgagacctcatctctaaaaaattagcagggcatggtggcacacccccatagtcctagctacttgggaggctgagacaggaggatgccttcagctctgcaagttgaggctgcattgagctatgatcacaccactgcactccagcctgggcgacagagcaagaccttatctctagaaaaaaaacacaatacaaaaactatgatccaaaataatgccctgtggctggggtggggcggcattaatgagggtttttttgtttttgttttgagacagagtctagctctgtcatccaggctggagtgcagtggcacaatctcggcttactctgcatcctgggttcaagtgattctcctgcctcagcctcccaagtagctgggattacaggggcacgccaccatgcccggctaatttttgtatttttggtagagacggggtttcaccatgttggcgaggctggtctggaactcctgacctcgagtgatcctcctgcctcggactcccaaagtgctgggattaccggcgtgagaaactgcgcctggcctaatgaggtttaagacaatcagaggactaggacccctaggactcagctttcgcagctgtgaaatgggctgactccccagcatcctcattgaggtggtctgctgagcgcaatccaggcctaaagtgtcaactcaattaatgtgcattaatttgtatatttcttgatgatgtgccggtaagcgatcaacaaacgcctgttaaaccaaacaggaagggcaattggcacagcggtgtggtggttactgtgggaagggaagtcttgtgggggaaagaaccttaccaaagggacactttgatgtcaccgatgcccagaccaagaatgagcacattcctagtcccgggaaccttggaggagccccatctctcccacagagagattgatgtctagttttgccctttatagaaataaaatcacacaccatagcctctctatcgtcccctcaacatcagccaatcaagttttttggtttgtttgtttgtttttttgagacggagtctcgcactgtcacccaggctggagtgcagtcgcacgatcttggctcactgtagcctctgcctcctgggttcaagcgattctcatgcctcagcttcccaagtggctgggattacaggcgcgcaccacagcgcccagctaatttttgtatttttagtagagacggagtttcaccatgttggccaggctggtctcaaactcctggcctcaggtgattcgcctgccttggcctcccaaagtgctgtgattacacacgtgagccacattgcccagcctttttatttatttatttattttgtaggggggaggacggattcttgttctgtctcccaggctggagtgcagtggcatgatctcggctcactgcaaactccacctcccaggttcaagcgattctcctgcctcagcctcctgagtagctggaattacaggcacccgccaccaaacctggctaatttttgtgtttttagtagagatagggtttcaccatgttgaccaggctgatctcgaactcctgacctccagtgatccgctggcctcagcctcccaaagtgttgggattaaaggcatgagccactgtgcccagccccagtcgagtttaaaataaggcttcagtggcagtggcgccccactgcaatcccagctactcagggggctgaggcagcaggatagcttgaggccaggggttagagacctgcctgaacaacatagcaagactcccatctccaaaacaacaaaaaaatcttaacagaatattattattctgtaatactgtaacaaaaaaaaatgaaaagtcagaggtgatgtttggtcccagaaaacgccatagtttttttggttttttaaaaatgtttgtagaaatggaggtctggctatgttgcccaggctggccttgaactcctggcctcaagctatcctcccgcctcggcatcccctgtttataatcctcaacgttctgcatcctggtatggtcgggtaccctgtgtctggaccgggaaggcctggagggtaggggctgggaactccgccccccaatccctccttcccaatccctcctccccacccccaaccccgcagcccccgtcgcgcatgcgcaatgactcctccaggtccgcaaggcaggcatctcccggccttagtcaaagccgaagcccagagaagcgagcgatcggaggatgcgagtctcggctcacgtctgcctcgcagctttcctccgaggcctggaaggcgagctagcctttgccctggcagcaccctgccccagcccagccatcccccgccaccaccatcctcccccagtgtctgggccgagccctgcggcatcgccagctcttacctagcgggcagggaccctggactttcgaagggcgggcagagccgggaggcagcgagaggaaagtcccactcggctccttcctgtgtg

SEQ ID NO: 1836 - DNA, 91114 bp, Homo sapiens
  source 1..91114: mol_type = genomic DNA
acgtccctcgtggagccgccgacgtcagcagtcgaatggcaacattgtggcgatgctgaggcgcagagtttaggagacgggttcatcagtcaggccggctccgggctttctgcagcagcaccaggggcgggggcggggatcttgacctgggcgagcgaccgggacgcatacagcgccggcctgaccccgcgggacccgcgcctcaccaccggagcgccgcagacgcagctccacggcctcgcgcggggggcggcgggcggccgcgaggcgctgcggcagcgcggagcttgtaaacagatccggccgcaggtgaccatgtgaactacctgctcccgggacgcttattgtccttctctcgatccgcgccacaaaggagctcggcggtcggggcgcggagggacaggcgaacgagccgggagagccggccggcgcactaagatggctgaaggcgcccggcgagggtgagcggggggcgcggcgcagccagcggggagtcctcgggcgggccgggccggcggcccttccccgcggcgagaagccggagccaccatgtcgttcgcgctggaggagacgctcgagtcggactgggtggctgtgcggccccatgtgttcgacgagcgcgagaaacacaaattcgtctttattgtggcctggaacgagattgagggcaagtttgccataacctgccacaaccggacggcccagaggcagaggagcggctcccgggagcaagcgggggcgcgagggggcgccgaggccggcggagctgcgtccgacgggagccgcgggcccggcagcccggcgggcaggggtcggcccgaggccactgcctctgcaactctggttaggagccccgggccccggcggagctcggcctgggcggagggcggctctcctcggagcactcgcagccttctgggggacccgcggctgcggagtcctggcagcaaaggggcggagagtcgtcttaggagcccagtgcgggccaaacccatcccgggtcagaaaacatctgaagccgacgatgcggcgggggcagccgctgcagcagcccggccggcgcccagagaggcccaggtgtcctctgtacggatagtgagcgcctctgggacggtctccgaggagatagaggtgctggaaatggtgaaggaggacgaggcacctctggcgctctcggacgcggagcagccgccgcccgccaccgagctggagtctccggccgaagagtgcagctgggccggactgttttctttccaggacctgcgcgccgtgcaccagcagctgtgctcggtgaactcgcagttggagccgtgcctgccggtgttccccgaggaaccttcgggcatgtggactgtgctgtttgggggcgcccccgagatgaccgagcaggaaatcgacactctgtgttaccagctccaggtctacctgggccacggcctggacacctgcggctggaagatcctctcccaggtgctcttcaccgagaccgatgatcccgaggagtattacgaaagcctcagcgagctgcggcagaagggctacgaagaagtgcttcagcgggccaggaagcgcatccaggaggtgagtgagtgagctcctagtctgggctctactggtcgcttttggtttactggccaaaccaaaggctggagcctcggtgtcgggtgtgcgcagtaggacggttgtttttctggacaagcggaaaccaagaggggttcctgatctaccttgcccttcatccctctcggtggctgcttaattgactctctgaaggaccttcgtctttatttcctcccccatttatcaaaagtagtaagtgcgctctgtgtactactcagtactggtaatgcgcaattaaagccactaagaaaagtgttctgtaagcatgggctacctgagcatttttctacccctaaagctcttccagcaataactgcccagatgtcaactcttctttgtccttgtcacctttatttaaaatagtttgtcttacggagcaaagttgatctgttttgattcttctttgtgcagtgtggcaacctacgcaaattttaaattcatttttaaacgagtgacctaagtgaaaaagcacctagtgactatcggatgcaaatttatttttaaaaggttttttagaagtgttttgtttctttttttttggactacctcaggtctttacagatggctcaggtttcactgctgttttaggtagaaataaagattctgggcaggaatgttcgttgtatttttgtacttactgtagaagtacaaaagccttttcaaactaatccttaaaataacaaaaaaaaagtggaagaaagggtctgaatggatatacatatggggctctagaatgtgtaggaaatgtgtaattcatgcctgctcactagcttctgctgaaggaactttactaaaaaagtcttttaaaatagacccagttttccctaatggatactactacacgtagtttctcaaagcaagttactgtttttactattaatgcaattgagattggtggagaaatgcacccccgccctccgcgccttcttttttttttttttttttggaagcagttttgctccgtctcccaggctggagtacagtggcaccatctgggctcactgcagcctccccctcccgggttcaagcgattctcctgcctcagactcctgagtagctgggactacaggtgcgcgccaccacgcccggctaacacgttagcccggctactttttgtgtttttagtagagacggggtttcaccatcttggccagtatggtctcgatctcctgacctcgtgatccgcccgcctcggcctcccaaagtgctgggattacaggcgtgagccactgtgcccggcctgaaatgccccttttaatggtgtttatattcctaagattgtgttgttatctgcttatgtatatataatagttgaaccttgttgttagattagggagctagagcctcatgtttttttcgtagaatattagatatttttctttattagatttgagtatttaagaaatgtttgtttctcacttataccatagtactctcttacaacttcccgaatccagattttcactgcttcctgttggtttactgtatgctaaatgtcacccactataacatgatcctagagttccagggatctgtttttatttcccttttttatcacctcacttcgggagtctaccttaaattattttgaaggaagtgacaaatcttaagtgaccacatatattctcagaagtgtttggttaatattgacctgtatttctcttaaactgcaagaaccgttagtgcttctttctcttattagatttacagatatattttttaaaatacatattcttaaaaatcccttaatgaatgggcctgtctgattgtaactttttggatactcagaaaaagcgactgtcaggccggtcgcggtggctcatgcctgtaatcccaacactttgggaggccgaggcgggcggatcacgaggtcaggagatcgagaccatcctggctaacacggtgaaaccccgtctctactaaaaatacaaaagaaaaaattagccgggtgtggtggcgggcacctgtagtcctagctactgggaggctgaggcaggagaatggcgtgaacccaggaggcgtagcttgcaatgagctgagatcatgccagtgcactcgagcctgggcgacagagcgagactccgtctcaaaaaaaaaaaagaaaagaaaaagaaaaagagaaaaagcgactatctccggttttttaattcaaatgggtcaaaaataagctctcaaaaaatataattttctagaactctttaaaaaggggattacattttttaaaaaatgtgttcctaattaaggttctcttgaccataatgatttattttctttaacagaaaattatactttttttctttctttttttttttgagatggagtctcgctctgtcgcccaggctgaagtgtagtggcgcgatcttggctcactgcaacctctgcctcccgggttccagtgattctcctccctcagcctcctgagtagctgggattataggcgtgtgccaccttgtccggctaatttttgtatttttagtagagatggggttttaccatgttggccaagctggtctcgaactcctgacctggtgatccgcctgcctcagcttcccaaagtgctagaattacaggcgtgagccaccgcacccagcctccccccgccccctccaaacagagttttgcactattgcccaggctggactgtactggtgcaatctcagctcactgcaacctccacctcccgggttcaagcagttctccttgctcagcctcccaagtagctgtgattacagtcgccgctaccatgcctggctaatttttgtatttttgtagtgacagggtttcccagtgttggccaggctggtcttgaactcctgacctcaggtgatctaactgcctcggcctcccaaagtgctaggattacaggcgtgaaccactgcacccggcaacttcaatatttgaaaaatagccatcaaggacaacaaatagtttcagtaataatgcctatcttgacttctgctggaagattgtgtctttagattatattgggggagggagggaagtgtggtgtgattgattggtgatgtctgccatgggcatgataatgaaagtgtataggatgctagccatgtatttgtcttaagctaattaaatttaactttgctttcttaatagtttgcagtaacattttttaaggtaacatttttatagaagttgtgccatgtttgtgttattctattgacttagtttgtggaattggctatagcttttcaagctaggtttatctgataaatcaaatgcattcttgaggatatgttacttttgaggatatgttagaatgcttagtcctttggtcacttacaatacttagtccttttccttctttaatttctatgaatctattttttggtcttttttcctacagtattcctttccctgtccatttaaaggtttcaacttaaaatcacctgtttttgttcaaaatggttagtaagttgttgaacttttttttgtttgtttttaatagaacagactgtacaactagattgtaagcttttcaaggtccttggctttgacaataccttggaactctcttctttgccacccctagttcaggaccacacatcttgtgagcactcttaattagtggataaaggaaactagagaagtttttaaaattaatttattcttactattgcaagaatttaaaggacttagaagatgtgtccttttaatgtgaagttgtaagtaaaatttttataaattgataagtgtaaattcctcaaaggacagtgtttttaaaacgagaaattttcttttagtacttcaaaggaaaatttcttaaaacataaataaattcctcagtaagaggtttttacttggggatggtgaattccctgtaagaggggctatggatggattttaatggggcgtcctgccgagttttatatctgtgggcatgtgtgcattttagagagaaaggcaataatgtgagtcacaggaatgttttggtttcacagtgcgtttaaaagttatgtttatgctataatgtacattatacttcttaggggctaaatccaagtgaaaggtgaaatttgttactggtatgtttgaatttggacttttacaagagtttactattggaagcagtatttatacagtagacactgaatcagtccttaaatgaatgcaggtgccaccaagacctctttgaacagttttcagcagtagccttggttgttggtcagagctgaggtttgtattagtgtatgtgcgttggtggcccatactgcagcttaggtttgacctggattttataaataatggtttctgtataaggacagctattctcaagatgattaactgtggtgctttagatagtaaaccttaattatgatggtaggcttgattaagatctaatcatcagtgttcattttggaatttattatgtttataaagatgtgctcaattctaacttctcttctgttgaaaccacggtttggaagtagcatgtgttttcaaaattatccgtgtaagccacataataaatagcctgttgagtgagtggagtcagaaacacctaggttgaaaataggactaaccacttctgatgacctgcttagttatttaacctcttttaaaaaggaaggtgggggaaataaaggatgtcttaagatttgagtaagacagtatgagaaagggcctaacaaagtgcctggcacttactaaagaggcttccaggaagtgttattttcccttttttcatgtaacaaggattatctggttttccattcagccctttttgtggggactgtaactaatatttattattcactatctgctgagatcagtgggtgttttatacctattttactgaggcagaaaatgagacttaaagaggtcctgtggacttcaccaaggctaaacagctgagtaaccaagctccgatgaaagcctagatttgtcttaatccaaacgtgtgccttttctgccatgcctgtggcctgttggggttcttaatccaagggactgtattccttccttaaagagaaaggatgtcaatctctactcttgagaattggggagtggtattattttaaaatgcagtcagttcaataatgactttttttttttttttttaaagacagtgtctcactctgttgcccaggctggagtacaatggcagtatctcagctcactgcaacctctgccttccaagttcacgcaattcttttgcttcagcctcccaagtagctgggattacacgtgcatgcaaacactcaataactgcttttgatttaggataactcatttcgaattaattatgacaagcatgaggtagggcagtctgaatgtgatgttttagagaaaggtgttgcctagtggtgcaaggataggtttatgttagagaagagtgcccaattgtggggaagttttttgtttgttttgtttttgtatcttaatggctaagctggaaaacagctcctgacttctgaggttatttaactgaaggggcaaggggcaaggagctctaggaggaagttttgtttaacaggtgtcctcccaaggatacctttgggtccttagaaaataacttttctaattttcttgaaaacctaagattagttttaaaactcaagccctgctgaaaccccaactatatacattagagaaatgacagtactttaggagtcttgggacgccacctgtctttcactgggccagcaagccatgacccatgattacatataaataaatggtggaagcaggctgctatttatagggaaggatataatatgattccaatgaagagagctgctctgtctggcagttcttgactgcattgactggaagtattgaaaaataggatattacatgttgaggacatatgggagctgtagactttcaagacagaagatatgtcaacattgtagcttgatgccttgtctaaccatgttatactcccatgaaaatattgcaaactgctcttttactgtaaaatacagttaaagaataatgaaactaagtgaatttgtgggattcttaaagtattgatgaaagacttgaaagttggaaacatttacaatattttgatgctaatcattttcttcaatcctgtacccaaatgtacttttagacagttttttgcatcactgaaaaagatgtaagtatagaaaaatggatatatgcttctagtttagggcttctataaaacaaaaacatggagactggtagcaggatgtcacccttcttggtaattaatttgtgtaatggtttctctgcttgccacttaacatcacaagatgcccagtccaccagagatttctttcttttttctttttttccttttttttttttttgagacaggcttgctctgtcacccaggctggagtgcagtggtgtgatctcggctcactgcagcctccactgcccggcttctagcgattctcctgcctcagcctcctgagtaactgggattacaagcatgtgccaccacacccagctaacttttgtatttttagtagagatggggtttcaccatgttggccaggctggtctcgaactcctgacctcaggtgatccacctgcttcggcctcccacagtgctgggattacaagcatgagccaccacgcctggcccagatacttcatagacatgaagtctggggatgtttcctccttgctaaaatgaggttaacttagacaacacttcagtgatattattataagggagtgtgtatgtgtgtctgagagagatggggagagaagggagaagatgggtgggaaaattggtttgtcaaacatagcagctgctgtatttgaattagccatcttatctttgcaaattctcacatgtaattttaatcgatctgttaaccttctccattgctgcttcatttgacgtttcattaactgtaaaatatttttgacagtaggtcttgaaagcacaagatgagccctctgttgctccattgatggttaaatgtatgtgtgcctattttttttttttttggtaacgagaagtttcctgtggctcttttcactctctaaaaggccaggacctgcttcctctgaatctgcctgattcactcagttgttggtaggagaaattaagttccaagtgtaagagacataggcactgaaaactaaataatagttcttgtaactatttgttttttttttttttggtagagatagtgaagttcatttggtttttcaggcttcttttaggggacttgataataccaagtagccttaacacagcatatctaagttattaaactgcataggggcagagaagaatttatccagcaaaaggccagaaaatttggagttgttttcctaaatgtgggggattgtcctttatgtttgtccttgaattttaaattaaatataattacaattctatatagtagactctttttcagactgtagcaaaggttctataaaatgggctgtgaaataatggggctgatgggttagacatttcacagaggaggatttttaaggataaatgtatgaagttactttaatgattcggaattttatttgtaactttcaggtttgagggtagtggctagggtcttagtttattcaacaaatagtagtataggcactgggaaaatgcagtgatgaacactgtttctttgggaagaaattttaaataaaattggtcatgaagtcatcctggtgcttggaggtagttgaagcagggtgctttttcagaagcatcccactacactgtcttgagtgcttcatggaaaaaaaaaaattaaatggatatggctcgggaaaaatctgtatttttgtcctgattgtaatatgagttgtttgaccttaggctgttgactagcctttttgggccttagtttttagtttataaagtgaggtaagtatggcctctttttaaaggacccacagcagttgataggcacagtgtggcaagggttgggacctgagcaacttggtttttttctttttttgagatgaggcctcactctgtcgcccagactggagtgcagtggcatgactttggctcactgcaacctccgcctcccaggttcaaatgattattctgcctcagtctcctgggtagctgggattacaggcatctgccaccatacccagctaatttttgtatttttaatagagacgggttttcactgtgttggccaggctggtcttgaactcctaaactcaggtatccatctgcctcagcctcccaaagttctgggattacaggtgtgagccactgcacccagcctgtattcaggtttccatctccttgcagtaagatgactgttgaaatcgcagcacttttaatattgctagtgtttttaggctttgagaaagcctaaattcactttgaagtacaaagggcatttgaatatggcagtagtgtttcattttgtgtgtgtttatccttacatccttaaatcattcattacttatacttcaaattttctgttcttttttcacttctccctgtggtttttagtattaaaactgcttttccgatcagtttttgataactgaaagttatacttgcaaagtgaatgcttacttattaaaattatttctctaggcctatctttctccttgccgtcctatctagatgagtttctatccacacctatggggccataactggagtgtgtataaggatgtatataacaagttttcaataactgcaatagttagttaacctttattgaatgcttactgtaggccaagcactttacaaagatctttgtgtacattatctcagttcacacgtagattagacagtaagaggtaggatgcaagtgagtttgagacctgacttctccttgttaatatctgtgattttgggcaagttacctgatgcagtgccttagcttcttcatctgtagagagattaatactgctgcctcatagagtgatttaaaaataggtatgttggccgggcacagtatctcacgcctgtaatcccagcactttgggaggccgaggcaggcggatcatgaggtcaagagtttgagactagcctggccaacatggtaaaaccctgtctctactaaaaatgcgaaaattagctgggtgtggtgttggacacctgtaatcccagctaacttgggaggctgaggcaggagaatcacttgaacctgggaggtagaggttgcagtgagccaagattgcggcactgcactctagcctgggcgacagagcaagacaccatctcaaaaaaaaaaaagtatgctataaagcactcagaacagtgcctggcatctagtaaacacttgataaatctaaactttgattaatatttgtatctacctaagagataaggattttgcagcagaggtagagaattggtaaatttgcctacataacgtatctattgtatgaaagaaccggattcaaatccaagcctgccttgttaaccactggactgtctgcatccctgtagaaagagagtgaggataagtgataaatttaaatgttgtccaattgaaatatatgttcagtgtctcaacagtggacaaaagcaatagtgcttagctgatgatatttttggaaaatcttaattatatacatatactgtaattacctttttttgtttgggattagagaatgatgcaatccaaaggaggctactttatttttcctttttattttttgagatggagtctcactctgtcacccaggctggagtgtggtggcgtgatctcggttcactgcaacctccacctctcgggttcaagtgattctcccacttcaaccttgtagtctcaagtagttgggactacaggcaggtgccaccacacctggctaattttttgtattttttagttgttgttgaaacagggtttcaccatgttgcccatgcgggtctcagtctcctgagctcaagccatctgcctgcctcagtctcctaaagtattgggattataaacgtgagccaccttgcccggcccctgctatcacttctatttcctttttattttgtttatttatttatttattttttgaggcggagtcttgctctgttgcccaggatggagtatagtggcacaatctctgctcactgcaacttccacctcccaggttcaagcaattctcctgcctcagcctcccaagtagctgggattacaggcacccgccaccatgcctgggtaacttttgtatttttgtattttattttattttattttattttttatattttattttattttattttatattttattttattttattttattttgagacagagtctcgttctgctgctcaggctggagtgcagtggcagaatcttggctcactgcaacctccacctcccaggttcaggtgtttcttctgcctctgcctcctgagtagctgggactacaggtacacaccaccacacctggctaatttttgtatttttagtagagatggggtttcaccatattggcctggctggtctcaaactcctgacctcatgatccgcccacctcggcctcccaaagtgctgggattacaggcgtgagccaccgcatctggccttttaacttttgtatttttagtagagacgggatttcaccaagttggccaggctggtctcgaactcctggccttatttccattttaaatagtccataacattgaatttagtcttgtactttcctcccttttttttgagacagagtctccctctgtcacccaggctggagtgcagtggcacgatctcggctcactgcagcctctgcctcccaggtgcaagcaattctcctgcctcagcctcccaagtagctggggttacaggtgcgtgctaccacacccagctaagttttttgtatttttagtagagatggggtttcaccatgttggccaggctgatctcaaactcctgacctcaggtgatccacccgcctcagcctcccaaagtgctgggattataagcttgagccaccgcgccggcctccttcttataattatagtaaataattacctcacctcagtcccatatagaaaaaaaaaaaagtttcttactaacaatttttctgactagtccagaagggaggacagttaaggatgttaatttcttactttattttcagtttagaaatcctacatctgtatgtttaagagagggtcttgttctgtcagcgcaggctggaatgcagtggtgccgtcatggctcactgtatgtagccttgatctcctgggctctagtgatcctcccgcctcagtctctggagtagctggaactacaggtgtgtaccaccacgtctggctgactttttaatttttattttgtagagaagaggtctcactgtgtcacctaggctggtctcaaactcctgagttcaacttatcctcccgccttgccctcccaaagttctgagactgcagacatgagccactgtgcctgcccttttttttccctcttgttaggtgatgtgaattttggtagtggggttgctaatgaaaagtttatgaaaagtagggttaaagaaatgaaggactaagaaaaacggtgtgaattaacttcattattgttattttgtgtttttagtagaaatggagttttgccatattggccaggctggtctcaaactcctgagctcaagcagtcctcctgcattggcctcccaaagtgctgggattacaggtgtgagccaccgtgcctgcccttgtgaattaattttagagtagcagtatttacacttgaaaatttcatgggaatgaataacattagtttaccaaaaggaaatgatatgccagctcatagtgaagctgcctagatgcttgcttttgtaaacagtatgttatcaagtcactggctccctgtatagccttggagttggctcttgagcaggttttactctgcattgagccttatgagacccataacttgaagtaagactgttctatttcttggtagaaattatcttaaaggagatgaatggaggaacaggtatttatctgaagtatcagcatgtttttgggtttaaaaattgaaaactggaaggaatttcaaaattgagtaatgtttttctcttttcattttgtctaactgcaccattccccagttactctattcaagttttccttttgtattaaatttcatcgtattttcagtctcccttgactcaagattgggatctttcccttaaggaaagatgaattgactggccttgagtagaggccatgtggggcagtggttccagagtttgagttaggctacaggggttcatacctcacttctactttccactagcttaactcttggtagtaactgagctttctgcccgtggttcttcatctctaaaatggcataataactatatacctacatcataagattgttaggaagaatgaaagaatgtacgtgaagtgcctagcgtggtatctaatatagaaaccgtcataaatgtcagctgctattgtgatactttctcatctactttttcctgaagcaactcatactgatgctgggttcctcctaaacccaaacttgtttgtactaaaaaccgtgtttgtaatggaagctggtgctgtacaggtaaaatatttccaagccaaaacaatgtcaaaacaacaagaaaaatctaacgggttgatcttcagcctcctgtaccctccataggaactcctagtacgtgctttcccaagtcccttgttgctgcttcgtgtatacattattatattcgttgacatcacaggacaggtggtccttttgatacagtcagttaaaacggtgattctagtattttttcttgtcaattttattgatagctcttctccatttttttctgtatttacctttactttgtttgtaggcgtcccagacaaccctgatcacaattgatttgcaaatattccagttgaaataactattaaagaaatggtaagcattaacctctggaagcccttaaaaatacctttaaatctccttcaacaattgtttatttaataaatagatcttgtgttaggtattttttaatttttaattatttttcttttttttttttttttttggcatatgaagtaagagctatccaggtgcttttaacagcctctcacacttcactagaaattttaccccactattaattctttctaattatacctactttttttttaatgttggcatttctgattagtattttcatacttactctagcaagatgttgtattttaatatctttcattgcacttttacatgtttactgtggtttggggtagctttgcaaagtctaaccataacttaaaatattgtctatggtaaaaaacaaagttaaatgtgcctttagggtacaatatatttaataattgagaactgcctataattcttcacttttatttcattagtgtgattttcaaaggatccagatttatatttcttaagaagagtatgtaggtatttgtatatgctgatttttttaacaagccaatttatttgactgtggagggtggggagaaagattggaaaaaagtcaagttatttgaaaatgcccattcctgtttggttgggaaggagggaaaaatgaatgtgatttaagatagctgggcatatctgtagttatttctttattataaatatattttattatactttgagacagaatatccctccatcacccaggctggagtacagtggcacaatcatggctcattgcagcctcaacctcctaggctcaagtgatcctcccatctcaggctcctgagttactgggactacagccatgcgccaccatgcccagctaatttttaacttaattttggggggtacatagtaggtgtatatatttatggaatacataagatgttttgatacagatatgtaatgcataataatcaaatcatgaaacatagggaatccgtcccctcaagcatttgtcctttgttttgcaaacaatccaattacactattaaattattattgactgttgtcacccagttatgctatcaaataccgggtctcattcattctattttttttttttttacccattagccgcccccacctccccctcaacttccttcctacccttcccacactctggtaaccatcattctactctctatttcaattgtctatttcaatgagttcaattgttgtgatttttatttttttatttttatttatttatttattttttgagacagtttcactcttgttgcccaggctggagtgcaatggcaagatatcagctcactggaacctctgcctcctggattcaagcgattcttctgcctcagcctcccgagtagctgggattacaggcatgtgccaccacgcccggctaattttttgtatttttagtagagatggggtttctccatgttggtcaggctgttcttgaactcccgacctcaggtgatctgcctgcctcggcctctcaaagtgctgggattacaggcatgagccaccatgcccagccttttcttctttttgatataggcacttatagctataagtttccctcttggtactgcttttgctgtatcccataggttttggtatgttgtgtttccattatgatttgttttaataaattttccttcttaatttcttcattgacctactggtcattcaggagcatattgtttaatttccatgtatttgtatagtttccataattcctcttgttagtgatttctagtttatctcattttggtcagagaaaatgcttgatagtcaggtttttttttttttttttaatgttttaaggcttgctttgtgacataacatggcctatccttgagagtgatagatatgctaaggaaaagaacatgtattctgtatctgttggatgaaatgttctgtaagtttttgttaggtctgtttgacctatgatgcaaattaagtccagtgtttctttgttgattttctgtctggaagatctgtcctgcgctgaaagtgggatgttgaagtctccaggtattactgtattgaggcctctctctctttagctctaatatttgctttatatgtctgggtgctccagtgttaggtgcatatatatttaaaattgctataccctcttgctaaattgacccctttatcactatataatgaccttctttgtctctagttgttgtcttgaaatctattttgtctaagtatagctattcctgctttgtttccattgacatggaataactttttcatgtatgtcttcataggtgaatgtgtttcttgtaggtaacagatcattgggtcttgttttttaatccattcagtccatctgtgtctaacaattggagagtttagtccatttgcattcagtgttattgataagtaccttattcctgccattttgttgttttctgtttgttttgtggtctcctctctctttcttcatgtcttttattgaaggtgattttttctggtgatactatttaatttcttgatctttttctttttgcgaatccattgtatgttttttatgttttttggtttgaggttaccatgaagcttgcaaatactatctcatgacccagtattttaagctgataacaacttaccactaataaagactctaatcttaactttgtctccccactttttaactttttgttgtttcttttgttgttgttgttgtttctatatatcttattgtaagttgtctaaccgttatttttgattggttcatcatttaatcttttttttttggagatggagtctcgctctgtcgcccaggctggagtgcagtggcgcaatctcgggtcactacaacctccgcctcctgggttcaagcgattcttctgcctcagcctcctgagtagttgggattacaggcatccgccaccaagcccagctggttttttgtgtttttagtagagatggggtttcaccgtgttagccaggatagtcttgatctcctgacctcatgatctgcccaccgcagcctcccaaagtgctgggattataggcgtgagccaccgcccagcctggttcatcatttaatctttctaagataagagtagcttacacaccacagttacagtgttataatctgtttttctgtttacttactattatcagtgagttttgtactttcagatgatttttcttttttgagacagggtctcactctgtctaggctggagtacagtggcatgcagtggagtgcaggctcaagcagtgcccccatctcaacctccctagtagctggggccacaagtgtatgccaccactctttatttttttgtagaaatggggttttgccatgttgcccaggctggtctcgaaatactgggctcaagtgatccacccatcctgtcccctgaaagtgctggtagatgacttttttttttttttttttttaaagacagagtcttgctctgtcacacaggctacagtgcagtggcttgatcttggctcactgcaacctcctcctcccaggttcaaatgatgctcctgcctcagcctcctgagtagctggattacaggtgcccaccaccacgcccagctattttttttttttttgtatttttagtagagacggggtttcgcgatgttgggaaggcttgtctcaaactcctgacctcgttcgtgatctgcccgcctcagccttccaaagtgctgggattacaggcatgagccatcacgccccagcttggtagatgacttttttattgctcattaatgtccttttctttctgattgaagtactccctttagcatttcttgtagagcaggtctggtgttaatgaaattcctcagcttttgtcagggaaagtctttattttctccttcaagtttgaaaggatatttttgctggtattctattctagggtaaaagatttttctttcagcactttatgtcatgccgctctctcctggcctgtaaggcttctactgaaaagtctgctaccagatgtattggagcctcattgtatgttatttgtttcttttctctcacttcttttaggatcttttctttatctttgactgttggaagtttgattattaaatgccttgtagtctttagttaagtcttcttggtgttctataataaccttcttttacttggatattggtatctttctctaggtttgggaagttctgtgttattatccctttgaataaactttctaccccatctctctacctcctcattaaggccaataactcttagatttgccctttcgaggctattttttaaatcctgcagtcacacttcattgttttctcttttttttttcctcttgactgtattttcaaatagtctgtcttcaagctcactatttctttcttctgcttgatcagttctgtcattaaaagcctctgatgcattcattcttcaatatgccaattgtgttttttagctctggaatttctgcttggttcttttatttcaatctctttattaagtttgtctgatagaaatctgaattcctcctctgtgttatcttgaaattcttttagtttccccccaaaaaagctactttgaattctctgtctgaaaggtcacatatctctctctccttttttttgagacagggtcttgtagtggtgccatctcgactcactgcaacttccacctcccaggttcaagggattctcctgcctccgcctcctgagtacctgggattacaggcacccaccaccacgcctggctaatttttgtatttttagtagagatggggtttcgccatgttggccaggctggtctggaactcctgacctcaattgatctgcttgcctcggcctcccaaagttctggtattacaggagtgtgccactgcacctggccacatatctctgtttctataggattggttcctggtggcttatttattaatagttcatttagtgatgtcatgttttcctagatcatcttggtacttgtagatgttcatctgtgtctgagcattgaagagttaggtatttactgtgatctgcactgtctgggtttgtttgtacctgtccttcttgggaaggctttccacatattctaaaggacttgggtgttgtgatgtaagctgtatctgttttaggggacaccccaagcccaatattgctgtggttgttgcagactcataaaggtaccaccttgatggtcttggtcaagatgtgaaagaattcactggattaccaggcaaagactcttgttctcttcccttactttatccttaacaacagagtttctctctctgttctgagccatctagacctgggggtggagggacacaagcactcctgtggccatcaccactgggactgtgctgagtcagacctgaagccagcacagcactgggtctcccccaaggcctgctataaccactccctggctaccgcctacgttcattcaaggccctagggctctacaatcagcaagtggcaaagccagccagccaggcctgtgcccttcccttcagagggaagaattcccccaggtccctgatgggtcctttctggaagccagggactagaatcagaaaccttggaagtctacctggtgttctattgtatggcagctgagctggcactcacaccactaggtggagtccttcccacttttccctccccttcccagtggcagaggaacctcatcccagaggaacaagcccagggggagtactggcagactgctgctgatgttcccttcaggcccaagggctcttaagtcagtttgtggtgaatgttgcctggcctgggactcacctttcaaccacccttcagggcagtagcttctcctatagtccagggcaggttcagaaatgccatccaagagtcaagtcctggaatcagggaccccatgagcccacttggtgttctaccccaccgtggctgacctgatagctaacctggtgccaggaatcaagcagaagtagtctcgccccaccccatagctaccacagctgagaatgtgcagagtctcgtaaagggtaatttgcatcatcttgctctgtcctattccccttagctaacttaaaaaatgttttttagggatggagtctgtgttatccaggctggtctcgaactgttggcctcaagtgattgttcctttttggcctccaaaagtggtgggattacagacctgaaccactgcacctgtccttctttctttcttttctgcacctgttcccattgtgctgaccttcctgccttcctccctcccccacccttcctttcatttctttcttgcttgacaggttctccatcgcctagggttgcgatcatagttcactgcagtctcaagtcttgagctcaattcatcctcccacctcagcctccctagtaactagccgatattacaggcatgagccaccaggcccagccatagccaagccttttaaatgcattatttgctgaagtcactatacacagtcctatttttgctccattatgtacaccatcaccactgccttttttttttggttaagttccacattccttattttattattattattattttatttgattttatttttttttttgagatggagtctcactcactctgtcacccaggctggagtgcagtggtgcgatctcggctcactgcaatctttacctcccaggttcaagtgattctcctgcctcagcctcccaagtagccgtgattacaggcgtgagctaccatgcccggctaagttccatacttctttctaggtagggccagatcaggtcccttccctatagaaagtcatttctgaccactgtaagaaatcagaggctggacatggtggctcatgtctataatcctagtactttgggaggctgaggtgagcggattgcttgagtccaagagttcaagagcagcgtggtgaacatggtgaaaccctgtctctacaaaaactacaaaaatttgccaggcatggtgatgtaagcctgtggtctcagctgcttgtgaggctgaggtgggaggatcacctgaaaccaggaatgtcgaggctgcagtaggccatgattgcaccactgcatgctagcgtgggcagcagcgtgaccctgtctcaaacaaacaagaaaaaatcagaaattgtgttagaaattcagaaatcaaagaggctttatgttgacagctgatatcatccataactgccaccctggtttttctctttacggacccctcatgccccttaaagtgcattgtaagtccctaagagatgaaaacagattatcttttttttttggagacggagtcttactcttgttgcccaggctggagtgcagtggtgcagtctcgactcactgcaacttctgcctcctgtgttcaagcaattctcctgcctcagcctcctgagtagctgggattataggcatgcaccccaacacctggctaatttttgtgtttttagtagagacagggtttcaccatgttggccaggctggtcttgaactcctaacctcaagtggtccgcctgcctcagactcccaaagtgctgggattacagtcatgagccactgtgcccggcctttgattttttatacataacatgtatgtacagagtgtgtatgtacattttaatgagaggtatgtattttcccaggggtagaacacagtcaaatttactgaaatttactacttatctacaaaggaaagaatctgaaaatcattttaaatatcagtttctacaatatttatctttgaactaaaaagaaataaaaatatcagtttggagcattactttataaattcagatattagggctttttttgtttttgttgttttttttttttttttgacagggtctccctctggctggagtacagtggtgttacgggatccttggggtgtcgcctcaccagccagaaacttgtgtggccagtggtgcctttgcctgagttttcctctggcctgctgggctcattctacccactcagcctggcaggctgtgctcagctcctgctaccagtctgggtcccatgcctgccaagggagagccagtcatggagcggtgaggggtgtgttagtgagcgtggggtctggccactgcatacaaccaggcactctggcggtggtggggcgggcagctccaggtgccagtactggcaccagctccctatgaggctgtggctggaccagggataccataagcagtttccatggctgacaccagggaatgcagtgtggtgcctggaagcttggagactccaggaactgcagcgccttaaagagggtgtcaccgctctggcttggggagctcctaggtctgggctccccagagggccacagctcttctgtcctcttgttggctgtaacattgtgggcaaggggtgtttcagccctgtttgtgttacagctcttttagccctgccattccctgggtcttgagttcttgtcctgcatccagcaagaatgaagtacacagacaagagacaagtggagagtgagcaagacaaagaggagctttattgagcaatagaacaactcagaggagacctgtagtgggcagctcctctccgtagccagcatgtcccgatgagtgttcagctttcagcagagagggtagctcctctctgaagctggttgtcccatcatttcttcagctctcagtagagagggtagcttttctctgctgggcaggtcatcccgacgagtgtccagctctcagaagagagggtagttcatctctccagctggctatctggtcgtctcttcagccctcagcagagaggagaccctggggtgggcagcttctctctgcagctgctctcccatcatctggctgaatatggggcttttatgggcctcaggggaggaagtgtgtgcgaaatggtccgtgggcaaacatgggcgggcctggaaaaggcaccacaagttcccaccccagtcagtaggatcagcagtctgacacccaggcttcaggccctccccgacttgaaggtggtgcttcaccaaggactcacccactcctgcccaggagcttgtctgcctcctgctgccatttatggtgcccaggctgtttgtgccaaggagtgtctgtgggccagcgctgagctgccctcagcacccccttggcctctcttctgtgctcattggtgcccaaagtccgcagcaggctgaagtggcaggggctggtgtgtcagcactgcccccgagcctgtgcacacccagccaggttgtgacagacctagggttggcctcaactttgccttgtgagtggaacaggcgctgatattgaggaaagtccaggcagtgggagcagacacctccgagcctgcaggggcaaggtggggccttcccaggccccggagagtgcagagatgcctggatctgcagctgtagcttgggcagctgtagccacccctgggagggtgggaatcctgcatgcccctggctcccactggctccatggagcatggcatatgcacatcctgggcccacctctgcctcagggcccctctctgcctgcccctcagtgcccgactgtactgctaccctgctggcaggcaactcagcctggccccattgcagtgtctcccaggacagtggtcgaggtacaggtggcatggcagccctggccagcgccacacaaatgaacctgacgcacccagggctggcctcacaagtcctagctgtacccttcagccaggtgctcacagacccttgggatgcggtaggaagcaaggttgaggctgtggcggagactccaggcctgggagtggttcctgcctggccctgtgatggtgggggtggttcagtcaggtgcctccaggacatggggcacaggaaacccactgccaccactgccgctcccacagctgctcttgccaccaccgcttatgcctccccactgcaactgatgtgatggcagcagccagtctagatggcccgccactgccatgagtggcttgatcttgcctcactgcagcctcaacctcctgggagcaagcgatcctcccacgtcagcctcctgagtagctgggaatatgggcatgaaccaccatacccagctgatttttgtgggttttttttttttttgtagagacggggttttgccatgttgcccaggctggtctcaaacccttgagctcaagtgatccacccaccttggcctcccaaagtgctgggattgcaggcatgagcgaccacacctggccccagattttttttttcttttttgatttcatgtcccttgagtctttttttttctcagattttagtattaacaagtaataattagcaggaataatataaaaataattcagtagttttacaaagcaagaacagagatgggcagtgtaaatgtggaaatgtatggcactggtccttatttctcagtaggggaaacagaccaaatggacctaaaggcagttcccagggccacagatgcagtatcattgctggggtaggttccttccatccaagtatcctaagtcactccctttcacagtaattatttgcatgttttaataattaatggtaaagatattacttatagattttgtgaaaggaaaataaatctagggaccccaaactcattaagccaaagggaaaagttaagctgggaactgggtcacacaaacctgtcccttttggttcctaaataagatggctacaagatgaaaagctacatgcttccgccatattttgcccacaagcaaattcatagtgagctccaagatctttaccctgaggtttttctgctaaaattttaccatggcaatgtaaattgatagcatatccttacaggtgcagtcacccccctgcccaccagacaaatgcatatctgattgttctcctgccccattttgtttgggttatcttatgtaaaagtgccgtctctacaaataataataataataataatcaaaaaattagccaggcatagtggcacgtgactgtagtcccagctactcaggaggctgagacaggaagatcacttaagccctggaggttgaggttataatgagccatgatggagccactgtactccagcatgggtgaaaaagcgagaggctgtctctaaaaaaataaagtgcagattcactgggccagacaaaggcgtgaattactattttccctaaccccccttacatgaaaattgtgtacttctcagtaacctgccctttcccctttaaatttggagccctcaaaattatcttcagagaaaggcgtagacctgtctcccgggcatatttccttaactttggcaaataaccctgctgggattacaggcgtgcactaccatgcccggctaatttttgtatttttagtagagacagggtttcaccatgttggccaagctgctgtcaaactcctggcctcaagtgatctgcccgtctaggcctcccaaagtgctgggattacaggcgtgagccaccatgcccaacctctgcttcatgtttcttaagtgaatcaatagagcaaaatcattttctaaaatcctacaagagatatgtcagattttgaagcagaaattatcaaagctttactttccaggcccctgctctttgtccttcctttctgctgaatcctgctgtggccgtttttatgttgtgctggttgagcttcagcacttctgaaaccctttgtggttgtattctcattcagatccatctgcgttcttattcagtgtggctctcagtgaatcttctcaaatttagcaaaatgcatctttcacattttaggtgcatctgctgcattttaaattaaggccttccctcttcatctcaaatatccttaatcctaaataattcgactttctttataattccttttagtcttttatatgcattatttatagtaccttacacattttgcagtttataacctgcaaatgcccatagctcagtttatttattccctggactttgtcagtttttagttagcaaaatcaaaaattaagttttataattatatcaagttagtgattattttttcacctgttgaattcttttatcatgaattataggaaacggtttacacgaaagtctaatgcttagtaaattgtatcttttgaaatgaagttataaaatgcattccctgtattttaagattatttgccaatacttagattaaaatagtttgaccaattgaaattaaaattgtttttaaggtagtctagtattggaaaaacatgaaactttataggaaagaaggcagattaataaattagcagtgttaggtgagatggcttgggcttctctgcaagagtattaagtttaggtgctgcataatagctttgtaaagtactattctgtctgaggacaaaaagcatggtggaaataatagataaaaatgttaatgtttggatagagtaactgatattctgtcctcagttattgtacatatttgtgtacagtggtattgtgacttaattaataatcatataatgacttgatgtttttgtgttggcagaaaatagtatctaaactttgtattacatttactttattgaccctgtaagaagagcccaaagaagcctagtgtttgagggttcgcttactgttgaattgtggcatttgatcacttgtaaatgactcagggggattttactattgaaagatgttggcaccatttttttcccctcattcttttaacacttttgctattcctgaaacctggtagaaaaccattatctcgaagaaagtgttagttttcaagcgaagtataagataaagggcttctttgtatgtacatattcttggaagaagggaattattgcctttgacctaaaaggaagaggctgaggcacaaaatatatttgaagagtttacttgggccaaagtaaggacagctgccgagaagactcagacccaagtatccttgaatatgcacggtctttgttacaaacaggttttttgattttttttttcttttcaggcaggatgtgctctgtcacccaggctagtgtgcagtagcgtgatctcaactcactgcaacctccatctcccgggctcaagtgatcctgcagcctcaacttcctgactagctgggtcaacaggtgtgcgccactacgcctggctgatttttcacttttttgtggagacagggttttcaccatgtggcccaggctggtcttgaactcctgacctcaaggtgttccaaagtgctgggattgtaggtgtgagccaccgcctgtggccactaaaatttttttttatagagtcttgcctttttgtctaggctggagtacaccggtgcaatcatggcttactacagcatcagcctcctgctttggcatcctgatgtgtgccaccatgtccgtctttttttttttttgaaacagagtttcactcttgtcgcccaggctggagtgcagtggtacgatctcggctcactgcagtctccgcctcccaggtgcaagcaattctcctgcctcagcctccagagtagctgggattacaggcgcctgccaccacacccagctaattagtagagacggggtttcaccatgttggccaggctggtctcaaactcctgacctctggtgatctgcctgcctcagcctcccaaagtgctgggattacaggcgcgagtcactgtgcttggcctttttgtttttttttaaagatagggtctcactctggttgcccagggtagagtacagtgatgtgatcttggctcactgcagcctggccctcccgggctcaggtgattctttcacctcaacctcctgagtagctgggactacagctgtgtgccaccacacctggctaattttttgtgtttttagtagaggtggggttttactgtgttacccaggctggtttcgaactcctgggcttaagcaatccgctgacctcagcctcccagagggctggaattacaggtgtgagccacttcacctggccataatttttaattttttttttttgtagagacatggtctcactatgttgcccaggctggtcttgaactcctgagctcaagtgatcctcctacctcactgtaggaggtaaagcctgccaaagtgctggaattacaggtgtgagccactgcgcctggcataaatcatgatttttaaaagcaaataatatttcatcagaatgaaaagagttaatataattttaatggccattgcattaaggccaactttgttgaatgacccatgcactggagataagaccctggccaatgctggagagaaactaggctgattttgtcactctgtgcctgccttctaacgctgaagatcattctgtgattcagtaataacagtgttttttcttagaataactaaaaatgcttcagtagaggaactgaaccataagaaatgagttttggctcaattttagtttaaatagtagtcattaatctaacatagaatgacagtaaatgcagtgagagaaagagtgggaaaagttattttattttattttatttatttatgtaattttttgaggcagagtcttgcgctatcactgtcacccacgctggagtgagtggcacgatcttggcttactataagccctgcctcccaggttcatgccattcattctcctgcctcagcctcctgagtagctgggactacaggcgcccgccaccatgcctggctaattttttgtattttcagtagagacaggtttcaccttgttagccaggatggtcttgatctcctgacctcgtgatccgcccgccttggcctcccaaagtgctgggattacaggcgtgagctactgcacccggccaaaaaactgttttagattcaagaaaaatgttatatgttttaattttatagataagtaaattgactacataatttatataacttcagagatacttgcctcactaactgatggttaatatggggatattaagatatttattaaagcagtgcttctcaaagtttaatgtatacacttatcacttggcagtcttaactacaattcagagtcccattctgcagatctaaaggtgaggttctggtttcatttgtaacaagttcctaggtgacaccaatgttgctggtcccagaccatactttgagtagcaaggtaccgtcactttgatatggccatttagttagttgaattgaactctgtagactaaagattaaacaggacggattgaccacatgcaatgttctttttcccccactctgtagatgggcttactgcttattagaatgtgctgcatttatggactcagtgtgatgtcccactccctcctatgaactttctcagggagcatgatgacacggcctcacccactgtttcccacccagattgctcatctgtgatgattcttttttttttttttttttttgaggcagaatttcactcttgtccaggctggagtgcagtggcacgatctcggctcactgcaacctccgcctcccaggttcaagtgattcttctgcttcagcctcccgagtagctgggattactggcatatgcgccaccacactcggctagtactgtatttttagtagagacagggtttcaccatgttggccatgctggtctcgaactcctgacctcaggtgatccacccaacttggcctcccaaagtgctgggattataggtgtgagccaccgtgcctggccaacttttcttagctttcatcacaagcaaaatcccatgtggcctgtcctctgtccatgtgtgtagtcttatttgcaaggtatttgcctctcattcacagaggcgttcagttttaaatttgtttgggagtttgattaatgtctctacagattaagtaagctctttagaagcagagacgatgtctgtttggttcaccattgtgtccctagtgtctggtagaatgtctacctagtggtagaatcacagaaatatttgttggataaatcaatgctgggcacagagtgagcagtccacaaatatcgttctttcttgactagttaagtatgtaaatcatgtattaatacttgttaaatgaccaaggtcaggggcgttttgtatttttaattgatatagttgtacatatttaggtggtacatgtgatattttgatatgcatatacaatgtataatgatcacgtcaggtaattgcaatatccatcacctcaaccatttatcctgtttttgtgttgggtacattacagttcttccaactgttttgaaataaacaataaattactgttaactataattttcctactatactgttgaataccagaatttattccttctaactgtatttttgtatccattaaccaacttctcttcaccaaaccccacactgatgtttgaattgcttctttttgctctagttgactattaaaaacaaataatagaaccaaccaaaaaaccgcctgttaacaaagtagaaagacagacacagctttgatcagcttacaaaaaataggtgtcagcaggtatgaaaatcagtgttaattggttattatggctttattttgaatgatttctttgttttacttttatgatagtttaacacatacaatgaaatataacatgtctttaggcttgtgtcatctgtttttaaaaattaatagacttgagtttttacatcagttttaggtttacagaaaaattgagcagatagtacagagattccatacttcatacctctctcctgccttcagtcttccctattattaacattttgcattggtgtggtacatttgttataatttatgaaccagtatccatagattattgagtaatccatagtttatattaaaattaattttttgtacagttctgggtttgttttccttttttataaaatgtagaaccctagagtttctatgttttgacaaatgcataatgtcctgctgtcctgtgtacaccattataatatacaaaatagtttaactgctctgaaaatcccctgggccccatctgttgattggagtgctccatctgttcattggagtgctccatctctcctagcctctggcaaccagtggtctttttactctctgtagtttggcatttccaggatgttatgtagttggaatcatatatagccttttcagattagttgtttcagttagcaatatacatataaggtgttccatatctttttgcagcttgatagttcatttcttttcccttttaaaaaatatttattttttatacagatgggatctccctgtgttgcccaggctggtctcaaactcccagggtcaagcaatcctcttaccttgctctcacaaagtgctgggattacaggcctgggccacagtgcccacccagctcatttctttttcttgccgaacatttcattgtatggatgtactacaatttgcttatccattcacctgttgaaagacatcttggttgcattcatgttttggtagttaaaattaagcttctataaactttagtgtgcaggtttttgtgtagataaaagtttccaactcatttggataaatattaatgatccatgatttctggattaggtggtaaggtatgtgtagttttgtaagaaactgtcagagtgggctggacatagtggcccatgcctgtaatgcaaacactttgggagagactgaggtgggaagattgaagccaggagttcaagatgagcctgagcaacacagtgagacccatcgctacaaaaaatttaaaaaattagtgggtgtggtggtgcgcacctgtagtttcagctcctcaggaggctacggtgggaaaatcacttgagcccaggagttccaggctgcagggagttacgaatgtgccactgcactccagcctgggcaagagtgagatcctgcctgtctatctctcagtcatctatcaaagtaaataaaaaataagactgttatggtgtctcccaatgtagctgtacagttgcatttccatcaacagtgaatgagttctggttgttccgcatcctctagcattttctgatgtcagggttttggattttcactattttaataggtatgtattggtatctcattttgatttataattccctaatgctatgtgatgttgagcatctttttatttattttttatttatttatttatttatttcttgagatggcgtctcgctctgtcgcccaggctggagtgtgatggcgtgatctcggctcactgcaacctccacctcccgggttcaagcgattcttctgcctcagcctcccgagtagctgggactacaggcgcccaccaccatgcccggctaatttttttatacttttaatagagacggggtttcaccatgttggccaggatggtctcgatctcttgaccttatgatccacccgcctcggcttcccaaagtgctgggattacaggcgtgagccaccgcgcccggtgagcatcttttcacatgcttatttgtcatctgtatattttcaatgagatattttgcccatttgtaaattggatctttttttactgttgagcttcaggagttctttgtatacttttggtaacagtcttttatcagatatgtcttttgcaaatgttttttctccatctgtagcctgtcttttcattcttaatagtgtcttttgcagagcagaagttaaatgaagtcccactcaccaattttttaatggattgtgtttttggtgtcatatctaaagtcaaggccaaaggcaaggtcagctggattttcttccatgttatcttctagaagttttatagttttcagttttacatttaattccatgatcaattttgagttaatttttgtgaagagtgcaaggtctgtgtctagattcttttttaagactcttctattgaattgtctttgctctctgttaaaagatcatttaactgtatttgtgtggatttatttttggactctattctgttccattggtctacttgtctgttctttcacagataccctactgtcttgactactgtagctttagagtgtctgaaagaggttgaggagtgtcagaccttcaacattcttcaatattgtgttagctattctgagtcttttcacctctgtataaactttagaatttattttttgatacccacaaaataacttgcagagattttgattaggattgcattgaatttatagatcaagttaggaagaactaataccttgttagtattgagtcttcctatgcatacacatggaatatttccttagatctactttgatttcctttgtcagagttttatagctttcttgttaaagatcttgtacatatattgttagatttatacctaatttttggtgtgctaatagaaataacatttggaattttttttgaaattaatgtattttattttttatttatttttttttttagagacagggtattgccctgtcacctaggctggagtgcagtggcgcaatcatagctcactgcaaccttgaactcctaggttcaaggattcctgcctcagcctctgcagtagctaggactgcaggcatgtgctaccgtgtccagctaattaaaaaatttttttttgtatacatgatgtcctactatgttgcccaggtgggtcttgaactcctgggctgaagtgattctcctgcctctgcctcccagaggggtgagattgccagacatgaaccactgcacctggcctggaggagtgtgtgggtgtgtgtacgtgagttcattttctacatggacaaataggtcatctgcaagcagagacagttttactgcttcccagtctacacattttaaatttccttttcttttgttattgcattaattaggactttcagtactatgttaaataggagtagtaaaggggacatccttgctttttgcctcatcatagtgggaacaccattaaatataaatgcatatataaaaatttatatgtttatataaaatatatatttacataaatatttaaaatatatatttacataaatatttaaaatatatatttacataaatatttaaaatgtatatttacataaatatttacataaaatatatatttacataaatatttaaaatatatatttacataaatatttaaaatatatatttacataaatatttaaaatgtatatttacataaatatttacataaaatatatatttacataaatatttaaaatatatatttacataaatatttaaaatgtatatttacataaatatttaaaatgtatatttacataaatatttaaaatgtatatttacataaatgtttatataaaatatatttacataaatatttatataaaatatatatttacataaatataaaatatatttatattaatatatttatatattatatatttattattataaatatatatacaccataaatactttctcaccattaaatatgttagctcaaggtttttttttatcaaggtgaaggaggttttccattcctagtttgctgagagttttatcatgaattgagtgttggattttgtgaaatgcattttctgcatctgttgatatgatcatgtgatttttcttgtttagcctgtttttgtagtagatgacaattgattattgactgttgagctagccttttgtatacttggaataaatcacattcagttatggtatataattctttttacattggttggatttgctaaatattttgtggaggatttttgtgtctgtgctaatgggagatgtcagtctgtagtttttttaagacagggccttgctgtgttgcccaggctggagggcagtggcatgatcaggactcactgcagccttgacttcacagggtcaagcaagtctcccaccacacctggctatttttttttttttttaaattttagtagagagagtctcgctatgttgctcaggctggccttgaattcctgagctcaagtgattctcctccctaggctttccaaagtgctggggttacaggtgcaatccatcatgctcagcctgtagtttttctttcttgtagtgtttgtctgtttttgctgttaggctaaacctggcctcacaaaacgagttaggaagtattccctctacttctattttctagaagatatttgagagaactggtataatttctttcttaaatatctggtagaattcacctatgaacctatctgggcctgatgcattctgttttggaagggtatagttattgattcaatcacttgcatggatataggtctgttcagattacctgttgtttctactgaatttttttgtacatttgtgtctcattttcttttactcaccgttatgctaacgaggatgttgtgactgaggagtgttaaaatcaccaactctgtcaactttcttccttctttttaaaaattctttccattataacttaatgtactttgaagttccattattaggtatgtacacatatgattgttgtgtcttcctgatgaattgactctttcgtgtttataaaatgttctgggctgggcgcagtggctcacgcctgtaatcctaagtgctttgggaggccgaggcaggcggattatctgagctcaggagttcaagaccatccagggggcaacatggtgaaactctgtctctactaaaatacaaaaaaattagccaggcttggtggtgcacacctgtaatcccagctacttgggaggctgaggcaggagaattgcttgaacccgggaggtggaggttgcagtgagctgagatcacaccactgcactccagcctgtgtcatagagtgagattctgtctttaaaaaaaaaaaaaaaaagaagttctgcattatctccagtaatactctatatcttacagtctatctactctttgatattaaaatagtccctccaggcttcttatgctttactgtttgctttcaacttatttgtgtctttgttttcaatatttatctcttctaggcaacatataattgtggcttccttttatatccattccaacaactctacctttaaattaaagagtttagtccatttatatttcatataattcttgacaaggttggatttaggtctatttgttttctgtttatatcttctgttttggtttccttttttttcttttcttttttttgacatagaggtatgtatatgaaaatagcgtgtagtttttacttcttttttctcctcttcttttcctgatttcttttgggttaatttaataacttgaatatattggggcttatagcataccttcttaaattattattcttttagtggttgccatagggattaaaccatacttggagttaatattgtaccacttcatctctttttaagagacagggctttgttctttctcccaggttagagtgcagtggctcagtcatagctcactgcagcctcaaactcgtgagttcaagtgattctcgtgcctcagcttcccgagtagctgggattgcaggtgtgtgctgccatgcttggctaatttttgtatttctagtagtgagacagggttttgccatgttggccaggctggtctcaaactcccaacctcaagtgatccacctgcctcggcctcccaaagtgctgggattacaggcacgagccactgcacccagcccatcttatacttaagaacccatatgtgtctgtatagattcatctctaaccctgttctttatgctttaggtttcatatttattatagtcagatacattataaacttcagtacagtcgtatgatttttgctttgaacactcctgtgtattttatagaaattaagaggaaaaatagtctattttcctactaatatcatttccagcaatctttattcctttatgaaaatctaagtttccatgtgtatcattttccttcaatctgaacacattttaaagaacatttcttatggtgtccatctgctggtgatgagttctcttttaatttaactgtttattttttctttgttcaggagggatatttgcttggaaatggaattctgggttgacagatgttttgttgtgttttgtttattcctcatctgttctctattgtttctagtttgtagtcagcattcataggtgtacttgttcctcctatgttatttttctctagctgttttcaggaatttctcttttatttttgagttccagtagtttgactataatatgataaacctacttgtgggtaactgcatttatctgcttggagctattagagcttcttgcatgtgtagatttatgtctttcgccaaatttgggatttttcttgtaatattttgttctgaatcattttctcttctcctctggaacttcagttcaatatatgttaagaccttttggccaggtacaatggcgtacgcctataatcctaacactttgggaggctgaggcactaggattgcttgaatccaagagttcgagaccagcctaagcaatatagtgagacctcatctcgggttgtgggggaagaccttttaatattgccccatgagtccctgaggctttcttttttgtttttttttcttttttctttttgagatggagtctcgctctgttgcccatcctggagtgcaatggcgctatctcggctcactgcaagctccgcctcccgggttcatgccattcttctgcctcagcctcccgagtagctgggactacaggtgcccgccaccatgcctggctaatttttgtatttttagtagagatggggtttcaccatgttaaccaggatggtctccatctcctgacctcgtgatctgcccgccttgacctccctaagtgctgggattacaggagtgaaccaccacacccagcactttcttttttttctataagattggataatttatctttatcttcaagttcattgactgttattagaaccatactctatacccatacagcgaattttctatcctagaattagtttctattttttgagatttcctgtttattcttgttgagtgtatttcttttatgtccaattagcgttataatagctgctttgaaatatttgtctgttaaatccatatctgtttcatcttatgattggtcttcattgattgctttttttaaaaatagtgtttttttttgtttgtttgtttgtttttaattgagacagagttgctctgtcacccaggctgtagtgcagtggcatgatctcagctcattgcaacctctgcctcctgggttcaagtgattctcctgcctcagcctccccagtagctgggactgtaggtgtgctcctccacacctggctaatttttgtattttcagtagaaactgtttcaccatgttgccaaggctggtctcgaactcctgacctcaagtgatctgcctgcctttgcctcccaaagtgctgggattataggcttgatccaccgcacctgccccattgattgctttttgatgactgagttttgttttcctatttctttgttggtctgttaatcttggattatataatagacattgtgaatgataaattgtagagcctctggattctgttatgttccctcagagtgttgatttttacagtcttgtcttcagcagtcaagttgattggattcagatgtcaaactctacctccttcacggaaggcagcagatgaaatatttattgttttgttttatctggattgtttagtacctgtcctgtgcatgtatagttccagtgatcagccagaaatttgagtagagtttatatatgaatttggactttcttcttcttaggctgtctccctttcatcactgttctctggctttctagctgctgtggttgtcctgaactctatcctcagattcttcaagccagcaagccaacaagactgtgggtttctgagggttttttttttttttttttggagatggagtcttgctctgttgcccaccaggctggagtgcagtggcgcgatctcagctcactgcaagctccgcctcccaggttcacaccatcctcctgcctcagcctcccgagcagctgggactacaggtgcccgccaccacgcctggctaatttttttgtatttttagtagagacggggtttcaccatgttagccaggatgttgtcgatctcctgacctcgtgatccacccatcttggcctcccacagtgctgggattacaggcgtgagccaccgtgcctggcaagggtttctgagtttttagtcatacctctccccttcttttggcatccactggggcacaccctcaggctgaaaggcatgaataaaccgtctagagccctccctgcttccaaggtattgttgatgtcccttccattttatagctattttggtcactctgtagtgcctacaggcagttgttttgtgatattttgccccacggtttgttgttgttatcagtggcaaaagttgctctgatagaactgcttagctaatactagagaagtcaaaattctccatattagttttaacagtagccttaaaaaaacagaatgatagctaatatttgtttggcactttttttgttataaaagcactttaatgtagattgtctgatttatcatgattgttaataatacagtgctgctacatgttgtgccaaaaatatgaacaggaaatgagtctgaagtctcaattcagcatgattacacatatgaactgatacaacaactaaaatgaaaataagtggggagaaagatagtagtggaaactataggtatgaaaaggaatagaagaattttgtgcctttggggaggtgatactgccagcaggtaaatggagtccatgtatgcatatataaattactgtcttctgtattagttcttttcatttgttatttttatgtatttacttgccttttgagatggagtctcactctgtcacccaggctggagtgcaatggtacagtcttggctcactgcaacctctgcctacccggttcaagtgattctcctgcctcagcctcccaaggagctgggattatgggtgtgtgccaccacgcctggctgatttttgtaattttagtagaggtggggtttcaccatgttggccaagactgctctcaaactcctgacctcaagtgatctgcctgcctcggcctcccaaagtgctgggagtacaggcatgagccactgtgcctggctgctttttgttttgtttgttcttttttttgagacaaggtctcacttcgtcacctaggctgcagttctgtggcacaatcacagctcactgcagacccgtcctcctgggctcaattctcatgcctcagcctcccatagctgggactatcagctaatttttacattttttctcccaagaaatcttgcctaagattaaattattgtttttttgagacgagtctcactctgtcgccaggctggagttcagtggcgtgatctcggctcactgcaacctctgcctcccgggttcaattgattctcctgcctcagcctcccgagtggctgggactacaggtgcacgccactacacccagctaatttttgtatttttagtagagacggggtttcaccatgttggccaggatcatttcaattactggaccttgtgatccaccccccacggcctcccaaagtgctaggattacaggcttcagccaccatgcctggccgattattgtttttatacatacaaggtctcactacattgcccaggcctgcctcaaactcttggcctcaagcaatcctcttactttggccttccaaagtgttgggattacaggcatgagccactgcacctggcctcattcttttataaaacttttatttataattttaataatatttatcacagtttgaaattctttgtctctaaaagaaccatggggaaaagaataattttttataaaatttaaattatttaaaaattgttttctgtttattcactacactgtaagctgtgaggaccaggaccatgtttttgtatgtccagctcgtaggccagtgcctgacatgattttgaaggaggtgacaggtagaaattgaagaaatttattggaaatgttccagatttggatggttttcattctactagatagcagaaaattttttgggctgggtccagtggctcacgcctgtaatcttagcactttgggaggccgaggcgggtggctgtcttgagccaaggagttcaagaccagcctgggcaacatggtgagaccccgtctctacaaaaaaaaaaaaatatatacaataactagccaggtgtggtggtgtgtgcctgtagtcccagctacttgggaggctaatgcaggagaatcacttcagcccaggaggtggaggttgcagcaagctgagatcgcaccattgcactccagcctgggtgacaggagtgaaaccctgtctcaaaaacaaaaaaaaaaggaaaataaaaaatgggaagtgttaaggctaagctcaatactttgagcctcaaaagaaatattcaggccatggtcttgagtagtgagacaccagaagtatggagatagtgatgaaaagcagtcaatgcttttcattccctcttgcttctgtgttttagggttccgaggtcctggcatgatagggagagttcaaagcaagtatttataggttattagaattgattttcttagttgtgaaactgtcttgttccacagctcttggataagcacaagaatacagagagcatggtggagcttctggacttgtatcagatggaggatgaagcctacagcagccttgcagaagctacaaccgaactctatcagtatttactacagccattccgagacatgagagaacttgccatgctacgaagacagcagatcaaggtatttttttattaatcctaactagtagcctgcctgtttcatagttctcagcctgaaaggccatgcgttatccacaagaggaactttaaaaaaaaaaaaaaaaagaaggtacctggtcctatttctgcaaagtttcttgtttggtagaatagggttgtagcctgagtatccattctaaagcacctcaaaaggcaattctgctgagtagccagggttgaggatagcccagaaagtaatgtgttcaagttagcacaaagttgtaaatacattgggaggattcctattttctccctttcctgcactttccttcctcctctagtcatgtctcctctttaatgttttggagactgtgtactcttagacttcattaccagaaattttgggcaggctgagcgtggtgcctcacacccgtagtctcaacattttgggatgctgaggcaagaggatcacttgagctccgagcttgagaccagcctgggcaacacggagaacccgtctctacaaaaaaaaaaaaaaaaaaaaaaaaaaaatcaaactagctggatgtggtggcacatgcctatagtctcagctacttaggaggctgaggtaggcggaagattgcttgaacccaggaggtcatggctgcaatgagccatgattgtgccactgcactccagcctaggcaacaccttgtctccaagaagaagaaaaagttttgggaacatttcttttttttttttttttttcgagatgggatctcgccatgttgcccaggctggtctggaactcctgggctcaagcgatttgcccacctcggcctcccgaagttctgggactacaggtgtgtgaaccaccatgcccagccagttttgggaacatttgttttagaagaacttgttaggaaagttttaagtttttaatgacagaactttaaatacatgaaattttttattagtgtgtgacaaagtatattacaaaaaatttttttcagccaggcatggatcatgcctgtaatcccagcactttgggaggctgaggcaggtggatcacctgaggtcaggagttcaagaccagcctagtcaacatggtgaaaacccatctctactaaaaatacaaaaattagctgagcatggtagtgcatgcctgtagtcccagctactcgaagggctgaggcaggagaatcactttaacctgggaggtggaggttgcagtgagccgagattgcaccactgcactccagcctgggcgacacagcaagactctgtctcaaaaataaaattaaattttttcccccacaacatgggtgaaaaagcattttttgaggcaagcatttaagggtttgattttatagctgaccttaaatgttatgtgtaattcatatataaatgttgctgaactagaacattaaaattgtctttttacctaataggttaagttggaatatcattatgtaagattgagtatttgagaaaattagcaattactttgagaaccttatgcgtggggacaggggtgagtatatttgaaaaggtatgagaaagtaaggttgtctgtgtgtcttattttctctttactaacgtatcagggtggagagtaggacagtcacacgacttagacatactcctttatcaatacttttggaaaatagctgtgctgtcagctttttgagggggggatttgttttggtcagtcagttttatcataaatttggcatttgggttaaaacagcaacatggaacaaataatttttagatgttggaaattcctggttttttttgttttgttttgttttgtttttttgagacagcgtctttgtcacctgggctggagtacagtggcatgatctcagctcactgcagtctcgatgtcctgggttcaagcagtcttcccacctcagccccacaagtagctgggactatgggcgcatgccaccacgcccagctgttttttgtcgtagtttttgtgcggaggtctccatctgttgcccaggctggtccagaactcttgaactccagcaatctgcccaccttgattgcccaaagtgctgggattataggcatgagccactgcccagcctggaaattcctgtttctttaaatgaatcatggatatttgtctgctaagaacttgactagaaggccaggaataaactggacgacctggatacccacctactttagactgctgcattgtttagcagacataatctctatagcacagcactgactatccagaatctgtacacattcttttacataattatatcatgatttgtattgggtattaatattagcaaattggttgaccctacttgtcagcctatattgtccactagcatcacttaactgctacatttttcctgggaagtagaatgtaggtgaagaggaacagaaaacatattttgaaaatttgtgtcttttctgacagtaaaaatggtatttcactgcatttctttttctaagacattgagaaaatgccccatcaatcatgactattcttttattcttgatcctacttgtgaatttgcagatataagtttttgttagccaacaactagatttagttagcaactcatacattacattagattgagtgtgttgtattgctttaaaaagatccgctaatttaattatcacacaaccttgtaagttgggtactcttattatttgtattttcctacttcatagataagaaaactaatattgggataattatgtacttgttcacagctaatttgtaagtggtagaactgatacagtactcaaatcaggcatttctgattccaaagattttttttttttaactgcattactggttacttgttacttctaagttaaaaaatctactcagactttttaaatctggaggagctaaaaaaaaaaaagcaagtataattgattagcaaagtagttgttttaagtattactaagatgtattagtaatagaaaaaaagaaaataatttatttttatttttatttttatttatttatttttttgagacagagtctcgctctgttgcccaggctggagtgcagtggcgcgattttggctcactgcaagctccgcctcccgggttcgtgccattctcctgcctcagcttcccgagtagctgggactacaggcacctgccaccacacccggctaattttttgtatttttagtagagacggggtttcactgtgttggccaggatggtctcgatctcctgacctcgtgatccacccacctcggcctcccaaagtgctgggattacaggcgtgagtcactgtgcccagccaagaaattaattttttttttttttttttttttttttacttttaaaacctttttgttaaaaactggagcacaatcacacatctagggcctacccaggatcaggatcatcgagatgtcactaggccaatcaaacagatttttcagctccaatataattttatcaaacccctattgtatatgtgtttcattgttgactgaaacatcattacgcagcacgtgactataatagaataatttttggcaatgcaaaggaatgaactgatggacacagcatgggtaaatcttaaaatcatgctaagtcaaagaagccaaatacaaaagaatatataatgcataaagggggatggacttaaaaggggcacgaagaatcttttggagttgatggaaatggtcagtatttgattaatgttgtttcagaggtgtatacagctgtcaaaactcattgagttgaccactctaaatggattcacttggttgtatataaattaagccatagtaaaattgcttacaggaaatatgctgaggaaaagacatctaacacaaagagcataaactttgtgatacctttatttgaaattctaggccaggtgtagtggctcatgcctgtaatcccagcactttgggaggccgaggcgggcggatcacaaggtcaggagatggagaccacactggctaacacggtgaaaccctgtctctactaaaaatacaaaaaaaattggccgggcatggtggtggccacctgtagtcccagctacttgggaggctgaggtgggagaatgacatgaacctgggaggtggagcttgcagtgagccgagatcatgccactgcattccaacctgggtgacagagcgagacactgtctcaaaaaataaaaaaaaaataagaaattctagaaatgatgattttgatctgtactaacagaaagctaaataattgttgccttgggtggcttaggggaaattgacagggagcaagcaccacagacaactttggagtgattctttaaatctagattttagtgataaaaatgaatgtacacatttgtcaaaatcaatcacaatttacattcaaaatgttgccttttgtaggcaagttatatctcaataaacgtgattttttaaaaaaagttaaatgtgaagaatgtacacacttatataagaagcacacaaaatggggtgatcagtgcctaaagatatatgtgaaaagagggactatctagtgcttcactattgaagaatgaataagaattttcagtaggaagtgggtacgttacaatctctgtcagagattggaatagagaatattcctgatgaagagatgtacaaagaggaatggtttagtgcttatacttagtgcttgtgctttaaccaggtaatgtggtattggcactaacttaattgaatcttcacaccaatccagcaccattgatggttgccagaaagtagcgtggttgggattgaacacgtgtttgatagcaaaacctgctgttatccacagggtgtgaattgtttggtatgcttttagtctaaggatttatagaagatgagaggaaagatggttggaatgttattatattctatggacagttgtgtctgttgggttctaatcaaaatatcaaaccggttatttcaacagagaatgataataataataataattattattattttgagacggagtttcactcttgttgcccaggctggagtgcagtggtgcagtctcaccgcaacctctgcttcccgggttcaagcaattctcctgcctcagcctcccggagtagctgggattacaggcatgtgccgcaatgcctggctaattttgtattttttagtagaggggggtttcctccatgttaggctggtcttgaactcccgacctcaggtgatccacccgcctctgcctcccaaagtgctgggattacaggtgtgagccactgcacccagccgtcaacagagagaatttaatataaagaatttgttaactaggtataaagtagttaaccaaataattgaccttttctctttatgaagagcttgatttccaatggtttcattaacctaggtattaaagtatgataggaaagaagagaacttggcatcccaaatgtataatgtatttatatttgtttttacatttaatatttatgatattaacataatatctcacctgttaagtattaagcagctcctgcctacccagcattattttaggccaggaagtctttctgagatagacacccctttagggagctcacagattctaagtctactacattgggtctcaaaaatgtgatcacctgactagtagtatcagtataacctggaatcctgtagaaatacagattcttgggcttcacctcagatcttctctactgaaactctaggaatggacctcagcaatctttgttttgacaagctttccaggtgattatgatacacacttaagtttgagaaccactagcctaataaaacaggacttgaaacagcttagggatttcacatactgaactgaaggttacaatttttctgggtctgagtttttctgggtcttaccaaattgactgcagtattaaatctacaaaacttcaaaagtcagttagaaacagcattaaaaagtgcaaaaagcgtgtttgtattctttgtatttgtagctataaacacattttgaaggtaaagatattaatccaacagcaaggtacaaattactttcttttttttatttttttattttatttttattttttttcacaaatagcactttttatttgccactatttgaagtctgaactttaaacagattcttggactggtggttcaaaaccatcagctcgttcaactttagcacctctctcgtccccagtggcttttccagaactactgccttcaccatgaagctccatgagctttcccaattcaaacttgggcttcttcagcatttttacttttctaacgaagacatcatggagaggatagattggcaagccttttctatgtcttttccaatgctgtctggaatcaatttattgaccacttctttcaaggcatttgtctgcacctctcgggtcatgatttccatcatcttcttccggatttggcggacccgttggtgctgggcataagaggtcttctgtatctgattgttgcgttttttagtaaaaccaacacagaacagacgaagcaagtaaccatcaatagtcctgacgtcaacgtgagcttcaatcattgtctgccattttttgaccatggaacacattttgtcacaggtaagatccatgccatggaagttaggcagtttttaccctgaacatcttcagtaatcagcttgaattttctaagtgcaacttcatcattctgcaaatcagcaagactcacttcaaacacacgacccttgagaccatcagatgcaattttggttccttgggtcctggtgatgagcatctttccaatatttcttatattgaacatagcaggtgctttcacatcataccaatctttcttagaaaatggatcaaccactttcttcttggccccctttttgctgcctttcgtaaggtgcttgttcttgccaaccgccatggtgctggtcagagagccaaaaggaagttactttcaaatgaaagtaaaatgaagttgaaactagacgaacctctagatttttaaatccagtgtctttaatgagtcagagccagctggactatactcatcatcttgatcaaccataagcacttcagacagattgtccaacttatttttaaatacttcctgaaagtaaataagctagaaactggaaggcacttgcatttctttctgttgtagccagtcacctcattttgccagttgtctcctagtaaattcttgaatgtgcatttcattcttatcccaacccccagggcaagtctgtaggtgcctttctgtgaaatagaaaactgcaccccctgccccccacccgcccactgccagtcacccatcaaacaaattaggaaagagccctttttcatcaagtgtagaaatacacatggcctggcaaagcatgggctgcatttcagtatctactccatccccttggctgggtgctatttattgtgcagggtgcagtttttaccactgtatgcatccaccgcatgcacactgtgaactaggtagtgccaccattatacattaagatactcatatctcacctgagctatactttcctttagttcacttgagtttcgatttctctctttttttttttttaagcatagtttctcacacttggcttagctataagaatctctcaacaatatttgctctgaatataaaaacccatgaatagatactaagctaatcatgttgttagatcattcaagagtcatcttcaggcaactccagggtctggaatatttgcattgtgggtgctgttacattagtatattcacagttttttccccctcatcttcttcatgatggtacattcacagatttatcttggcattgttttaccaaagaatctaaggtggatttcccccctactgtgtttcttacataaaagccagtatccaagtgctgtgcttcataataattccacgtcaggtaatttgtatttataaactagtttcgctatcctagctgacacgcgctttttttccgtgttaaaaacaggcactgttttctttctagcactgaaattgaaaacagaggtgtcattgtttttagcacatgatccatctaaccagtgctgcacatcttcaaatttgccaagttaggaaaagtacttagtacccttgtttaatgtcttaggtacaataaactattaaacaagttgcttacgagttggctgcaacattaaagctacgaaacttcaaaaatcagttaaaagacagcattaaaaagcatagaaagcatgtttatgttctttgtatttgtagctgtactcataaaggtaaagacattaatccacaacaaagtacaagttactttcaaataacttgccacaggttaaaaaaaaattttttttgcctcttcaaaaagcctcaaggctgggcgcagtggctcacacctgtaatcccagcacttcgagaggccgaggtgggcaaatcacctgaggtcaggagttcaagaccagcctggccaacgtcgtgaaaccccatctctactaaaaataaaaataaattagccgggtgtggtggcgtgctcgtgcaatcccaactactcaggaagctgaggcaggagacttgcttgagaccgggagttggaggttgcagtgagctgagattgcaccactgcactccagtgtgggtgacagagcaagactccataaaaaaaaaaaaaaatccataatgcaagttttacacttttctttcgataaatggtacatggacttaaccatgcaagtaagaatgatttttgtattaagatttttgaattctgaacactattaaatttctgttccatagttgtatctgttgagagctaatcagaaaaactagttatttcaacagagagaatctaatataaagaatttgttaattaggtataaagttgttaaccagataattgagaaggcaagaaagtaactctaaggtacttccagaggaagcaattgtaaaaacagctaccactcctagggttggagaaacaaagagaagggattggaattattaaaactgaagcatagaggaggaaccccgtggagctgacctgaaaaagagggcattgcttgcctggtgctcaatggagagacctagttctcagaggattcagtactgaggggttggtttgtcttgggggttgtactatgagcctagggttgaaaaaactgcaaattagattccgttactgcttcagaaaggaactgccgatgctggggtgaaataaggcttgggtgatgctgacaggaacagccaccagttgaagtcaagggatgcagatagaagcatatctcctccctcttccaaactcttctattggcaaaggctaaatgtgatttgcactctcaaacctagcatcacaagacagaaggatgaacttggagatgaatagacaagaatgtacacacatcttcagactttcaaagttagggggaactagcttaaggttttaggtacaatcgactaattacggatctttaacctttggacagatgttacagctgctgagttttaaaagtcagttaaaggctgggcatggtggtgtgcacttgtagtgtcagcttgctgggagactgaggcaggaggacacttgaggctgagagtttgaggctgcagtgcgctaatgattgtgcctgtgactagcccctgcactccagcctgggcaacatagtgagacccccatctctaaagaaaagaaaaatttaaagtcagttaaacagcagcttaaaagaaaagcatactgggcattcgagtatttcaccttctgtatatttgaatatattaaggtagcaaactatgttatcttcacataattgtcaaaggatttagacttttcaaaaaaggtataacttcactaatttccatttgtcttttctttgtattgttaaataaagtgtaatcatgtcattgagaagaacttctattataatatcctgagtaagggatttaagttttgacttgtatcattattaaatttctatcccatacttgtaaatactaattgtatgcttttaaacctgtatgttttaaattcagaggtaattgcaataaaagaaagcacacataccaattttcttatagcaaacaactccaccagaatccttaaatctaagatgaagtctaaatatgtcacttagtgcatagaatcccacagtggtttcctgtcaaattaaatacacggtccttagcctgacattttaaatgtcttttaagacaacctcatatgataacaacctactttcctagtatctctcattactttcatttttctctcctgaaagcaagcaggctggactgctttccatcccttagcaggcacaaaaatttttaggcttttgctcagattgctcctcacctctcgcatgccttttcagtggtttttctctctttatgtacccgtcaaaatcctaccccttcttcaaagccatctgcagttaatgaacctcaatgaagtttgtcctcatctacacaaatgatactctttccccacaataccttttatttttctcataggtgttttacccagagacacacttaaccatctttagtatctggctaaaattctgttaatataaaattctactcttaatatttccagatattactcattattccctttcgaaagtctgcccagactttgcacccagatttctacacctgatgctccccttgatgtcttaggcatgctcactcatgacttttttttttgtttttttggtattctaattctttttgttttgttttgtttttttttgtttgtttgtttgtttgtttttagtagagatggggtcttgctatggtacccacgctggtctcccaactcctggtcacaagcaatcctccctgtctgtctgggagcaaaaggaaagcagtttttgcgtgactcagctcccaagcttatcttgccctttgatatagtgagtttggggtcttgagattttattttcctttcacagcattgtttagagactatgggttgtaggccaggtgtggtggctcaagcctgtaatcccagcactttgggaggctgtggcggtcggatcatttgaggtcaggagttcgagaccaggctggccaacatgacaaaaccccatctataataaaaatacaaaaattagccgagtgtggtggcgggcatctgtaatcccagctactcaggaggctgaggcaggagaatcacttgaacctgggaggcggaggttgcagcaagccaagatcgcactactgtactccaacctggacaacaaagcgagacgccgtctcaaaaaaaaaaaaaaaaaaaggagaatatgggttgtattatttctaccttcagaattcattactagctttttagtggcttaattatacttgatcagtgtttttttaagtgtgtcatgggtgggttaacattttgcctgttttttttttaatttatcctaataaagttgtcattggcttcatatataacttgctgatagctatttctctgtatatggtaaagcaagattgtatgtataagtgatccattgcagttcttgattgtacctttcttccatgttaaaacatacttatgtagtgttttgaaatatacttttaatattatcacttctttaaattttgttttagcattcacctggttcattcctgtccatcctttgattttcagctatctgagccaccgtgcctggccttcctctgttattgttatctaaagtcttttcagtatgcctataggctggtttttatattgtcattgtgaaaatccaggttttcaattgttttatatagtggctgttaaggaaataaacaatttaagtaatttgggggggggcataaataagtcttaaccaaaaaagatattttatcatagaggaggaaataaattcctcatcgagacacctaaaaacaatcagtcttaacatattggtatatattctttgcctacgtatggagtgagagggggatggaagaaagggcaaaatggggaataggtttctatgtcaaatatcttcagtattattgttaattcacttgttttgtaaactaatagcttatcctcttgagcagggaagaacaagtattctttgtggtatataaactttaaatgtttgaggaatgagtagaagaaagacttgaacttcttaattttttctttttctctctgaagatttccatggagaatgattatctgggacctcgaagaattgagagtctacaaaaagaagatgctgattggcagcggaaagctcacatggctgtactgtctattcaagatcttactgtcaagtactttgaaataacagctaaagctcaaaaaggtaggtttctcagtaaatttatcctttaggtatttttgaaaatgagtggttaagtattttatgttcagaaaaattacatagaaaagtatataaagatcactcataatcccagcaattagagaaaaccactattagcaaattaaggcacatcctatcagtcttttcatagatacatatatttaaatatatataatttaaatatgaatagtaaataattgtgtttctactaacatactgaggaaaaaaccataaaacctcacagaattaatgctttcctggaaactttgaaagttaataacaccggacatgtgagagtatttttaaagtttctgaaagctaattttataagtgttttaactgcagaacgttatttctgaggacagattgaagacattagaatctaagatactctcaaattatgttttagaaatgtcggccgggcacggtggctcacgcctgtaatcctagcactttgggaggccgaggcaggtggatcacaaggtcaagagttcaagaccagcctggccaagatggtgaaaccccatctctactaaaaatacaaaaattagccgggcatggtggtgggtgcctgtaatcccagctactcgggaggctgaggcagagaattgcttgaacccgggaggcggaggttgcagtgagctgaaatcgcgccactgcactccagcctgggcaacagagcgagactccatctcataaaagaaaaaaagaaaaaagttataagcagtttatcatgacagcaggatttgtttctctttgtgtggtcagtgaaatctttttcaaatgcttcagtattaagttgttatttgtcttaatttctctttaaaaaattattaatagctgtgtatgatcgaatgcgagctgatcagaagaaatttggtaaagcatcatgggcagcggctgctgaacggatggaaaaactccagtatgcagtttctaaggaaactttgcagatgatgagagctaaagagatatgcttggaacagcggaaacatgcactaaaggaagaggtaacaaaaatcatcagaaatataaaatcagaaaaagttacagtttgtcattttaatctttgcacaagacatttttttgattcgataggcagtgattttatgccatcttcatgagatgaaaacacttagaataggtcctgtgacttaagttgtcattagaagagttagacgtagcgtatttcacagcatcacagtgtgatggttggcagcactgcactgttgatcagaggggccagcatcagaatttcttagttgctgtaaagtttttaatactgtaaaaacgtaaagctttccagcaattattaagaaagtatcactgaccagagaaattcagtaaaatttctaaggcagtggcattttgttaggattgattatataatgcttttataccattacattttggaacttcccattttattcctactggaacacactggtctcccccatctcccaccacctctgtacccgctacagtcactgtctatccttttttactattgacagttataaatattcatacccattttgtgggctgccctcattggcttgaaaacactgagtacatatttattaaagtagcacattttagttgctagagaagaacaaatcatcatctctgctttagttataagaatacagcattatgtaaaatatgtatttttttggcttaggttgtacagcaagatggttctcattgacatttttgaagtgcttatgctcatatacactttttgttgatggatttttatcattatttcatttcccccttatttttatttgctggttattagaaggtaaaattggaacttggcttatccgggaaattgttcacactttatattcagaatcgctgtgcatggatttcatccccatctcatgttcccctgaggcatttctactataatatccttttctaattagcttgttcccctcatgttactggctctctggagttgtcttaaattctagaacttttaaacttaagtccctctttttgcttataatagagtaccacctttatcttcatctttgttgttgttgttgaaacagtgtctcattctgtcacccaggctggagtgcgatcacaactcactgcagccctgacctcttggggctcaagcagtcctacctcaggctcctgagtagcaggcacgcaccccccccaacaccttgcaaatttttatttatttacttatttttttgtagagacgaggtctccctatattgcccaggctcatcttgaactcctgggctcaagcagtccttctgcatctgtctcccaaggtgctggagttaaggtccatgcccagcccgtcttcattatattatctagcattattgttctaacctggctaacactgagttattctgtcagtggacagctgcctaagagagcaggggagggtaagatttctgactactcttactgtagttggtctagagtagtagaggaaaaacgagcatgaaatgggtcctgagagtttgagatgattatcttggggagtggggggggtcctattccctggggctgtcccattaatgtaatagtctggattgtatttgaattcttcacagtatttgttaaaactgccagctgtcattcttgccaggtttatgcttgttttgtgtataatttagataggtattgtgctttgtatctatgtgtggtgatgtaccaattttattagcattaatttaacatgcccacattactcatgagaaagagagtaaatgtgaattattaagcccattccagaacagttctttgccagtagaggttttgcaaaacagtactaccctgtgatttgtccccataggttatttttaaaacaaagttcttcttgatgtgacaaaattaagacaaccctaaaaatgaaaatgtttttaatttaaatttaatttaaaaattaaatgtaaagtatttcagaatatttgccacaagcgtaataccatacttgaaataaatgttctgaattaacactgaaatattaaatattacctaagcaggcaaaattctgtttgacttgaaagaattaactgctcttaggagttgatactgttccttttaatttataccccctttaactttttaactttttttaacttttttttttttttaaattaatttagttagttaaaatagagacagagtcttgctgtgttgcctaggctgttctctaactcatggcctcaagagacccctcatgtcatggactcccaaagttctgagattataggtgtgagccactgcgtctggcgctgagtcttaattataatcattcttaccccttttaggtcattcttgcccctttaagaatatgacaaccctgtactcagagtaatgtacatatatatgcaattttgcacacaattttagtaggttctcaaattatctatatctgagcctcttatttcagaatgactgcccatgttctgatttcctcatcaaaactgctgaaaatactgtgtttttagcccaatacctgtgaaagaatcctttgtgagtttaactagttgtagctactttattctactctttcaatagtatactccccatctagatttggaaataatagcataatctgaccatgcaagtaagtctttattttcagttctatattgttaatccaggttatcagatatagcttacgttttttgttttaaactattggacaagattaaaatacatacaaccacacaggattaggagtagagtatatgctggaagtgttattaaaataaggattaatgttgaaataaggagattttctatatagttattaattgaaatagatgatgataaaattaaaatgccatcatgaggttgggcatggtggctcacgcctgtaatctcagcactttgggaggctgaggcgggtagatcacctgaggtcaggagttcaagaccagcctgaccaatatggcaaaaccctgtctctactaaaaatacaaaaaattagccaggtgggtggcgtgctcctgtagtcccagctactctggaggctgaggcaggagaatcgcttgaacctgggaggcagaggctgcagtgagccgagattgtgccactgcactccaacagcttgggcgacagagtgagactccgtctaaaataaaataaaattaaattaaaatgaaatgaaataaagccatcatgaagcaaatcatgaaacatctggattaaattgtagacttctattttgtggttaaccgggattaaccagaaaaccctttagattccaattcgtgtggctgaaagactttaaaaagtatatcagggccaggcgcagtggcttatgcctgtaatcctagcactttgggaggccaagacgggcggatcatctgaggtcaggagttcgagaccagcctggccaagatgacgaaattctgtctccactaaaaataccaaaaattagccagatgtggtggtgagcacctataatcccagctactcgggaggctgaagcaggagaatagcttgaactcaggaggcacaggttgcagtgagtcgagatgatgccactgcactcaagcctgtgcgacaagagtgaaactctgtctcaaaaaaaaaaaaaaaggtatatcagtgtgctttctttccctggcagaggattttaacaattccccatctatttataattccttgataatttctctgaacatacataatctaatagaatatgaatgcatactagtcttgaagattagctacttatttttgtctttctcctacaagcatgtagctaaattatgattaactaaggttatattcccctctttcagttttaattcgtcaagtatttattgagcattgattatataccatggtggatatgagcttaggatttggacagtgctgtccagcagaacgccctgtaatcatggaaatgttctatgtttaccctctccagtagggtagttttcagccatatgtggctaatgagcttttgaaatgaggcttatgcaacagaggaacagcattttaaattaaatttaaataaccacatgtggcttgtggctaccttactgaacagagcacctctatagatctcagttctgcaaacttaactctttaggaaagcttcagtgagttccttaacctgtctttgaaatgtaaatattatataccttctggaatgttatgatttcatgagttaatgcatataaagcatttgctatagcacttgacatagagtaagacctggataaatattagtgattattactataattgtatgttatgttttgtgccagtatcccagaagggaatacagagaagaaaaagatacataatttccatgcttaagatgtttacttgcctcaaccaacatttcagggttcacaaagcatgctgttgactaggtgatgtgacattttgtatgggccttgccagaaacttccaatagtaagaagctgtgatgtggtagacacagcctgagtctgagctgaggtggggtttttgaggtccttgtccaggcaaggagattggtttttagttttcattttatttgtcaataagtagattattccataggtgcacactatatatttcaaagagtctaaatacaaaaaggtaggttccactctaaaggccttagtttatcttaaattctgttttcaccatatgaattctgttttggcagcagttaaagtttaaaatgttttagtccctgtccttagtgctttatgtgtattatcttgttaaattctcaaacataaccttttatgctataagcccaaaaccattatctgaattccctgaagacagatatatttcagaatcccagggtttttttagattttagaaaggtaagatagagcatataacttcagacaagtgttattagtccactaatgaaacacatggtcacattaaatggaatacctaaggattaaaaatagtttatgaaaagttcagatcacatttttccacaaatggattgtgagatttggtttgacattaaattatgggaattttccattttccaggatttctgacatgtggaattcagataattctgtcaacttgtgttacccatatttgtgcagttgttactggtgaaacctgtatttatactcaggcttgtctgttactaattctcatgttcattctttctacataatagggctagttttggttgaaaacttgcccttaacatcattcaccttatgctgtccaaggtttttatgaccctttaaaaaaaagatatagccttgccctgtcaccgatgctggagtgcagtggcacgatcatagctcaccacaagctcaaactcctgggactcagagtccctactgtctcagcctcctaagtcactaggattacaggcacatgccactatgcctagctatgacttattttcgaaccctcatttcatttcttgttgactgcatattttctgtaactcaaacagtggtggatgctcagtgagtattttttgaatgaatgattcagtccacaggtagctcttttaatagttcctctaatgtcattggaattttctagcacagtagggtaaaaggcagaacaagggcataattcatttgcatagtttgcaaaaagtgccatctggtttcatgataaagtacagtcaaaataggtatacatgaaaactactttatcattattacacatggtgagaatgattgtggagtcagcagggtatgttgtacttacatggatgtatggacatgaattggtacttcatccccttactagatttgctgtaaaacaataacaataacactttgatatttttccgtctttttgggctggtaatccctaattttttctagtggaaagagcactcttgtaggaatcaggagaactgagtctagctcaaactttgctagtcattacctggatcacattgggaggttacaatttggtttggggtactggtatcctgatacttgaagtatgtttaggagagtaaaagttgagctaagttaaattttaagatggccaatttttcctttgagtatttaaactactttcagggcttctttcttcttgcccagggaagcactgctctcagatataaaaaagacaccccattgtggcacccaccttccctgcactgctccattatctggaattagttctcttttcaccctggattctgtttctcttagttctgtggctgtcagctgaggacaggaaaactcagtctggaaatttcagatgttaaaacagggaggaaatttggagcagggtgcccgctccatacctcttcatgccttatactaaggattttgcctccacattgaagattagatagacctcagagtattattttgccctcacagatttctctgagtcatagcatccttttctcctttgctgatctcataaaagtcctgtatgttctggttctacaaccctttagcttttcccaaagtccaccactgacctattgtttgtcctttcagaggttgggatttaacagactccttcactgcttgtctgcctctgatgaggttttggttatctttagaccacagcccttggcaaatccacgtctggactcttggtctagatagaactcaccgaaccaaaaaattgagggtgaggtcactgcttgtaagagaatacctacttcctttctcagtttgatttttgatattgagtgtgtgctggtagcactgcgcttctcaagtgcttttaaagtaccctggctctgggctgcagtcagagtactgttctctttgtggttgagaaagctgacagcgtaaaggcatgtcactgggggactttcaacttttttccttagccaagagattgggcaggagagagaaacttacagagtgctaggggaagaacttagcagagcatcatgaacgtagcagaaaatggtcacttagttgggtagaaccagagtagtgaaaatgaactcacagcctggatctgaacaatatcactggaaagtaatcttagattaaggtttttagactggtttacactaaggttttaacttaacgattccccacttgagaataaagccttctaacattagatatcttacctgtttgtatgctgtggtaatagagagtgtgggtgcagatactggaacaatgtatatcctacagctgtgtttgcagagctgggcaagagccccaagagagtatgaaaagggatgtttatcatctaaagtggcgagtccacgagtctcaaggtagacattattccttggttcttattttatgacttaggacaaaaacaacagttcatattgttcacattcccctccctagctgctataattaaacccactttggggttatatacgttgtttgtcacccataaaatatttcctaacacagcgggatcactcacagtcttacacttagataatctattaagtatccgtttataaaatattcataaaacaaagtaccactgtatttaattcacctggttatttttaaatttttacaactgcacgtttagactggagcctaaccattgcttttcagttcaaaattcttgtgaaagggatttgaaattatattttaaggaaaaatattctaattattgggtaagactgtgtagatatatagactgtaaagcaaaagctggaattttctttaaaacgtattctttttatgtgctgacaggttttaccaacctcgccagacaaaagggatcatttaggaaaataagaattcactgtctttttccctgtaggttgtccctgtacagccagtcaagtatttctttggtattctgggaccccagtgatgtctcacatgagctcgtaaacaatactcttaataattttcccttttgttcctctcgtctcctcctttgaaggtcactccttgggaagccacttgaatccagggctcctcactattgctcctttggctctgagggcacactgatgcccgtatcggggctttcctggagctgctaagcatgaacctttaaactaccaaagcagtggtgctatgttcttggaagaatgcttactgtctcactctagagaactatgcttgtccttcacatctcactgactcttgaaaagccattcctttggcttcttttatctgcctttttccgtacagccaaatagaaagccatagaaatagtagggttaggaaccagttatctaaagtacactttccccttggtggtttccttcattcctggcaaaaattttcccactccagcaccgagaactgaccaaccaagcaaacctcacagaagaccatccttcactttatgagccatgcccagaaatttctggatctcactttaagttcagcctaggacgttgattacatttacctaaagtgacaccttacggattgcaaggatttccatctaaagcaattgtcttctgctgttccagtcacatattctcacctcactctatagtcagcagatcccagaacctagccagtctgtgaccatggagcaaagcaaaaccccagatatgtggcattaaccagcttttaccattcttgtaaatatctgagaatagccccgtcattttcatatatctctgtgaaaagaacaactacataacttagcatccacttttgagagggaaagcatttatatccagatgatacatatattattaccataaatatgcataagtataacataaacattaaaaccttatttttaccatgtttgcctacttccaccatataatatgacttgattattactgttttatacatatatatatatatatttttaaagtctagattccatgcctacaagtttctttctgagaggaattacttaataggtttatgctatctgattagtattaatttttaatactaactcaattttcttgtccccaccagctagaaattttttaatttgtattttcaatgcagatgcagagtttgcggggtggtacagaagcgatagcacgattggatcagttagaagctgattattatgatctgcaacttcagttgtatgaagtacagtttgaaatcttgaagtgtgaagagttactattgacagcgcaactagaaagcatcaaaagacttatatcaggtatggcgtgcatttaaccacataagttcaccaaagattgaatacatgagaaaatacttatggactaggtatgtttcttttgttaagacatttaaaaaattgttttctgtagggatagagtgtgggggggtgatttctagcatttattgagcacttactgtttgccagatactgctaaacactttgcatacattcactctatgaggtgtattaaataataatcaccacttacaaagaagcttaagagataatggctttgcctgaggttgcagagccagtaatgagattagaaccttgttctttccaaaccctagcccatattctttaccactactcttttttgctgttctgtaacagaaaaaagagatgaagtggtatactatgacacttacgaaagcatggaggccatgctggagaaggaagagatggcagcatctgcgtacttacagagagaagagctgcagaaacttcagcagaaagcacgccagctggaagcaagacgtggacgggtttctgccaagaaatcctacctcagaaataaaaaggtatttaaatattgcttttgttcattatttagtcttttatccgtatctactaatctcatctgttttgtctttaaaacttgcttatgttttaaaactaagtaagcactatctcttatcagtgctcaatgcgtttatagtgctctgagaattgccctcttaaacacattggaacagccaatagtgatgttctctttacctctagaaacactaatggtgactctgctaaaggccttgactacaggatccctgataatgtgattcctggctccctttttatttaaggaggcccagcgatgttttttacaagccctgattctgaccttaaagaattttatagattgttatttctttatttaactttgattacattttagaatgtttgattcttgatatttggaatgactcattttgtggaaatgtgattcttcctgtgtcttaaaaaatgttttgcactctagtccagatgttaactatcgtggagctgtttctagtcactgtaagtgtagagttggaatctggaactagctctccaacctagaccaaactgatgactgtgtggtactgattcgctttaagctcaagtattataaaagtatgtcatgttctctgagaacccaccttcctgctcttcaccacattccaaggctaccacttcctcattccacagaaaatcaatacctttgctttttgaaatagatagctcttgcacattaaagaaactcagacaggcatgtatccacagtaagtcaagaacccaggaccttctatcacgttgtccatcaacagaacagttaccttgccatccagagccctggctttcacataattatgtgcctttgctatttccccgtgacagtggtaattgaaacccactgctgtgtcagccctggttgtgagcttcatttcacgttccaatctgcaccaaccaggtaaacattgcaggctgggcgcggtggctcatgcctgtaatcccagcactttgggaggctgaggtgggtggatcacctgaggtcaggagttcgagaccagccaacatggtgaaaccctgtctctactaaaaatacaaaaaattagccaggcatggtggcacgcgcctgtaatcccagctactcgggaggctgaggcaggagaatcgcttgaacccagaaggtggaggttgcagtgagccaagatggcaccattgcactccagcctggacaacaagagtgaaactccgtctcaaaaaaaaaaaaaaaaaaacattgcagtgatttcagcaggtcttatagaacagttttaggggagaatgaaaagtaaataagatttcagaagagcacatttttgaggaatattaggagtattttatatattacttttaggtgtatagtgcagtacttttgagactcggaatttgcaaacctgcaagtttttgaaaatgctatgcaattcagacttaattgaaagtctgatttcattttaattcaccagtatgctaggcacattgttagacttaggatacaaagatgagcaaggcatagtccctgctcctcctagtcttttagagaaggcaaaccaggtgaacagatgagtgttctgccggccaaaaacagcaagagcagggagtgaggaaaggcttctctgaagagatgacacttgtactggcttttaacatctgaatagaaattggccagattgatggtgttggggtaattacaagcaggacagaatagtttttagcaaagacactgaagcagaaaacagcatggtttgtcagagcattctacattgtaagacatgctgcagggcggggaccaagttatgggaaattttacataccacattaacaagcctgagctttgtctgtagtataagttaagcaaaggggtagtatgaacagattcacattttagcaagataaggcagcatgaaaaataggttagagggagaagagatggaaaggttctgattggaaggtgtcattatcctccacctcaataaggttgagaggttaagactatgaagtaagtgggtgcctgtgcagggtaagagatggacaaatcttgaactgtctagatctgacactttgcagaaaaagttagtaggatttagtgatgtggtgaaggagggaggaagagccattctctatcaaccctctggtttctggattgggcattgaggtagatgatggtgtcaccaaccaagatggaaaacccagaggaagagcacatatgggtgggaggtgataagctgagttttagacttgcatataagaggtcttgggcatccaggtagagatggctgtgagacagttgagacaattgggcacctgggtcttataagagtgtatgagatggtctcagaacaacatactgagcaggtgatttttaaaatattttatttatttttttatagagacaggggctcactatgttgcccaggctggtctcaaactcctgagctcaagcaatcctcagcctcccaaagtgctgggattgcaggtgtgagccactgtgcccagcctgaggagggtgttcttaggaatgatgaggtggaggtgggaggctgataggaaagagcaagggaaggtggtggagcaggatagatacatagtttgaggaagaaaaaccttcattgtatttaatatttgtaattcaggaagcaaaacgttcttggctaggggtgagaaagcattgtaaagggcacaggctatgaaagactgagctgctgtgatgtagtgcgaggagaaaggctctaaggaaagaacactggggaacatttgaaagtgtgtgcagaagaacgggatcaaagagaaagggtaatcgaagttggaagaagcaggagagctcgaagtcatagaagtgaagatgatgattccacacaacaggatggtcagtaggctcaggtgctccagaaaggtaaaggaagaaagaaatgactccatgacatccaatattgggagactattggggccttatgttcagagtttcgagaaaagttgtgggcaaggagtagatcttggtggtctgagaagggagtgcagcagaggtttaaagcagtgactgacggaatagcaaaggaaactgtacaggtgaggggtgaagaggagcaaccttggtgaccatggcccacagagctgtgtactcttctagcagtattaagagcttcaggctgaacttaataccggcttaataccagctcttcccttgttgataagtgttagctcatagcaatttaatcagtattcttcagtcttcatttctgtgttaatctaaatctgaagtagggaaacccagccttggagaatctctccatttacacttgtgtgcctgtaccccaagcccagcaactgaggtggcagaactgcagagggaaggagtagtgaaataaggaagggtggtgaaaagataggaaatgcaaaacactaagtcctaaaaagaaaagctactgagaagatcaaatatacaaggaaaaacaaatgtctccctatgtaacataatcctatattcccttgtttacatatcaacatgcccaaggtcactggcttcttggtttctctggcactcatcttaagattgcatacacagttcatgtcctgcctcaccccttgaaagagtggagataggtggtccccggctgtgctggtgaagtcaatgctttgtgattaaacatttcaagaagagtaacaaaaataacaattttctttgttttttatcttctttaattctcccagtagtcaaatgaaatccagagagctcagaaaattagaatcattttcatacttcatttggtggcaaaaccagacctgagctaacatgaagttatttattatcttattctcactttgacaattcatttaactattactgcttattatgggatatggtttcagatcttgcttattaggatatatatggtatatacaacttaacaccattctctaaattatcaaaaaactttgaatttcaaaacatgtctgacctctgttctagataagggattgtggacctgtatcctcatttataagcaagggaaccaacgcttctggtagtgacataaatcacctaaggaaaagcagctaatatggagcaggggtaggattctgtcctagacactcagagacctgagttactgtatcaccaagtcatgacattatctaacacgccctttgttttccccattgcactggatagattcttgataggcaatagagtgaaccagagtgggtaaagaacatgaagtaaaaaatgacattttgctttaaaataacagtttactgacttcaaaggttattatttgactttctctaattgaaagagtgatcattttaggctgggcatggtggctcacacctgtaatcccagcactttgggaggtcaaggtgggcagatcacttgaggtcaggagttcaaccaatctggccaacatggtgaaaccccgtctctactaaaaatacaaaaaaattagccaggcgtgatggcatgcgcctgtagtcccagctgcttgggaggctgagatgggagaatctcttgaacctgggaggcggaggttgcagtaagccagagatcatgccaccacactccagcctgggcaacagtgagactccatctcaaaaaaaaaaagtgatcattttagtatagctttggaatgttggagactaacccttttatctggaaaacttctccaaatagtttccttaggaaaggacacagggtaaatgaagatttagcttggtactggtaaaaagttaccagaatatagtgcataattttataaagtagtgcatatctcacagttattgcaaaaatcctgttttatatggtgattggaaaatatatgcttttttttcatagtttctaaataattttgataattttgactttctagtcttccaggtctcttgcagctcttatgtctgcgaccaaaagattcagatctcatattgtttaagccagtctggacaaaaaattcatggtctttaacttgtcagagggagcttaacaatacatattttatataagtaaatactttcatattcttttttgcccagacatgtttaaagagcataatgaagccaggtgccatgactcatgcctgtaatcccagtaactcaggaggctgagccagggggattacttgaggccaggagttcaagaccagtctgggcaacatagtgagacccccatctctcagaaaaaagtataatgagatgtggaatcttctggatgcagacttcagatctgaaagagacctttcaggacaacccccttcagtccaccttgccccatccctcctccttcaaaaaagagaaaccaggaggtctatagaagttaatagtttcatagaggagtcttttcgtaagatcctgattacttggcttttacagcttcagttgtccaaataagaaacaagaggtggtcaatgtgatactttgttctgtaggtggtatatattaagatcaaaatttaaccttggtgtggtgttcagagtctttcaagtttcacttgtattaaaacacattttatgtatttacaggaaatatgtattgcaaaacacaatgaaaaaatccaacagcgcactcggattgaagatgaatatagaacccatcacacagtacaactagtaagtttggattcgaagattttgaacaaaacttaatttttttgcatgttttagagtggataaaatctgtagagaatgataaaaaaacttataactgcatgttaacattagttcagtttatataatgagcagtttttaggcaaaattgattggagaatacagagttcctataccctcaacccgcacacgtagcctcccctaccgtcaacatctcctatactcctgtccccacacttgatagcctttccactgtcaacatcccccagagtggaatatttgttaaaatcagtgaaacattgaacatcaccattccccaaaatctgttgcttatgttagggttctttcttggtgttttgtgttctgttggttttgacagtgtataatgacatgaatctgctattatagtatcatatggaataatttcactgctccaaaaatccctttgttccgctactcatccctctctctccccaagcccctagcaaacactgatctttttatagtcttcatagttttgcctttaccaatgtatagttggaatgatacagtatgtaacctattcagttggcctctttaacatagtaacgtgcatttaaggttgctccatgtcttcatggcttgatagctcattttaacaccaaataatgttccattgtgtggatgtctcagtttgtttatccatgtgcctattgaaggacatcttggttgcttctaagctttggcagcaattagtaaagctgctataaacacccatggagggctttttgtgcacataaatttcagccaatttgggtaaataacaaggagcatgaatgctggagagtatggtaagagtgtatttagttttgtgagaaactgcaaaactgtcttccatagtggctgttccattttgaactcccaccagcaatgagtgagagttcaggtttttccacatcctctatagcattttgctgttgttacgtttttgaattttagccattctgacaggtgtatagtggtatcttttggtgtgtgtgggtgcgtgtgtgtgtttaagagatggagtcttgataggttgcccaggttagccgcaaactcctgggctcaagcagtcctcctgctttaacctcctgggactacaggtatggactcctgtgcctggcttttactgttgttttaatttgcaaatctttaatgcagatatatagataaatagatacatatacagagagcgaaagagcgcatctgtccaaatgcctacttgcccctctatatatctctagtaaggtgtctgttcagatcttttgctcttttgttttttggagtcttattctgtcaccaaggctggagtgcagtggcgcgatctcggctcactgcaacgtccatctcctgggttcaagcaattctcctgtctcagcctcctgagtagctgggactacagacatgcatcaccacgcccagctaatttttgtttttagtagagatggggtttcaccatgttggccaggctggtcttgaactcctgacctcaagtgatctgccctccttggcctccaaatgtgctgggattacaggcatgagccaccgtgcctagcctttttgctcattttttaaattggatttttattttcttattgttgagttttaggagttcttcatatattttggcttacactcctttatcagatatgtccctttgttttgcaaatattttctcatgatctgtggcttgttttctcattcttttgacagtgtctgttgcagaacagaagtgttttaacaaagtccaatttaccagcactttctatcatggttcattcctttggtgttgcatctaaaaagtcattgccagtccccaaatcagctagatttgctcctatgttatcttttaggagttttatagttttgtgttttatatttaagtctgtgatccattttgaggtaatttttgtgaagggtataaggtttgtgtctagtttaggcttgtggacttcctgttgttccagcaccatttgtttaaaagactgtcctttctccattgaattgtcttgttcctttgtcaaagatcagatgattctgtctcttcagtctatttttgggtgtcctattttgttttgttcatctaggtcttttgcctctccatataagctttagaatcagcttgtcagtagccacaaaaaaattgctgggattttgattgggacagtgttgaatttataagtcaagtagggatgacctaatatcttttttgtttttttcattttaaaatacttcttcttttagtttttttgctttttaattattatgtttattttagcctctaccgccttctcctacacctaacatcttaacattgaatattcctatccatgaacaaagaatatttttcatctatttaattctttgattctttcatcagagttttataattttcctcataaagatcttgtacaccttttgtaagatttatacctaagatacctaagtctttcttcctcttctttgtcagggaggtggtaatataaatagtattatgtttttaattgaaaactccagttgttcattgctggtgtattacaaaacaattgacttttgttaattaagctttttcttaataatctataatctagattttttttgtcagttttctttcagattttctacatctgtcttcagacagttttatttctgtatagcttttatttctctttcttattgcattagctagcacttcagtataatggtgaaaggagtggtaagggggacatctttgtcttgttcctgatcttagcaagaaagctctagtttctcaccagtaagtgtgatgttacctgtaggttttgggatagatgttctttatcaagtagaggaagttccccctctattcctagtttgctaagaatattaggaagttccccctctattcctaggttgctgagaatattagttcactttatataaagttacattagaaaccttctcctactcccatattgctgtgccgcatcccacacaatatatattatcctgacagtcatctttacagatgtgtcttaaattagttaacaccagtaatttgtacttaaatatcagaaatgccaacatgaccatatctctgtatttggatatttctaaaattttctgtctttagcatcatactaaaggccaaagggcttaaatttgtctccattactccttaaggcacattcttagctaatgctgccccttactcttcattttaaccacataaaattagccaaactacccataaactataagattacctttctcctagaatctagaaatagattaattaatgtacttttatttttcattactgtttctgtgggtcagaaactgctttataagattagtcaggggaccagcatgacagtgaggtaagttgctccctgctataaccatttgtacttgcattatcagtttacttatgaaggttccacacttccaatatatttctttttataaaacataagattttggtggaggggaagaactaattaactttttagaatgaatgagtatcagatctttttcccagatctattttttgggggcaacaggagtaaaaattagtaaatcgattatctttcttttccttttttttttttttttttttttttttgagatggagtcttactctacccaggctgaagtgcagtggtgccatctctgctcactgcaacctctacctcctggctttgagccattctcctgcctcagcctcccatgtagctgggattacaggcacatgccaccacacctggctaatttttgtatttttagtagatggggtttcaccatgttggccagggtggtctcaaactgctgcccttgagttatctgcccgcctcgccttcccaaagtgctgggattacaggtgtgagccaccactcctggccaagaaattgattcttaaggtaatcccaaagataaatgtcatctgccttagaattttgcctaatatcttggttggaatatataattgtcagagaatgaatccattaaataactagtcatctttaacacatacagataaagcataatgaaagttagcttagatcaaaatagatcattgtttttcaatgctagttttaaaccaccagtgtcagaacctcttatgtggtggattgtttaaaatacagattcttagatgttaaccttattattgcaacagtttcccctggacatccttgtgaattaaatatgcaagactaaggaagtttattttaatatttgatagtaaactctctaaaacaaaatatgaggattacttattaatactactattttaaattgttattagctcaaattggataagagaattctgttttccccattaaagaatgaactcttattttttgtaagtacactcaaaactccaggctttcacttcaagaaaacatacatggtggctcctgtctgtaatcctagcctttgggaggccgaagcaggaggatcacttgggcccaggagttcgagaccaggctgaccctgtctctataaaaaatttttaaaatagctgggcatggtggcgtatgcttgtcttgggcacatgctaacttatttcaggctctaagagcccttttgaattgtgttcatgtgtggtgtatctttgtgtccttttgtgtaaattagtagtatattactagattgcattttattcagaaaattagcctaccacaccttctttttttttttttttttggtagagatagggtctcactgtgttgctcaggctggtcttcaactcctggcctcaagcaatcctcctgcctcagcctcccaaagtgcagggattataggcatgagccaccacacttggctttattttccagtttcctgttgtctccctgccacccttacgtccctgctcatactttcttgttagagtttatgatacaatcacccaatgcaaatgcaacagtaattctcattagaaattatattgtttagggaaagctggtggggaagaggagagaaatgatagaagaatagaatggggggttggatctgaaaaggacaggagaacaatggaagagagggtagttaatttccatttgaaattatctggtctggtcttctgggaggtatctctaattttttaaaacaaagcaagaaaatagacaacccatttacctatatagaaagccttttcatttatttaactaaaattaattttaccaaatgagattttattatatagcttttagatgattcaactctatagggaaaattaaaagtttgtttagataactgccaaaaataagctgtgatactaaaccagatgattcatggataatgcttgaaaaatatttttctaactgctggttatattggttgttgatttgattgcttttgttcgtttgtttttttgagacagagtcccactctgttgcccaggctggagtacagtggcactatctcggctcactgcaacctctgcctcccaggttcaagcgattctcctgcctcagcctcccaagtagctgggattacaggcatgcatcaccacgaccggctaatttttgtattttgggtagagatagggtttcaccatgttggcctggctggtctcgaacccctgacctgaggtgatccacccgcctcagcctcccaaagtgctaggattataggtgtgagccaccgtgtctggctggttgctgattttattttttaaagtcatctacatttaagttagcataatatagcagctagaagtattttacactaaaactgtgtattaaaaatatttcatgtttcatgctttcatatttcatgtttcatgaagtattaaaaatatttcatgtttcatgaacaaaaaaaaattttgttcagtgaatcatcccctttggcccacattaggataacttctcatcttttttcctattaatgataaaaattgggacacagcataatggaattattattaattttttaccagaagagagaaaaattacatgatgaagaagaaagaaaaagtgcctgggttagccaagagagacagagaacactggatagacttcgaacatttaaacaggtattaaaagtaatggtccatttattgtttttcttttttttttttttttaacagagctacatatacacctgtaggatttctttgtgggaaaaacttggttttcccttatttataaactattataaccatggaagtcctttttaaaattgttttaatggcatggctccatttcctctggtggttttccgaatttagtattcttgtgacctttgacccacagcttcagtagtataagaggaatgataagggcctctgggaaacctagattcctcttgagtttaaaaaattagttaaatcacaactgactatccagctcaagcatcagcatgttatttattccacatacatcagcctgtggtggtaatacatcaaatgaccattggcagaattagaggtggaggggagcagcatatttgagaaatgcttcagcagttctcttgccagggtaagccatgaccacacactgataccacagtatccacacatctcctcagaactgtgctgaagcctcacagttctcatttttaaagtactctggagccttacttcagttatgcatgctgaaggatcactttgtaggtgaagtaggcttttgaacaagtgttacagtggaaaaaaaggaggtgaggcaggggaaaagccttgttattaagtaaatgtggctcacgcctgtaatcccagcactttatgaggctgaggcaggtggattgcttgagccggggagttcaagaccagcctgggtaacatggcgaaaccctgtctctatacaaattagcctggcatggtggaacatgcctgtggttccggccatttgggtggctgaagtgggaggattacctgagccagggaggtcatggctgcagtgagctgtgatcataccactgcactccagtctgggcaacagagtgagaccctgtctcaaaaacaaacaaacaaacaaaaggtcttaccatggtaaaatatatataagagttctaccagtaagtactgaaaaaaatgtatttctctcttcattctgtcataaaatggatatatagttgatggagctttttaaaaatgccaagtaacctgttaaagaatattttaattttctcgtgtgtgcatttgaaaacataggaaactttttgcataccagtagcatttatacatttgacatcacttatgttttgcattttacatgctatttgttttatacatttagtagttttattcactaaaaatctttttttaatcataattttgaatatttgaattatcaatcgtggatttgataggcaaataataaattcataattgtttgtaagctattattaggtactttcggattttctgtataactttaagggtgaaataaccaataagccaacataacatttttgagatggaatctcactctgtcactcaggctggagtgcggtggcacaatctcggctcactgcaacttccgcctcccgggttcaagcaattctcctgcctcagcctcctgagtagctgggactacaggtgcctgccaccacacccagctaatttttgtatttttagtagtgacggggtttcaccatgtcggccaggctggtctcaaactcctgatctcaggtgatccacccgcctcggcctcccaaagtgctgggattacaggcgtgagccaccacacccggccacataacatcttttatttgaaggagaaaataaataggcatgtgctcataaattgtttcaataacatttaaccagttccaataacttctggtattttagaggtatcctgggcaagtcatacttaaatcaaccagattacgactagctcatgcaagaagaaaaggtgcagcaagtcctgttctccaagaggatcattgtgactctttaccaagtgtgttacaggtagaagagaaaactgaagaggtgggagaaggaagagtcaagcgtgggccatcacagacaacagaaccccagagccttgtgcaacttgaagatacttcattaacacaacttgaagccacctcattacctctcagtggtgttacctctgaactgcctcccactatatctcttccacttttgaataacaacctcgaaccatgttctgttaccataaatccactcccatcccctcttcctccaacaccaccacctcccccacctcctccccctcccccaccaccaccacctctgcctgttgctaaggacagtggcccagagacactggagaaagatctgcctagaaaggaggggaatgagaagaggatcccaaagtcagccagtgccccctcagcacacctctttgacagcagccagctggtcagtgcacggaagaagctcagaaagactgctgaaggtttgcagaggaggagaggtacgtcaacatattttcatggtccatctgttgtatgacatcaggcatagtaaaaaactatattttttgacgttgcaaagcttaaaacactttatttttgacattatttgatagtaaacaggttttcaaagtcacactagaggagaattcttagtgcataaagtacacagaaatgtatgccttcttgggctgttaggcatgttttaaaaacagatcttctaaagtgatacattcatgtttggtaatgtataatgggtggctccttttgtgttagggaaaaagttttgattttaaacctgagatttttaaaaaaatactcatatcagaaagggtaagatatctggtaaggactgtcaccacagggaagacattggcaggatcatgtaacatttgttcatacatttgttgaggacttttgtgtatttgtataaagaagcaaagaagaacagggagtaatctgttcaacttacaatgtgacagatgtgcctcaataaggttactatttttttttctaattttttttgttaagagagattcaagcacaaataaaattatttctaaaaagagcagagaataacccttgccttttgcctttaaggaatttgcattttgcatggggagaacattatataaatgttacatattacttgtatattacattttaacctgaaggaccattctataaaacatttcttgatgtaatctgagtaggatttcacatgtaaaacaactaaatgaaaaaagcacagtctccataataaacaaaaattaatttttaaaaacaaaatgtgtaaccccatcactctgaatttgggtggagcaactgcaatatggaaatcctttgggaatcacacccataatactactaagaccacctcccagttcccaatctggtcacttctctcatgtaggaaatgataggaataccaacagtacccaccatggattgggtcttgggattttctaaaaagaaggataattaggatcccttgtgttctgatcaccttctgcacacatttcatgatccattttgaagatggtgtttcagcgtcctgtgctttcacagttgcgaacggtagaggttatacagtttcattctaattaagtgcagtcctaactgtaatactgttctgtttcattttccaaagtgagctcacccatggatgaggtgctagcctccttgaagcgtggtagttttcatctgaaaaaggttgaacagcgaactctgcctccttttcctgatgaagatgatagtaataatatcttggcacaaataaggaaaggggtaaaattgaagaaggtacagaaggatgttttgagagaatccttcacacttctacccgatacagaccctctaacacggagcatccatgaagctcttagaagaattaaagaagcatccccagagtcagaggacgaagaggaggctttaccttgcacagactgggagaactaacaagtaaacggccttattgtctttagtagcattcagtaatacaggttttatatcggatgatgaggtttggggtattttttattgagcctgaggcatatcgtttgttttataacccaattttagcatggatcacaaatttatgaacttcaggttttacttaattctgtagtttctagaaacttaagataactttttaatgattattgctatgtaaatactatttttaaaaatgtcctcctcattaaaaatttctgctatacagctgtaattgcaagtaaagtgacagtctcattcttgccctaaaaaaacagaaaagggcctggcacagtggctcacacctgtagttctagcactttgggaggctgaagcaggcagatcacttgaggtcaggagttcaagactagcctggccaacatggtgaaacctcttctctactaaaaatataaaaattagccgggcgtggtggcgggcatctgtaatcccagctactcgagaggctgaggcaagagaatcacttgaacccaggaggcggaggttgcagtgagctgagatcgtgccactgccctgggcaacagagtgagactcagtcttaaaaaaaaaaaaaaaaaaaaaaaaggctttccaggttcagtggttcgcttctgtagtcccagttactcagaggttgaggcatgaggatctcttgagcccaggcgttcaaatccggcctgggcaatatagcaataccccgtctgtaaaaagaaatcaatacgtcaattttttttttaatgcaaagccttttctgacaaagtatttcagtaacaaactgttatgcacactgaattttgatgtcatgttagctgacctcaaaggagttttctaagatcattctggaaaaattgttgcattgtctgattatttaactttctaaacccttaaaaaaaactacttattgtcacagttactgtattatctagacaaatttgcaggtatcattaatatataaaaattatctacatatctaatgaatactcctatacatattaagattctctttggttacacatgtagcattctcctaatataatagagagctatagtctactacattttaatatactaattatagagtaatatggcacagattacaccaaatatatagaaacattaaagataacatggtataaattaaacagtatatcaaatttataatgatggtaactgaaatgttgtaatttgtataaaatttatagagtatacaaacatgttctattaattattattctttcttgatggaatatgtttctctaggcttcaaacattcaccaaagtagggaagacttgagtcctagaagggaataagtaaaggaataattaattcatgtgttagccctgtgaattatttttgttgaatttctttttttattttagagacagagtctccctctgttgctcaggctggagtgcagtggcacgttcatggctcactgcagcctcaaccttctgggatcaagcatcccaagtagctgggactccagacacatgccaccatgccgggctaattttttaatttctttgtagagacagggtctccttatggttgccccgattagcataataattcttaaaacatgtttgatcataagaattaacttggggagcttattaaaaatggacattctgtccttgacttaagaattctgagtagaacaacaaagaaaaaaaatctttttttgacagggtttcactctctcacccagggtggagtgcagtgacatgatctcggctcgctgcaagctccacctcgtgggttcaagtgaatctcgtgcctcagcctcctgagtagctgggattacaggcgactgccatgatgcccggctcttttttcttttttttttttgtatttttagtagagatagggtttcaccatcttggccaggctggtctcgaactcctgacctcaaatgatctacccacctcagcctcccaaagtgctgggattacaggtgtgagccaccatgcctggcccaaaaaaaagaattctgagtagatctaatgtatatgcaagtacacatctagattttgaagacataatataaaaatgtaatgtatgtcagtttttaaacaactgattacatattgaaagattctattagttacattaggtaaaatattactgaaagcagtttcacctgttcctttgggtatgggttcattaggtaaatattcctgtagtacctctccaccagcatctgcatcaatcaataacttaaaaagggtaatattacattcaccatgattcagccaacattcagtagtagcattatcctgctttttttcctattatgtatacagttacatgtaacagtcactttgtatgacttatgtttttggatcccaaagtaacttcgagttatttttgcttgtacatatgtccactatgctttgtaaaggaatatatatatatatatatatagagagagagagagagagagagagagagagagagagagagagggatgcatatcagtttgtgaatgtctagactctcaggtatgtctaactgggaatcttttccatagtggatatttgtaggttgtctcccactttacagttcttactaccatgtgttgtttccttctgctgtagcttctcaggaagctgcttaagcttgtgcctaaaactaccatctttgcactgactaattccacagctggaccttcacataaatgtgtgtttagctctttcattacagatggtccacagtggcccattcacagcacaccagcagctgctcaagtcagcctatccttgtctgtctcctcccatcccaccatatcctgcctaaccctagacattgcatcagcattttgtatactcaagtggctgggatgttactcatagcttctggctactaatttagccttagtatcagatgttaacatggtgcatggtgtatacactttgaaaattgcttaaaacttttttcgggggtgtgggagacggctgatggctggaatatgtggtacaatgttgagagagaaacagtgaaacacttagaaaatatatgagcttggaagtttgcagtctccctttactaaatgtgtgctaacccagaagcaaaccatagactagtatggactgattaggcagtgatgaagtagctgtgtatcactactttgtgatcatggagactaaaaggctgtgaactttttatctacaaatggctaagaaggctttaccgcaatttgtatttcccattaatttattagattccttttttttttctctctctctttttttcttttcttcaagactgagtttcactcttgttgcccaagctggagtgcagtggtgtgatcttgactcactgcaacctgtgcctcgtgattcaagagattctcctgcctcagcctccggagtagctgggattataggcgtgtgttaccactcccagctaatttttgtatttttgtagagatggggtttcaccatgttggccaggctggtctcaaactcctgatctcaggtgatccacctgcttctgcctccctaagtgctgggattacaggtgtgagccactgtgcctggccagatttcttgattatagattttgtcattaatgtacttatatacttttaagagctaatttcttgaatattcataaagtaggtaatgaaggtcccttgttctgccttgttcgttcccctctgaaactcttctctttccagagatagccatagtcatgctcaaggaaatttcttaaaatgtatgtaattacatagaggtttaaaataagtttcaggctgagtgtgaactttaagtttcaggcctgtaattctgcagtacttcaggaggctgggggtgggtggatcacttgagcccaggaattcaagactagcctgggcaacatgacgaaacacatctccactaaaaatacaaaaagtagctgggcgtggtggctcacacctgtagtcccagctacttgggaggctgaggcaggaggaaatctgtctcaataaataaataagcttctagtttgtttcctgtgagagtcttttttttttttttgagatggagtctcactgtgtcagccaggctggagtgcagtggcgccgtatttggctcgctgcaatctccatctcccgggttcaatctgggattacaggcgcaccaccatgcccagctaatttttttgaagttttagtagagaggggtttcaccatgttggccagactggtctcgaactcctgacctcaactgatccaccctcctcagcctcccaaagtgctgggattacaggcgtgagccactgtgctaggcccctgtaggagtcttctaaagtaactatagcaatgtagttcaaaggaaatatagtttgagacatgtaattttaaaatgtccaatagtcacatcaaaaatgaaaaggaacatgtgaaactgatgtttgtaatattttatttgacacaatgtagccaaagtagtatccttcaacacataatcaacattaaaaactaaggacattgctttctatttctttttttcacactaagtcttcaaaattcagtgtatgttttatatatactagtagcacatctcagtttgaatgctaaggatctgatacttaatgagaaatgtcctaccaaaacagcaaaattgtatttaatggaaaaatagtacttactgttttagatttttaaatcaaactggatttaaatcaaactagatcagtcacactagacacatatcaagtgctcattagccacatgtagctacagtattagaaaatgcagaactgtattaagttggtactttattcatgttcctgtcagcttttatctgaagagtatgtcttttatataaatgctcctgtgctttgggtacgccccatagatcttaagcacaacacttttcaataaaatgcccgggtgaagtatccatttaaagattggtattaatcctgtcctctaaatgttagtctaacaaaaacagtttctactgcattttgaagacaccatttagttgttcttactctagtagcagtttatggggcaaatagtttagactgaatttacctttttagtatatagttttcatacagtgttagagtaaaaataataaaaatgaaaatctaatagtcttttaaaagtgatcaaaatctgtatttagattattttgttttcatttttactgctttaagaatacagtcatggccttttgtaaaaaatgtcttttttacactttttgagggaacgtaaatacactgtatctttaaagggtcttttttttaatggtctgtattattttgtttgtaaacaggtgacataacagaagaaaaatatcattcaagattggttctgattcttttggaaaatgacagtttaagcacttggttcctcagttggataacattagatccaaagttcattggttcagtggtgtgaagaaaggaagcacaattggcaggttatcactttccagtcgttccaatagatgatggttaacatgaattttacatgtgcaatgttcctgactgcaatgaagaaaaggccttctggagatttctgttttttaagcacattctccttccatccacatatttacatccttgtaatggccagttaagctagggcttgctgtaagttggaagaacactgggttgacagagatctactgtgagctgtattgggactgctttgagaaccatctttcaatgcactgaaaagtcatctgaaaaaatagcttcttccatatcagcttatattaaatactgtgacactctgagaaagtttatcatcatgatagctgtaagtcaggcattaaaatcaaatggaaatacacctaaaatgtccgcattactcatttccaaaggatttttcataaagatgttcagcaacatctgaaaagctgcatttatggagatacatctattaatatgttcacaacatgatacatttaacatggcatatttttaggagtcttatactttgtaaggttttgaagtttccgtgcttttaaatcactcttcatatttcttgaatttataatagtttgaattttatgtgcatccttgtttatggaaggcagtactttgataatatttcaaattatttttattttgtttgaattattgcttgattgctatgactgacatgactttcctattgagaatcaaaaatcaagattcaatcatagggatgcagatcttaactcttttcacaaattaccattttaagtttttatttttatgctccacagtgaaaagcatgtgctctacaaagatagaaagtagagacaagtctccgtggctggcatttcaccatcttcacatgcactgaatggaattttgggagaatgcctttgttatagtcactaaaattttaaacttatacacagctttaggtgctgattttggctgtgatggagtcctgaaggacacatttatatgttccagattttcagcaggattgttgtgggcttgaatacatgtagatcattggactcagtgtgcagtaccctgtacatataattctgcataagacagatcttggcctttctgtggagggagttaagaactaaaataccaaaaatcactttatttcttttaagacaattatctggcctaaacccagaaagcagtactggagcaaaagcccagtgtatatgaattggtattcctagagaaaaaaagaaatgctcacacctttgttattttaaagtgttttcttgaaaataattagggagaaaattttctggcaacaggttatgtaagacaacaactttttttattatttcaaaacaaaacaggcacatgccaccatgccccagctaatttttatattttttatagagacagggttttgccatgttgcccacgctggtcttgaactcctggactcaagcaatctgccagcctcggcctgctaaagtgctaggattataggcgtgagcctctgtgcccagcctgacaaaatcttttatttatttaaatgttagtaatacgtttattgatgagactaggagcttctctgcagcatcttcataatacattggttttagttcccacactattcccacatcttatctgggaagattagaaatacagatgtaatatggaagcttcaacagcatgggggtggtgatagtgtcctatttgcccttggtaaaatattaaagcgtatttcttaacccaaagagtgattggttatatgaatatatttgaaaaagttaaagcaaatttgcaaacctttacaaaatcatgtatcaattttatgctatccagtttttacgtacccatgtgtcaacatttcatatatccagttctttgggtgctggttcactttttttcatttattcaaattcagaaaaatacggacggatctaatgttaaattaaccagaaaccctggaacattcatatcttgagagggaatttgctactcttttacttttgggatttcattataaaataggctcattttatacatatgtcctgtggtctgtcttccagagtgtgctgtaatcataagtctctagcaaagagtggagggtggagggtgtgtagaactccactcagcctcatggatacatctacaagtctctcaacccatcctgttacagttctccatgagagtcacctcacacttggaaaagaaggaggttaaagcagagtattgttggcagccagctatgcccatcctcttgtaaataactttccaacacacccatttccttgccttaaggtgcaggttcctacttctacaaaatttcaaatgattgcaggtcaaaaacctttggagttactcacaaataataataaaatttcaaataactagggtctacttgtccatcaagatgacattaccagtggaacccacctgttaattttaaagtagcttcagaacccaacaaaaattatgtaagcctggttaaatgtccttttttcttcttgcctctaataaaatcaggatcttcggccttgatactaaatatgtgtatatttagttatgatggtacttgtagatgctcacatttccagttccaaactcgcccgtactttttatgtgcttcaaaatattggacacatttctgttaatatatgatttctgtatccacaaaccgctgtttgcttatgctgagtcaatttagaagttaatttccaatctagtctcaactgcaatgcatttaaaataggtaaaacaagtaaatgagtttgggacattttgagattaatgttactgcccacttgactgtcaatttcaaatggctcctaatgcaaccaaaattataaccaatgtagcatgtgtaggaaaggtatttttaattatttaaaatcattgtgtatattacagcagtatgaggaatgcctggctaaagaggattttttaaaagatgaagaatggttttgcttgtattatataggcttactgagtttgtgagcagcataaaaacaatcattccttaattcttcattgtggaactgaaatatttctgtaatgcattttttaaaaggagactcctagacacagctgtaatagtgggaatagaaatgtagagcttttctcataacacaaaaccagaaaataattttcagcactttgacttactctatgtaataaggaaaaaaattgtttccacaaagttgaactatgtagtaatatttggtaacatatggcatggccactttatatcacagaatgtgtgtcaagttgcaaagcatacttgggccatagtagacactaagaattaaaactcttaaatcagtgaaacaaaaactaatgggcagcattctctctgtttggaatgggatcagtatacaattaatacaatttaattttacacattccctaagacaccatttttaagttacagtcacatgagtgtttgtataaatttaagtcaatgcttttagcctaggcaaagctaaatacaaggtttttggggttttcttttttcagctttattattgaagtattacaaacttaacatcagataccaatgtgtaaaaagtactattgggtccttaagggctctatcagggagttgaaatttcatacgctttaccaggttacttgtaaaaaatgaacagctgtaagacatttcaaaaccattgcagacacattgttaaaatgcagccatttgataatgaaagcagaaaccttaagttttacctaattattgcactaaatgtaaatgataacataaaattaagtgtgcattttaaacagattctatttcccacttactgcttagcatagaaaaagagctatggttagaggagtgaccagcaagatttatttcagatggaaaaggggtgagaaagtggaagcaccttactgttagagcatgttgcatctatttagtgctactgaacaattcagtagttatttctgaactttgctgcaaagtgctctttagttaaagcacattaagaagggtcactgcttaattgctttgtaaaatgaagcaatggtattttttatccgatatagtgtaatttaaaagttttcctacaaagtgagtttatattgttgcctaaactatgttatgtaagcaaagggtttggaaaggcgggagggagtctagattcggcgagagtgtgcgtttgtgtgtgtgaatgtatgaaaagtttccccattgggttattcttaagatgtgtttattgtaaagttttctacgttttgcccacagtaaatgtacaacttcgcaattgtaggatttaattgattgaattccaaatttatactgtctcttcccttctgcagagacattatgccactgtaaggtgcatgtacagaaaatacctctgaggttgacttgttaaataactgatgaatgttatttcacactgaatctcaaagcagtcatttgttttgcgggttaggggaaagttttgttttttgctggtgttttttgttgtttttaattaggcacactaagagtggctaaatttgggggaattggtggataggaaagaccttgaaaagtgatgtgtagatgaaaacacaaggtatggatgttggttacagagttcagttttaacaagggaaatttggggattttttttttttttacttgcatgttctatgggtagctatcaaagggtgtaacaaattattccagcttttcccaatactaattatattggttttaaaaagtctgcataatcactaggtggcattttcccttcatttgtgaaccaagaggggtaaatgatgctacccatacagtgacttctgagttctttaactttgacagaatctccattgtttcattgaatttctcattgtattatatgtctttccaagtgtgcaaactataatatgtagttaatgaaaaatggaaggctgcagattattttgcatgaataattaattgcccattagggctaaggagactgacatgatttttatcggttctgggtaaatgaaaattttaatggaaaactcattcaccatttactagctttgtgcaatattataaaaggtagaagcaaaacactagcacattgtgctttgcttggcttgtaaggatggctttagtaccattacattaaatggacagtgtgcacagtgtattgtaaatgccaactcttgcaaatttacaatacttaaatatgttcaattaacatcctaaagtattaaaagtacagaggaaaaactaagcaagcatttatagcaataccatgaaatctccagtaatcgttttgactgttgccttttgctctttagtgcagcttttctgcattgtaattgtattgctttgtatttcatgttttttacactcatgacttcagagttaagtacttgtacaccaagtattgcaatcacctttctcttgttgtacatgcaatgtaacaacctacagttttggtgcttttaacaatattcctctttttctttaataaaggatatttatttgaattaattaa

SEQ ID NO: 1837 - DNA, 3323 bp, Homo sapiens
  source 1..3323: mol_type = genomic DNA
ttggtatttgaatacatttattgtgacaagaatgctgttataaatattcataagcaaaggccatctttttatctaggaattgtcaaagagaagattccaaattggaaggatacatcttttgtaaaatctgccaccaattcctgctttgagaataagcacctattgtaaaatttctactaacattataaatggtcacagcacatgccacttgatacaatccaaactttgaaatgtttgacttctcagtgggctgtccctctccactgcaaccccccttcctccagcctcctgaaacatcgcactatcctttggtaagcaattccatatagatagctgggggaggaggagtataacctgaccatagcatcaggtacatcaggtacatttatttctaaagtctaatagagaacagtttttactgcttaatagtaagaagcactgagagtgattttaatcgacattcttaactctttcaactccacctagatagctagtatctacagatgatgcagaaaagaggttaggggagtactttccaatagtttattgtattttcttaaatatcctttctggaattttcagaaacaaaacataaaaaaattatatactttattacaaatggtaaactcagagtgctccaaatctcttatttacaaacaacactgggcaggatacccaaacaaacaaacaagaaataacttacaaaggcatgaagctgtttattgacagtaatcagctttcatcaaattaaaaaatatatatatgtacatacacagttaacgaaggcaggccagaaagagttcatctgtaggctcagcctcgctctcacaaacctccctcctgccgcccctccccaaccctccccccgctttgtgttcttaaggagtactacagaagcaatctacagtctctattgcagtttgtaaccccctccccctcccccctttaatactgaatgagatcgaatgttaggtccatgcagttcttggtcaatgttaacgaaaagtccaacgttccgttcgcgcggggacagcccgtccgcaaagcggggcagcccgcaggcggccgctccctggctccacgccaagggagggcgcgccaagtccttcccactcgtgcacactgggggcgccgtcaggacgcaacccagtccaacttggatacccttggctttagttctcggacacttcttttttctctccgtcgcaacttgtcaagttctcaagtctgtctctctgtgttattttttttcttcgttgcccctcagcccccgacggtctctcttcaaaatgtttgcaactgctgcgttagcatgagttggcacccactgttaacgtggttcatgactttctgtttaagctgtgccacctgttccctgagcatgttggccgtggacgccagctccgagttctgagctttcaaggttttcactttttcctccagccgggcgattctctccagcttcctttttcggcacttggaggcagcgatgcggttcctcatgcgcttcctctccgccttgatccgctcctgggactccatgtcgatgggggacaggggcggtgtctcgccgggcatctcgggcactgtctgaggctcctccttcagggcctgcagccgcgggtgctgcacgggcatctgctggggcaggtggtgcggcggctgctgctgctgctggggttgcgcgggaaaggccaggccggccgcgccgtaggagggcgccccgccgccgctgctcagcgcgcctgggttgaagttgctgaggtttgcgtagaccggcggctcgctgtgcaggctggcgctgaagccgccgctgccgctgccccctgccaccgaggctaccgcgggagccaccatgcctgccccgttgaccggctgcgccgccgacgtgacgctgggcagcgtgttctggctgtgcagttcggccagggcgcgcacgaagccctcggcgaagccctcctgctcatctgtcacgttcttggggcacaggaactgggtgggggtcggcgtggtggtgatgtgcccgttgctggactggattatcaggcgctccagctcgggcgacgccagcttgagcagccccacgtcgggcgaggtgaggaggtccgagttcttggcgcggaggtgcggcttcaggctccccactgggtcggccaggttcagggtcatgctctgtttcaggatcttggggttactgtagccataaggtccgctctcggacgggaggaacgaggcgttgagggcatcgtcatagaaggtcgtttccatctttgcagtcatagaacagtccgtcacttcacgtgaggttagtttgggctgcgcgcacaagtttcggggccgcaacagggctgtggcaagcgggggacacccgcgccccccggagcctttgacagggaaagtttctctaagagcgcacgcacccgctggctgtcgtccccgctgcgccctcctcaccagctcgctccagggagcgcagggttaattaagatgcctcccgcactcttacttgtcgactcgcgcgcgctacccggctttgaaaagtcgcggtcactcactgagcgctcttcgtgcgcagcggttcctcggagtccgcaggcgaactcacttcccagagcagcggctctccccgcggagcggatcagtgcggaccctgcagtggccggccggcggcgggtcttggccgcccggactccgacgacttgtcccctcctccgctgctagggggagggggcgcccggcagccgcggctcgcgctcgcccaagttcaacaaccggtgcgagcgaagctgagcgcacgtccttcttctcttgcgtggctctccgccgccttctggtctttaccgccgtggagaagcctaagacgcaggaaaggcttgcaaaagttggctccgggactctgccacttgtctccggtcctcccagccgggaaagttctttgctgctgcagccgctcgccgacttcccccggcgggcgcgtgggtaccgctgctttccgccgctgtcaacagcgcctgggcagcagggctctcctcccgggggcggctggagaccaggctctctggacactcccgaaacaccagcccgggagccacaggcgctagctctgggcagttagagagaaggtgaaaagaaaataagatttgcagttcggactatactgccgacctggctggctggctgtgtctgtctgtctgcctgactccgcgcacctccactcccgcctcgctgcttcagccacactcagtgcaactctgagcccttatccagcccgagctcaacacttatctgctaccagtcaacccctaaaaatagcccatgatgtc

SEQ ID NO: 1838 - DNA, 87681 bp, Homo sapiens
  source 1..87681: mol_type = genomic DNA
tgagagtgcataaaattctttatttagaacaataaagtatatgtatatatcatgtaattttaaattcaaacctgtataaaaaagggttgggacatacacctattttaaaaagtacacatacagtatatacacatacacatcacattttacaaccttttttatttaattaaatttcagtcataatagaactatttagaatagtgtcgacatacatttacattattatatgcaaactccaatctatgactgaactgagggtatatctgcgcatccatctaaattaatacttttcaagtccattgatttaaaaaaatggtggcaagtggacactataatcacatattaacccttagaatatagaatagaatattttgattggaaaattatatttagtgagtattgtagctcagagatcaagtactggaaaacggtgtggtttttagtttaacagttgttttaattttattgttaaaaacatcataaggatgtagttggagatggcagttataaataaatttacaatgcttagtaaacatttcaggatcacaaatatccattttagcatggattatttcttgaaaaaaacaccttgttataaaatgaaagtaccattattttatttttacaaacaaaggcatttcaagactagttaatggaaagcagcaacattatgaattgtgtgatcaaactccacaaatgagctaattagaatttcaatctgaatggttttattttaaagccaatttcaaaataatattgtttcaaagataagctggtttactttagatttcttatcccactttccaattttaaagtgtaattaatgaattacccctttataaattgattctaaaatatcttttggcattcaaaaccttcatgagcattttacattttctgctcttagttttcaataaaatgagaagatttaaacgctcactttggtgcatttccaaatgttacacacatcttatagtttctcatcctgactaatatgactaaaacgtactactggttttcattctttggaggtgatccaaaatgtttattcaagcaaaggaaaaagccatctcttgtgtaaatggtgatccaattcaccctacttaagactgaatttcacttttactaatggacactatttacattagaaacaagaacagcaatgactttttatggtcaagatacttattcacagaatccagagttggatattttgtatgggttagtttcaatgctattttgtcttctttgtcggtcatattgcaataggactcacccctaaggagtgatctctgagtttaccatatagataaataaaaaattgagacccaaagaagagaggtgatttaccatatcagttaatgacagactggaggctccggatatcttttgcaacatccatcccaccatgccaaaatgcatttttgaagaatatattttttaaatatacataatgcctaaaagctccaaactgaaattacattttgaaatgaaaacttggctgcagtaaaatatttttaaaatccatgatttctgaatgagtttttctctttatttataactttagttgaattagagtaggaaaacgtgccccaaagtttctccaaagtactttaaagctcaatgaaatgtatttaattcttactaaaaccaatacttcattaggtatgcatattttttcataattttcttttcacatactttttaagagaataggctacttgttctattattgtattgaagaaaaattaatttttctctgactcattaaaatgtggcagtgtggtaagcacattaaattacaatacaatatccaggaacacttcattatcactcaggaggcaacatttatcataaagccattttctaaatagacctggtttctaccaaagaggtgcaaagctttcagtatcattgagaatctacagacttctgagatcattttaaaaggtaattttgaaaccttccaagatggaactgtcagatacatggcaccaactgaaaaggcgatttcatggtttactatctcagcagtgagttttccatgatttatgaagaaggatattcagaacacatctgggataaaataagcaaagataaatatatattttcatctcaaagcagaaataacacagttaatgtccaagcagctagcatccaaaataatgttcagcatttttctattgttcatgcattttattcaactttagtgttttaaaaattggcaatccatgtaactttcaatggaccaacacatttaataagcaggacacatctcccctctcctaccatgtcagatttaataacttgctgaatttgtttatttaactccattgattaagaccatgtccatgagtgttaaaacccagctactaggtttgaggacaaaagtacacatttattatactcttaagcacattaagcaggattttcatatgctcaagcaaactgaaaccattggttaaataaatcaaactactagattgagaagtatctatcttctcaatctatacacaacctacacgcataactcatattaatctgtatctattttcctgaaaacagtcaatgccacacactgagacaggacctatcagcaatttaaattgatctctggttttattactaatcaagtgtaccatgtgatatctgagggcctgaacaccttaatgcagcttctcaaagcacctgggttatatcttagagaaattactcatatttaaggaaccacagcatgttagagaagaaagggactgtaggaatcatctgggctctttggtacaaaaaagagcaaaggccacttactggagttgcatctggatttgctttgaacagaagctaaaatccaaatatactagaaattcttggacttttgaaatgaaaggaaagctagcagttagtttttcatgcccttttgtgtcactacattgaaaactgtcatcttacggttgtagaacatggcaataatgttatcacaaagattaagttagaatggaaagctttggattcctttatgtgtacattcaagacatgttaaaagaactttcatcaaaataaaccataagaaatcattctttgactttagtcagatgttttcttattataaaaaaaattggcaagggatattcacataatgtcttacaagttctagtttaaaagcacaatgtccatcttgggaattcctgccaaattcactcttaatatgacaaacactgtcacacattttaaatagcaaactgacatgcataactacataaagctttctttttaattcataaaccttaatgaatatagagtgcccgattttaactaaatggatcctttaaacagataatggtgattatactataaataactaaagtttcctgattccttgcattataagtaacctagttttcaacacccatattagcatgtgggcgtggttttctaaccttagatactaaatgtcataatttatttttaggctctcccatggtggaaattgaaatgggaccatcttacattcagcattttctcctaagtccctttacatagctctgtaatagttttagaatataaacacatcataacacattttgcaaacacgatttatacaccctatagtggtcaagggaaaaggcggactttcccaggatgccaatgtccttcttggcagactgttctgatgttcagtgttcttaacttcttcctgcgatgactcttttggagtctcccctctgccaaggcataattcagtactggctcccttgcataaatggaaccaggcaaccatttgcatttgtatagtgggatatgggtgagcatggtttacatcaggaagagatcgaaatcagacccatatcactaatcggcaactataaagctgacatgttgccaaatccaatcacagttcccactgctttctacactgtacagtggctgacactactgagttttaaacattttttccagatccctttgagaaaaattgttaccctcactatccaagctgaaatctacttgcagagaccaggataactacaggctgcagtttgtatctgaagaataaagctaggtgttttttcagcatttagacatttctggagccatgcaaatggtacatgcagtctgagacacgtgctttctcttccaacatcagctgcaagttctaaatgagacccaagtcccgcagtccttaaaatagagtcctgctccatgcaagttcttctttatagatgattaattcagtgccagtttcacagtaaaacattctgttccaatttctgaatcatccatataaagtcatgggtagcaagaacagataaagatgtggtctgtcactccagacagaatatgaatttgtttaaagctgcttcatttatgaagcaaacatgaactgttaccagcctagaaaggaaggaagaaaagagagattatggtgtatctgccttctgcctttttaaaaatctcaatagccgaaatcatatatgaccacagaatgagtaacaaatttgcaatgtatgcttcacttatatagcagaaaagaacttcataaatattttcttagatgcagtgatcagtcattttctatgatctccttggtaacacattatctgaaacaatcttactttttgtttattatctatgtcctcccattaaaatgtaagctccatgagggcagggagcttctctatctcttttactgctgtacctccactcttataataatgtctggcacttaatagacactcaataaatatttcaccctgtgactttcatacctcctgacattctaccaatgatctcagtttgtgataatataattatcaacttagttagctttgaatttctctagcaagattataaaaggtagtaaacaggggtgaagggagaaggattgacgaacaaagtgtctggagagtggagattagagaaatggagatagatggagtagcatgaaagagatccctaagacaggtggagaagctggtcaatggccaccaacaagtaatagcctcacatggccactgagccgctctagtatcttgactatctagttaggttctagcaatcatttcttccagctgaggaaatagcagcagaaagatttcgttcaatacttccaaccaaaaaaagaaagactgtaatcttggcaccgcatcccaacaaagttctggggaaagttcgtttggcctcagcatagcttattgtacttgttgaagcatgaaagccatattttgttttagttattcagtacttgtgttaatctactagctttcagatgtttcaactttccagtaaagtatttgtatttccttctctacttaaaaaaaatacatatagatggtatcatcccatcttcaatcccagtctctaaataaatgtgttttgcatttctcgtcttctctgctcaatctctttcactacttttgtccttgtttatcaacccagcatcacagatcactgtttttaaagtattgagatcattacacagattagccataaaattccatagtgtaataagaattgcaatatttttccagtctctctaaatgtaatatattaaaaactgtcttatacaacaatttaccaagcagagaactctagaagctagacaacctgtatttaggaaatcagaattaaatctagaacaaaaattaagagatactaagataaaacttcagaaatccaaaatatatagaagatattttaaaagcatggttagaaagcaaaagggaatcacaaaaagcaaaaggatgtattttttaaatgtataaataattggaaacacaaagcttaatatagagaattaaatataggacaggcatggtggctcacacctgtaatcccagcactttgagaggctgaggtaggcggatcatctgaagtcaggagtttgagaccagcctggccaacatggtgaaaccctgtctctactaaaaatacaaaaattagctgggtgtgttagtgcacatctgtagtcccagctactctgggggtgaggcacaaaacccccttcaacccaggaggcggaggttgcagtgagctgagatcacgccactgcactccagcctgggctacagagcaagactcttaagaaagaaagactctcaagaaagaaagagagagagagagaattaaatgtagagaagattggaaatctatttttgatttttgtccccgggtcacttagcaaagaaaataaacgtaaagactggcacctgttttcccatagaacaaaactacaatttttataatgataacctgggttcttgcaagaacccttgtgaaataagaagagtacatttatcactaaccctcattacacatgaaaaaccagggtttaaaagacatgaactgataactgatataaattcatctagtattctacaccaaagagtcaaggcttgaatccaagcctaatcctttctaatcatctgctttacaatgtatctacagaaaccaaactcccaaagctttgaaagtcttaggaaacatctagcaaagaatcacaggtcttgctatttggtaaccaaccattgccaagccttgaggcctaaatttccaagcttgtcttcagcttgtcctttattccaattctaagatttattttcttcccccttagctcagatataccaaaattttgtttgtatttctttagtgaacctctccacaatcaaacccatgctatttactatcaaccacacggggccatttctgtgactaagcaatttctctttcaaggtctcaaataagattctttgcagataactctcaaattgcaaatcattctttccaggcctgactgttatctgaagttccagtctaacatatttggccactggttagtttcaataatatttaccaacagcttcttctcctgattttccatttcctgttaatgccaccgcactctggtaagtcccatagtctccaaatcattcttgagttctgcctgtgatgccaagtctcacatcccattagtaactaggatttgttgattcttttactgcaatgtcttcaaatggtctatgctttcttatttcctggccctgatgctaattcagttgtcattctctctcacatcttatttaaagactggcctggtaagtggactcaatttctctagttaaccactcccgtacatcttgccataccaacacccgattagttttctcacacctcagctttgattgtcacccacatctttcctacaccattttctcccaatacctccttatgtgacacaaggcatttaagccccattcctggaattcaaaccctttctcaaaccgatgctcaccctttcttctcagcatttaactctttatatgtgacttccactggaatccaactgtccaaactgacccttgaacacagtttctactttgggactatactgacttagtttacgccatgtgctcagtacagatgctacctccaccacttacaaagtgaagcttttctcctattgttagtgatttctctctcctttcaaaaataggtaactgtatttgggtgtgctcaattctaatatgtcattcattccagtatctagaactgtgttgaattcacaacttgtatgaacatatgcagaggcctggactttgatcaaagtaactctgtaaacttttagttcacttttaaaaattggttattatgtatatgtctgatttccttttgtaggctataaacaatttgaggacacaacaaagttatattaagctttgcatccatcaatgcacctgctagagtttgttggaatcacatttgtgggaagagtaaagagcaaaagtttcctgtaacgtattaacataaagtttttaatgtaatccatctgttttatttatctatcttaatctttgctatccacaacccaatatgaaaaaggtttttgtaggatgctactatggatatttggcataagctatgtgaccaagtaaatttttaacttttcacatagctgttctcacgcatggtgtcaaataaacacacttcagttaattttttatttttatattttgagaccaggccttgctctatcacccaggttggaatgctgtgatttgatcatggcttattacagcctcaacctctcgggctcaggcaatcctcctgcctcagcctcctgagtagctgagaccataggtgcataccactatgcccacccaatttttaaattatttgtagagatggggtcttcctatgtttcccaggctggtctcgaactcctgggctcaagtgatcctcccacctcagccccccaaggtactgggattacaggaatgagctaccactcctggcctatttattcctaggtgcaactttttttgttgttgtttctagttcaatacattccttccacgtttgttccttgtagttaagatattaaaccctccttcttttcattttccaattataggttatttccttaagagaactagcccatatgttctctattctagtgttccaatatttgtcttgatttaatttgttttagttggtgaaacttccatttcagggagaaatccttgccataaacctgagtcattccttgtatttttccccttccttgttaaccaagaaaatgattataatccaaattatatctattttttaaatgtataattgcaactccacattttatttctgtcttggcattttttactacggttattcttattttttagaagattttctctccaaccacatcacagtttgttctcccagaccttccctctactacacacctatctaggaactagacttaagagttccttggagggttttccatctctgctggtagaaggccaaatgtaagggtttacttcatataatgggtagtcaatagatgattacaaatgatatacacacatttttactttggggttttcagattctgaggacgaactggcccttttctacctcttttcctacttttccctcagcatttgaattcttatgtactcatagacacatacaagtttatttctgtttttattttcatatattttattctcatcttattgtaattctgagatattcattcatctttccattaatttattcaacaaatagttattcatcatttatatgtgcacagtataagtgacattgtttagtggggctccaaaactaaattaagaaaaaaaaatcctgccccctaagagtttatggttttgaaaagggcacaaaatgttcatttaggtgactgtgatgtcctaccaagtgtcatatgaaatctatttagagggccagaaatagagattattttcatttgggaagtcaggtttttgtaggtggcagtatgtgacctgagccttggtggagctttgcagagatgacgagtaaggcactttgtgaaggagaatgagtcatgttttcattcattctgccatctatttcccattgactactgaataagtgagctgggtttttttctggataattctggcttctttaacctggctaatgtgattcattttatacatgagtaataattcataccttaagaaaaataatttattagttaatttctcatgtgattatattcccccttgatatgcataccttgctgtctcattaatccaacccaatacattaaatacacacattcacacaaaagataaaaacaaaccctacttcagaagaacaatcttctttgccatttgcttaaactttcatttagggctgagtcactcactcagtctctcattcaacaaacatttatagagagccaacaatgcacgggcagcaagttaggtgttgagggtacagcaagaaacagaaagacctaactcttttcttggaatgctaactgactattcaacacattcataagttgtttgactatggttgctttaaaataccatcttttttcctcctaaacaaatggcctgggtttccgtatcctaatccactcccaaatgtcatgggacgaatgtcgtaattaaaaccacatgattaaagacctgtgtgccaaaacaggatcccagcaatgcaatcccaaaccaaacaacagaggacattacttgagcatttgagcatttaagactcaattaaccatttaatgtgtggtttgtgaatgccacttgagagaactgaaatggctgtcaagaagaagaaaaggaaggaaaaaaaaaagaaaacagtgaatctcatcttatggttcaaaggcaaaaaaatgaatttctaggaaaaagcatggtttcagcttgggaaatattgcttcggaaaataaaaagtgtcaagcaaacggtctatccatttacattatttgacaggaagaatgagcctagaaagaagtggcaatgggcagcagaaaatagagggtgctattcatgctacggacatgttaatcaagagtatgattgaaggtaaaagtgacagagtgtgtagaataaagtattacagtgttagagaaatgtgcaacataattatatcatgttatcttgagttgttaaaaaatgttgctgtataaccataaaagtaagctcatacaggaggcaagataatttatgactcagttccactgaagaagattaagtctagagacaaatctctgaacctgggacaggagttaaagctggaagggcagtgacttgcagggtaaagaaggaatccaccacagactatctaggtaataaagaggagagtaaataatcctttgacaatgagggaatgcacagaagaaatgaggaatttgaaagaggagagaatattcgcatgcaactgtggtaaatgctctcaggattccatgccagtaacaaaaataacagccaattagcagaagcaaaagtgagggacagcatgaatcaatactgattaagttaatgcagctgtgggtcttcccgcaacagtatctgcagcaagggagcagagaaagcagacgggacaggagataatgataccagtaccttctagccacatcttactctcctttctcccacaatccctccgcagacccacacagtcacagcacctgtctgccatgcgtttatgttccgtgcatcctgggctctgaactattataatgcataattattactagtcatgtggaaggtggcaattgacctggaaaatcttactctcctgactctaagatatttggatgttttctctttttcctgaaaatggcagggaaacattctggttttctcttgtttcagcatctaacacatgggatacagtcatgttatagtggtcacacctaaataaaattgattccatatatttttattctattagtaatacttaattttagtcctaatttgctatatttcccttgtctaattaattttctggtctcaaaaacagtctaagtaaacatacaactgttaatttttgtgcatatcccacactagatgaatccactagtcaggacaaacactgcttacctttcaaaactggagaatacacaatgaattagatatgcacatttcaattatgtaacagcttcagccaacatactgacatctgcttgatagaagacttactaatgaagtttgtttctaaactttggcatctcatatgctgtatagttcttgctaaatatttcagtttgaattaaaatttttacaatctacccatctgacaaaggactaatatccagaatctgcaaagaacttaaacaaatttacaagaaaaaatcaaacaaccccatcaaaaagtgggcgaaggatatgaacagacacttctcaaaagaagatatttatgcagccaacagacacgtgaaaaaatgctcatcatcactggccatcagagaaatgcaaatcaaaaccacaatgagataaccatctcacaccagttagaatggtgatcattaaaaagtcaggaaacaacaggtgctgcagaggatgtggagaaataggaacacttttacactgttggtgggactgtaaagtagttcaaccattgtggaagtcagtgtggtgattcctcagggatctagaactagaaacaccatttgacccaggcatcccattactgggtatatacccaaaggattataaaattataaatcatgctgctctaaagacacatgcacatgtatgactgaggctggaaaccatcattctgagcaaactatcgcaaggacagaaaaccaaacactgcgtgttctcactcataggtgggaattgaacaatgagaacacttggacacagggtagggaacaccacacaatggagcctgtcatggggtggggggagggggaagggatagcattaggagatatacctaatgtaaatgacgagttaatgggtgcagcacaccaacatggcacatgtaaacatacgtaacaaacctgcacattgtgcacatgtaccctagaacttaaagtataataaaaaaaagaaaaaaaaaggaaagaagaaaaaaacttaccaatgtacgaaagtaacagtgttgatacaagccacaattacacttcttgaaactctctctctttctcttgcaacatactgaaaaacaataagaaaaaatgcttatttgctcttggtcagagattctgaggtacaccatgatctcggcattgtaaaaggcagcttttctgtaaatatagtagcagaagattgcaaaattgaatggggagcctaccttcttattactatagggaagagggaagacttcatttgtcttaaggtagtctttccaagtagttaaaacatttctttctctgtatatgcatatacacataccaagcatgcctatatgcatttcatatgtgtctgtgtatacatacaggcatgacatgagagaaggcaacacaccaaatgaaaattataatcaaaggtaagggaacatatgagtgctgggcagtatagggtaaggtgaaagaatgacaagagccagctacagtgaatggaaagtcatcttacagcaaattttgtattcagctttagagaaaacaacgagtatgttgagaatagttaagggctctgaaagccagagtaaaataaaagatatataaaatatacaagagaaaatcactgaacgtattttgaataagaagtcacactatgaaccagggtttacagaagagtgtgactaaaggttgagtttagaagggctaaagaaaagatcagtggcagcaactcatgagatcataaagatgtcagtgatgataatgcttcctactgaaagaactaagcttaggaagacgctccaagagctgaatcagtatgttttgataaaagtgtggaaaagacagaacatgagcaaatgtgcctccagagttccacaaccaggagtctgagaagattctgctgccttacttaaataagaaagcagaggtaacccctttacaaaccctaagaagagtcatgaagacaattatgtgaaggtattctgtaggtaaatggagatgcagcactgaagagagagtgagacatcagaaacatggatagagttgggactcactggttaggagctactgtcatgagtgaaggacttcttaaagacattatgggcaggtacacagtgtgtgaaatggcaatgtcatgcttgattgggcacacatttagcaaaacaaaataccttatctcattatcctcttcattaatttgtatattttcaactgcccttgtaagacttggctgtctcttctggaaaaagaagaaagacatatactgtaaaataatcaatgaatggtctaatatttaagaggtaagtggactccacttttatcttttatggcaataactccaataacagttttttcagcatgtagcatgcaaaatatctttgtaataaaaaattatgaaagctgcatggtactatcaactcaacatttttaggatgttgggggctaaagagtaataaagaagctgacacttaatcaaattcaaaagacatttcaagaagctgagtcacaatgatttttgcacattttaaaattttagacaggcttcaataagaagagaacaaaagagtagaaatccaaaatagcagataatacaaatgacatttctatttgtcttttaagtatatcatatgattttcgtcagatcttccttttcatatttagttcaggctattaacaccagttcctaattcttaagcgtgaattatcagctagagggattgtctccagacataatgagaaacaggaaactttataaaatttaaattttgtttagattataagctaaggtagaattcactgttttcttaaaggatcatttcttgaggaaaaaaagatgataatttatgtaaacatagcatatttttaaaaaaaggaatggtaccacttaccttccagtataaggctccaaaagcaaagccaattataagagaaaacaatgctggcaatgccatggctgcccagtgtaggctggagtctccagggggatttttggccttccctataatttaaagaacacactgatgaatacagcatatccattctagaagttttgctcttatgctgtggttgtttttaactgtttctgtaacacattctggacctatatctgtttaaagtattcaaaagattgatttttctgctgaatattgcttttgcaaggcaatataaatccatgtagtctccaaaagatgaatgcattaaaaaagaaagaaatcacagagacagaaagagatctggcttgggtaattctgacacatatggaacacagacttaatatatttctggggggaaaatgacttatactatcaagcaaatctatctcccatgcctttatcttctaaaatctttttgctttctcactcttgacagcttgctcagaaattttaaacatgacattttacaacctggatcaagatctgtatgcattcagctatgtttggactgttgaaaatattaaataattgtatgtgcactgtggttatagtatttttaggtatctcatgcttagaatcatggctgtttccacgttcatatcttcaacacacatttgtcggatgccactgtgcaacggactaagagtttggacttttaatgttggaaagcttaagactaacactaaggggaatggttgaaggcactagtgttgtcccatactacgtctaaataagaaactcaatgagagagaacatatatggaattggtttgggacacctttcttgatcctgcctggctcttccatgagaagcaaaatgattcatgaatttaggttggatgtggtggctcacccctgtaatcccagcactttgggaggccgagtcaagcagatcacctgagatccagagttcaagaccagcccagccaacacggtaaaaccccgtctctactaaaaatacaaaaattagctgggtgtggtggcgcatgcctgtaatcccggctactacggaggctgaggcaggagaatcgcatgaacccgggaggcggaagtcgtaatgagccgagatcatgtcactgcactccagcctgggcaacagagcaagactctgtctttaaaaaaaaaaaaggagcagaatgattcacgaattaaataaacaaaacacatctcccacaagggtctcttccaacatgaaacttattttgacagatttttctatatacctatacctatttaacatacaaagtacctagagtacataatataaaataatagatctactatgtgtgtatcaacatcttacagggaaaaattaattcatagatttaacttgataagtcagaaatagattttatctactatggtgaggacaggaacagcccattcctctaccatatgtgaactgagagcaggaaattccctcatcctataaatggtatgtttccaaggagactctaatgatgggatgtatggatgtgtgctcacgtgtgtgtgtgtgtgtgtgtgtgtgtgttgggggaggagacagtgagggatgaacaataaggtgctggtgatccccacgtagggagttgtcagaaatagggtcttccattcacataaccatgaatatcctccttaggattcctcctcctggcccaccccacatcctatagccccatgggagatatgttttaccatctcaagttggagcccaatgtgaattttctcaccaaaataaatctgagtaataaaatgggatttggtataattaaagtactatcattacaataacagagctattttaaggattatgtaagattacgtggactcgtttgggatttaactactatctataaaagtgctctctatatgaaatggattcagggttacaaacaattcgcaccatttgaggaattttaataatactgtttgtaaataaatcatttggctgttttggttctccttgaaggccaatctgctgtggcccccattatctattgggattgctggtatgtaattacaatagatttactaggtaacctccttaagaggccataatcaatgtacacagagagaacaaataaattaattaagattttgtccttaaaatccaatggaaaactctaacaagctaggaagatgctatggagaactccattatctacgttgggtcagccagatgccctgtaatcaaggtagccaaacaccatgttcttcttgttctatacaaagaccaaacctaagtcttgaaattcaccactcagaccaaaggaaagaccagactcaaaagcaaaaagcagcttactaaagagtgagatattctggaatttgctacctaaaacctttctcaggcagaaggatagcatctaaggaaggggcttccaacaaagctgtgtgggaggccttactaaagaaagctcagacttgctctctgagagtgcggtgactaccatgttgacagttccatccctaagactgtgagccaatacacaatcctggagtctgactaagacacagcagcaatcttcctgcaggagacagggagggagagaaacagcaaagactggatggcggggcggcagtggagaggagggttgggggaagcgcccataggttactgagcttcacctcccatagaggtcaatgttacctcactttttttatttcacttgttcatgcgtggggcttaagaaccaggcctttggtccatcagggatactactgtccctcttgcaggcagacaaaaagaactttatcagaagagatttgcttatacctccagggaatgactttcaatactttccactgcagctatcgagtaggaatcaatgagatttgaattgcatgcctcaaggcccaaatgaagggtatttggggacaaaacttaagctgacaacaaagttttgattttatgcaaagatagcctgcagagaatttatgtggagaggaagctcatctgggccggatttgagtaatcccaaattcctgggttattaccatattaattatatctccttattaccaaaactattcactgtccagaaatcttgggaactgacttgtttcatttgactaataataaccaacatctgtagaaatacagaacacaaagaattgtgctataattttgctgaacttctttttagagtgagcatttttaggagcaccatgcctgtgacatggttatcttggtgcttatgaaacaagcaaatgagtattcttccttgattcagatccagagctcactaaaggttcaacataattactgatccaaagtcttattgcatctcattgttctagtacttaatgatgaactcttataagacatcagttatgtctccaagcacatgtgtactaactcacttaaaactcacagaaactctgtgaaggaggtattatgatcttccatttgaccgaagagtcaaaagagtttaacttgactggtatatgagtccaggaaggttgggtcaagactatttctagaaaatgtataagataatgtcaaagttaggatttctttctctatcatttaggtactgtctgcaagaatctcaaacataaaacatcttttaaacattctctttgcttatcataaaggatattactgttatgctataaacataattccctttggataactaataggtttgtatgttattccattctcccatgacttttccttacacactcacatctctgtaataagttttcatatgccctggtactctgacatggccagcttttgagttatccctgaaaactagcatgctttcttcaaatttccctaacccttctcccaaaaaagtcttaccccctttgtgctacacctaaaaacatttgcataattctattatgatacatattgtatactgtactatgagtattttatttacgtctgtttctctctgaatgttagcaccacaaaatcttgtcctgtgcagaggtatctaagtggcatattcatgagtgacatcacctagctaaaagttgctgacaatgcaagactcaaaattttttaaaaaggaagaaaaaagaaacagtgaacaaaaaagaaggctgtccattcatcttgcaatttaaaaagtaatctcagattcagaggcacgggattgaataggtattttatatttagtttgtcttttaaaattagtaggaaagacttttgtttccaaatacgatggtagcagactagcctttccaacctaagtaattataattctagacaaattatgaggcaactcttttcagaaattagtgaacagcagtacaaatgtgtaattcacgagacagggcatccacactaagtgaggctcatgtttgccctggttttctggctttcagctctcctgtctggggtgcactttcagattgaggtgtggaagacagagttcaaacaaggaccaatggcctcactaagctaaggagtcagagattgaagttcagggctgccgatgcagctggagtttctagatctaggttatttggaagaagggagctgtgcaaagaaggagcatcagaaatccctagatgaatctccttaagttactggtccaataataagctgtatatgcaccagtagagaagtcacaaaacctgaccaaaaaataaaattataataaaaaaaaataaccaaacaccaaactcatgggaagctataatcttagtagaggccctagcagacacagaacaatggggacaaaattattaagacaagcaatattggagagattttctgagcactttacagatatctcagatattccatgccttaggaataaggctactttcccttgtacccaagaaagtttaaaaacaaggctgggagaaaagataaacctcatctgctactattcgaacctcctaccaaaacacaattcaatagcctctaaagaaacgctatagaatctgaaagatattcaacagcatagaattcataatatccagcatatattaaacaatcactaaccatttaaaaggaaatgtgacccctaatcagagaggaagaagtcaatagacatcaactctgagatgacctatgtgttgaaatttggagacaagaactttagagcagctattatatttaagtgacaaaaaagaattttttttcataatgagtatgcagatggaaaattccagcagagaaatatgaaatacattaaacaattaactggacattctagaacagaaaatataaattcataaatagaataattcactggatgaaaaattcagcagatcagagatggcagaacaaaaggtcaatgaacttgaaagcagacaagtagaaattactcagaagaacacagagaaaagaggataaataaatgaacaaaacttctgcgacctatgacacactagcaatctgctaacatatatgcaagtagtatctcagaatgagaggatagataaaatggattaaaaaatttgaaaaatttatgactattttttccccaaatttgagggaaaacaaatatatagatccaaaagcttgacaaatctcaagaaagataaatacaaagaaaaccactcataggcatattctagctcaaatgttaaaaaggagaacactttgaaagaacgcagaggaagaaatgaccctgtacatacagggtaaaaataagacaaatggtggctaccttttttatttttttcagaaacaataactgcaggaatactatagtgatatttttaaaagactaaaagaaaaaaaatcctgtgtacccagacttcaatatctagtaaaaagtacctgctacatggaagacaaaacaaagatattttccaattaaaaagaaaaaagaatttgttgccagcagatctgtattataagagatgctatagaatgtttttcagcctgaaggaaattaataccaaatggaaacctggactgacaagagggaatgaagggtacaggaaataataaatatgcaggttaatataaaagacaatatatttcttcttctcttactttaaaatacgtatgacagttcaaagaaataattgaactgcattgtgtattgtagactgtattgtgaaatttataactgatgtagatatgttaatatatgtcaatgatgacacaaaagatgggtatgggtaaataaaactaccctgtttcaaggttcttgcatttttttctcaagtgctacaatagtaactctaagtagaatattacaagttaaagtgtatactttaatttccaaaataaccacaaaataatgcaaaagggtgctgttgaaaatccaacactaattaaacactagaaaaaaaataattaaccaaaaaaaaagggctagaaataaggaacagaaggtcaatacacaaatgggacagataaaaaacaagtaaggaaatggtggattaaaatccaactataccaatgatttattacatagaaatggatgaagcactctaattaacaatcagagatacactaaataaaatagtgaagcccaagtgtatgttgtctactagagatgtactttaaaaatacagacaacagactgaaaataaaggaaagccaaacatataccatgaaaacagtaagcataagaaagatttgctctaatatcagacaaaataaacttcaagacaaaaagcactatcagagataatgagggatatttcagtaagattaaaaggtcaattaaacagggaagatctaacaataatcaatgtataagcccataataataaagctttaaaatatatgaagcaaaaaacccaaaaccaaatggaaaatcagacaaatccacaatcaaaagttaatattttcaattcccttttctcaataattaataaaaattagacaaaaagcttaataaggaagggaagatataaacaacactatcaaccattttggccaaatttgaatgctgcattcaacagttaaataacatacataaaatagtttcagtacatttcaaaaaaattatagagtatgttttctgacaacaaaattcatagactagtaacaataagatatataggaaaatctcaaactttttgacatcaaacaacgcacttttatattatccatgaatcaaagaagaaatcacagttgacaaatatttagaaaaataataaaatcacaacacaaaaatgtgtgaggtgcagctaaagcagtgtatttaagaaaatttatacctttaagtgcttgtaattagcaaaaatagtttaaaatcaatgatctaatttttccacttcgaaaagctagaaaaagtggagtaaatgaaacacaaagcaaatggaaggaaataataaagattagaaatcaatgaaatataagcagagaatttaagaagacaaaagttgctcctttgaaaatgttaataaaatccatagttggtaagaaaacccttaattgactaacacacaaacagggctctagtccctttttgacacattttagaactgatatgctacgtaatttagaattttaggtttcagaagattctgtcctgcacataatgtataacatatactatccccagtgaatcctgggtagcattctgtaatcaaatacattaatatttcattagtaaaatatatattcacttttagaaagataaatagactataaatagcctcaaatcacttcaggtcaggttttggtggcaaaaaattccaaaataagtaaattgtattttagagtttttttaaatgttctgcattgtaacaagctattatgaattagtaataaattgattacttcttttcacagataggtcttctaagtccctgaacaaatgacagtgccccatttataagtcctaagggatgacttttttagcctagatcacaagatggtttttattcttcctgcaccttccatgaggctagagagtatttagtaaatacaataaactttataatgacctttgtctggattttcaaagaaaattgggttcttggcaaaagaggacagaaatttcagaaaaataagcctattctcatcaagcatataattctgtggtaaaataacaaaatcatcaaatttccaaatgcgcaatagtaaatactgatatacacaaatctgaaaatatctttggaattctatacaaccagcatttatacaattaaacttccgtttttgtcagacacattccacacagaatatatgttaacaaccagcatttatacacttaattttaaacttccgtttttgtcagacacattccacacagaatatatgttaatgattcaacaaaaggcataaatcatatttctaaaattaattttatgtcttatttaaaataacctcagcagaaaatttattggcctaattctctaaacattatctccagctctagggaaatttaattctacaaacttaagtctcaagaagaccataaaaggaataacagtaacagaacagtatcaataataataaatgtagaagtttccttgaaagcccatgcaatactcctataggtgctaattggagccatgcatgcattaaatcagatatatgtacttactattactgctactgctgtcattcctaagggagctggctgcaacagggggtaacataaatggttttgtgacactgactctggaatctaaatagaaagcaataatgtgtcagtgttatatggtgatttgtatgagttatagagtccctgaaaggtgaagtgcaataccagattacttgccaggtctgcttcccaaatctagagtattcagatcctatttatttcatactgggtcctgctattctattttactaagaaatccaccattatcaccttgtagaacaaatacttattgaataaatatgttaataaatacaaataatgacacattgatggtaatttctcattaaaaaaagaaagcaatgaatccaggtttgtattatagggacccagtgaagggaaaaaagagtcttaatacagagtaactggggaggatcagaatttgtgacttagagttagatccttaagaaaaaatttgagaaggaccattaagtagactggaggtacagaataatataattgtaattactggcaaatattagatgagaaaaggtatgagtggccatctcatatattgtttactcacaaacagctcactaatttgaaactgatgaatattgctttgggttagaaacccacaaatctacaatcattagtttcttctgtgctattgatatctgcttttttattagacgtacatgcatgtatcttgctacagcttaacacagaggtagattcttactacatagggaagatttaagtttgttgtttacatttgaactggaaatgcttacatgtcttacctttctcaggacttaatgttgaagaaaccacacaatcactagtttcagatgccactacaaagtccttgaaggcatcaatggatctattaaaaattctaaagaattcttcaggagtaaagagcctgggttctgggctcttgaatgatttttttagatcctagaagaaaaaataggattacatttttcaaatagtcttcagacttaactgaggtgaagataatggactataaatatgtctctcaaagattcaagtatttagactcttacaactagcacttttagatggctgttttaacgtatgtaattcagattggtaatgcagggtagtgatcccagtgggatcacaagttgaatctggggcagtgaacacaatgtcatggcaaaaaataaaataaaataaataaccttaaaaacaagctggggatatttttctttagagatgctcattaaaaacatgagggtttatttttaaaagacccctccattacaagaacttccagtctttagaaaaaaaaaaaaaaaaccacaccataatgcatgctctaatatccaaaaattagaaagtcagatgatactaaatattggcaagggaactcttacatactgctgagataatgtaagttggtacatttgatattatccagtaaagttagacatgtgaccatcctgtgactcagaaattccattctcaggtaaataacctactgaaactattgcacatatataccatcagacatataaaaaagtttttttgcagcaatatctgtatcacttatgtcaatccagacagagtggcttaataactagtgatatattgaattagtggagttcaattcaagagaaggttaactacagctatatgctttaaagtggatacatcttctaaacctaaagctgagtgaaagaggcaagtcccaaaataataaaaatggtatgattaattgatataaaattaatataaaattccccaaagcaaatcaaagctatgttgtagggatacataatggattataaagaaaagtaggtaaccaaaataaacaactatctgttacttactatggactattctaagtgctttatatacagtaactcaatctccaaaacaactgagaaatataattggtaatctcctgggttcccaccaaagtgccatgattagtaaatgcacattctttgttgtttgcagtgttcttcccaacatcaccattgacctaactcatttacctaactcatctttaaggctctaatgcacatgttatttcctttgtgacaccttgtgtgatgcactctactttttgtgatctctacttcttttgaatgccattggcacactatatgcagtagtaatatgaaagagtggttaacaccacattctgactttggaaattagaaaataatacaaagattaaaggtagtgattggattattagtatggtaagaattataagataggatagtacaaatgggattgaagttgggtcttacagaatagctggaatttagatgggacacaggaaaaagcatttaggtattaaggtacagaatcctgcttaaaactttgaatttaaacttacataagtctcctaagctaatctttggccatttgaactgtataccaaatcaggtctcctaagcatgattttgctatagacacagtgtgatgaaaaaacatcaaattttattaatatttattttgctaggtagggtgttaaagtactcatggcaaataacctaacgtcgaccctgttagatgaattctggcattgcccccattttaaagataaagaaagtgaggtacaaagaagttacgctcacagaactcattagcgacagagccagaatttaaactccaatatctcactcttattttctggagtacattgcctattccatatgtcatgcccatatcctgaagttggtgatgatcagttatccaatgactttgaggagccaaaatgtattcctttgctgtgacctatggggtgattacattatgcataaaaggatatgtgtttattacagacaattttccatttaaatgaacacttgtaacttaatagaaaggtttcaaggacttcacttatgaagaataaagataaaggcaggactgattttgcattgtaatgtaaataagttttatttttgtattagatgacaacatttaagtttgaatgtgcacttcagtattgcagtataactgcaaatacttgttttctttgctcatctgaacaagatttttaaatttgaagtttatacaatcaaaatatcataaataaaggtgcctcattttccccaacagcaccaagaagcatgggtttttagagaagcgtaatgaaaaataatcccaatgaacacaaagttaccttagatgagttttctttcacgcactccacaaggtcatccactatattcacaagtttgtctatgatggaataattactcaagccttcagaaatatttgaaaacttgtccagaagatcagtcaagctgtctgacaattgtactaccatctcgcttatccaacaatgacttggctgcaagatatgaaaaaagagacaaaacagctattttaataagtaagtgccataaaactcggagtactcttcaaagctatcgttttagttactcaagtgattctcctgcctcagcctctcgagtagctcagattacaagtgcctgccaccatgcctggctacttttttatttttagtagagaggaagtttcaccatgttggccaggctgtctcaaacttcctgacctcaaatgatccacccgtctcagcttcccaatgtgctgggattacaagcatgaaccaccgtgcctggccagatttttaaaattaatattacattacttaaaatgttgtaataggaggacaggggttattgtaacaggaagagaagggactagtgtgacaggaggaggagggactattgtaataggaggagggactcttgtaacaggaggaggaggttgtaagtttgcatgctttatatgattttaatgtgttatcttttctcttataaagatcttttaagtggaaactctgatgtattttgaacactgctgaaatgctgcagtgacaaaaataacattgttattaagaataacattgaattggctcattaaaagcacaaataatttaatacaacttgtaacaaaaatattgtactcagagtaactgatgtcatggaaaataaatcaaactactaagctttatttctctatttaccagcagaatatctctgtgggaaaagtcaagccttttatttatttatttatttatttatgctttaattttttacagagacaggctctctctctgagtcctgggctgtagtgcaggggtgcaatcatggttcactgcaatgttgaattcctgggcccaagtgatcttcccacttcagcctcccaagtagctggcactacaaggcgcatgctaccaagtgtggctaatttttaatttttttatataaatgggatcttgctttgctgctcaggctgctcttgaactcctggcctcaagcaatcctccctcctcagcattctaaaatgctgggattagaggcgtgagtcactgcatctggctcaagtcatttatttattctaaagtatagaagggaccactttatattcatttaacagaactgttttacttaatataatacagccaaaaaggaagcaggtttatctgcagataggtaagccccaattcctggaaccattaaatgtcactcaaaacttttaggattgttggctctggcttcagataagaaggataaacaaatctcaacatgggaatttagttcaagtggccatttcaactcgtcataaccaagttctcaaagaatatgtgtttccaaagtatgtgcagaacagagtctttgttttgttaaatcagtgcttacttcaagcacatgcaagttcctacttgcatcattatcaggtctctttcaaagctgtcagtctttccttggatgctgaattgctctgcaagtttctttccttttagggagtgataattccttatagaccgtcagccctatcaacaatgaacagatttcctaggatatggaacacagcatacactgtaaattgctatttgaatagtatttatgtgatagagtagctttcaccaattcattccgttgaaattgtgcaaatttttctaacaatgaaattccaggtattaatctcttaggactctatttcctcactttatgagtatgcttgcctaggatctctggcaagtaagaaccaaaatcaaattccttgttttgaattaagacattcctttagtttctgtggtagttgtcttatatgaatgggtactttgttcattttgctttttttttgtggttaaagtagaaaatgttttgttgatttgtttcttatttttaagctgaggaattctggggtacttactgccacttctgttgatcactattttcaaccgaactctatgtttacattttatattctagttcctatttagctattaccctacctcctcccattttcacataactaaatcaacagtctaaacaatcaactctttccagtaaaatttccaaccccaatcctgtgctttcttagagttaaaccatggaaattccacaatctaatcctactctaatgtttgcccttctaaagtcatgaacaatttgttgatagttgatataaactacgtgcctacacagctgaaaaatcgtgtatttctaaaacacttgtaatcatgtttcactcattttttatttttgcttgtgctattgtttctttggaaaaggctgaatcataaattcaaagttctatttttcagtaatttgtttaaccatgtatatattggctttttaagattcttgagtttattaaagataaaatgaaggtaaacaaataatattaaatgtcagtcagttttgatctgcctgcttgtaagagaggaaactagttttgactggaatgtctagcagttttgtaatttttaattaaatatcgtcaatgatttgcaaggagaataaaacacaatgaactaagtatttcatttgtgaggtgatagcaggtctttctgtttttcaattcctccacgattatgattatgaaataaatgattaaagattgtcaaatttacaaacgtactttttgtttgccttaataaatgatattatcactgtttcttatttttcagagatattttaaacttaaatagttttatataaatatttactcaatgatattcattagaagaaagtaagatataatgttctctctttcactagaaaatataaaggattaagaaaattgacagtcatacaggatgtcaaaggtgacacaaatgattgcttttaaattcctgatgtgcatgtaatttgatgctttattcgcctgtatgtattgtttccaaaagaagaaacatatagattctgctttgagtgtaaaaacttttttcttgactccatgctctcaatttcttaccttctttcttgatagcttctgtcttatgttttcttggttaattatagcagctctagctaggactactaaaaacatgtgctttctatccctatgtacttataacatgttattattctagaatccaaactgactcaatgatattgactcaatgatattggactgctagcatctcactaccactgacaattcagtcaaaaactgtgaacttccttaggaattttaaagtaccatgaacaccaaatcatgatctcgctaaatgattaaataaaatatataatttaaaatgaataaaattaaaagtattctaaacataactaggaatatgactgtttccaaagaccaacaacagaaatatatgcacattctaagactaagcataaatttttaaaaggtaatatattaattccacagaatatgtgacacagaatctctgtagttccagaaccagtaaatttgagaaaccggctgaaataaaccatgtgttttaaaatcatcctggagacttgctaattctggcatgctttctcctctctatctcctgcctcattcaagaaactgtgctggtttattaggtgaaataatttgacacattattccacattggtattagatgcacagtcttttttttttttttttttttgagacagtcttgctcttctcgcccacgctggagtgcaatggcgtggtctcagctcactgcaacctctgcctcctgggttcaagcgattctcctgcttcagcctcctgagtagttgggattacgggcatctgccaccacgcccagctaacttttgtttttttagtagagatgggatttcaccatgttggctaggctaatcttgaagtcctgactccaggtgatccacccatctcggtttcccaaagtgctgggattacaggagtgagccaccgcgcccaccccacagacagtctttaagagcagtcacggtaagatttacggattaagaagctgaaagtagacaaaataatactgtaacacttcttcactgaagcactttacattactttcaatttggtagctattcacagagagatatctatgttctttcttatagggcctaaagctagtatctacccagtgagaacgttcttttcacaggagttggtgaaataccaattagagattctcagagtgaaaagcctggctcataaactatgaggtttctaagaatattcataaggagtattcacccagccttctaatctgattaatctaaataccagcattaccacccagtttgtttttgttttactttctttaattcgtgtcaaacttcagtcttgctggaattagacgtatgcatgcctagggcacgaagtgtacctttctgtttgtgctttcagcatctacctctgggatgtgcaatcaaaatctagagccatgtcatcagaatcaccagaattccagacctagaaggaatactgaggaccagtctcaccaattgtataagcgggaaaatcaaggcttagagtagtgaagtgtctcgttccaggttacataacaaatttacacagaaacgcgagaaaccaggactctcgatcactcattttgttctagtagccatgagaatagtgaaagcacataaaactgaagtgtttttttctgctgaattcactatgacccatgtggtctcacgtctggaccagacacgattcttcggctcaattaagaaatctctttggaatagaaatggttctttctgtttcatttcagttaatccagagtcataccaatgaaggtaaatttctctgaggaattgtgacaattgccatttgtggactttatttactgttcttttggtttttttcgttgtggctagaaagctgacattctactctcaaacattccatgggcaggcaaatttaaaagtttcctataaaagcactttgcaaaatattgcatgttcatgttgccagtgtagtctccgaaatcttaacttctctttggattagctgggttttgtaatgatttattttagtcctctccctaaacaattaatttgggtcttcagtgttcactttaggcatctaactttacatttcttgtttgaattaaagtgccgtagaaatctcaatctgattaagatggtaatcaaccaaagcactctaaatatgtgttatttcccagggcagacctataaatggcccctaggcccgccctaaaatagaacagtgaaggaacagcacaggggtttggggagtgagggcagcaacgatgaactagaggcccagtttttagtcccaactctgtcaattcactttgtgatttcaggcaagtcatttaatctattcagggcttcagtttctccatctataaaataaattctaatcgatgctggccaatatgggaatcccactatccatctgcagctcctctcactcaaaatgcattgaatgtgactgcagagctaaaattttcattttacttaattataatttctttaaattgaaaagtcaataatatcaccctatttagaggctggaacttttaagtatgtttggaaaacacagaaatgtgactatcttctcaatggtaaattttattaaaaaatctaaatatggaataactatttctaatgaaaatttagtgtatgaactgtaatatgttgcagatgtaaaacacactgtggattttgaataatatgaaacatataaaacattccattaataatttttatattgattttaaggtgaaatgacaatattttggatacatggggctaaataaatttcattatacttaatttcagctgctcgtttttatttattttttttttagtgttgctaccagacaattaagattatgaacgtggcttccattgtatttctatcagagaataatggcctagataatctgaacagcatcttaatataatcacttattaggaagacgggcccctgtgctgtagtacagtatacaaaagaactacttaaaatagcatttaatgtcatattttattcattcaactaacattttatgcttattccttttaaataaatactttcttattacatgggagatcgaggcagataaatagttgactacaagtgtctatttggctgacgtctatttttatagagagaatgccgcatcataggagtggagcctcagaatccatgcttacaaacggtgaactttccctgtagccatagttggttggatgatggtagacacctgacttggataggccaaccagaacgttcctccccaaaattggtattgatcattagaaactgataattaatctctgaatagggctgaaattgaaatatgtaaacctggcagctcttgggcagttacattctaccaagtgactggaacaaaggagaaaatatctgcacaaatagaatgaggcggagaaacagagattcagagatggagaaggaaaaactgatagtttccaatcctggttccagtcttttcatggggcctgttgcacccatgcccttaggtgacatgctattctttagtgtccttataataatgggacttttactattagtgaaaaccacaggaatctaaactaataagatgggctccttcaagatttggaaatctagcatttttgccaagagttaaatgtttattcataactattttttgaggagcgactatatgcattggattgtctaaagaatggtgaggagatacacaggagtaaaagatttcaaccttgctctgtagatagtcaaaatatagtaaaaagagaacacaacaacaaaataataatgatggtatctgatgttattatatgcacaccacaactcatattttttgtattttaattatttctcacgataatactttgagacaaatatataacacttaaaatattaagctctatgtaagcaatatatgatcatgtacccaagatgaatagcttctggacaaattccatagaagtcacaagataataaactaaaagatagggtccacatagcaggtgcaatgatagtattgctgaccaccaagctccagcatcaagcaaaacactcagcacagagtagcacctgatcaaatgatacatgggagagaaaatgtgggctgaaagagcagaaaatgtccttgtgtgaaagagaaatcttaaactgaccttggaggagatgaccactaagatgggttaagccccaagatattgcatgattctatgggtagaatttggataagtggatgggagaagaaagggcatcctttgagaacaggcgcattattttaggaggcagtgatgcatgtggctgaggtggcaagtttgtgttggggaataatgggtattcagatgagttggttagggtagggaaggattacagagagtcatgaacattaggttcaggaatctggctctcagcctttagtaaatgggaacaataagcaggttcttgaatgcaaaaataactcaattaaagcagtagaaccaaaggcttaaagaagctgtgattccccaaaattgcataatacaattcttacacctaaaatatttcaaaaaattcacacgtatctaaaagaagataataacgttgcagtgcagatactgtgtgacgagttataggcactcacctcatcattataaccttgtgaactaagttcaaatctgtgcctcaaggaaattacaaatgattatatggtagggaaattttcttcctccttcctttcttcactttctttcagcaaatattcattaaatgcatatgagcatccatgaggcactgagaatctaatgcagagcaaaaagaatatagttcctacctttgtgaagtttacaggttggtggaagattatctattaaatcatcccacaaatacatccaaaactgctactctgaggagtgcgatgagaagagtttccagtagaacaatttggtttcatcaaaaatcaaaaccaaaatctaaaagaatcaggtgttagctagacaaaagaaccaatcaggattccaggaatagagaaagccaggcaagaagctatgtggcagcaaggaactggtaacgataacgataaaggactgaaaaaggatgtggaaaggtgccagatcagtatagtctttttttttttttttttttttttgagacggagtctcgctctgtcacccagcctggagtgcagtggtgcaatcttggctcactgaaaactccacctcccaggttcacgccattctcctgtctcagcctcctgagtagctgggactacaggcgcccgccaccacgcccagctaattttctgtatttttagtatagacggggtttcactgtgttaaccaggatggtctcgatctcctgacctcatgatccacctgtctcagcctcccaaaatgctgagattacaggcgtgagccactgtgcccagctagatcactacagtcttggaggccttgttgaagcagctccttttcctgtttcctaagagcagcaaaaagccattcaatgaatataaagaaacaggaatgaaatgattggatgtatttctttttaaatcactctgtctattcaggaagaatcaaaacatcaaataataaatcctcaggtatcaaagaaaatggaaagagcccagaggtaagtaacagggccaggcaaaaaaagatgagaatagccaagaagtgaaattgtgcatacctgaggaagggtactgaagagggaagaagtttggaaggcttattgttagagtggcatcacatgctgccaatcacttccatatttagctgtgcctttaaaaagtctgaacgaaaaactgacaatgatagcaaagattggttcaggtaagtatcatcaatagatgctaaatctgtgggagaaactttgagaaggagaaggattgcttatatggccttaaagtgtctctccccaaattgtgaatgagtaaatatacataaacagttgaacatcttaaccagatgatcaaaacaaacagcaccatgaggagaggatggactctgtgtgcctctggatgtggttacctgagcacaaatcatcactttcgtagcattgtcacttgaattgcataagctccacagaagcattaagaaacatcaatcaaatgttgcaaagagaaacacttttcttaaaggggaggactgtctcattcaaaaatgtcagtgccataaagacaaagaaagcctgaggaaatcttaaaggagactagagagacaggatgtagtagcttattattgctgctataacaaagtactacaaacttggtggcttaaagcagcacaaatttgttattttacagttctggaggtcagaagtttaaaataggtctgaataggctaataccaaggtattcattagggctgtgtttcttttggatgctgtaaaggaaaaatcattttctttgccttttccagctttcagaggccatgtgcgttccttggcttgtgaatccctcttccatctttgaagccagcagtgtaatattttcaaatctccctctctggctctgacactcctgcctcccttttataagaactcatgtaaatcagagtgggaccacctggataatccaaaataacttttccatctataaatccttaatttaattacatctgcaaagtcctttttgccatgtcaggtaatatattcccaaaacaaggcatctttgggagtcattatttacatggtatcaaaatgaaaattccaatcctagataggatcttatactgaaggaaaagaaatgcaaaaaacaaaaaacaaaaacaaaaacaaaaaagctaaattgaaatgcagacctagattaaagtactataattattgtaaaatgtgttgaagttgcaaatgtactgtgtttaggtaagaaaatatccttcacataggaaatacacactgaagtatttaagagtaaatggccatgtatgcatcagtatacaacttattcaagaagttcagaaacataataaaacacacatgcatacatagaaagaaagcaactgataaagcaaatgaggcagaatgttaaaaatacttgaaataggtgaatctggattaaacggcacatgggtgttctttaaatattcttgcaacgtttttgtaaatttaaaattatttgcaaataaaaaactaaaagaaaactgatgaatatatactttaagtaaaaattgaaaaacgaataagatccagtgttcagtagcaaaataggtggcacagttaataaaaatgtctgtttcaaaataactaaaagagtggaattggaatgttcctaacacaaagaaattgtaaagttgagctgatgaatattccagttactctgatttgatcattacacactgtatggttgcatcaaaatatcacgtgtaccccataaatatacacaactcttatgtatccataatagctaaaaataaaaaaatttttttaaaaatgaagatttttaaactcaaatattacaagcaacccacagtttatgtaaatgctatggaagttcaagtgaatgaaggtgtgtggcaacaattcagcaatgccatttttattctttctacaataacattaccagtaaatgtaaaagaccagaaatatccaggtattctttaaggttaggaagttaaaggaaatttcaacagtccggcaatataatagtttcaaagagtttaaaatagcattggtgattatcgttagatttaaatactaagtggttgatcacaccctgctatttgtgagacagaatctgctaggtaattttctaagaaggaccttggaaaagtgaactcccttttctaggagaatttagctgttttttaaaatgaaggcaaaataaaaataaaaataaaagtgtattctattctagagctttcttctgcccagtgcccatgggcagaattttattgctttggcaccagagaatctttttggcacccattcccactccaccctctattgtttaaagacaaaagataaggcagctgggactctgaccactcgcaaataatcagaggcctccccactgggaaactcctctggtcttcgcagaaacgaacatgtcaaaatgaaggtaaaacaaagggtgagacccctggttctgtccaatgctctaaacgtggccttgtttttcttgcccatggtggtggccaagaagaacagtgtttctccagttgtgccagtatagcatgccagaatcaatagtagatttttctcaattacagaaacaagcacaaaatatgtggcagtgaatcagctttattttcacaagcttggctcttgctatcacaagccgacattgaaatctatgatttagcatattctatgattataccagcacaaaaaattctatttagttgttttcagtttagcatttgtttttcaaagagcagcaggttatctttgggtgcttggcaatcacaatcctaaatgctgctgcagtcaggaaggatctggggtgggtctttattacctagaggcttcccttcaaacactttccctaagtgttgtaattatatagatcctcactttccgtaacccagggttaagagtctgatgacctacgggtttctttttaagactctgtcacgttctaattgtatagccttgggcaaaatacttttgcgctgtaaagctcaatatatcatttgtaaaataggaatcataatagctattttaccttcctcagagtttttctaatcagccaagaaaattaatatgtgaaatcattttgcaaatggaaaagtgttataaaaaggccacataatcccccctgcctgccttcccaattactaaactttttgaactaaagatcattgcctaattggtgtgtgtttgtttcttcaagtgtctgccaaagtgctggctcctggttagtttttcctaactaaatacttgcttagtaaccaaataataaaattaattaactttcaggctgctaataattttccatttctatttccagagaactccccctaactcaataggatagacattgacataggcttgaggataaatggttcaacatgaagatacatgttctaaggaattctaaaaaaaactttaggtagttcatgctaaaatgcttactaataaaaagaaatgtagctttgacattctcttgaaatgacagccttgtagtctttgaaatgcattttaagcacaagcacataatgatgtgtttaaattggtaacaactttgatggactgatccacaaaaattggtcaaaacctacacaaagtagatgtttaataagttttggtagattatggaaagatgagagttgtagagaagagagtaactcaaatggttttaaatttactcaagaaacacagtacagtagttgaaatgagtcaacataaaacaacttgtcaaagcatgttgaaagatataagcgaacttcaaagtatagaagcttaacataaaattattaaatattcaaaaagttccatgtcttatgtatgggtgcatacactgcagtaaacatataagagaatgctcctcctgctctacataacactagtgaatgctgtccacattacaagccctgaaagcacacattggaatgaaaaagtccagctcagaataagtgttaccactaagagacaaactggggattaatgaagacagagaaggagcatacatagggcattagttacatttgtaatgtttcattattaaaaatatatttgaagcaaatattgcacaatggtaaggtttgataagctctgtgataggtatacagatattacattattctctatgcttgaaatatttcttaatgtatgaattctgatactgtgtaatgagaaaaataattaaaatttcttggtttcagcaacagagtagtacttataatagtaaacacatacacttgttgtaaggttctaagaatctattgcactgctagtaaatcaaattgtgctttcaaattaaacaagtgaggtaggtcagctatgaaaaagaatttacataaacttacactgaagtccttttttagggggatgcttaaggaaaatgagaaaatctgtggctaggtctaaagaagataatcgtatttactttggaagtacagatggccctctgtatccacggattcaaccaaccaaagatggaaaatattcaaacaataagaaaacataaagcaaattttaaaagcagagcataacaatgatttatgtaatataggcattatattcagtattagaattaatttagaattaatttagaaataatttaatttagttccaaattcctggaactaaactcctggaacacacaggagttccagtgtgccttccatggtgaaaaataaaaatttaaaaataaagtatacagaagaatgtgcataggttatatgcaaatactatgccattcatagaaatgacttgagcatcctaggatttgggtatcctgatggtggagtgagtggggaggatggagggtcggaaggtgtcctggaaccaatttcctaaggatagtgaagaacaactatacaggtctaggatatatgtgctgaaatgatcactgataaagtttaacagttgcttaagagggggaaaaaaaagcctgcaagtcaaattccaaagataaattcttcaaatcctgacaataagcaagctcctaaatagcagctagtgtactatctcaatatgaatgatcccatttcttctatgagctactaaaatgaaactcagaaatgtagtttacataccaaaacatccatcccggggacatatttgagggttatcatgtagtcttttggaagatttgccacctacagagacaaaaaaaaaaattccataagaaaattcttatacatcaattaatcatatttgtagtgctttggagaaaagcacacaaaactgttgtgctttttaaagttaccaatgaatttcaatatttacatgtatattgatttttaatccttgatttccctctgtaatcaaaaggcatccttcaaaataaaaaagtgataatacagatcttttagactccaaattcagttatgcctggctaggtataacctactgagttttggaaacatgatctgaatttcagcttccacctgtgatcttggaattcccctcaaggactattttcctacttgttcctccataggattaatcataaaatacatgctttttatgtcagtggttctcaaaatgtggacctcaaagtgatgtgccagcaatagggaatctgtcagaaatgcatattctcaggccataccagagctactgaatcttacttaacaagtcctccaggtgattccgatgtgcacccaaatttgagaactattttatgttgaacctaaaaaatgatcagtgaaacttcaaaaaaacaatgctacttatgagatgcaaatgctttataagaaataatttagaaagattcattttgtgatgtaacttaattctcttaccttcggctgaacatttgagaagtctcaaatatttgcctaggttcttttgaaggctttaaataacgtctgacttacttacatcagtcattctggcataagtgaataagcaataggtttaggacaaaggaatctgggacaaatctaaactctgtatgttggttcctctcatttatacaatgaagatcaagatacctatgtcaaatggtcatttagaattaagacagatgaatgtgccaaacacattataaacactcaatccatgttctttactgagagctataccggcaactgactttggaggcatataaccctagtaagttacagagttctaggttctcttccttcctacacactgtaccaactttgctgtccgcaaccttctcttatgtcaccattaaaattcccagatgaataatttagccaacaactgacttagaccattgggtattaagataacatatattaaaaagtagttttgcaccattacatcttcaagggtctatcttgctttgtagacttattttttccttcaccttgtctctaaaaactttatcttccttatagaaagctaagatcatgtgcatgtttgctagactaggtcatctcgcacaagtttaccataacattttctgtatgattctgcttggtcttgtcaatagcttctagaatctgagaacaatttattgataaatgaatttaggcatgggcataagtagtcacatgggagctaagatagtaactgatctcatggtgcttactaccatcctacttccagtaatgccacctgacactcatttcagctctgaactgaggcacttagtatggttcctcttccctaagttcacataatcataaaatagtaacagtgtctaacacgtatcaaatatttactatgtgctaggcactgtgctcactatgggcttgggctgcattattacaatttatcctcagatcccgctgacatattacctctatttaacagatgaagaaactgaggctagaaggggtcaagtgccttgactaaggtcacacagccatcacatgttaagtctagactagaactcaggtccctggagagaagagcctcccttgtctcttagctccactacatattttcacactctacaccctctgggcacttgttctgggtattttccacttgtgaatcttcaccatcaaccttcttcataccaccctaaataaaatattagaatcattgctgctttttttttctttttttggtacagagtctcactctgtcacccaggctggagtgcagtagcacaatcctggctcactccaacctccacctcctgggcttaaggaatcctcgcatgtgtcagcctctgggattacaggcacgcaccactacacctggctaatttttgtatttttagcagagacggggttttgctatgttggccagtctggtctcaaactcctggcctcaagtgatctgcctgccttggcctcccaaaatgctgggattacagtcatgagccaccgtgtccattccattgctgcttattgaaaacacacctgagctgccagacatgacggcatttttgttcatttatttttggcgttaactcccttattctttacacttaactttcttcctctcaaactttccaccaagcttccataatttcttttctcttcttaatcttcatcctcatctttgaaaggaaaaagcgtctagtcattttatgtaaaccctagtgacaaagacagagcagacctgttgcagatgtgaaagcgataagtaagcagcaatattctatctcattttgaataaaccaggtaaattaaaggcattccagatagaaaaacgcagcaagaagtggcaggtattctgaacacaagctgcttaacaatccagccctttcttaagcataatttatattattttaaaaatacaaaaatacaatcaactagattagtatttagaaagtgtgggatctgagtatatgtctaaaaagcaaagaaaatgtaaagagtatggtgaccaattccatttcatgaataatttatatacaaatattggttcaaagaaggcttataggaagttccctgataaaaacactgaaatctacattctaccactggtggtagggcagtgtataataataaagtaatttattcgttaagctgatttactgatattcaatttctggtgagactgaaaaataatactgtttttgaaacgtgctttataatttaaaacaagttttcatatacagtctctaccacaaccccatgagagattatattaagcttattttacaaatgaggtcatggaaactcagagaggttaaccggtatccccaaggtacacgcattaggagtaactggtgcaggtaggatgcaaaccctggctttgtgtgctggggctcagcacatctacctatagcgcagtatcccattattacgtccttggttttcattggtttccttctaattacatttggaagagaacttagaaagtcaagttgtagatatttgtggtcgcttaataaattattgtgttaatattactttctaagcatttatacagattgaacatctctaatctgaaatctaaaataaagctacatgcatacaagccatgtcatctttgacagagtcaacaaacatacacaatagggaaaggactccctattcaataaatggtgctgggataactggctagctatatgcagaagaatggaactagacccctactattcaacacatacaaaaattaactcaaaaggaattaaagattaaaatgtaaggccccacactgtaaaaatgctggaagaaaacttagtaaacaccattctggacattggccttggggaataatttatgactaagtcctcaaaagcaattccaacagaaacaaaaaatgacaattgggagctaattaaactaaagagctactacacagcaaaagaaactactaacagagtaaatagacaacctacagaatgggggaaaatatttgtaaactatgcatccaacaaagatctaatatccagaatctataaggaacttaaacaattcaacaagcaaaaaataaccccataaacaacaagtaagcaaaagacacagacatttctcaaaagaagatatgcaaggggccaagaaacatatgaaaaattgcttaacctcactaatcaacagagaaatgcaaatcaaaaccacaataagacaccatctcataggggttagaatggctgtcatgttggtgggagtgtaaattagttcaaccattgtggaagatagtgtagcgattcctcaaggatctagaaccagaaataccatttgacccagcgatcccattactgggtatatacacaaaggattataaatcattctactataaagacacattcacacgtatgtttattgcggcactattcacaatagcaaagacttggaaccaacccaaatgtccatcagtgatagactggataaagaaaatgtggcacatatacagcatggaataatatgcagccataaaaaggatgagttcatgtcctttgcagagacatggatgaagctggaaacaatcattctcagtaaactaacacaacaacagaaaaccaaacaccacatgttctcactcataagtgggagttgaacaatgagaacacatggacacagggagggaaacatcacacaccagggcctgttgggtattggggggctaggcgaaggatagcactaggagaaatacctaatgtaggtgaggggttgatggctgcagcaaaccaccatggcacgtgtatacctatgtaacaaactgcacgttctgcacttgtaccccagaacttaaagtataatttaaaaaaatgtcaaaaaacaacagatgctggtgtggctgcagagaaaagggaatgcatatacactgttcagccactgtggaaagaaatttggggatttctcaaagaattcagaactaccattcaacccagcaatcccattgctgggtgtatatccaaaataagtccttctaccaaataaacccatgcatttgtacgttcatcacagtactattcgcaatagaaagacatggaatcgacctatgtgcctatcaacaatggactgaataaagacaatgtgatacatatacaccatggaatactatgcagccacaaaaaaaaacaataaaatcatgtctttcgcaggaatatggatgcagctggaggccatcattgtcagtgaattaacacaggaacagaaaaccaaatattgcatgttctcacttacaagtggggactaaacactgcatactcatggaaataaagatggcaacaatagataccagggacaactagataggaagcaggaagacagggttaaaaaaactacctattgggtaccatgttcactacctgggtgatgggatcaatcataccccaaacctcagcatcatacaatatacccaagtaataaaccttcaaatgtagctgctgaatcaaaaataatagttgaaagtatattaaaaagaaaaaaccacaaatattctaaaatctgaaaaaaaaaaatgaaatctgaaacacttttggtcccaagcattttgggtaggaaatattcaaccccgtagtatattgactcaccttccagaaagcacagataaccatgaaataaattctgcttctctgatatatatcactgtggaaagtttcacagagtagagggagcctatggcctgcaacttggaaaatactccttagaggcagtgaatttaatgtatggattaatagcacaggttctggagacagaccactcaggttggatcctggccctgaaacctactaactcagaagtcttgggcaagtcacttcatctacttcagcctaaatttttacatgtgtcacatgggaatcatatagaatctagctgatggatttataaggataaaataactcatataaaatactaagtgcttagttaggcatggtatgtgaatgagtatgaatttctattaatactaaatgcgagggagtgggacagtctagatagaggaagggtcttatgcaaaggcaaagaaatgggaaagctcataatgtgttagggagaccagttaagagataagaaatattccaggaaaactgcctttgagagagaccctccaaatgttgagctagggaggtcaaatggtaggtagtaaggtacagtaggaacagttctaccatcagaactccacagcaagttgcttctgcttagacacatagcatcatctctgtggaagttctactccttgtctgtaagataaagagggcaaactagataatttctataaattcagtctggtttgacttacttacgtaagtggtgatgcaacactgaatgtgtttcagcagagaaggaacctggtagtaaaataccaagattagtatgggaagacagtttggagcaaagagaaaacagagacagacaaaagattagaagaccactaggaatttgaatatacattaaatgtttacatgcaaactggaaactagaaaagcaggaaccaggtctagagtccagggagtattccctattggtagggttaagtggataagtaaccaaggctacgtattttaaaaaacaaatctgttctactaaagaaattcatggcaaaaaaaaattaattgacggaaaattttaccaaaggccaactcattctaatgagctctggtttggagtgcaaggatgtcaatactatgccagattgtaaaataaaaaactgcaaaaacaagttactggatgatgagctaactgtgctaggtgggaaccatttactgtcttctttggatgtcttaatgattgaccatgtccagtgacactggaaaaacatccatgggagaacagcatttggaaatgctggagacttggccaacaagaagtctttgcaagccaaactggcactggctgcataccacaccctgcaggtatttggactcagaagaaaaataactcaaagtcagaacacttaacttcctctctagatcactgatctaaaaacctttggatctcatggttcaagggtcactgaggtccctaaatctcatgagatcagtggccaccttggacatctttgcaagacccttacttgttatgctgtctctcccaagtccaaggcaggaatcaaaattcattagttatctatgactcccttgacacttttacaaaatgctgtgcctatgtcaacttttctggggaaagagtctatgattttcagacctagcaaagtttaataatcatggctgtagaggaaaaaagctctacacttctatcatcgttcactcaggtacagtagcttactatgttagttgttcaaccttcagaaataacaccccccaaaaaagctttttgcttctttgtttctcctaaaaaattatctaccactaatattgactaaaaatctaaccaaccaggtgtattacctatagttttcaaatgtaactggacttttttaaaatggtaactcaattagtgattaaaaataaattggcagggcacagtggttcatacctgtaatcctactgctttaagaagccaaggtgagaggattgcttaaagccaggagtttgagaccagacttggcaacaaagtgagagtccatctcaagaaaaaaatttaaaaaattagtcaggtatggtggcaactactctggagtcccagctactagagaggctgaggcaggaggatcacttgagcccaggagtttgaggctccagtgagccatgattgcaccactgtaccccagactgggtgatagacaccctgtctcaaaaaaaaattaagatgacaacttcaggaggcttttcaaggtcatcgttcctcagtaaagaatatctaaataaagatagataacaattttttctttcaaatagaagagattataaactacaatatttagggagtgtataatacctcatgatgatgacataccttatgatgatgacacaccttatgatgatgattccaattaagtaactaactgagcttctacaatatgatagcttcctaatcacagtaagataaggtgactactattcaggaaataaaattcagtaggttacaatgataattcattaattgtagttgaaacttacatcttaaactactgggaaggcattataaattatgaactgcattactgtgcctcaatgataggtagttaaggggtcaaacctctactcaactatttcccaagtgatgataatcagattactaaataccactagatctcagctttctaaccaatatactgggctaaaaatagttatcttgtaaggttatgaaaagtaaaggagacaatccatgcaaagtgtttctgcatggtgtctgtgtactcataactattgttctaaaaaaccaaggagcaggctgcacatggtggcttacacctgtaatcccagaattttgagaggcagaggtgggaggatctcttggggccaggagtttgagaccagcctgggcaacataatgggacccacatctctacaaaagataaaaataaaaattcaatgagcagaagacatattatccaagtagtttattctataaaggaagaacaatgttttcctaacaataagactcatatgcttgataatatagcaatctatctagagttttaataaatattatttctaatagtcctttttttaaaatacaaaatgtcctaaatttagctttaaatagagaaagaattttctgctgaccacaggagcagaaattaaaatgctaaatattgcaacctaataaaataaaatttgaaaactatctttcaaactattatttttcgaaggtcaaacaaaattatgtgaaatcttcactattaatgatatacctaggtcatctgaagaaaagcttagaattcatccagaaatggggacattcagagactccaattcttcactttaatgcagtggtaattctacttgagaacaataatatttgaagaagaaaaataatcagaattaatcaaaactgtctattcaaagtgtgaaaatgtgttatctgaggatatttttataatctctcattacgataatctccatgaatcatgtataaatatagccaacttgaaataagtgcctatcacaagaccaggaagacaatagattcctttgttctaatgctatcttactaatttgtagactgaccttgaaaagacagagtaatttcacctttacgagatggagatgggaccttaagaaacattttgaggaagacaagtcattacccaatagaaagttaaagacaaaacattttttctttttagcaacaaaatcatattgagttaaattgcctcaaatgaagaaacaaagtcgtcacaaacaaagagaagagtagggagaatacacagagaaaactagtttgaactttttcaatatctggatttccttcctatatgaacaattacaactactaaaatctgcaacctaactatcccatagatacaagttataaaagcttgattcatcctcttcccagatacttgaccctttctttaggtaagtctgagtttgccatttaaaacaaatgttgcaacatttttttagaaacaaagcaaaatgttctgtaaatagatgaactattatgcttagtaaacaggccagaagcatttcgaataaaaaccacggggaccgtgggggcagtacaaagtgttcaagaagaaattaaaaaaaaaatttgacattaaagtcataaatcatgggcttctgtgacatgagaatcacttcaagcaaaaaaacttcaagtgtgtgggcacagtgcaggttgccacctaatgcaaagatgaaactggtaggggctgcaaaggaatgatttccattgaaggaataactgtgagcacaggcaaaaatggactgtcaggccactttctttccctcacataaaatgtagcaaggttatgtctgcaaagcaaattcctctcatcctatataacctccttcagtcgagttattattgaattattccaagaggtgcaacctgaaaaaaacatcattatggaataaaataatttcaaagctgaaaaaggcctccaagtttctctaatttagtagttcttatcttctttggggtcttagatttctctgagaaatgataaaagctacacactctcctcagaaatgaacataaggcatatgaaggcagcacaattctgagcttcatgtgtaagcatttgaagtttgtcagccctagattaataactattgatcatgtccatgttcctcatttgaaaaattaggaaattgaatgccagaaagattcagtgatttgtccaaggccacacagccaggtaatagtggagctggtattaaaaaaacctagtattcccgacttccttcaagatgctctgccccaccatgtatagagaaaggctgtgattatctacatccataaatctcaacagtcactcatgttgctgtttgaataaatgaaattagtaagttaggataggaacactccacttcttttcaaacattaaaatacacacacacacatgcacacacacacacacactctataaacattatggcctaagcagtcctgatacttctacataaataacttttatgtagatgctagttggaaacattagggttctcacaccccatctccacaagttgagattcggtatagtgatgcccttagagctgtaccttaaataagtccctgagagactgtgatctgctggttctaaagtagtgacctactttaaacatattttggagatttgtattaatctggcatccttataagtctatacaacacagatgataactagtcataataggaattgagattaaataagagtcaagacattttggtttctaaacaatgacagaagagaccatctagagcaattgctcttaagcctcctttcagaattttgttaaaaatatagatgtttggatccctttttcagacttaccaaagtagtttcttggtgtagtcccaggcacctgtaatttttattattattattatactttaagttctagggtacatgtgcacaacgtgcaggtttgttacataggtatacatgtatcatgttgctttgctgcacccatcagctcgtcatttacattaggtatttctccaaacgctatccctcttccaggcccccaccccccaacaggccccagtgtgtaatgttcccctccctgtgtccttgtgttctcattgttcaactcccacttatgagtgagaacatgcggtgtttggttttctgttcttgtgatattttgctgagaataattgtttccagcttcatccatgtcccttcaaaggacatgaactcatctttttttatggctgcatagtattccatggtgtatatttgtgaaattttctttatccagtcttctattattgatggacatttgggttggttccaagtctttgctattgtgaatagaggtacccataattttcatcagcatgacaggtgattgtgatgctcactaaagtaaagcacatcatttcctcttcttcactcacccagcaaacatttaatgaacatcatctactttgctttccccgcccttctcatatcaccattaaaattcccagatgaaaaatttagccaacaactgacttagaccattgggtattaagataacatacattaaaaagtagttttgcaccattacatcttcaagggtctatcttgctttgtagacttatttttttccttcatcttgtctctaaaaactttatcttccttatagaaagctaagatcatgtgcatgtttgctagactaggtcatctcgcacaagtttactataacattttctgtatgatcctgcttggtcttgtcaatagcttctagaatctgagaacaatttattgataaatgaatttaggcatgggcgtaagtagtcagatgggagctaagatagtgactgatctcatggtgcttactaccatcctacttccagtaatgccacctgacactcatttcagctctgaactgaggcacttagtatggttcctcttccctaagttcacataatcataaaatagtaacagtgtctaacactgtttactatgtgctgtgtgtcaaatatttactatgtgctaggcactgtgctcactatgggcttaggctgcattattacaatttatcctcagatcccgctgacatattatctctatttaacagatgaagaaactgaggctagaaggggtcaagtgccttgactaaggtcacacagccatcacatgttaagtctagactagaatccaggtcattcacaaaagttagattttaaacacatactgtccttttagtattgtttcttgggtcacaaactaacaagcaactcaaggaaaaaaaacatgatctatttttaaacagtatgtttttaaaaaaaaaaaagtactcccccctcacccccatccctatacacaatagctaactgggtatatagcagacaactcttgcatggctttgctcacagttccctcaagtaagacatactgatacatctgctgctgctgcatggaagaatgcttttaaacctgaactctctgggtcctaaggaatttgtataaattgtgtctgtgtgtttctaattctatattgaggctaagctagcaagacttcaacagtggccttaaacttctgttttgaagttctattataaacccaaaataagacatatacaccagaaaatatatatcaagaggagggaagataaatagagccccttctactccttatcccagtacctcaaaaaataaacttttcatccttttctccatatcacaaccctcatttcttacctattctcgcatcacctccgttctctagtcagtatttaaataactaggaatttaaaaattgcttctcaagctttgttcatcccgaaatcatacatggttcaaaaaagcatgtaagatctcccctagatcgtgacggttgggaaggatgcattccagatgtgttatgcccactctgtggcttgatcttgagagaaagcatctggagaagcatagcatggagctggcagtgacttggggaagcaatgcaaatgctttcgctgagggaagagttcaatgtgacaaaccagggagatgagtcccttcaacatgtgggcaatgaatcacctctctatgttccctgaaggagcaaacacccactgacatgtgacagggtcttcctgctgattgaattgggagaatagccatttcagatttcctttcgttagactttttaaagaagagtaggaagacatgtgaaggggaatagaacatgctgggaaacccactggagagattatggggaacaagctggggcaagcccatcagcacacagcgaactctccaaggtccttcactgcctatgaaggatggggagaagaccagcaaagaagcagtcacagcagtggtgtgcaactagccagttttaccaacaaattatccatgaccctaaatatctcactacctgctttctataaaccctttattgtaacccagtgattactttccccactttaggaaaacattactttggggcaagaaaaatctaaatcttttatcaacaagcacaggaaaaagagccacagctcttttttacacagcacggtaaagcattccttacttaccaatttagtgacgtcttttacattattagtcacacgattcctgcagatcccttcagttttgacgagaggattaaataggagcagctgaagataaatgcaagtgagaatccaagtctaaatgaaaacagaaaaattgcttggtgatcatcagttaagatctgtaatcattcaaacttttaacatctaatgccttgatgcacaaaaagaccagtctaatatatgttattggcttaaatgcaattaaatattacgcattcaagctatgctcaccaaagtttttaaaagcttttagttaaaatccattttgaattattctctcaatgacaatattgttaacttttgttaaaaactttcttcagccaatttcccaatggcaattaggaataaacttgtagcagcatgttaaagacttagcccttagggtatcttctaaaaactagagaatgcataaaatgtataccttatggcaccaaaagaaacatcttatttctactttaaatgtagactgcttggcaagaagcagcataatccctgagcagtgctttaatccaataatctacaatagcacaccaagttaaagtgagagagatgtatatttttagacctaagagaattccactgaatttgtgagacatcaaaagaatattttgaaacacagctttttagccacttaaggaaaatatttccttagccaacaggaaggcattcttgaaccctagcagaaagtaatctgtcttctctctctctctctcgaacacacataacctacacatcggcttgaaaataacattttctattatgtattatagttgcttttatgcatgacttatttttccttattacactgtagagtttcaagaacttgtgcaactgatttatctttgtagtatcttcacaacacataacacagtgtcttgcatataaaaagtcctgaataaatatttgctgggtcaatcagtggtcaaggtaaaaatatatcctgatgctcaaattcaataaccatttattgaatatatattatgcaacaggaacaacgccagtcactagggtaacaaagatgttgaagatgcccttgaaactcagaggcaggtaaataaataacactcacatcttgtgataaacactttcggaacacagaagaggaagcaattaatcaattaaccttaagggggagaaccagttgcaggaagacagtgccaagaaaagccagaaagaaaatgtgactgtggctggatttaggaggacaaggaggacttgcaagggctgacaaagaaaagatgaacgttccaggaaaaataaacagcatgacaaaaccatgcagatgtgaagacatcttaaaatatgtgcacattcttttatgagataccattcttctgtaaaatcttaaaattacacaagagtccagatgcacatggctagaaatcttctctatttacatagctagccatattaaaaaggaactggattattattttcaattaatatctgcatgctaactagatattatactagaacaaataatgattattatttgctaaaatttctaaaactacaatgctaattacatggatatagtggtttgtattcaagattgaaatccttttattcccttaccaccatggtctattttagcagtaatcctgcataattttatttaaggctacttctagcattgtggggtcacactcttcatagtatcatctttcttggaccacagtgaagactaagttgtataaattatttctgtttgaggattcttctttttggacagacaacccctacatacaaactgtcccttaataacagtcttccttcacatgtgtaaatataatttattaaagtcagctttcttttatattgtcattgctaagacgtaacctccctggaaatatatttctctaaacccctctttctgatgtgatttgggaactttctctaaggatctctgtaatggaccaatctcagaaatgaccataatcatatcctttgctcaaagaaatgtaatggcagaaattctgttactggtcttcgcaatcctttacgcctggcattgaataaatactaaagaaacgtttgttttctcattcatctaacaagtatttattgagtatctggtgtataccaggcattgtcctaggtgctaggcctatataatgaacaaaattcctgccctcataaggcttaatcaacaaacataagtaactaggttatacagtatgtcaaaaggtgtcaaaagctatgggaaaaataagattagagcaaggtaaaggggattgggatcataatgtctactctgccttactggtgatcttgggttcagagtgacaatcacagtcatgagtcaccatgtgtactgctttgcccagcaccaaggctttgcccagcaccaagtgtactgctgagttttaagaaaggttaggttggccgggcgtggtggctcatgcctgtaatcccagcactttaggaggccgaggtgggcggatcacgaggtcaggagatcgagaccagcctggccaacatggtgaatccccatctctactaaaaatacaaaaattagctgggtgtggcagtgcatgcctgtaatcccaggtactcgggaggctgaggcaggagaatcgtttgaacccgtgaggcggaggttgcagtgagccaagattgcgccactgcactctagcctggcgacaaaagctagactacatcaccaaaaaaaaaaaaagttagataacaaaagagtacatacagcacaagcagagcagactcccaggccatctctaatatcagaaagtcactgaacactcaagatacgtgtggcaatgataggtgatgttgggtaggtagaatcattccttctgcttataccttgctagctgagcagctttttagggatatggcatgaacttctattcattttctagagcagctacccccaccagtaccagtctcaacaataaaatattaatacatatcagtgcatgacatatgcttgtaataaagcacacatcagtgcctgctacctagtaacttcagctgaattcccttggaggaagtatagatgtacacctaaaagtttcttgagtccttgttgaaagaagacttatagggagggtcaaatcaccaggcatctctgagtctcgagaagagccatagaactaactgtactcttttctttccagagattgcagtatgggtggaaacagcttgaaatttttaacagggtaatattgataagtgtctcattaagaagacaaaatttcaccaaagattggacaaagctaaggcagtgatccacgcagacatctgtgggaagagtactgcatacagagagaaaagctggtgccaaggtcctaaggtctatttaaggcatctgttatttaagacatagcaagagtaaattagggagcagtagaagatgatgatgtcagagagacaatggagaggacagctcatgtagggcgttgaagcctattgcccagacattgactcttacttgaataaaataggattcattgcaagattttgagcagaggagggatatatacttcagaataaaaataaattaattaaataagatcagtctgattgctataataaaaatagactttagggtgacaacaggtagaaaatgaaaccgacaagttgggaggttgctgctgtaatccaatcaagaaagggttatagtaatacattgactgaaagtggttagattctggacatcttctgaaggctgaaccatgagaatttcctgacagagtacgatttgagagaaagagtcaaagatgactataagaactttggtatggaaagatggtgttgccatcaactgatatggggaagactgggggtagagaaggtttgggaggcagatcaggagttaaattttgagtatgttaagtttaagatgtctttgagatattctagtgataatgccaggtcaagatatttaaatctggacttaggagggaaacttggggtgcagatataaatatgataaccttccatatataagcaaatgagtggatgagatcaccaagggagtgagtaaaagtataaaaaagaacaaagaactgcgcatgctatggtgttctaaccttaagggatctgacagaagagtgagaacccacaaaagagtccaagagagcaaagcaaaaagatcatggaaggaagccaagactttaaaaaagtactttaaggaaaatagggtcaaactatgtcaaatgccagttataggccgagtaagataaggactgataactgaccactggtttggcaacattaaggtcactggtaatattaacaagagcagttttattgaagtggtatgggaaaaagccagtctacagtgggttttagaaagcaggagatgagattaaccagaaacagtgagtatgaacagctgttttgaagagttttccttcaaaggagagcaactggataaacaaacacataaataaataaaaccaagatggggaagtagctggcaagaaattgggggtgaagagagttttatttgtaagaaggttgaaataccagaatgagtgtatgcctatgggaatgatccagtaggaggaagcaattggcaatataggtcagaagagaggggactgcttgggcaacagccttgagcaggaaagaaggggtgagattcagttctcaagtaggaagtgtggctttaaataggagtataggtagttcaatgctatcaggcagagcgctggaatgtgaatgcagatgctggttgtgttttgggaacaattccatgaatagagctaaaagttactgaacatttactatacaccaagcatcttggatatctaataaggaaaaaaataactttcatatatcctaattttaaagatgaaggagttgaggtacagggaggtttggtgacttctgagtggtgaaatcagtaagcccaggtctgtccaattctaactcctgtccttttagcccctctacactgtcccagaactcctgcaaatctgttagatggtttgtgagaactgtgatgcgatagcagatctctaaaactttaatacttttgcaaatatcaagcatatggagacaagtctgttccatattccatgccacagctgaatagtctatattattcaagtcatcataatttttaatatatgtcctttgatagttccttaaaatatatcaacacagactgctataataattgaagaatgatttgatcagggcaacataaattttttttgcatcagttaaattcaaatatcttacaaagacacagttttgttcattttgtaaaaatccactgggtcaatgctaaaattaaatctatgttagcttatgaacattcaaatatctctgaaaaacctatatttcttaaagccctttattttaaagccattataaataaattcatattgtaatttaattttgcatatactttgctaccattaaaaatatccacctttcataaaattaaagaattcattctggcatagctaaacattaggacagggagataatcaagttagaaatattgagatttttgccaagcagtaatgacacctccttcatcagtatactcaggagagagctgaaatgcagagcttacttctttatataaaaaagaaacttttcagtattaacttttctacacagaagtctttctaatattgtacacacactttgatttcttaaacagtgaattgaaatattaaactttgcttttctgtgacggttcaggttcatcaaataaaaggaagactttcaaagtatctcagttatgtagttgtagcttcccttctccaagtggttccaaattactgtacttgtttgtataacttttaaaaatttattttaggtttcatttgtttgttccttagttttcctgtttcccccagattgtcaggtcattacttgcaacatattgttactgctaacatgcctatttctagtctcctgcactcttgatgatgaacacaacatgtgtcccatatgggagcttacagcaggaagtataatggccccaaagatgtccatgtcctaattcttggaacttgtgaatacatcaccacacatggcaaaatggactttccagacatgattacgttaagaactagagatgaagagactatcctagattccctgggtccaatctaatccccatggtccttaaaaatggagactattttccagctctgttcagagagaggtgcgatgatggaagaagggtcggggaaatgtgacctgaaaaggactcaacatgtccttgctggcattgaaaatagagagaagggaccaagagtcaagaaatgtaggcagcttctagaagctgcaaaagagaaagaaatagattctcccctagagcctttggaaagcaacatagtccaactgatactttgatgtaagtgagccttattttgaacatttgatcttcaaaattatgataattttttttttttttttttgacagagtctctctctgttgctcaggctgggatgcagtggtgcaatctcggctcactgcaacctccgcctcccagattcaagtgattctcctgcctcagcctcccaagtagctgggattataggtgcctgccaccatggctggcctttttcttttctttttttttttgtatttttggtagagacagagtttcaccatgttggccaggctggtcttgaactcctgagctcaggtaatccacccacttcagcctcccaaaatgctgagattacaggtatgagccactgcacccggccagtcactaaatttttggtaatttattacagcagcaatagaaaaataaaacacagctcaattgaaatacttttggaatgaatgaatgaatgaaaggtgtagtgtagtgatggtcaagctattccaaatgaggaaagtgaattgcctctgccagaattattggcccgcaccctttattttaagcagagcagctcagctttttttgttgttttatttgttcatgcctctgagtaagattctgtttaaacaaaggtttccaagggcaagaagaaattaaaaaaaaaaaacgcttttggaaaccatgggcagaacatggatccagaaaacctctcagtcccttcccatgtgacttcaaacaagtcagctaatctccctgagtatccatttatcagcctataaaatgatagtaaaaataatttttgccttacccatctcatgaactagtagtaagaatcaaatgagaaactattcaaactatgggtgttatgcaattatttgttgtgtggtttatgggctttgcatcggctaggaaaccagaagacaagtacttcaaaaatgtttgagtaaaactttctgagaaaagactttatagagtagatctcccatatacaaagagtatgacctttagcacatgaatattttgacactgactttgagttcacacacctttttcatttatttcttagttctgaactgtgtttagagtagcttcagttaacagacaactgacttccaattaaatgacatgttccaatatatcaacaaaatatttatctttgttttctcttcctcttcttccaatttctggaaactctgagggaatagggtgcctaaatatgtgggtgtgcacacacgctcacacacaccctaatggagatacactgaagcaaaatgtccctgtgtttgtgacttctgctctaaaatgtatcttttcagtttgggtaatcatctattttttttttctgttaacattctctgcagctgtatatgacatttttctttggctactttgttttatcattgtacaacttttctctctaggtcaagctcattgtgtgataacccctcatttctggatagtctttcattgtatagacacatatcgtcctgggtagttctcgatttttgttttcagaaacatgcatcaaaagtgtcccccgtttattcccccacaacacacaaaattccaataatcctttcattgctaaatgttgccttcaaatcatttacatgattaggaaaaaaaataatgagaaatctgtgtgcactgttacaaccaaggcatgcagtagaaacagttctggtagagggaagtaatactgactaaaatttatgttaacatcagtgacagatgtggctggtccttttctgggagcagacagtagcagacagtactagaaaagtactttaaagaagtctggggtgggagggatttacaagaagatgaggttgaagacctcaaaggcaaaggtcttgcttaattttcatttttgttgagaacaaacatcagcagactccagtggactattcactcaataaccaatccctcctgaacacagagctttccttacagtaaaaggccacatgccaggaaaaggagctacaaacacccaaaacaaaccatggacttaatctgaacgtgtgttgcaacacataagtcacactgcagattcctttccttcagtagaaattaaaatgcatgcagcctaagaatatcagggggacatatgctgttcaagaaaccagaagataccaatcctctaaacttggaaaaacaaaaaaataaaatacagaaaaaaagcctttttttctctatgaatatgagaagtgattttaaaatatgcattgtcagggtccatattacagacgtcacaaagtcaaaaagagagttaagtgtttgtgtagctcattttctttatgcacagacctacgaaatggtattagagctgccctgaacaaaacagcagctgctgccaaaaacaacattcatcttctctttaatcctgcataccagctattgaagcaggcagttcccttgtagcccaaatgtattttggaagagagccaactggctcaactacccaaagacaggaaagcaagttaccaagatacaggtatggtaattggtcctgagttcaggtcttcttaactcatatgaaccatatcttccaaaaataatctatgtaaaccaacaacaggatcctcatttggtgaataaccattcagttctatatgacttcttttttcagatctttttaattgcttaaaaatttaccattaaacattataaggaaaatacctaatcatcttacacagactaaaattcttctctaagcactgttaagtaatcttaaagggacaactgaaacatttagtagatttgttagtttttgaaacttaactactatcaataaaacagatgttaccagagtaactaattgaaactcagaccaacttggagtccaaattggtgggtgccaaaatcttgtaaagatactcttctaacttcccttttgtgaagaagtaagctaaaaatgttttaaaatatgggtgatcattaaaatatgtaatgaatatgctcttataacaaaaaaaaactagaaagaagttgcttaatatgaaaaggcagacaatgtaatataataagggaatttaatgtaacgggaatttaaagatttcaaggtattcaatgcatgagaaaaatttggggaaattcaccctttaataatcagtcctcgttctacatgtaaatactacttaaagtggaaataactcaaaatatattgacttctaaggggctgtgcataggacaagcagtttgcagatattatttcctgtaatcctcccatcaaccaggtagatattattaccctactctgcaggtgagcaaaacacaattcgggagagattaggtaacttccttatggccactttgctaggaaattgctggattggatataaaccaaaacctacactatctatgctggaaagaaaaatactaggccagttagataataaaactgacttcatttatatttaatgaactactaaattttattttaaagggtcatgttacagaaggcatataggtctctttaactcaatcagtttcaaattgaaattacatgtcaagttattaccaggttgaataaatgagtcgagcaggtaaatcaagttacacttagctatagcttaaacaaaaatttacatagctagagggaggggagaaacccaaaaaataaagcgataagttgtttcttcttataaaaacaaaattgggtgctttcagacttctagtaacattatcccaggggccacttcttcatttaacagacatgtatggagtatctaataaatacataagataaagacagaaagactatgatcactggcctcaggaagctcaagctactagagaacacagcacagtggtgggagtcagagagaaaaggcccagcccctccctcaactgccccctgccccaagtacagctaaacctgacttggggaggggggcatttgggggacaggggcatttgagggaggggctgatagtttctggggggagaagcttctccaaaggtgatcgggggcagccaactcaaagttagtgagggagaagacccctgagagaggaagtagcaggtgcccacagaagtgtggaaacaaggcatgttcttagaattctgtgatttttttactccattggaaaataagtttcaaagaataagcaaaaaaaaaaaaaaaggcaaggctagagagatatgcagaggccctccttgctaattgatttagatttcattttaaaagcactggggagacctggaatgattttaagcaagggagtgtcaagatctgatttattgttaaaaggtttatcaggcatcagaatgaaggatggactgggggagagagggcaacaaacctgggggcatgaggcccattaggaggtcactgaagtaatccaaagctgagatgataagggccttaactagggcagtggcagtgagaatggagagaaatgaacacgttcaacaggatatggaagtagaacggaagatcttggtgactaatgaaaagagggtagggtcaaaaggggaagaggcacaaatgacttccaggttccagtttgggtgactgtgtaaaaagtggtgctatctgctgatccagatatgtaggaagagaagaggcagcaggagtctgggagtttatcaccaaaaaccttagtgaatactaccataccatagatagataccattctatcatgaactatctgtgtaggagatgagagaatgtgaagccaaatacatgagagggaaatcagttgattgtggggtacagcagccaatggaaaaaaaataccaaagggagagggcaatgaataaaacaagcactaaaagatgtcaatatgatgtttactaaagagtacttaatggagctgaccttaatgagggcagttgccattgagttgatggaactaaaagtcaatcacagtggatggactacaggagtgaatgagtatgagggaatttcaagggtatattactacagtttgccaaaaaagaaagaagagagtgagtgatcatggaaagggctagaaaagttcacttcggtcttggtagaagggaacacacagccctgaaagagtgggactaaaataataaactcagcatttctcttttttaaatggcctaggaatagggaacaactcacctggggttaacagagccaggtgagctcagaagttttgaccctgtgtaaaaatccctgataaaagactggtacctcaggcaagaatatagggcctgagtgttcaggtttttactgttactaattttaataaagatgtacataatagagtaagcatttgtgacagcagtatagactatctaattagtaacaatggtttaaaaagtagatcattagctattcataaagctctttagcagttatacaaagcagaggggaaaaaaatcccctacacagtataatccacttaattttaaggagatgcgagctaatgactaattctaatttctgtgaggataatgatgtgtaacagactgagctagtctagaaaactgatgggtactagtttaattctcaactatcacgtctggaaaactaaaaacgccatttctcagatgccctttaagttagctaggtttatatatctaccgccaactctctgcaataagtgtgtattttcaaagaaataagacgagcagacctcccccaacaccggccaaagtatggaaacataattttaaaaattcatgaaagttctgaaatctgcatcttcagcactccatggacacgggcaccgtttactcttatgccaactagctgctcttaaaattgaactaccctgatgtacaagaatctgagggttgtacatcaccctgatgtacaagaatctgagggctgtagctctctaaaaacagctacagaaacataaatcataatttatactctttcaaatacgtgacttgcttctgaaagtgagatctcatgtaaatcaaaaattatgtaattatttaaaatctctaaaatattttgaactccaaaccatttggtgatgtgaaatgagcataggcttcagttgccatctgatcccaagtgcccaatctgagactgaatgcctgaatttcctagaacctttttgtgtttttttcccactatggatgtaattaatgtgctcatatgtattttcacatctgctactgaaaatctgacaagtttagtctcacaagaccttttaaataaataaataaataaataaaaatctgaggaagcagctcagaaaattttcaacaaagttccccccacccctcacgacccgccacccaccaacctggatcttttactacatgagaataaactaaatctttatactctactttaactgcttccaaatatcatcaaaatgagtggagctagagacatgagctcaaagaacgttcacaatcttgatcgttttctctgtcacatcagatgacaagcttgattggcaaaggtcacaaactggctttgcgaattatgcaatgtgtgtgagacataccaactgcctttttagtgggatggaataaactgttaaaatgttccttctttcactgaaggtgttccaactgaaaccaagggagtcagctgtgttatgtttagatgaaagtgtaatcatctggggtgtttaattaaaatacagattcctgcatgtcagagggaatccaaatttctgagggtgcatctcaggaaagcacatcttttagtaagccctctatgtgattattaggtactctataaagtctgagatataatattttagatagttcatgagtgttatattgttaaagaaaacaaacaaaacaaaaatgtcttaaaagatatacaacgttgtatttgattgaagggctacatactaggtgctcttgatttagagtaacttgaggggggtgagggataaaagatgacaaattgggtacagtgtatactacttgggtgatgggtgcaccaaaatctcacaaatcaccactaaagaacttactcatgtaaccaaacaccccctgttccccaataacctatggaaattaaaaacaaaaaagataagaaaagttaagtgtattgagtgcacagaatactgttgattgtctctttcaattgccattccaatattctcctagcatatccctctaaactatcatggctggaaagctaaaaactccatttatcagacgccctttaagttatccagggttgtagatgggacttcggttctgccaattaggcgtgactgcaagatctgatatgggaaggaaatactcgagaagacaggctggctgtgggcatgcattttattggcttagttggtactgcgggcagcaagaccctccagtcagcagcagtaacagctttctgcactggccgcaacatatttacagactgtagtggacttaagttctgagtgctgggagtgttctggaagctcagcttgcagtctgctcctacggcccttccaaaaattccacaggccatcaaatgcacttcaatatactctttgaagtatatcccaggtttcaatcaggcagagtagactatattgtccaaaattaaatcctaagcaaaacaaggggaaaaagcccagtaattaagcatttatttctcctaagggtggtcaaaattttccttagaaatttcccattagtgtttcacaattcaagttgaaaaataaggattattttaaattttaaaaaagaccaattttttataggcaatccatgagagtttaatacaattctaccagctgaaacacagcaaagcatttacagttggcatgcctgggacaagttcctctggtaacaataaacttcaattgcagattcattgacatgcctgagacacatttctctggtaacaatactctacaactgcaggttcaatgacatgcccaggacttgttcttctgataacaatatatgtcaattgcaggctcactgtttatgaagatgatgacatttaaaacagagaacgttatcaaagtaagatatggattcaaatcctggtgctgtcacgtgttgtaatccagagcaaattatgtaacctctctgagactcagttttcttgtgatgataacatgtttttgcagttttgaaaagattacataagacaatgttatgtaaagcactcacaagccaattggcagatctatgagaacattacatgactattaatgctctaattattattttgttaattacagttaatagttaactatagctagttcagttagctacagttaaaccacagttgatgctacagttataattttatctttattgatcccttaaatattctaaaagctttgctaacagtaaatgactatacaatcattcacaatacaacccattttttaaaaaatgtgttttctttttaattgcacataataattgtaaacaatctcatttatcctctgcctccccatagattaaagatcagccctggaaagtgaaataaagaggttgtgaaactgccccctgagcttggatttggatccgctcttccaagcaggcaggctcttttctacctagtataaaagtgaggcaaaaattgtttgggcaacaggtgaatgttaacctaaatagcaaagtttcaaaagtcaacttcagcttcactaatatatccaaaacagctttagaaaacagtgtgttggctgggcgctgtggctcacgcctgtaatcccagcactttgggaggctgaggcgggcggatcacaaggtcaggagttcgagaccagcctggccaacacagtgaaaccccgtctctactaaaaataaaaaaattagccgggcatggtggcatgcgcctgtagtcccagctacctggggggctgaggcaggagaatcgcttgaacctgggaggcggaggttgcggtgagccgagatcgcaccactgcactcaagcctgggtaacaaagcgagactctgtctcaaaaaaaaaaaaaaaaaaaaaaaaaagaaagaaagaaagaaaacagtgtgtttactcatgcacagagaagtggtatagaggagggggttggaaaacatcaaccttagaatcagactgcccatatcttaatttctactttgacacaatccttatggccgttggaaagttattttatcattctgggcctcagtttcctcatctgtaaatgggtgtaataacagaactgactttataggtttgctgaggattaaatatagttatgtaagtgggcatttagtatagtacctgtcaaataatacacctttataaatgtttgctatggctattgtcattgctgtctagaacaagcattcctagtaacatcatgcccaaacttgaagaatggtggtttaagccaaaaatctgggcactatccttgattcttcccagtcccctatttccacatctgatcatattttctaccagcaaaataaatctcaaaactcatttctctccatttcatcttgtacaactttagcttgtgctaagctcttagcacactcttactggaagattacagggatcctctaaatagccttctttgctttcagacttattactcacaatagtatcttcttctgggaatatataaaacatgatcactacctgcttaaaatctcccaatgccttcccattacatttacagtaagactccaactcctaatcaaggcctacagagaccttcggaagacagacttgtccaactccatgtttacgccttagtaacctttatcttcccaccatgctctagccacactggcctcctttatgttcctgaaatacctggaaggtaattcctgcctcaagccctttgtacttgctgctgccagttttctcctttttgggctttgccaatggcaagttgttctcatcattcaggactcagttcaaatatcaccttctcagagaagccttcccaggtaacctgtcttaaggagcacctcttatcacatcacatcacatcacagttttgctttcccttaagcacttttcattctcagaaattattttgattacccaattagtttactcttatcatctgttcctcccaacaagaatatacatggtataagaatgaggattatattattcttatccgtcattcttacctctagcaccttgatttggtcctttctcatagtacataatcctccatatttgtggattgtatgtattgctaactgctactgaattgctcataaaagttctccttcaataaaattctcttttatatggtacagaccaaggtactggcactatctaaattgtgttactagagaataaacccaggtacatataatggggcagagatgaaggctggacaatgtacaattcaatcctcagcagctggtttccatatttacacaatagaattgcaacatcgccaaccagttttgcttattatctgtttcttacacttgactgtgagcaccataaggtgccatatggactttcagtccctccctgttttgtcagactgactaaggcaatggcaggtgtgaagaagcccctcgtaaatatatttagaatgaatgagtgaaggataaacaggagggttttgttcatcagttgggtataaaccattgtcatccttctcactcttaggctcaataacttctaaattcaaatagtgacgattagctaaatgcttctcagtttgaacttttaaccattttctttgtacctttaatacttccctaggtccatgtaagtggaaaactaggctataaaaccatgagtagactacaagctccaagaagggcagggacaacgtaaatagacaattttaatgaatgaacaatcattgaaaaatgcttctcctggtagatgtggcccaaaattgaagggctgacctggctataaaatccccagagctccctttctgaagaaactacgtaagtataaagtggagtttctttcctttattgacaaaaaggggcatattaaaaaagcgaaaacactgaaagtatcacacagagctgaaatgtagacactgtcctgcagtaagttcactggaagtctctgagaagtcaacaattccatatactgctttatttagaatttattgtaatacgcaaccataaattttttatttccccaatgagttgcaatccattaacatttctaaagtagccattcataaaaattattcatggtgattcagcattcaaaatgcatgcaaagaataagatttcactcagggaagacatacccagaagtgatgacatgggttaagcttttaaatgctaatcttatctcttcccaaagcattggttgactcttatctatctgtcatcttttctaaagcaggcaaaacaatgttcataaaactgaatccctttccagactcattcctactttgaccaaaacaaaaccagctaccttttcttcagggacacactggcatagtgttgatgttcccctatcatgcaacttgtttgcaagaaacagaaagtcgcatgccagactactcatgagctgattcaatgacacttcatccctcccccaaaataggctgcatcatcacattttcatgctaataatcatgactaagtggcaagctcttttattccaattgtttatcgtgagatccatggaattatccttagcattctctctaataccattttgatgtaggaggagactctaaattcattaagaaaggaagatgtggccgggcgcagtggctcacacctgtaatcccagcaatttgggagaccaaggtgggcggatcacctaaggtcaggagttcgagaccagcctggccaacatggggaaaccccacctctactaaaaatacaaaaaattagctgggcatggtggtgggcacctgtaatcccagctactagggaggctgaggcaggagaattgcttgaacccgggaggcagaggttacagtaagccaagattgcaccattgcactccagcaggggcaacaagagcaaaactccatctcaaaaaaaaagaaaagaaaaaaggatgtaggacacagtaaggaaggagatgattttttacaatgtatcaggataggagtactggcatcacacttgttattgttatctctattttagaagattctgacttaacagttttctcggtaaatgtaagttattgtgcattctgaaattcatcctcatggtagacttgggaagattattttgctttcaagtttaaaacaaaagaagaatataggaaatgtaccttaaggcctcaagtcttgactcttaataatgctgggaaaatacagaaagaaactttcttcttggagcagaaaagggggagagtgggtaaccatttcaaggtaatcctttgagcttcttttcaaagcagctgctttgctgaggaatcagaaggggatggaagaacaaatgtaaacagggaaactggatagcaaagagattttctcaccatatgggagagaatagggatctacttcctcaggaaatgaagagagggactcgtgagcaatatattcactaaatgaaatttaagatgtacttcggctgctgtatgttttaagtgccaaatctgcacaaaccattttgtacatctacttcattgctcaccatttgtgtgttatctcctcttctttatggtcctttttggagcttttctttgcaaatcaaggcagaaggtagactttgtgatataattatataaaactggaaacattttattggttcaagaaatgttaacttttcagatctacacccaaaaccaagaagcttacctgattaaaaaaaaaaggaacacagatcatgctctaagtttgtatcattttaaacacttcagaattttttaaacttggcatcaaagagtatccccaaaatgatatatgtttttaaaagtacatgcaatatctgtaacattattttagagcactgtattgtaaagcagtagtattactgccttgagtcactaagatgatggcttctaaccacacatgaaatttgaaaacatcacttcttgttaatccttctccaactttcttcctccacgcttaatctctgatcttatgtattgagacattatttttgctgaactccttaaccatatctgttttaaatacataaatatcattctaatagaatcatctaaaccctctcatattgtcatatttctgtctttcaactccttttagacaaagactatacatctcagtatccaaaactacacaacatcctttacttgagtattgcactagctacctattaactagcacaaattgttaacagaattttaaaggaagcatcttgagtgtgggtgagctgggaaggaagaatccatttaccatatttgtaatagtctcatgaattattatgtatcaaaaaaaatctcggctgggcacggtggctcaggcctgtaatcccagcactctgggaggttgaggcaggcagatcacgagatcaagagatcgagaccatcctggccaacatggtgaaaccacatctctactaaaaatacaaaaattagccgggagtggtggcacgtgcctgtaatcccagctactcaggaggctgaggcaggagaatcacttaaacctgggaggcggaagttgcagtgagctgagattgcaccactgcactccagcctggtgacagagcgagactccatttaaacaaacaaagaaacaaacaaacaaaatctctaggtgagaaaataaaatgtcaacagtactaatactaagcaagaaattaggaacaaacagatcaggtttgatgactgagagttgtaagatgctgagaaatttgctcaacctctgtgagctcagattcctcctcttgtatcaaatggaataatcacactaccaccaccctcacaggtggggagaatcaggagacataaagtatgtaacacatttagctcaggacctggcacagagaataagcatcggaaatcaacatttttcctcttcatcatcatcaacaatattctgccctaaaatcctttctggttcttaagtcttcatatatctggcattagcgagttttaactggcccttgtcattcagcctattgtgtcatttccttaagaatggcaagcaatggcctcaccttctcctttatttatttatttatttttaatttactgtctccattctcttctaccacccaaagtggctcatttatcatttctctctctgaggaaaattctgtttgaacaatgtatgtatgtttatacaggacagtgttacatgcagtttcatgtgtctgctgaggtcagcaggcacaaaattgtcaaatgtctggatccattcttagaatgctgacaggtggatgttgtccctcaaagagacatttggcattaaattcatagtttagttcagaaaacctttatcaatattttggcactgtgccactagctagggataccagtgttagacaacttagctaggtaagtaaaaaaataacttcaatataatgtgataagtgatatgattgtttttttaaatgctacaggagctcagggtaagatcactaaacaacatagtagggagaggggctgaggaaaaagagcaaacaaaagtcagggaggacttcctggagtagagaccatcaaagctacccaaatgcgaggccctcagggccttggaaaccaagtgcagcaatattggtatgtcattgtacatagttaggtgacgctggaatgaaacttaccactcgggagtggtggagataagcaacagccaaaccacagaggaccttgtatagtgtgctgagggtttggactttatcctgagggtaatgtaaagtcggtagaggattttagccagggtaatgacacagtcagacttctgttaataactctagattgtgtgcattagaaagaacctttaaaattataggatctacccctacattttgatggacaataaaatggacatcctgaaagctgcatagcaatacagtaccacatacatgaatttaggacatggatctcctgcgctgtcagtaagttcttgttctgactttcctgtattactcctcaaatgctaggacacaaatcttcagggaaaagtgcaaaaggaattcctttttaaatctaattctgttcctaagcaattcacaaaaattacacatgtcagtgtttctactacattctcctttaggccttaaaagcagggactttaatatatatatatttgtttttctttttcaatatctaaaagagatttctgcattttaatattggttcaaagtgttgtgttagatcccactctgaactgaacccaaaattacttcccacattttccggcttggtaaattaatcactgtggtatccacaatcaaagattcaatcaagaaacttccagaaaacctttggaaacaaactttgtattacaaaagagttataaaacaggagctgttttctctctttcacaagtgttttgaacaaatcagcactccatcaaaaagaacataacagtttaatgttctgtcaaagaatggaatgcttgtttacctgaagtaatggactgataaaagtaacttgcatctgtcttgattgatacaaaacttactcaaagatgaatctggacaaccaagcccttaaactaaacagagtcactgacaagaaaataaaacctgaattcataatggaaacatttccaaactgttgattctataaagttattaaattcaacacatgcaaaaaaaataaaaacaacaaacgaacaacctttgaatgcaaaactgcattttatttgaaaggagctaacatttaccgaggttttctggtacctgtcctaatgcccttcttatgcattagctcatttaatcctcacagtcaccttaggacttagacactattataaacctcattttacaagtgagaaaatcagaatgttatccgaagaatcaagtgactcaaagtcatacagtttgaagagatgattccagatttatgagtctccaaagctattcatgatcatactatacaaaaactaatttgaggctcattttagaagacattaataaactaaagttttcatgtacttggaaaatttatattttttattgctcaagtctgagaacaatacaacaacactaggcctctgaatggacagtatagtatgtagagcactgctcagttaattaactctcttgactttcacaacttgtgaggtcgccaacatgtgtcaacatccttacagacacagagcagacagtctaatacatactgatgtgtctgctggcataatccattccctaaagcttacagatacaatttattgagcatcacttctgggtcagacaatttccacatattatctcatttatttatttatttatttatttatttatttatttatttattttatttataatatttttgtagagacaaggtctcactatgttgcccaggctgttctcaaactcctgggctcaagcaatcctcctgcctctgtcttccaaagtgtttggattgcagacataaaccaccatgcccagactataatctcatttaattcttgtgttcttccaactatgtactattacccctacaaccccattacaccaatgaggatattggggcctagaggaaggaaataaatatcatgttgtaatcataatagtggagctaagatttaactctcattctgtctaactccaaaccccatgcttcttccagtctacacaaggccaatgagccaaacactttgagaaatataatttacttcttaaaattagagcaggaaaccgtgttaattctgaaaaacattgttttctaatagtacaattatttgagtgattgtgaatcgtgattacaaattaggtatataacattatttccaggtttttaaaaaaaagaagggaaagaacaaggaaagaagggagagaaaaaagagtgaggaaacaagagaaggaagctgcaaagtattattcttccattttacagaagtttaagagaaggttaaggaaagataaataaattgcctaaggtcccatgtcaagctagagtcaagagccagaggtaaaatctatatgcttttgacacaaaagccatgttctttccattttcttttgacaagtggctatatttctatggatgctgaaaatgacttcactcatatagggaaaagtaggcaatcactcactgattcaaaatgggaatgactcatgttctgtccccctaattccaggtaaagcaaagagcttgggaatgcgagctctgaatccgaatctgtttcataagccagccaccacatattggtgccgcgatcttgggcacatgatagaaagaagtaactttgctctaggtaaactcttttgtgattctaattatacacatttttctttttcagtttttgttttaaaaaaagaataaaaacaactacattactcaggacaaaagtgaatttgaggctggagttacttggataaattgcttcaactttccctttcactctggtagtggagattttgcagttaaagtcactttctttaagaaaggagccatcactattgataagcattacattaccatttgtttaatggtaatagcaagagtaaatgtttatttagtattttcttggtgtccagcactggactaagtgcttttttgtggattatttcattttatccttataactacctatgataaatgtaccattgctcattctgtttggcagatggggaaattgaggctaagaggttttcgttcttaggcaaccaaagcagaccatctgactgcagagtttggttaagcacatctctgttctgttgtctcctttacctgtgttgagatgatgccaggactttttagccaacattttcatttgtactaaactgctattgagtatgttacaaggtgatgctgctgataaggttgtgctgacaatcacccatttaaaatcttgcgatattaatgcagaaaatattttttttaatattaatgcagttggattgataagaaatgaacaaaacaaaggccacaatataaatggctggtagctttaaaagccagacataaacgacattattatcaaataatttcctaatatgatcacagacatttaaaaccatcttccaaaacatcatgtaaagaggatcagagcaaattgataaaagtactttctgaagtatctttctatttccaagaagttattttgaaacataactttaaaatattttaaaatctgccctctgccaacaaagtaccactttatttgaaagacagaaagctttttggcaatgaagtaattcctgattccataaagtaagacgacatctttagagtttacaatgagattccctcacaacagtcagatgagtcaggcaaggggtttccatttgactgctggggagatgggtgggaaagcctgatgaggaaacccaggctccctgacctgtgggagtgttgctcacatacagccatttacacttctggtaagtactgaggagtgtggggtcagaagcaactcatcactcaaccagaggactcagctttgcctgctctcagtctttctggtgtaaagttaaattgcatcttcttctccacaaataaattagaaaaaacaacaacaacaacaaaaaaaaaacaaagaagttcaaccctttcagtttgtatgtgtatgcatgcgtgtctatattggtgcattatattgtagtgattagaaggaatctggcctttagatttaaataggcttggcttcaaatacaaactcttccacttgcactttttaaattctcattttgggcaagttttcttaatctctctgaacttcagggtttttatttttctttgttaaaaaaaatgatgccaaataataatatgtattttacaacattttgctacaatcgaatgagatacacttgtgcagtttgtggcatggtgtttcacccatggggagtaattcacagttattaacttattaatttgtcttatatttccttattcagtaagctgctcttacttcttaaacagcttgtctttggcctactttgttatttcttttcaacagaaaggggagaaaagtaaagaagataaaattgggaaaattttctaaaaatttgctaagggtgtttatgagtgtcaaataagatagataacgtataaataagagagttaagctattagtctctaaggattggttttaatttttttatttatgaaagccctatagccaaagccaggaattactaacactgaagttatttcttacagcatacagatttgtataatgttctgtgtgatttactattcttttagagaaggaaacaatgctctattaagtaagtgccagttgctgtgatgttagacagtctatctcttttaattatcacatcaatactactactaggtggttacttctgtgcccattttaaatattgagaaagtgaagttcaaagagaaaaacttactggggttggtaagtggcagaaccaatactacatttgatctatatccattcaaacctttgctattctctcacattgtctccagtttcactaagtaaatgatgttatgcattcactgaaaattaatgctgtaaaatagtaaacaaagtagccttgccagtcatgcaccaaacacatttgtgtgtataacagacctagcacaattgttaaaattttgccattagaaaaaaggcttataaaaaatgtatcagtatctaacaacctgaattaggtctccattcatttcacaacattccaagtgtatttactgagcagttggcaggagccactctttgaggcaactgcaatcatgaaatttttgttgtccaaattctattactggcagcttttttgaacatctgagttgcatttgtttttgattcaatgttcatgtaaacagaatgcatatctttgaggtattaaataagccacactaatgcgctgtggttaatgccagctgagtctcttttgcaataaacacctgggattggcaggagaaagaccttgtcttagttttcctatctgtgaaatggggtttaaaaaaataataactacctctcagcggaaaagtgctgtgaattaattaatcttggaactgttttctactaagtgccattttggcatgatctattatcaggatggtttgattttataatataatgatagaagctatttaaaatggctacacatttaaatgccaaacacttgacacatagtacagtaaatttcatctcttcaagttgaatcattatgtgtgacatttgtacagaagtgcaaacaataaatggtcaaatcagtcttggatttaaaagtctcattattgaaaaatataaataaataaatgcaaacggcttagaacaggtcctgacattgtgagcattatataaggatttgctagtattattagaagctacttataattttaaattaaaattagctacagtcatatgtgtatctatatatgaaataaatcaagcaagcctaataaatgcctaaatacatttttttcttaaagaccctagtttcatattttaaaaaaaggtacattatttttaaagtattattaaagcatagagtactgtggcttcagtacattacaaacaggaagtaaagttttaaaaacacttttctgggcaggggctaagaataaatataaatatgtacattatatatatattatatacattattatatatatatatatatatatataatttgttacaaagatattggaagaattatgtaagccctattttgtagttcagtgcttttctacatacaattaatgtcatccaaatagtaaaaacattatgctaataatttcctctgaatttttcatgaatgttgcctaatccctttattatcccctcattttgtttagttcccactttggaccacctggaagtagaaagcaccagccattctcctatactgtgataatgtatctttcaaacagcagaatgacaaatgtgctaaggtcagtcctctgactaacagagcacatcaaagatttatgagtagggcccacggaatacagcagttttctaaagttgcgagaaatccaaactaaagcaatcacagagcttttggttgttcatcaaaaaaggaaatccctaatgtgtttactatttcagaagcgttaaattgtacatttacacagaaccataaataatgatgtatgactgctgaggtctgtgttgcaatccttgggttttctagatcacattagaaacaattttatatgaaaacatctctaccctcccttcttaccactcctccatctagagttctgcagtgaacatgaattttaacagccagtacatcgatatggataacacatccaggagggtgacaaggcctttataacaaagcacactttctctgtcacactcttcttggaagccaaagaatctgtgtgttttcccaaggcagttgtttgggaaggcactgagaaaggaactccaagtaaacagtagaaaactcagcactgtagggccctaagaggttccttcacaatagaccaccattattcagttgtattccttagaggcaacctggttcactgccactcaaatactcacatttaggtgaaacaagccaataatgagatgcaattcagccctggagcagagtgaagacattgaaagggaaaggtcctcagctttagggattttatgtcaaggtgaaaaagagggaaaagttctaagcactcacagggcttatgttcagcagatgaacttctgctcctgaaaaggcaacacagtatgggcatacaagacaaacacaacgcccccctccaacctgtgctctttcttcccaggtttgcacagggatgcaattatgcagtggggatgccctttctgcaaaggtgaacaaggcttgctttttcaagtgagcaccgatgagtttgcggtggtcctttcatgtccttttacatggtcaccctaaagagcaaaggcattctttgtgagcaacagacaaagtttgagctgctgtctgtgtacctggaacacagaaaaggctaccttattgccccgctccctcccaatttacccatgttctaatcagcagcattcaagagccccagggcaacagctacaggcacaaagtcaagtgctgaatttctgcatccaaatatcccaataatagccattgctacttttttttttttttaaattttctagactattgcctcaattctaaactttgttttagtggatagctcagtgggcaatgccagtgattagagaagaacattatcttcatggttgtggccctgttttctgagaaatgtgtgttctcctagcttgaggagggtccagctgatcttggaatattctcatgtcaacaagaaaagactgccatagcttctgactgctaaaagaaaaaaaaaaaaagaaaaaaagaaaagggctacggctagctgctgggtttgctccagctctcagctaaggaaaggaggtaagcaagcactgttccaaggatggtactggacccagacaaaagccagccaaggagagatttggcatagtatcatctgcaggaactgcctttccctgaggctccctcctctttccacctccgtgtctccagctgcagcctctcatcttcactatcttctcaggattaactatcttgggcatgattcagagatactaagactgggagactagtccaaggtcacacatcttgaggcagagcaaagggtaggatcagttcctctgattctcccctcagtgctctttctactacatcatcagatcccttcttggttttctttctccatttcaactccatgcacacacgtactggaagttaaagggacagaaaaaaaacaggcaaatacagggaagcattaccttttgtaagcttatctcctctggttagctgactttatcttagaattctttttcatagaacttaaaaatttagaacagagaaagtaaagatcctctttaactatggattttgctaaaacaggaaagtgtaaataccattctttttacaaagaaatatcaagcagtaggtgaaatgcataaaagtagaacagtctaaatttaaatctccttcatttctccccattggcttattcataatcataaaacaatggttataatgtgcattcacactgaagcaatggctgcataaatctgagaactgaaggaagcttaaataccatctggttcaaatatctattttactagtactttagaaatagagaattttagaaccagaaggcacttagaaatcacctagtctcacttactcattttacagttgagcaaactaagatctggagttcaaataatttcccaaattactactacttattatccaggttaataaaagaaatcagcctcctaatatccaagccaaagtggcagcctacaaaaatagtaaaatgtagccaaaggacaaagacaggtacataaagaacagtcttcctttagatgacacacattatgattttaaagaaagaaccatgagccccaactatgagaaaatcactcccccacctcttttttctatagagaaagaaataggtagagatgagatcatgacaattctcttaaactcccagcccctgtaaacagtttttagtatacccataattaagtgaaaaggcaaacacatcttgctgcatctataaatcagaaaggctgcagtcaattgtttctatgaaacagagcctatacaaaacaaccctgaaagcagcatatattataaaaatatcttggtgttccctcaacttgttttgtaaattgttctgtctacacacgtgactaagaccaagaacagtgtgtaagaccaagaacagtttcttgcagctgctcatgatttatgtgctagaaagaaagataaaagatcactcttcagagatttatatccaaatgccttgccctaatttacaaaagggaataaaatttacaaaagggaataaaaataatttacaaaagggaacattaagataatccagaaaagaaaaataaaagtctcaaactagcataatgaaaaaaaaatgtcactgcacgttgcctggtaaagacaacaaagacaccccacagaaatgaatgcatggcctcactcagaaaagcaagtgcgagaacattagggatgggaaactaaccaagtctctttagtccaaaataaaataaaataaaatgaaataattccttagaatcatacaaggagaacttagcaagagtgtagaaatatgaaactgagtcagcgataaagataatatttccattttccatttctattttctattctaattatctcattcatttgtactttaaaagaaaaaccttcaaaaacgtagcacctcttaagcccacatatcacctttgtcttcacatattcctggattgatgtgtcttaattatagtctataaacagatattagcctatcatgggagtcaccaaatcgacagacgtagatttaggaaaacttggtctctgtgcttggttcattaggcataatttacctgcaataagtcagtttttctctggcttgtaaaagtaggccagcaggcactctcttctcaggaacaataaattcaaactgtacatatagtaagctactatgctggtataaagacacatataaaatttcatttagtccttaaaaccaccatgcgagaaaaatctttataacttttataatcatcatacagattacaaaaaacagaaatcccaaaaagtttaacaaatatttgcctaaggtcatttgtctcatgagtagtaaaacaggaattagaatctaagtcttcagaagctagaacctagaatccttctaccaaccatattttaggtgtttctcatatatgctcagatatggtttattctcagatataaagcgaaggccacatgtagtggaatttgccaatccatgtaaaaaacctccaatacccacacttgctatttgagtgagaaatttttatgtgatttatggtgatggaaacatttcagtcacctattattaaaaaaaaaatgtgacccagaatttgctatcttcaaatcagcagttagacgtaaataaaatttagcaattttaattggtttggcccagactttcagatttccatatggttattttccttgttttatgttaaatgtaatcaacttagcacttgggttttaaagtcttggcagaatgtatcaattaaaagctacataaattggaattattcaaagcatacattccaaattgagtgatcttaaggacaagactaaaaaaatgctcttttcataagtatgttaattttcttctacaaagtaaacttgcatcatcacccacatgacaaacttcatacagacataaaagagatattttctttggagtagtgaaaattagcattctatttgcttattctctgagagttagtatgcctaaaatggccttttttacattgtttgcaagatcaatctttcttatctcagtatttctgaaattgacaggagttatgacacttctcacaaaccatccccaaactaaaatgtaagcacaacattgataaatgtaacaccaggcacattaagctaatggcacttttaaccaaatcttaatcagtgttgcaaaatatggtgccttgattgttatccaatatggtgtatcagaatattatgtttaaaaaatagttacacattgaaagagatgttttttctaagcccaagccacaaacacctctagaaaactgtaaaaccacacaatctgaataaaataaaatcaaacagaaatctgaaaaattcaaaagacattcatttctgtagaactgtgcttaaatttattgcctgtgtcattatattggaaatactgaagtgtaccaacatgctaaatgaatgaatcattcatcaaaccccaagtggttgttgatggaattttcacacttacttagcttgacggaaaggccagaatacctggagtccccatgattcttggagagctgtgtaattcaaatcaaaccccattttaaaatattactataaattttttttatatgtggggtagtaggagagtacagaacaagttgctttataatagaaccatggtattgatgccatgtttataaatgactatttaaactactaaatattaatagatattcttccctggtgaggataacattagaatcagaacaatcgatcctatttcttaatgtccaatttacataggctaccttccatccatgcagcattgcacagaaaatgtctttgtaatttttggattagaaaatttaacaatatgaaagatctaatcccctcctccatttctgcagattattttattgattttgggctatttccagtgtcccctttttcagtgactgtggaatcgctagaagtattcttaaaaaaaaccttgaaggtcattagatcctaggcaatgaatgccttcattcaacaagggtactgccctcctttgcctacaagccgtttaacatcagcaagttcccccaaagggcctgcactttaacttgtgtgatgtgtgaccgaacaggtcacatatctaaaatacttagctttctcaaatttctctggtcggcagcactgagtcactaatgccacagtcacaatgtttcagactagattgacctctttctagttttcaatggaattattccatgtaatccgatttacacagccatttaatcaaagcgagaaaggagattacagagctcacatttgttttgcaaagcaagggtgcaaggataatcaatcctactgcctctcaaagtgacttgatagtacatcccctggctttggagtgttggacattaaccttatctgtctcctgtgttcttgtttaaataggaaggtttaggctcttttcctgaactagaaggtagcagcttcttcccccagatctcaccaccatccatgggagcagatgctactataagaaggaataggtctctacccttcttataatttcgcagaaagcttgtctaaatcaagagattacaataaaacttttcttttgttgcaagaatctttaacatttgcatttcgacagcacgctgtggtgattccaggtgcggtgctcaatgccttgcctgaaagctaacctgcttgtaagagaggggagaggcacatcgcgtcttttctcttagagagtgctctagagactatgcaagcctcttttagccaggcaatgtccctttcccctgccttttaccacaccggtacaaggggctagagtcttgcaactttttgcaggcctagatatctgtttaaaatatgatgctaagcaggtcatttgataaagcattttgagcacattgatgccttcattctacaccaacgatgtgtacaaacaccccggtttcctttttccccaccacttccaccccttccacacatttcaggaactgcaatctccaacagaacctctggggggtgaaagggcaacccttagccaaccgcggcagataacacataacaatttctaagggggaaagtgagaggaggtaacaatcaacaatggtgaagagaactgtggataggggcaccgtggcggccctttctaaacgaagaaccaggtattttcttcaagggaaaaaaaaatctaattgtccccccaggcagcgctttacccacagtgctttatgtataatgcagaatttagcagcactgggaattatctcaatcactatcattcagaggtgcctattttataaaaagcctttatcccttttgaaatggaaaaaggtgcgtgcattgtggaggtactagagctctttagagcccacacagagctgcaaactaggcagacaccgccgagagccaagtttcccgggcaggcgggcaggttcccgccccgccgagagctgccgcttaggagttccgcgttggcttcgctcccgcggctgcacccgcgttcgcgccgctcctggtgcccggcgcccacctcggggctacacaaataaatctgagtgagagagctagtgagggtggcgcgtggggtgctgtttcataatctcctggaatccacgggaaaaccgtctcctatgcaaagacatgccttcccgtgataacttaacattccatggcccaaaagccaatctttccaccagacgggaattacggtttccgactgacagctcaaaacttaactgctgaggctccaaacttgacactggctccctctcagcactcccactccttttctccctggctcacccggctcggctcgggatcacacaccacgccggcctcccccgcatcctcttgtctcacccggcaggcacagccctgcacgccccagctgcaagtcccagggagcgccggcttccccggggcaccgggcgcgatttttcctggagagcctgggagctcccgggcgcgccctactcacttgtgtcttcttcataaggaaaggcagcgctgcgatccagcacaaacagtggtgtggcgactccgtttagctgttctggagctccagcatattgcacgaacagcggcggcagatagtccacgcattgggtagcccgagcgcagcgccctctccactgtccctgcttcccgcagcgcttctagtctcggcgcgaggcggcgagcgaagccc

SEQ ID NO: 1839 - DNA, 87681 bp, Homo sapiens; identical to SEQ ID NO: 1838
  source 1..87681: mol_type = genomic DNA

SEQ ID NO: 1840 - DNA, 3785 bp, Homo sapiens
  source 1..3785: mol_type = genomic DNA
ggtggggcggggttgagtcggaaccacaatagccaggcgaagaaactacaactcccagggcgtcccggagcaggccaacgggactacgggaagcagcgggcagcggcccgcgggaggcacctcggagatctgggtgcaaaagcccagggttaggaaccgtaggcatgctgcgccccaaggctttgacccaggtgctaagccaagccaacactggaggcgtccagagcaccctgtgagtgcagaccacggacccgagcggcgagcgctgcagtggggcggcgcgcggctccctgagggaggggtggggaaggatcaccaggaagggaggaagcggcagagggggcagcggctggggataccggccgggaggtcccctgtcgaaaagggaagccggtgtgctgggtgcttagggcatgttccgggacacgctcaggccagagccttgctggatgtgcccttggtgggacttgggatggaaacccagacgttttactccccgctctgagcacatcgctatccctccccgcccctcaccaggctgctgaataacgagggatcactgctggcctactctggttacggggacactgacgcccgggtcaccgctgccatagccagtaacatctgggccgcctacgaccggaacgggaaccaagcgtttaatgaagacaatctcaaattcatcctcatggactgcatggtatggagaggggagccagacttcccctgtcccccaaaggggatcccaagggggcgacctggaccccatcctggatggttggaggggcagggacaggatctccggaagattactaagagttggtctgcagcagcatttgtaataggcaggaccctattcatcaagtggtggtgaggaaggatccctggacctgagaggtctgacttgggttctggtctcagccatccacttatcagttgtggaaccttgggtaagtcgcttaacctctctcagcttccttacctcatgtttaaggagaagacaataatttccctctccccgctcccctcatgggttgttgtgaaggtcagatgaaataatgggtataaacagtagaatgacgtgcaaacacaaagtgttgtcatcccagtttcaccgactcacagaaccatggcagtctccagaccctagtccaaccccttaagctttcaaagaaaggaaaatgaagtccagaaaggggaagtcaccattagattgtgaacttcttagtatctgttcggtcgacaagtatttaggtccttgcagtattctcaggactagggaaaaaatagcaaacagaaagacaaaacccccagccctaataaatcttacacagtgatacaatcacggctcactgcagcctcgacctccctgggctcaggtgatcctcctgccccagcctcctgagtagccgggactacagacatgcaccaccacacctcgctaatttttgcatttttccagagactgggttttgccatgttgcccaggctggtctcaaactcctggctcaagcgatctacccacgttggcctcccaaagtgctgggattacaggcgtgagtcactgtgcctggccacattttttaaaataagtaaaatatatagtatatattaggtattgaaaatgcaatggagagaaagcagggaagtgaaagagtatgagtttgttgggtgtatgtgtcagggacagtctcactgaaaaggtgacatttgatcaatgatctgaagaaaggtgggggacaagccatgtggttatctgagggaagaatattttggacagaacagcaagtaccaaggccctgaggcagaattatgcctgctcaaggatcaacagggttggttggtatggctggagttacgtgagatggaggagggtagtaggagatgaggtcagagaggcagggagtgcagtgcttggttcctggcatacaataaatacctagtaaaagtttgctgaacttacttttgtttttttcaaattggccagaaggtgaactctccaggaaggatcttcattgtaactcaactgcctactctcccctaccccctgcacaaccaatgccatttttagttcaacatatgactcctactggatgcctagagctggtgctatagggcaatagctttcaaacgttttgaccacaacccagccataagaaatacattttaaggggctgggcatggtggctcatgcctgtaatcccagcactttgggaggccgaggcgggcggatcacaaagtcaggtgttcaagaccagcctggccaacatggtgaaaccccatctctactaaaaatacaaaaattagctgggcatggtggtgcgtgcctgtaatcccagccactcaggaggctgaggcaggagaatcacttgaacccaggaggcagtggttgcagtgagccgagatcacgccactgcactccagcctgggcaacagagcaagactccatctcaaaaaaaaaaaaaaaaaaagaaatacattttaaggctgagcacagtgcctcactcctgtaatcccaacactttgggaggctgaggctggaggattatctgaggccaggagttcaagaccagccttggtgacctaataagaccccatctctacaaaaaaaattttaataaataaataaataggaaaaaattttttaagaaagacattttaagtcagagctcaacacacacatagacccactaaaacaaaagtcatgaaacaatacttttcctactacatgtaatatacttcattttttcttttttggtttttaatgctgatcaaccttcttaatttatctcctaactgtggggtcaaatctgcaatttgaaaaacattaccatgggaaaagaggagaaataccagttgggttaccactcccatgcccctctcagtgtctgtggggtgagctcacagtaataacatcactcatttggacaactgttggcagatatgaaatttcatggtattagcaccctcaccaactgggatgaggtagggattacagaaagaaaaactgaatttctgagagactaagtttcccagagtaacatggttagtaggtggctgtgctgaggctggaacctgggctcagaaccccatgttcagggctgtggccaaaagcttttccgctgaacttcctgctgtgcccagggcatgggaggaagatatagtctctctggggccagagaagcctttggggaaggagggtgctaagggtgccaagcagaacatcacatcccatcatatcacccccaccaggagggccgtgtagccatcacccgagtggccaaccttctgctgtgtatgtatgccaaggagaccgtgggctttggaatgctcaaggccaaggtgtgtatgtgcccatccctccatagccctgggcccagccttcgtgcttctacactgtgttcactcccaccaggaccctgtttctagagttctcatgtctactcagtccatttctggtgtgggccagctcccaagagcaggtgggggttgggggctggttgcttcctatggcactgggagcagacctggatttggggtccctaatgccaggctgtgtgcgggactgatctctgttctccctctgcaggcccaggctttggtgcagtacctggaggagcccctcacccaagtggcggcatcttaacggcattggtggaagctggggtcagaaaagagaaatgaccatttggaggggcggggcctcctagaagaaccttcttagacaatggggggaggatgggactttgttttttccaagaataaacttcaactcctgtcatgtg

SEQ ID NO: 1841 - DNA, 3785 bp, Homo sapiens; identical to SEQ ID NO: 1840
  source 1..3785: mol_type = genomic DNA

SEQ ID NO: 1842 - DNA, 34927 bp, Homo sapiens
  source 1..34927: mol_type = genomic DNA
aagtcagggtgggacgtgggcgcggggagacaggtggtggctacgacggcgaagggagctgagactgtccaggcagccaggttaggccaggaggaccatgtgaatggggccagagggctcccgggctgggcaggtaaggagcgctggtattgggggcgcaggcgccggggtgagaggcctgatagcagacggctgcagctgtgcgggcccaggctccctagggatgcagcagccctttgtggctggggagagaagatcctcgctcaaggtcaggtgggaggcaggcagtgtagctgggtcgcctctttcctgcgaagctggtgtcgcttgcctctgtcgtgctgtccaccagtggccccacctgactgggagcgtgtttcctggacaccaggcacatggacagtcaggtgttaaaaaggcttccagaaaccaccaagcccagtccctcaggccatgaggatgaggctcctgaggcccagagagaacaaggcactcactgcccacggtttctcagcaaggcagtggcagggctgagagtgatggctgaggctgtggccaccccgcctggagcagggtgatggacaggctggactcagaggacccaggaatccttctggtttctggggcagaccccagtgacaagaatctcctgagaaagagagagagagagagagagagagagagagagagagagagagacagagatcacccaaggcatccagatggacatgcgaggagtgattttagcctcagcgatcgagggaagaatctcctgatgggcgtgaactgatatgtgtgggggtgtccatcatctgggatggagctccagggtggatggacatatctgatctgagtatgggaagttggaagtgaaagagaatgatgggagaaaggaagaggaagtactatttttatcccagacaggggtgcagttggtcctgggtgaggaagcgctgaacttccatctggaaagtcaccattcctgcccctgccaagcgtcacagcaggatgtcctcccctcgcccctggctccctcccgcttcagccctgcctgtgtagggccagttggttttgctgattcctgcttcaaaccccagggaggtggagagagactggggaggcatagttgctacctgctcacctcctcactttttaactctgagccttaatttttttgggaagtcctcactcagccagatttccaggtttcccctgcttcgttggagtttttcttgacacacactttccgcctagtcagctggtcccagcctttctcctgtctacagctccaagtcctgtagcctcttgtgggggctagggaacatggtggctctcctcgcacttcagggagggtcattcaccctggacaggcatgagcagttccttccacccagccctatgctgacagacgaatcagacagggtcccttgctcttgggccccaggaacagaggctcttctcaaagagagaagggccaagtggacaagggccaagaacaggctgagcattggttcagaggaggggagaaggtgtctcttaagatctggaaagcttcctgcaagagtcaagacagttctgagaaggagaaagacccattttcaagagtgcgtaggacatgaagccaaggtcactatccctggattctgttccttgggtaccacgagggcagagacctcagagcaagaccaaaggccagagagcccacaggtgtggtgtggagcagagaatgtgcatttcagagacaggccgacccagtcacaattccgctggaccatttccttgagcaagtggcttcatctctctctctgagcttcagtttacttatctgtaaagaggcaataatcaagctgggcacggtggctcacacctgtaatcccagcactttgggaggctgaggcgggcagatcatttgaggccaggagcttgagaccaggctggccgacatggtgaaaccctgtcttcgttaaaaatgcaaaattagccgagcgtggtggcaggtgcctgtaatcctagctactcagggggctgaggcagaattgcttgaacccgggatgcacaggttgtaatgagcagagatcgagtcattgcactccagcctaggcaacagagcgaaaccccatctcaaacaaaaatgcctcccgggttcaagtgattctcctgcctcagcctcccaagtgctaggattaacaggcgcgccaccatgcccagctaatttttgcatttttagtagagatggagtttcactatattggccaggatggtttcgatctcctgacctcgtgatccgcccacctcggccccccaaagtgctgggattacaggcatgagccaccgcacctggccagcacatagtaggtgtttaagggaggtggggcactccctccccctgcaaatgatgcaccaaagggagggctgtccacacccaaattatgcccactcagcaccttggtgggccagtgaaccacccattccctcacacttgtggtgtggctttgcaaatcagcctgtttcctgtatacagtgtgaggagtgtgagaactcaggcaggctggactctgagcggggccatgggatctactttagaagagggtctctcacgcagccacacacagacacacacacacacacacacacacaagccaaaacaccatacatatcatgggaaaatctacgtgtacagatgtgttcagaggcagggcaggggctacacataaaacacagactacatcctataactccatgcacacacccacgagctgatggcttcaaggccaagctcaattcagtgaaagtaattctcagtggggtggggtggggtaggtggtgaggagcaggtgggaccaaggtaccatccagtaatggggcctctcacaatcaacctcagtgttgattttaaagtatctggagctaggggtttgaggctgcagtgagctgtgatcgctccactgcactctggcctgggtgacacagctagattctgtctctaaaaaataaacacggcagagtgcagtggctcacgcctgtaatcccagcactttgggaggccaaagcaggtggatcacctgaggtcaggagttcgaaaccagcctggccatcatggtgaatccccatctccactaaaaatacaaaaaattagccaggcatggtggtgcatgtctgtaaacctccacctcccaggttccagtgattctcctgccttagcctccccagtaactgggattacaggcgtgtgccaccatgtctggctaagttttgtggggtttttttggtttgtttgttttttgtttttttgagacagagttttactcttgttgcccaggatggagtgcagtggtgcgagcttggctcactgcaacctccgtctccctggttcaagtgattctgctgcctcagcctcccgagtagctgggattacaggcatggaccaccacgcccggctaattttgtgtttttagtagagatggggtttctccatgttggtcaggctgatcttgaactcccgatctcaggtgatccgcctgcctcagcctcccaaagtgctgggattacaggcatgagccacctcgcccggctgtttttgtttctaattacaaaattagcacattgctgttttaaaaacactcaaacaggccaggcacagtggctcgcacctgtaatcctagcactttggggggccgtgatgggaggatcacatgggcccaggagtttgagacctgcctgggcaacataggcagaccccatctctatttaattatttaaaaaaaaaataaaatttaaaactcaaacagtaagaggcatataaagaaatacaagaaatgcagcctcctccaatcccacttctgggatatgcccatcgtgaaaaatttggtgtgtgtccttccagattttcccatgtatggctgctgaaaaacatggaggttaagtctagtctctgcaggctggcagaccgggactcacttcacaactccactgctcatttgtttgttatgaggcctcagacaaatcattttacctggtttgggcctcagtctttgcatctgtaaaatggggataataatagcacttcataggattattatgagaattacatgaaataatgcaaataaaggcttagcacagagcttatttaaaagaatcccctgtatacatatgtcaatgcaaataggcatatactctgcattctgttctgcaacttgcttgccatggtgtatgcgggatgtctttccgtgtcaatacatgtcaatacaaaatacctcatccttttaactgtttcactaaacgttagcttggtaaatggttaacggtggtgattttgaaatgttacttcctggcaagtgttgctgtcatgtgcggccatgttgtcggcagtcacagatattattgatcagtgagctaactacaagccttatagcctcctgtgaaaatgaagtgacccaccagaggggcacccacctctgtcacagagggcagggccaaatgcatgggacgctctctgtctgcttacttctgcatcctcagctctaggtcagaatctggcacataggaggtacccattaaatttattttttttttttttttttttgagacagtgtctcagtctgttgccccggctggggcacatggtgtgatcatagctcactgtaacttcacacacctgggcttgagtggttctcccacctcagcttcctgagtagcctaggactacagatgtgtaccaccatgcccagctaattataaaaaaattcttggccaggcacagtggctcatgcctataatcccaatactttgggaggctgaggcaggaagatctcttgagactaggcattcaagactagcctgggcaacatagcaacaccccgtctctattaaaacataataataacaatacaatttatttatttatttatttagttatttatagatggagtcttgctctgtcacccaggctggagtgcagtggcactatctcagctcactgcaacctctgtctccgggttcaagcaattctcctgcctcagcttcccaagtagctgggactataggcacatgccaccaagcccggctaacttttgtatttttagtagaaatggggtttctactaaactcccaacactttgggagggtgaggtgggtgcatcatctgaggtcaggagtttgaaaccagcctggccaacatggtgaaaccctgtctctactaaaaatacaacaaattagccaggcgtggtggcaggcgcctgtaatcccagttacttgggaggctgagacaggagaattgcttgaactcgggaagtggaggttgcagtgaaccgagatcgtgccattgcactccagcctgggcaacaagagcaaaactctgtcttaaaaaaaaaaagtgtgtggagataagatctcactattttgcccaagctgcactcacactatgtatggtctcaagcaatcgtcctacctcacccattacatttttgtcaataggccagctcctttaatccacaagcagcagcctaagcccaaagttctctcttgcagtgtggcatttcctaaaatatgacctgtacaccactcaggtgtgtaagtgattttaggggataatggatgaccatttacgaatgttaatttatgtgtttattttagtgtgcgctgttgtttcacttctatttatgtctcatgattctggttttccatttatggtagtaaagtttccattttaggtacatatatcaaacgtgaaaaggtagcccgtggaagtgccaaaaatcatgaaggaaaatgaaaatgatcaatcattttagcctgaaagatgtttaaggccagtgtctatgtagcaagcactatgttaagcattttattatatgagatcatctatatatcacgtataatgctcaccacagccagccttagatgcaagtcttatttttgtcatcattttgctgatgaaggaactgagggaagtgcagaggtttagtaagctgcccaacaaccttctgccagtaagtcttgttttttttttttttgttttttttgtttttttgagacaaggtcttgctctgtcgcctaggctggagcgtagtggcccaatcttggctaactgtagccttgacctccccaatctcaggtgatcctctcacctcagcctcccaagtagctgggaccacaagcatgggacacaaagtccggctaatttttgtattttttttgtaccgacggggttttgccatgttgcccaggctggtctcaaactcctgggctcacgtatctgtctgcccaccttagcctcccaaagtgctgggattataggtgtgaaccaccacgcctggtgcccttctgccagcaagtgattgggagaacctggattgaatttgggttgccatggcatggacatggtgaactgagcttccagagctgccagactcccagaaacgtttataaagcagtgtggattgccaagctgtaagtaaggctccatcctaataaaactgtccatgatacaaaaagcacaccaaagtacccaagggagcggactcagtaaaagggattatcaggtatattcacgttactggttgggggacttctactaaaataccaattagaataattgctctatatcccttatttatagcgatacttgactagcagaatcagttctatgttcaagacactcccaatttgtgaaaataaatccattttgtttgcatccaaaataatgcttttttttttgttctctctgtgtcgagaggctacagagttcattcaaaaaaggtattaagccaggtgtggtggcttgcacctataatcacagcattttgggaggccaaagcaaggggactgcttgagcccaggagctcaagaccagcctggggaacataggcagaccccgtctctacaaaaaataaaaaaattaactgggcttggtggtgtgtacctgtggtcccagctactcaggaggctgaggtgggaggatcacttgagcccaggtggttgaggctgcagtgagccatgatcatgccaccgcactccagcctgggcaacagagtgagatcccatctctaaaggaaaaaaaaaaaaaagagagagagcggaattaaagccaggtgcagtggctcctgcctgtaatcccagctattcgggaggctgaggtgggaggattacttgaggccagaagtttcaggttgcagtgagctacaatcatgtgctgtactactccagcctgggtgacagagtgagatgtgagactccatctctttaaaaaaaaaaaaaaaaaccaggctgggcgcagtggctcacacctgtaatcccagcactttgggaggcggaggcaggtggatcacaacatcagaagttcgagaccagcctgaccaacatagtgaaactaaaattagtttctactaaaaaacacgtctctactaaaaatacaaaaaattagctaggcatggtggcgggtgcctgtaatcccagctactcgggaggctgaggcaggagaatcgcttgaacctgggaggtggaggttgcagtgagctgagatcacgtcactgcactccagcctgggcaacagtgcgagactccgtctcaaaaaaaaaaaaaaaaaaaacccagcctgtgtgacgtggtgagaccctgtccctactaaaaatacaaaaattatccaggcgtggtgttgcccacccatagtgccagctactcaggaggctgaggtaggaggatcacctgagctatgggaggtcgaggctgcagtgagccatgattgtgtcactgcactccagtctgggccacagagtgagataccatctcaaaaaaaaaaaaagtattatgtatttaaacaaatatgaaaaaggaggtagcccaggacacatccctgatttacccactagaaattaattactgacggggcacggtagcccatgcctgtaatcccagcactttaaggggctgaggcagtggattgcttaagctcaggagtttgagactagcctgagcaacatggcaaaaccctgtctctacaaaaattaaaaaaatacaaaaattacccgggccctctcattcacagcttctcaggtaaaaaaaaaaaaagaaaaagaaaaagaaaaaaaaaatagctggaggctgggtgcggtggctcatgccacacctgtaatcccacactttgggaggccaatgcaggcagatcacttgaggccaagagttctagactaccctggccaacatggtgaaaccccatctctactaaaaatacaaacattagccaggtgtggtggcacacgcctgtagtcccagctcctcgggaggctgaggtaggataattgcttgaacctgggaggcagaggttgcagtgagccgagattgcaccactgcactccagcctgggcgatagagtgagacttcatctaaaaaaataaaaataataataataataataatgataataataatagccaggcgtggtggcacatgcctgttgtcccagttactcaggaggctgaggtgggaggattgcttgagcccgggaggtcgaggcttcagtgagctgtgattttgccactgcactccagtggcacaagagagcaagagagcaagagggcaagaccctgtctcaaaataaaataaaataaagaaagaaattatttgccatgcctgctagccctgattcttgatattgcttgatattgtcatgagggttctatgtgggcatgaatagctaaggctctttattgaacatgggcagctttgtcattaatcaagtctgggtcggggcaaaggcgaagaaaatgttttaaatgattcatttttttttaattttatttttatttttattttattttattttatttttgagacagagtcttgctctgtcgccacgctggagtgcagtcccgggtttaagcaattctcctgcctcagccttccgagtagctgggactacaggtgtgcaccaccacgttcagctaattttttgtatttttagtagagatgaggtttcgccatgttggccagaatggtctcgatctcttgacctcatgatccacccacctcagcctcccaaagtgttggggttacaggtgtgaaccactgcgcctggccttttatttttatttttacagagacaaagtctcactatgttgcccaggctggtcttgaacttctgagctcaagtgattttcccatctcggccctaggattacaggcgtgagcctccagccctggctattctaaatgatttctgacagattttgccatgaggtggtccagagtacaacaatggtctgcagtagaatagtctgcttgttcttttttcttttttactttttgtgctctacatgttcagagaaactgaactaaagaaatgatccctaaaggaagtatagtcttgtctgctgttttttgtgttgctttgtttgttttgttttgtttgagagaggttcttgctctttcccccaggctagagtacagtggtatgatattggctcactgcaacctcaacctcctgggctcagcgatcctcctaccttaacctcctgagtagctaggactacaggcgtgcaccaccacacctggttaatttttgtattttttgtagagatgagttctcaccatgttgcccaggttggtcttgaactcctggcctcgagtgatccttccactttggccttccaaaatgttgagattactggcgtgagccattgcatccgaccacctgcctgttcttgatgtaaagcattggcccaagaaactcagccacgaagctggcacacattttggacaaaatgttcaataaatcaataggtctatagttggaggagaaaaaatgttaacttaaaaattttttttaatttaatttaattaattttttctttttttgagacagggtcccctgtcgcccagactggtgtgcagtggtataatcacggctcactgcagccttgacttcctgggctcagtgatcctcccacttcagcctcctgggtagctaggactacaggcaaatgccatcacgccatcatgcttggctaatttttttttttttttttttttttttgagacagagtctcactccatggaccaggctggagtgcagtggcgtgatgtccactcactgcaacctccgcttccccagttcaagagattctcctgctggccgggcatggtggtggctcaagcctgtaatcccagcactttgggaggccgaggtgggcggatcacgaagtcaggagttcaagaccagcctagccaacatagtgaaaccccgtctctactaaaaatacaaaaattagctgggcctggtggaacgtgactgtaatcccagctacttgggaggctgaggcaggataatcacttgaacctgggagttggaggttgcagtgagccgagatcgtgccactgctccctagcctgggcgacacagtgagactctgtcctctgtctcaaaaaaaaaaaaaaaaaaagggccaggtgtggtggcttacacctgtaatctcagcactttggaggccgaggtgggcagatcatgaggtcaggagtttaagaccagcctgaccaacatggtgaaaccccgtctctactaaaaatacaaaaattagccgggcatactaggcgcatgcctccaatcccagctactccggaggctgaggcaggagaatcgcttgaacctgggaggcagaggttgcagtgaaccgagatcacaccattgcactccagcctgggcaacagaactagactctgtcagaaaaaaaaaaaaaaaaaaaaaaagagattctcctgcctcagcctcccaagtagctcaagtagctgggactacagtcacgtgccaccacacccagataatctttgtatttttagtagagatggggtttcaccatgttggccaggctggtctcaaaatccagacctcaagtgattcacctgcctcggcctcccaaagtgctggggttacaggtgtgagccacggcccccggtagccggacgccggccactaattatatagctgagcatggtcgggtgccgtggctcacacctgtaatcccagcactttgggaagccgaggcaggtgaatcacttgaggactggattttgagaccagcctggccaacatggtgaaaccccatctctgctaaaaatacaaaaatcagctgggtgtggtggtgcgtgcctataatcccagctacttgggaggctgtggcaggagaatctctttttcttttcttttttttttttttgatggagtctagttctgtcacccaggcttgagtgcaatggcgcgatctcggctcactgcaacctctgtctcctgggttcaagcgattctcctgcctcagcctcctgagtagctgggattacaagcatgcgcctagtacacctggctaatttttgtatttttagtagagacggggtttcaccatgttggtcaggctgctctcgaactcctgggctcaaggagtcctactgcctcagcctcccaaagtgctgggattacaggcgtgagtcaccatgcccagactccttctggtcttagtttgataaagattgctgagtagccaacatgatctaaccaggttaataaatgaggtcagtaaaaagaaaatcaaaattaaagcttaatataaatttctcattgtctgaaagaaagaagtggaggaagggagaaaaaaaaaaaaaaaaaaacagatgaaaggaatccccagggctcccagaaccagcaatgagggcagattctggggtgaatgaaacaggacattcttttctcccaatttaggaatccaaggtcacgagtaagaatttcatagattcgaggctgcctctgactagggcatgtaatgttctcagtcaaacttaaggctgcccgtggtccacagaacattttgtgatgattataaaaaggccacaggccaggtctggtgactcatgcctgtcatcccagcactttgggaagcggaggtgggcaggccacttgaggttgggagttcgagaccaacctggccaacatggtgaaaccctgtctctactaaaaataataaaaattagcgggcatggtggtgcatgcctgtaatctcagctacttgggaggctcaaacaggagaaattgcttgaacccaggatgtggaggttgcagtcagctgcgattgtgccactgcactccagcctgggggacagaggaagactccgtctcaaaataaataaaataaataaataaataaataaataaataaataaataaataaataaaaattagactgggcatggtggcccatgcctgccatcccaacactttcggagtctgaggtgggaggactgcttgagcccatgagtttgagaccagcctgggcaacatggtgaaaccttgtcactgcaaaaaagtaaaaataaaaggctgggcatggtggcttatgcctgtaatcccagcactttgggaggccaaggtggcaggttagtaatcccagcactttgggaggccaaggtggcaggttacttgagcccaggagttcaagaccagactggccaacatggtgaaaccccatcattacaaaaaacacaaaaattagtcaggcttggtggcatgggcctgcagtccccactactcaggaggctgaggtaagaggatcccttgagcacaggaggcaggagtttgcagtgagctgagacagtgccactgcactgcactccagcctgtgcgacagagcaagaccctgtttaaaaaaaaaaaaagaagaagaccggaaggatggggtatacccacattttgtataaacagatgtatgcctatatgacttcacaattacatagggacggtcgctgctattcatagtctcattctgttatatatccctctgcacacacagactcctgcaaacccacagatatgcacccataagcacagggctcactgcatatgttttcatatgcacagacttgcattcaacaggcaggtaaatatatacccagaaacgtgcattccaggtagaggggggattgtcttgaagagaaaagcctttgttaacagcacagtggtcaaatttttgatgggaaatggaccctaccctgtcagacctgccttcctgcctcacattctcctagacctctcagccctccccctccacccttagactttccagggagtgaaaagtagaggagaggatcttgataaaggatgtaggagccaagccaggcatatgccagcaatcccagctatttgggaggctgaggtgggagaagcgcttgagcccaggagttagagaccagcctgggcaacgtagtgagacctcgtctaaaaaaaaaaggatgtaaggttttgatatgagttttgcatctgccaggaaccctcagtgtattattgggacaatcactgaacctctccttttccccagttttaaaatgaggctgatgaactgtatttgtgtttcctaaactcttgtgaagacaaagtgtcttttaccattccctgttctacactccctcttccccacatggatctcatgattttaaagtttttacctactaagctacctcatttagatgcaaattttcttattttcaagttaaaaaaatttttcttttaatagagaaagggtctcaccacgttgcccaggctggtctcaaactccggggctcaatcgatcctctctcctcagcctcccaaagtgctgggattacaggtgtgagtcactgcacctggcctcaagtttacattttaatcaaagatttggctgggcacagtggctctcgcttgtaatctcagcactttgggaggccgaggcaggtggatcacctgaggtcaggagttcaagaccagcttgggcaacatggtgaaacctcatctctactaaaaatagagagattagctgggcgtggcggcacgtgcctgtaatcccagctgctcgggaggctgaggcacggaggttgcagtgagccaagattgcgccactgcactccagcctgggtgacagagtgagactttgtctcaaaaaaaaaaaaaaatgtaatcagcgatttaattaagtatgcaatgaagaaataaataatacaatttgtcaaaacaagaaacaaagtatagtggaatttcctttcagatttttgaaatattaaaataacctaaaggcctccccggcactagcctgggacttcctgggagcatgtaaacttcaggctgggagcctctgactacaaacatttctggcattgccagatcctatggacttacgattgctgccaggccctatcctccaaagctcacatgcttatagagggcaggaactgccacctgtagctggggggccatagaggaaacagtagaggccagataccctgcaaagctagagttcctctgatcttaatttaacataggctgactttttctcactttttgcccagtcttaagtcggggattttctggcccagattcagtccagaatctaggacctgccttgcatgctttcctggatcctagcccaaggccttgtgattccttttccctccccacctgaccccagcctggaccaggtaccagcttccagccccatgatctccaacctagattccttctgcttcttctactggccttttctcactgttgcaccatagtttatctcttctccttctcctcctccttcttcttcctcttctttttttcctttatatagagactgagtcttgctacgttgcccaggctggtctgaaactcttggcaattctcctgccttggtttcccaaagggattacagacatgagctacagcacccggccttgttttgagacagggtgttgctctcttgctctgttatccaggctggagtgcagtggcgtgttcacggctcactgccgcctcaacctcccaggctcaagtgatcctccccactcagcctcctgagtagctaggactacaggggcgcaccaccatgccctgctaattttcagattttttttgtagagataaggtctcactgtgttacccaggcactggtctctaattcctgggctcaagagatcctcctggccgggcacggtggctcacgcctgtgatcccagaactttgggaggctgaggcgggcaaatcacaaggtcaggagatcaagaccatcctggctaacatggtgaaaccccgtctctactaaaaatacaaaaaaaaaaaaatagccgggcacagtggcgggcgccggtagttccagctactcgggaggctgaggcaggagaagggcgtgaacccaggaggcagagcttgcagtgaatgagtcgtgatcacgccactgcactccagcctgggcaacagagcgagactctgtctcaaaaaaaaaaaaaaaaaagagagatcctcctgcctcagcctccaaaagggctgagattataggcctgagctactacgccctttcttcctcctcctcctcctccgccaccaccacctcctctcctccttcacctcctcctcctcttcctcctccccctcctcatccctctcctccccctccccttccccctcctccccatccccttccccctcctccccctccccttccccctcctccccctcctcttccccctcctcccctccccctccccttccccctcctccccctcctcttccccctcctccccctccccctccccttccccctccctttctttctcctccttcttcttctttcccatctctcccttcctcctatacattccctcttcttaacctcaaacttctacaatctttctcttgcctttttctaaaggctccaagaatgtcaagcctggcagggaccttactggtctaagtccacattccatctgatgttggtattctctttacaacacaaccaacttgtggtttcctaaggctcatacgactatcacaaacaacaggatgctcactacctcacaaaacagctcagcttatctgagaccagttccaggttgctgttagtcctttactgggggctcttgttgctaattactctcaggctataatagtcaaaaagtcatttgcagtcacagatgggtgcactctggtctagcaggatttcccaaatgtccacctccccccaggactcctaacagtaggggaaagagtgaatacgtacccttttcctggaaagtttcttgatttgatttaaaattccatgcacattttgcattttcctccataataggtcatgtttgtttaacttacatgaataaggtcaggaaacactcatgctctggaaaaatgcacaccatgacatgacttccggtacccatgggaggctgagtatctcagtttaagaaacaggagtcgagctgggcacggtggctcacgtctgtagtcccagcactttgggaggtcgaggagggcagatcacctgaagtcaggagttcaagaccagccagaccaacatggtgaaaccctgtctctactaaaaatacaaaattaggccgggcatggtggctcatgcctgtaatcccagcactttgagaggccgaggcgggcagatcacctgaggtcgagagattgagaccagcctgaccaacatggagaaatccagtctcttaaaaaatacagaattagccgggtgtggtggcacacgcctgtaatcccagttacttgggaggctgaggcaggagaatcacttgaacctgggaggtggatattgcagtgagccgagatcacaccattgcactccagcctgggcaacaagagcgaaactctgtctcaaaaaataataataataaggccgggcacagtggctcacgcctgtaatcccagcactttgggaggccgaggcaggaggatcacaaggtgaggagattgagaccatcctggcaaacacgatgaaaccccatctctactaaaaatataaaaaatcagccaggtgtggcggcacgcgcctgtagtcccagctactagggaggctgaggcaggagaatcgcttgaacccaggaggcggaggttgcagtgagctgagatcgcgccactgcactccagcctgggagacagagtgagactctgtctcaaaaaaaataaaaaagaaaaaagtaatgagagaaatgcaaatgcagaaagagaaatgcaaatgcctggcagtatgttgggcttcttttcaaaacttaaaaaaatttattattattattcatttatttatttactttagacaaggggtcttgttctgtcacccaggctggagtgcagtggtgcaatcgtagctcactgtggccttgaactcctgggctcaagtgatcctcctgcctcagcctcccaagcacctgggattataggcatgcaccaccatgcccagctagtttttataataataataataataagaggcttgcttgaggtgatggatagctcatttatcccttttgtgattattacacattgtatgcctctatcaaaatatatcatgtaccccataaacatatatacttaccagatacccataaaagtaaataaataaataagtaaataaataaatatacaaaattagccgggcgtggtggcacatgcctgtaatcccagctacttgggagactgaggtaggagaatcgcttgaacctgggaggcagaggttgcggtgggccgagatcgtgccattgcactccagcttgggcaacaagagcaaaactccgtctcaaaaaaaaaaaaaaaagaaaagaaaagaaacaggagtctagggctgggcacagtggctcattgcctgtaatcccagcactttgggaggctgaggtcaggagttcgagaccagcctggccaacgtggcaaaactctgtctctactaaaaatacaaaacacaaaatacaaaaattagccaggcgtggtggtgcacgcctgtagtcccacctgcttagggaggctgagggaggagagacagagcttgcagtgagcccagatcacaccactgcactccagcctgggcaacagagcaagtctaaaaaaaaaaaaaaaaggaaagagagaaaagaaacaggagtctaggctgggcatggtggttcacgcctgtaatcccagcactttgggaggctgaggtgggtggatcacttgaggtcaggagttcaagaccaccctggccaacatggtgaaacccccatctctactaaaattacaaaaattagctgggcgtggtgacacatgcctgtagtcctagctagtcagggggctgaggcaggagaatcacttgaacctgggaggtggaggttccagtgagccaagttcacaccactgaactccagcctaggtgacagagtgagattctgtctgtttttttttcttttgagatggtatcttgctctgtcacctaggctagagtgcaatggcgtggtctcagctcactgcaacctccacctccatggttcaagcaattctcctgcctcagcctcccaagaagctgggattacaggcgcgcaccaccacgcccagctaatttttgtatttttagtagagacagggtttcaccatgttggccaggcttgtctcgaactcctgaccatgtgatttgccctcctcagcctcccaaagtgctgggattacaggcatgagccaccgcgcccagccgagactctattaaaaaaagaaaaaagaaagaaacaggagtctaaagcaaaggagattaattacccagtcccattcttccaccttccaaagcaggagttggtaggacagaattgtgcactggtgaaagtgtttctaagcactaaactaagctaacattcatgtgagcttatgagaaatggatgaagagccccatttgacagaagaggaaaagtgaggcttaggaggaatgatttcagcaaagtcacacagtaagtgtcaaaattgctatttgaacttaggtctctaactatggggacagtcttctgagttttgctaatgagaaacttccactgctccctgcttccacttagacccagcatgaattctctctctctgtctctcttttgttttttctttttagacagagtctctgtcacccaagttggagtgaacagtgcggtggcagtggcaggatctaggctcactgcaacctccacctcttgagttcaagcaattctccagccaccatgcccagctaactttttttttttttttttttttgtatttttagtagagacagggtttcaccattgttggccaggctggttgtcttgaacttctgaccccaggtgatccacccaccttggcctcccaaagtgctgggattacaagcatgagccaccgtgcccagcctgctcttttgagatggagtctcgctctgtcatccaggctggagtgcagtggcttgatctcggctcactgcaacctctgcctcccgggttcaagtgattctcctgcctcagcctcctgagtagctgggattacaggcgtgtgccaccatgcctggctaatttttgtatttttagtagacacggggtttcaccatgttggtcaggctggtcttgaacacctgacctcgtgatccacccgcctcagcctcccaaagtgctgggattacaggaatgagccatcgtgcccggacttttttttttttttttttttttttttgagacggacggaatctcactctgttgccaggctggagtgcaatggcgcaattccggctcactgcaacctctacctcctgggtttaagcgattctcctgcctcagcctcctgagtagctgagattacaggcacctgccaccaagcccgattaatttttggatttttagtagaggcagggttgcaccatgttggccaggatggtctcgatcccttaatcttgtgacccacccgccttggcctcccaaagtgctgggattacaggtgtgagccaccgcgcctggcctttttttttttttttttgagacaggctctcgctctgttatccaggctggagtgcagtggcacaatcgtagctcattgcagccttgagctcctgggctcaagtgatctttttgcctcagcctcccaagtagctggaactacaggcatgccccatcacacctggctaattttttgattttttttctagagatgaggtctcactatgttgcccaggctagtctggaacttctgagtttgaatggtcttactgcctcagtctcccaaagtgccgcgattacagatgtgagccaccacgcccggccagcaactccagctttgctctactccaaataggttgtgtgactttaagcatacctctgtgggcctcagtttgctcatctaaaatcagaggtttagccaggtatggcagctcatgcctgtaatcccagcactttgggaggccaagaaggaaggatcacttgaagccaagaatttgagaccagtccgggcaacatagcaatacccccatctctagaacaaataaaaaatcacctgggctcagtggtgccagctacccaggaggctgaagttagaggatcacttgagcccaggagtttgaggttccagtgagttaggattgggtcattgcactgcagtctgggcaagagagtgacactttatctcaaaaataaatcaacaaataataaaattggagattaggcttgctggtttctaagacctttgcagatgggagactctatgcattaacactgcatgttccagttgacatttattaactaattttgggtgctggtggctttcagacaaataaactacagcttctgctcttgatgaacccccactctcatcaaaggtatgggagaggcagtgggaccctggggctgacatgtaaatcagtaatcatggaactctgtgtctaagttgattattgaggtctgaatagaatgttgcaggagactggggtgagagggaagcaaagagcattgggaagtcttcagactaggtgatatttaggccaggtgcctgtaatccgagcactttgggaggctgaggcaggagaattgcttgaggccaggagttcgagaccagcctggccaacatggtgaaaccctgtctctactaaaaatacaaaagttagccaagcgtgatggtgcatgcctgtaatcccaactactcaggaggccgaggcaggagaattgcttgaacctgggaggtagaggttgcaggaaaaaaaaaaaaggtaatatttcagctgagccttgaaggttgagttagaattcagcagttggacaaaagagagcatgccgactgggttcggtggtgcatgcctataatcctagcatttggggaggccaaggcaggaggattgcttgagcccaggagttcgagatcagactgggcaacatagtgagacctcatctctacaaaaaaataatcagctgggcatgatggtgtgcacctttagtctcagctactggggaggttgaggtgggaagattgcttgagcccaggaggtctaaggggattgcgccactgcacttcagcctgggagaggaagggagaccctgtctcaagagagagagagaaagagagagagagagagaaagagagagagagagagaaagagagagagagagagagagagagagcgagagagcgcacgcatttcaaagcagggagaaccacaagtacaaaggcattaagtaagaaaatagcatggggtgtttgggaaaggcaagaatagttcagaacacaggctgtgtgtgtgggggtgtgtgggggtgcctgtgtgtgggtgtttgtgtgtgtgtgagtgtgggtgtgtgggggtatctatggaggggatgcctgtgtgtgtgtgtaaggtgagtgtgtggatgtgtgcatgggtgtgggtgagtgtgtggaggtgcctgtgtgtgtgtatgaatgtgtgttggggaggggagaatgtgtgtgtgtggggtgagtgcgtgtgtgtgggggtgaatgcgtgtgtgtgtgtatgtgggtgtgactgtgtgggtgtgtggacgagtgtgtgtgttcctgggtgtgggagcctgtgtgtgtagggggagtatgtatagggtgtgtgcatgaatgtgtgtgtgggtacgtgtgtgagagtgggtgcctgtgtgtggggggtgagtgtgtgtgtgggggggcacttgtggagggtgagtgtatgtgtttactgagtgtgagtgtgggtgcctgtgtgtgggagggtgagtctgtgtgtgagtgtgtgggggagtacctgtgaggggtgagtgtgtgtgtttatgtgaaagtgtgtgtgtgtggatgcctctgtggaggtgggatagggggtgcctctgtgtgtgtgtgtgagagtgtgtgtgtgtagggtgtgtatatgtatagggtgtgtgtgagtgtgtgtgtgtgagagagtgtgtgtgtggcagaatagactgcggaggtggatttcatcttgatatgaaaggtctggaatgcatggtacattaaactttgaggacagcgctttccaagcactctgaggagcagccctagagaaggaggagctgcagggactccgggggcttcaaagtgagggccccactctgcttcaggcaaaacaggcacacatttatcactttatctatggagttctgcttgatttcatcagacaaaaaatttccactgctaaaacaggcaaataaacaaaaaaaaagttatggccaacagagtcactggagggttttctgctggggagaagcaagcccgtgtttgaaggaaccctgtgagatgactgtgggctgtgtgaggggaacagcgggggcttgatggtggacttcgggagcagaagcctctttctcagcctcctcagctagacaggggaattataataggaggtgtggcgtgcacacctctccagtaggggagggtctgataagtcaggtctctcccaggcttgggaaagtgtgtgtcatctctaggaggtggtcctcccaacacagggtactggcagagggagagggagggggcagaggcaggaagtgggtaactagactaacaaaggtgcctgtggcggtttgcccatcccaggtgggagggtggggctagggctcaggggccgtgtgtgaatttacttgtagcctgagggctcagagggagcaccggtttggagctgggaccccctattttagcttttctgtggctggtgaatggggatcccaggatctcacaatctcaggtacttttggaactttccagggcaaggccccattatatctgatgttgggggagcagatcttgggggagccccttcagccccctcttccattccctcagggaccatgggctgtggctgcagctcacacccggaagatgactggatggaaaacatcgatgtgtgtgagaactgccattatcccatagtcccactggatggcaagggcacggtaagaggcgagacaggggccttggtgagggagttgggtagagaatgcaacccaggagaaagaaatgaccagcactacaggcccttgaaagaatagagtggccctctcccctgaaatacagaaaggaaaagaggcccagagaggggaagggaatctcctaagatcacacagaaagtagttggtaaactcagggataacatctaaccaggctggagaggctgagagcagagcaggggggaagggggccagggtctgacccaatcttctgctttctgaccccaccctcatcccccactccacagctgctcatccgaaatggctctgaggtgcgggacccactggttacctacgaaggctccaatccgccggcttccccactgcaaggtgaccccaggcagcagggcctgaaagacaaggcctgcggatccctggctgttggcttccacctctcccccacctactttctccccggtcttgccttccttgtcccccaccctgtaactccaggcttcctgccgatcccagctcggttctccctgatgccccttgtctttacagacaacctggttatcgctctgcacagctatgagccctctcacgacggagatctgggctttgagaagggggaacagctccgcatcctggagcagtgagtccctctccaccttgctctggcggagtccgtgagggagcggcgatctccgcgacccgcagccctcctgcggcccttgaccagctcggggtggccgcccttgggacaaaattcgaggctcagtattgctgagccagggttgggggaggctggcttaaggggtggaggggtctttgagggagggtctcaggtcgacggctgagcgagccacactgacccacctccgtggcgcaggagcggcgagtggtggaaggcgcagtccctgaccacgggccaggaaggcttcatccccttcaattttgtggccaaagcgaacagcctggagcccgaaccgtaagtggggacccgtcgtgggggtgggtaggagcagatctagggatcctggagcagggagtaggcctggggtggcggtgaaggcttgagggccacggaggaagatccgacgacagccgacggccttcgttcgcttccgccctgcacagctggttcttcaagaacctgagccgcaaggacgcggagcggcagctcctggcgcccgggaacactcacggctccttcctcatccgggagagcgagagcaccgcgggtgagcgggcggcggtctcgaccgggcgcgggggtgccccggggtgtgcccgagggggggcgcagggtgagcccgaggtggagacacggggtgagtcggagggggacgcgggatgagcccgaggtgggggcgcgggatgacccggagttgggggtgctgggtgagcccaaggtgggggcgcggtggcgggccagactcactgcgttctttcgtcgctttgtccatccattcattcattcaggatcgttttcactgtcggtccgggacttcgaccagaaccagggagaggtggtgaaacattacaagatccgtaatctggacaacggtggcttctacatctcccctcgaatcacttttcccggcctgcatgaactggtccgccattacaccagtgagcccgacgggacccctcccccgtgccctatcagcctatctcccctcagtccccctcaggtgtcccccatccatctttcaatgccctactccattccccgcagtgggtgaggtgtggaacctgaccctacggccccaagtgtttgggtgacagccccacacccccttgctagtccacttcacctagatgggggcttggagaagtgggggaggtggtgtcaatacgaggcctgccctattgacagccttcacccctccctcgtcctcgcagatgcttcagatgggctgtgcacacggttgagccgcccctgccagacccagaagccccagaagccgtggtgggaggacgagtgggaggttcccagggagacgctgaagctggtggagcggctgggggctggacagttcggggaggtgtggatgggtgagtgtggcctccaggactgcctgggaagaggggaacgggaggggccgctgaggtgatgagagtcccaggacagctgcctggcgactttcccactccttcccttccccgacccagggtactacaacgggcacacgaaggtggcggtgaagagcctgaagcagggcagcatgtccccggacgccttcctggccgaggccaacctcatgaagcagctgcaacaccagcggctggttcggctctacgctgtggtcacccaggagcccatctacatcatcactgaatacatggagaatggtgggtgctacccgagtcggctaccaggggatactgctctccctgctgtccctgccagagggtggaaatacaccttttcttctggcccaaagctcaagcaaggagggtttcttgagctttcctgccccctggagactcacctccagccgggcgcggtggctcaggcctgtaatcccagcactttgggagccgaggcgggcagatcacgaggtcaggagttcgagaccagcctgaccaatatggtgaaactctgtctctactaaaaatacaaaaagtagccaggtgtggtggcacatgcctgtaatcccagctactcagaagactgaggcaggagaatccctttaatccgggaggtggaggctacagttgcagtgagctgagatcatgccactgaactccagcctgggtgacagagcaagactctatcaaaaaaaaaaaaaaaaaaaagactcacctccaggcatgagaaaaaggtgtatcctctgatctgatcctgtctgggggcaagcctaaggtggcaagaatgttctggaagagcattcaccccaaccttccctgacctgccattctgtttgccttcttcaaagccctaccttgatctcaggatgcttgatctcagaaagcaagtgggtccctagccctgtttctctcccttctgcccctgagccctaggagggcagatctgcccccaaagccctctttttcagttctgagtgagacccccacccctgcacccctcttggtctgttactggacagagtgagagccccaggaagaggaatatgagtttctagcttcagctttgttcacaccgatttgccgtgtgacaggccaagtgcctgcactgtctctggtgctcagtttccccaagtataacagcagaaatctaaatgggctcaccagaaataatacagagtattcatcaaggcctctagagtctgactgcctgggtcagaagcctggcttcatgattttatggctttgtgataattatatcacctctttctgccatggtttcctactataataacgcgttagtaacttcctcacagggtcttgtgaggatgaaataattaatgcatacagagcagttagaactatgcctacttccaggtgctgtggctcaagcctataactccagcactttgggaggccaaggtgggtggatcacttgagcccagaagttcaagaccagtctgtgcaacatagcgagacttcattcctacaaaaaaatgtttaaaaattagctgggcatagtggtgtatgcctgtagtcccagctacttgggaggctgaggtgggaggatcacttgagcccaggaggttgaggctgcactgagctgtgattgcaccactgcactccaacctgggtaacagagcgagaccttgtctcaaaacaaaaaacccacaaaactatggctaccatatagtaactgatcaataagtttgttgctgttatctggctctgattctttgggagtgtaagatctatccttttttcaggaagagaaacaagctgttcattggctaatgggaaatggcaaatagattatgtcatgtgtatcttttttttttttgagtctcactctgtcctccaggctggagtgcagtggcatgatctcggctcacttcagcctccccctcctgggttcaaatgattctcatgcctcagtctcccaagtagctgggactacaagcatgtgccaccatgcctggctaatttttgtatttttagtagagacaggttttcgccttgttggctaggctggtctcgatctcctgtcctcaggtgatcctcccgccttggcctcccaaagtgctgggattacagatgtgagccaccatgcccagcctatcatgtgtatcgactttgattggtagttgcttgtagtgctggagaaggattctgaggttcattggaagtgagtgccaggaatgattagtaacatctgccatggatacaatggaagaatggcagtatatctatgtctatgtatttgctgtgtgtaggtgaggtctttgtctttggtaactagttcagcactcaaagtggggacactcaggttgctgtcatccttttacagggttttaatctcttgggaagggccattggtcactcactgcatcctagcaactcccatccatgtccagctgccctccactattagagaggtggtccctcagacccccagaccccctctttcttattccatccaatatattcagcacatagttattgtttcttactctcggctgggcaccaggaacatggatggatgaaacaaggttcctgttgtcagggaaacctgattttagttacagctactggggaaaccagagtttgtgccatgggaaagttccagcatgcccatgggagtgtagatgatgatccagtttattatgcctggtaggatctagagaggcttcctagtggggcagtctagcagggccacgaaagaaaagtagaattttttttagcaggcagagatgaaacaaagaggctttggggtgagagcctagtggtctgagtgcaggatctcaaaattgctaaactgtttgaagtcaaaggcagagtgggggaaagagaagaagctaccagtgtggaccatgccaagcttaggatactagttgaggattctaggttctaccttattggtgatgaaaaacctacagatccctcccagcatgctctaccctagcccctctgcaaaaaaacctttacatatcctgggcatccttaccctgaacacacactcctccattctcactcttcaatcttccttttcacatgtcagacacacttctagactcccagttggaggagaaaggtctgggggcctccccctggggcaacttgggccagcaactcttgcttctgcccacagggagtctagtggattttctcaagaccccttcaggcatcaagttgaccatcaacaaactcctggacatggcagcccaagtaaggagactggggaggggggctgggcaagggaacagaccagtgacgtgaagacatctggctcaggaccgctgatctgtgtttggcctgcagattgcagaaggcatggcattcattgaagagcggaattatattcatcgtgaccttcgggctgccaacattctggtgtctgacaccctgagctgcaagattgcagactttggcctagcacgcctcattgaggacaacgagtacacagccagggagggtacgtgtgagatttaagggtggtctgggccctgcagggtctggccaagcagacccaggtgacctcactctgcctcctccttaggggccaagtttcccattaagtggacagcgccagaagccattaactacgggacattcaccatcaagtcagatgtgtggtcttttgggatcctgctgacggaaattgtcacccacggccgcatcccttacccaggttagagccaagggcaggaactgaaagggtgatgggaagggcaagtccatgtcttcccattcaattctttccagtctcagaatctgaaactttgtagctgcatctcctctatcttctcaggggtatgagtccaacgtccccaggcagatgccacatctcccagggctggcttccatctccgtatctctctttaataaccccagctcttttctttttctctttttttctttttcttttttttttttttttttttttttttttttgagacggagtcttgctctgtctcccaggctggggtgcagtggcgccatcttggatcactgcaacctctgcctcctgggttcaagtgattctcctgcctcagcctcccaaatagctaggattacaggtacgtgccaccatgcgcagctaattttttgtatttttagtagagacagggtttcaccatgttagccaggatggcctcaatctcctgacctcgtgattggcctgcctcggcctcccagtgttgggattacaggcgtgagccaccacacccggccccagctcttttctttagttctggcccaggcagcctggtatggtagaagaagatctagctcaggaacaagaggcctaccttttatcagcagatctgccactgttgctaactttctgtttggctttgttcagatcattactgtaactagtgaagctagtcacttcacttctctaagcctcagtttcctgatactaaaaataagagactaggccaggtacagtggcttatgcctataatctcagaactttgggagaccaaggtgggaggactgcttgagcccaggagttcgagaccagcctgggaaactggtcgaaaccccatctctacaaaaacaaaagttagccaggtttggtggcatgtgcctctagtcccagctactcagaaggctgaggtgggaggatcacctgagccagggaggcagaggttgcagtgagccaagaccatgccataacactccagcctagggcaatagaccaagaccctgtctcaaaacaagaaaaagagagactccatctctacaaaaaaaaaaaaacaaacaaacaaaaaaaacatttaaaaattagctgggcatggtggcacacacccgtagtttcagctatttgggaggctgaggtgggaggatcatttgagcccaggaggttgagggtgcagtgagccatgattgttctattgcactccagcctgagcaacagagagagaatttgtctcaaaaaaaaaaaaaaagaaaaagaaaaagaaaaaagaaaaaatgagagaccatttgtgaaagagcctgactcatagtaggttgtcagtatacactgactcctcccaccatctcctggacaaagccctttacccctgaattcagccaagacagggatggaatttttgaaaggaacttgctaagaaactctggggaaaggaaatggagcataaagacaggagtaggggggtcatgcggcacagtggctagatttgtagaagcttcccatatccccagagcaaggtgaacagacctttgctccaaggaaggtaaagacaccttggaaggccggatgcagtggctcacacctgtaataccagcactttgggaggccgaggcgggtggatcacaaggtcaggtgttcgagaccagcctgaccaacatggtgaaaccccgtctctactaaaaaaaatatatataaaaattatctgggcatggtggcacgcgcctgtaaccctagatactcaggaggctgaggcaggagaattgcttgaacccaggaggcagaggttgcagtgagctgagatcatgccaccgcactccagcctgggtgacaaagtgagactctgtttcaaaacaaaaacaaaaacaaccaccttggaaacaggtgaaaagctgaggggcttccctgccctgggcttgccccaaaccagcgtccaggggtagtgctggagctggaaatacagaaatattctccagttatcctgccaggggtcctcactgctccttcccggttcccacagaggcaaacccatagggaatgtatctattagaagaaaataggcagtgaaagcatgatgataaatggcaactgacatatagcattagggtcagggagacaatggggagaaatggggaccttggtaaacttgcagctgctccagcagatggctgcaattaaggcgtgggggacccaaaaaaacagatcttttgtttttttaagagaagcccaaacttggagttttaggaaaatctgttcatttccatttattggcgattgattcaaattgtttaaaagcactctaggggctgggcacggtgactcacacctgtaatcccagcactttgggaagctgaggtgggtggatcacaaggtgaggagtttgagaccagcctggccaacatggtgaaaccctgcctctactaaaaatacaaaaatattagccaggcgtggtgttgggcactggtagtcccagccactcaagaggctggggcaagagaatcacttgaaccctggaggcggaagttgcagtgagccatgatcacgctgttgcactccagcctgggtgacagagtgagagtccatctcaaaaataaatataaataaattaaataaataaattaattaaatgaataaataaataaaaccactctagggccaatccaaagtggatctgtgggctatactcaggctggatttagcctgtgggcttgcacccttaactctggccatgggtgtttagttccgtggcctatgtcctcctatgccccagttttaaaatgtgagagtcccagccaggcgtggtgggtcacgcctgcaacccagcactttgggaggctgagatgagcggatcacgtggtcaggaggtggagaccagcctgaccaacatagtgaaaccccatctctactaaaaatacaaaaattaaccgggtgtggtggcatgcacctgtagtcccagctactcgggaagctgagacaggggaatcatttgaacctgggaggcggaggttgcagtgagccgagactgtaccattgcactccagcctgggcaacagagcgagactctgtctcaaaaaaaaaaaaaaaaaaaaaaaattgtgagagtcccataggcagaggctcccttgtacaagtcctggggaaaaagggtctctgttgaccaggctttagtcccaagctttccaggagcaaaactttgattttgtaaataccctataaggttttggtctttgggaactgcttgtcacaatctttgttcagaagactgaaggagaaaccagacactacatgagcaatttagaaatagggaaggagggagctatgttactgctgtgatcatgtagttctccagagcagctcttcttggggtctacatgccaaaagcctgccagaggggccaggaccagcataaagggagggaaccagcccaaagactatttcatctgggtcatggaggggcctggggaaccttctcaagtccaagcaaggtctgctttgctaggcccagggtccatttggcttcgtgatgcaggatgtcatgtgcctggtcttaaaactggagagacctcaccactgtcttggttgtgggtgcccatcctgccctgggccctgaccatctcatcattcctaccaaataataataatcccaggtgccctttattatttatttatttatgtatttatttcagacagagtctctgtcacccaggctggagtgcagtggcatgatctcagctcactgcaacctctacctcctgggtttaagcgattctcctgcctcagtctctcgggtagctggaattacaggtgtgtgccaccacgcccagctaatttttgtatttttttagtacagacaggtttttactatgttgaccaggctggtttcaaactcctgaccccaggtgatccacccggcttggcctcccaaagtgttgggattacaggcgtgagccaccgcagatggcctcaggtgccctttatgaagcatctccgatccagactttctgtgcctggatagatttgatgctttctgtgatatatatatatatatatatctgtgagatatatatatctgtgagatatatatatatctgtgagagatatatatatgtgagatatatatataataatatatatattatttttatttttaatttttttgagacaagagtctggcttgagttgctcaggctggagtgcagtggcacagtctcagctcactacaacctctgcacctccacctcccaggttcaagcaattactgtgactcagcctcccaaatagctgggactacaggcgcataccaccaagcctggctaatttttgtatttttagtaaagatggggttttgccatgttggtcaggctggtcttgaactcctggcctcaagtgatctgcctgctttggcctcccaccatgctgggattacaggcatgagccaccatgcctggcctgtgcactatatttgatgctttctgtgcacaatctcatttaatcctcataacaattctatgaggtaggaacagttatttactctattttccaaataaggaaactgggctcgcccaaggttccacaactaacatgtgtgtattattgagcatttaatttacaccagggaagcaggttgtggtggtgtgcacctgttgtccagctatttaggaggctgaggtgaaaggatcacttgaacggaggagttcaaatttgcaatgtgctatgattgtgcctgtgaacagctgctgcactccagcctgggcaacatagtgagatcccttatctaaaacattttttttaagtaaataatcaggtgggcacggtggctcacgcctgtaatccagcactttgggaggctgaggcgggcggatcacctgaggtcaggagttcaagaccagcctgaccaacatggagaaacccgtctctactaaaaatacaaaattagcttggcgtggtggtgcatgcctgtaatcccagctactcgagaagctgaggcaggagaattgtttgaacctgggaggtggaggttgcggtgagccgagatcgcaccattgcactccagcctgggcaacaagagtgaaattgcatctcaaaaaaaaagaaaaggaaataatctataccaggcactccaagtggtgtgactgatattcaacaagtacctctagtgtgaccttaccattgatgaagaccaagattcttttggattggtgctcacactgtgccagttaaatattccgaacattacccttgcctgtgggcttccagtgcctgaccttgatgtcctttcacccatcaacccgtagggatgaccaacccggaggtgattcagaacctggagcgaggctaccgcatggtgcgccctgacaactgtccagaggagctgtaccaactcatgaggctgtgctggaaggagcgcccagaggaccggcccacctttgactacctgcgcagtgtgctggaggacttcttcacggccacagagggccagtaccagcctcagccttgagaggccttgagaggccctggggttctccccctttctctccagcctgacttggggagatggagttcttgtgccatagtcacatggcctatgcacatatggactctgcacatgaatcccacccacatgtgacacatatgcaccttgtgtctgtacacgtgtcctgtagttgcgtggactctgcacatgtcttgtacatgtgtagcctgtgcatgtatgtcttggacactgtacaaggtacccctttctggctctcccatttcctgagaccacagagagaggggagaagcctgggattgacagaagcttctgcccacctacttttctttcctcagatcatccagaagttcctcaagggccaggactttatctaatacctctgtgtgctcctccttggtgcctggcctggcacacatcaggagttcaataaatgtctgttgatgactgttgta

SEQ ID NO: 1843 - DNA, 12055 bp, Homo sapiens
  source 1..12055: mol_type = genomic DNA
gtgtgaatttacttgtagcctgagggctcagagggagcaccggtttggagctgggaccccctattttagcttttctgtggctggtgaatggggatcccaggatctcacaatctcaggtacttttggaactttccagggcaaggccccattatatctgatgttgggggagcagatcttgggggagccccttcagccccctcttccattccctcagggaccatgggctgtggctgcagctcacacccggaagatgactggatggaaaacatcgatgtgtgtgagaactgccattatcccatagtcccactggatggcaagggcacggtaagaggcgagacaggggccttggtgagggagttgggtagagaatgcaacccaggagaaagaaatgaccagcactacaggcccttgaaagaatagagtggccctctcccctgaaatacagaaaggaaaagaggcccagagaggggaagggaatctcctaagatcacacagaaagtagttggtaaactcagggataacatctaaccaggctggagaggctgagagcagagcaggggggaagggggccagggtctgacccaatcttctgctttctgaccccaccctcatcccccactccacagctgctcatccgaaatggctctgaggtgcgggacccactggttacctacgaaggctccaatccgccggcttccccactgcaaggtgaccccaggcagcagggcctgaaagacaaggcctgcggatccctggctgttggcttccacctctcccccacctactttctccccggtcttgccttccttgtcccccaccctgtaactccaggcttcctgccgatcccagctcggttctccctgatgccccttgtctttacagacaacctggttatcgctctgcacagctatgagccctctcacgacggagatctgggctttgagaagggggaacagctccgcatcctggagcagtgagtccctctccaccttgctctggcggagtccgtgagggagcggcgatctccgcgacccgcagccctcctgcggcccttgaccagctcggggtggccgcccttgggacaaaattcgaggctcagtattgctgagccagggttgggggaggctggcttaaggggtggaggggtctttgagggagggtctcaggtcgacggctgagcgagccacactgacccacctccgtggcgcaggagcggcgagtggtggaaggcgcagtccctgaccacgggccaggaaggcttcatccccttcaattttgtggccaaagcgaacagcctggagcccgaaccgtaagtggggacccgtcgtgggggtgggtaggagcagatctagggatcctggagcagggagtaggcctggggtggcggtgaaggcttgagggccacggaggaagatccgacgacagccgacggccttcgttcgcttccgccctgcacagctggttcttcaagaacctgagccgcaaggacgcggagcggcagctcctggcgcccgggaacactcacggctccttcctcatccgggagagcgagagcaccgcgggtgagcgggcggcggtctcgaccgggcgcgggggtgccccggggtgtgcccgagggggggcgcagggtgagcccgaggtggagacacggggtgagtcggagggggacgcgggatgagcccgaggtgggggcgcgggatgacccggagttgggggtgctgggtgagcccaaggtgggggcgcggtggcgggccagactcactgcgttctttcgtcgctttgtccatccattcattcattcaggatcgttttcactgtcggtccgggacttcgaccagaaccagggagaggtggtgaaacattacaagatccgtaatctggacaacggtggcttctacatctcccctcgaatcacttttcccggcctgcatgaactggtccgccattacaccagtgagcccgacgggacccctcccccgtgccctatcagcctatctcccctcagtccccctcaggtgtcccccatccatctttcaatgccctactccattccccgcagtgggtgaggtgtggaacctgaccctacggccccaagtgtttgggtgacagccccacacccccttgctagtccacttcacctagatgggggcttggagaagtgggggaggtggtgtcaatacgaggcctgccctattgacagccttcacccctccctcgtcctcgcagatgcttcagatgggctgtgcacacggttgagccgcccctgccagacccagaagccccagaagccgtggtgggaggacgagtgggaggttcccagggagacgctgaagctggtggagcggctgggggctggacagttcggggaggtgtggatgggtgagtgtggcctccaggactgcctgggaagaggggaacgggaggggccgctgaggtgatgagagtcccaggacagctgcctggcgactttcccactccttcccttccccgacccagggtactacaacgggcacacgaaggtggcggtgaagagcctgaagcagggcagcatgtccccggacgccttcctggccgaggccaacctcatgaagcagctgcaacaccagcggctggttcggctctacgctgtggtcacccaggagcccatctacatcatcactgaatacatggagaatggtgggtgctacccgagtcggctaccaggggatactgctctccctgctgtccctgccagagggtggaaatacaccttttcttctggcccaaagctcaagcaaggagggtttcttgagctttcctgccccctggagactcacctccagccgggcgcggtggctcaggcctgtaatcccagcactttgggagccgaggcgggcagatcacgaggtcaggagttcgagaccagcctgaccaatatggtgaaactctgtctctactaaaaatacaaaaagtagccaggtgtggtggcacatgcctgtaatcccagctactcagaagactgaggcaggagaatccctttaatccgggaggtggaggctacagttgcagtgagctgagatcatgccactgaactccagcctgggtgacagagcaagactctatcaaaaaaaaaaaaaaaaaaaagactcacctccaggcatgagaaaaaggtgtatcctctgatctgatcctgtctgggggcaagcctaaggtggcaagaatgttctggaagagcattcaccccaaccttccctgacctgccattctgtttgccttcttcaaagccctaccttgatctcaggatgcttgatctcagaaagcaagtgggtccctagccctgtttctctcccttctgcccctgagccctaggagggcagatctgcccccaaagccctctttttcagttctgagtgagacccccacccctgcacccctcttggtctgttactggacagagtgagagccccaggaagaggaatatgagtttctagcttcagctttgttcacaccgatttgccgtgtgacaggccaagtgcctgcactgtctctggtgctcagtttccccaagtataacagcagaaatctaaatgggctcaccagaaataatacagagtattcatcaaggcctctagagtctgactgcctgggtcagaagcctggcttcatgattttatggctttgtgataattatatcacctctttctgccatggtttcctactataataacgcgttagtaacttcctcacagggtcttgtgaggatgaaataattaatgcatacagagcagttagaactatgcctacttccaggtgctgtggctcaagcctataactccagcactttgggaggccaaggtgggtggatcacttgagcccagaagttcaagaccagtctgtgcaacatagcgagacttcattcctacaaaaaaatgtttaaaaattagctgggcatagtggtgtatgcctgtagtcccagctacttgggaggctgaggtgggaggatcacttgagcccaggaggttgaggctgcactgagctgtgattgcaccactgcactccaacctgggtaacagagcgagaccttgtctcaaaacaaaaaacccacaaaactatggctaccatatagtaactgatcaataagtttgttgctgttatctggctctgattctttgggagtgtaagatctatccttttttcaggaagagaaacaagctgttcattggctaatgggaaatggcaaatagattatgtcatgtgtatcttttttttttttgagtctcactctgtcctccaggctggagtgcagtggcatgatctcggctcacttcagcctccccctcctgggttcaaatgattctcatgcctcagtctcccaagtagctgggactacaagcatgtgccaccatgcctggctaatttttgtatttttagtagagacaggttttcgccttgttggctaggctggtctcgatctcctgtcctcaggtgatcctcccgccttggcctcccaaagtgctgggattacagatgtgagccaccatgcccagcctatcatgtgtatcgactttgattggtagttgcttgtagtgctggagaaggattctgaggttcattggaagtgagtgccaggaatgattagtaacatctgccatggatacaatggaagaatggcagtatatctatgtctatgtatttgctgtgtgtaggtgaggtctttgtctttggtaactagttcagcactcaaagtggggacactcaggttgctgtcatccttttacagggttttaatctcttgggaagggccattggtcactcactgcatcctagcaactcccatccatgtccagctgccctccactattagagaggtggtccctcagacccccagaccccctctttcttattccatccaatatattcagcacatagttattgtttcttactctcggctgggcaccaggaacatggatggatgaaacaaggttcctgttgtcagggaaacctgattttagttacagctactggggaaaccagagtttgtgccatgggaaagttccagcatgcccatgggagtgtagatgatgatccagtttattatgcctggtaggatctagagaggcttcctagtggggcagtctagcagggccacgaaagaaaagtagaattttttttagcaggcagagatgaaacaaagaggctttggggtgagagcctagtggtctgagtgcaggatctcaaaattgctaaactgtttgaagtcaaaggcagagtgggggaaagagaagaagctaccagtgtggaccatgccaagcttaggatactagttgaggattctaggttctaccttattggtgatgaaaaacctacagatccctcccagcatgctctaccctagcccctctgcaaaaaaacctttacatatcctgggcatccttaccctgaacacacactcctccattctcactcttcaatcttccttttcacatgtcagacacacttctagactcccagttggaggagaaaggtctgggggcctccccctggggcaacttgggccagcaactcttgcttctgcccacagggagtctagtggattttctcaagaccccttcaggcatcaagttgaccatcaacaaactcctggacatggcagcccaagtaaggagactggggaggggggctgggcaagggaacagaccagtgacgtgaagacatctggctcaggaccgctgatctgtgtttggcctgcagattgcagaaggcatggcattcattgaagagcggaattatattcatcgtgaccttcgggctgccaacattctggtgtctgacaccctgagctgcaagattgcagactttggcctagcacgcctcattgaggacaacgagtacacagccagggagggtacgtgtgagatttaagggtggtctgggccctgcagggtctggccaagcagacccaggtgacctcactctgcctcctccttaggggccaagtttcccattaagtggacagcgccagaagccattaactacgggacattcaccatcaagtcagatgtgtggtcttttgggatcctgctgacggaaattgtcacccacggccgcatcccttacccaggttagagccaagggcaggaactgaaagggtgatgggaagggcaagtccatgtcttcccattcaattctttccagtctcagaatctgaaactttgtagctgcatctcctctatcttctcaggggtatgagtccaacgtccccaggcagatgccacatctcccagggctggcttccatctccgtatctctctttaataaccccagctcttttctttttctctttttttctttttcttttttttttttttttttttttttttttttgagacggagtcttgctctgtctcccaggctggggtgcagtggcgccatcttggatcactgcaacctctgcctcctgggttcaagtgattctcctgcctcagcctcccaaatagctaggattacaggtacgtgccaccatgcgcagctaattttttgtatttttagtagagacagggtttcaccatgttagccaggatggcctcaatctcctgacctcgtgattggcctgcctcggcctcccagtgttgggattacaggcgtgagccaccacacccggccccagctcttttctttagttctggcccaggcagcctggtatggtagaagaagatctagctcaggaacaagaggcctaccttttatcagcagatctgccactgttgctaactttctgtttggctttgttcagatcattactgtaactagtgaagctagtcacttcacttctctaagcctcagtttcctgatactaaaaataagagactaggccaggtacagtggcttatgcctataatctcagaactttgggagaccaaggtgggaggactgcttgagcccaggagttcgagaccagcctgggaaactggtcgaaaccccatctctacaaaaacaaaagttagccaggtttggtggcatgtgcctctagtcccagctactcagaaggctgaggtgggaggatcacctgagccagggaggcagaggttgcagtgagccaagaccatgccataacactccagcctagggcaatagaccaagaccctgtctcaaaacaagaaaaagagagactccatctctacaaaaaaaaaaaaacaaacaaacaaaaaaaacatttaaaaattagctgggcatggtggcacacacccgtagtttcagctatttgggaggctgaggtgggaggatcatttgagcccaggaggttgagggtgcagtgagccatgattgttctattgcactccagcctgagcaacagagagagaatttgtctcaaaaaaaaaaaaaaagaaaaagaaaaagaaaaaagaaaaaatgagagaccatttgtgaaagagcctgactcatagtaggttgtcagtatacactgactcctcccaccatctcctggacaaagccctttacccctgaattcagccaagacagggatggaatttttgaaaggaacttgctaagaaactctggggaaaggaaatggagcataaagacaggagtaggggggtcatgcggcacagtggctagatttgtagaagcttcccatatccccagagcaaggtgaacagacctttgctccaaggaaggtaaagacaccttggaaggccggatgcagtggctcacacctgtaataccagcactttgggaggccgaggcgggtggatcacaaggtcaggtgttcgagaccagcctgaccaacatggtgaaaccccgtctctactaaaaaaaatatatataaaaattatctgggcatggtggcacgcgcctgtaaccctagatactcaggaggctgaggcaggagaattgcttgaacccaggaggcagaggttgcagtgagctgagatcatgccaccgcactccagcctgggtgacaaagtgagactctgtttcaaaacaaaaacaaaaacaaccaccttggaaacaggtgaaaagctgaggggcttccctgccctgggcttgccccaaaccagcgtccaggggtagtgctggagctggaaatacagaaatattctccagttatcctgccaggggtcctcactgctccttcccggttcccacagaggcaaacccatagggaatgtatctattagaagaaaataggcagtgaaagcatgatgataaatggcaactgacatatagcattagggtcagggagacaatggggagaaatggggaccttggtaaacttgcagctgctccagcagatggctgcaattaaggcgtgggggacccaaaaaaacagatcttttgtttttttaagagaagcccaaacttggagttttaggaaaatctgttcatttccatttattggcgattgattcaaattgtttaaaagcactctaggggctgggcacggtgactcacacctgtaatcccagcactttgggaagctgaggtgggtggatcacaaggtgaggagtttgagaccagcctggccaacatggtgaaaccctgcctctactaaaaatacaaaaatattagccaggcgtggtgttgggcactggtagtcccagccactcaagaggctggggcaagagaatcacttgaaccctggaggcggaagttgcagtgagccatgatcacgctgttgcactccagcctgggtgacagagtgagagtccatctcaaaaataaatataaataaattaaataaataaattaattaaatgaataaataaataaaaccactctagggccaatccaaagtggatctgtgggctatactcaggctggatttagcctgtgggcttgcacccttaactctggccatgggtgtttagttccgtggcctatgtcctcctatgccccagttttaaaatgtgagagtcccagccaggcgtggtgggtcacgcctgcaacccagcactttgggaggctgagatgagcggatcacgtggtcaggaggtggagaccagcctgaccaacatagtgaaaccccatctctactaaaaatacaaaaattaaccgggtgtggtggcatgcacctgtagtcccagctactcgggaagctgagacaggggaatcatttgaacctgggaggcggaggttgcagtgagccgagactgtaccattgcactccagcctgggcaacagagcgagactctgtctcaaaaaaaaaaaaaaaaaaaaaaaattgtgagagtcccataggcagaggctcccttgtacaagtcctggggaaaaagggtctctgttgaccaggctttagtcccaagctttccaggagcaaaactttgattttgtaaataccctataaggttttggtctttgggaactgcttgtcacaatctttgttcagaagactgaaggagaaaccagacactacatgagcaatttagaaatagggaaggagggagctatgttactgctgtgatcatgtagttctccagagcagctcttcttggggtctacatgccaaaagcctgccagaggggccaggaccagcataaagggagggaaccagcccaaagactatttcatctgggtcatggaggggcctggggaaccttctcaagtccaagcaaggtctgctttgctaggcccagggtccatttggcttcgtgatgcaggatgtcatgtgcctggtcttaaaactggagagacctcaccactgtcttggttgtgggtgcccatcctgccctgggccctgaccatctcatcattcctaccaaataataataatcccaggtgccctttattatttatttatttatgtatttatttcagacagagtctctgtcacccaggctggagtgcagtggcatgatctcagctcactgcaacctctacctcctgggtttaagcgattctcctgcctcagtctctcgggtagctggaattacaggtgtgtgccaccacgcccagctaatttttgtatttttttagtacagacaggtttttactatgttgaccaggctggtttcaaactcctgaccccaggtgatccacccggcttggcctcccaaagtgttgggattacaggcgtgagccaccgcagatggcctcaggtgccctttatgaagcatctccgatccagactttctgtgcctggatagatttgatgctttctgtgatatatatatatatatatatctgtgagatatatatatctgtgagatatatatatatctgtgagagatatatatatgtgagatatatatataataatatatatattatttttatttttaatttttttgagacaagagtctggcttgagttgctcaggctggagtgcagtggcacagtctcagctcactacaacctctgcacctccacctcccaggttcaagcaattactgtgactcagcctcccaaatagctgggactacaggcgcataccaccaagcctggctaatttttgtatttttagtaaagatggggttttgccatgttggtcaggctggtcttgaactcctggcctcaagtgatctgcctgctttggcctcccaccatgctgggattacaggcatgagccaccatgcctggcctgtgcactatatttgatgctttctgtgcacaatctcatttaatcctcataacaattctatgaggtaggaacagttatttactctattttccaaataaggaaactgggctcgcccaaggttccacaactaacatgtgtgtattattgagcatttaatttacaccagggaagcaggttgtggtggtgtgcacctgttgtccagctatttaggaggctgaggtgaaaggatcacttgaacggaggagttcaaatttgcaatgtgctatgattgtgcctgtgaacagctgctgcactccagcctgggcaacatagtgagatcccttatctaaaacattttttttaagtaaataatcaggtgggcacggtggctcacgcctgtaatccagcactttgggaggctgaggcgggcggatcacctgaggtcaggagttcaagaccagcctgaccaacatggagaaacccgtctctactaaaaatacaaaattagcttggcgtggtggtgcatgcctgtaatcccagctactcgagaagctgaggcaggagaattgtttgaacctgggaggtggaggttgcggtgagccgagatcgcaccattgcactccagcctgggcaacaagagtgaaattgcatctcaaaaaaaaagaaaaggaaataatctataccaggcactccaagtggtgtgactgatattcaacaagtacctctagtgtgaccttaccattgatgaagaccaagattcttttggattggtgctcacactgtgccagttaaatattccgaacattacccttgcctgtgggcttccagtgcctgaccttgatgtcctttcacccatcaacccgtagggatgaccaacccggaggtgattcagaacctggagcgaggctaccgcatggtgcgccctgacaactgtccagaggagctgtaccaactcatgaggctgtgctggaaggagcgcccagaggaccggcccacctttgactacctgcgcagtgtgctggaggacttcttcacggccacagagggccagtaccagcctcagccttgagaggccttgagaggccctggggttctccccctttctctccagcctgacttggggagatggagttcttgtgccatagtcacatggcctatgcacatatggactctgcacatgaatcccacccacatgtgacacatatgcaccttgtgtctgtacacgtgtcctgtagttgcgtggactctgcacatgtcttgtacatgtgtagcctgtgcatgtatgtcttggacactgtacaaggtacccctttctggctctcccatttcctgagaccacagagagaggggagaagcctgggattgacagaagcttctgcccacctacttttctttcctcagatcatccagaagttcctcaagggccaggactttatctaatacctctgtgtgctcctccttggtgcctggcctggcacacatcaggagttcaataaatgtctgttgatgactgttgta

SEQ ID NO: 1844 - DNA, 49735 bp, Homo sapiens
  source 1..49735: mol_type = genomic DNA
taaagcaaaagactattttaatcccagaagttatctcaacatgcatttgtcttttcataaaaaaattacgtaaaaatgcccccaggaaaaaatactaaataagagtgaaattatatttttgaagcctcttaaattattgctgctgagaaaacgaggtttagtgattttcaaattacatgtataaaactaatgaatgcctctgactgacagaggtttggctgtaaaaaacaaatcagttttatgtgacaccaataactattactgtttcagtgttttaaaacttgccccaaattgtttctgtagctgtgtaaactactgtattttgaaatgggcattaaataatcttttaaaaaatgaattattacagtgcactactagacttcaagtgtgaacatgactcatgcactttacaaacattgaagaagaataaataaattatgggatagttgacagtcttcatttcaaacactgtttttaaaggaaaggataaaacccttgtgttcatggggaggggttcagttcagtcctaagtgtttgtccattgaccaaggctgattgatctcgtgttggcaacagaggcaggaggacggttcatttgctcggctataacttgctatgggtaccctgcagcatgcgttaatgtgcactggtatctggaacctcggtttttcccatcaatgagcagaagtggcattttcctgaagtagtcaataatatctgacacagacagaaagtcctgaaagagtcaagatagggagatgagtcaacattggaatgaaaagcaggaacttcactttcagtttttttatctgcataatatatgctgcctcttcaagtgatgaggattgtggggggaaaaaatgtaaatgtggcaattagtttaatgatttctgctatagaactttgaaaaaattcctcataaacatccaacaaaccatagataaagataaaatatgggccgggtgcagtaattcacccctgtaatcccagcactttgggaggctaaggccggtggatcacctgaggtcaggagtttgagaccagcttgaccaacatggtgaaaccctgtctctactagaaaatagaaaaatattagctgggcgtgctggtgtgcgcctgtaatcccagctgcttgggaggctgaggcaggagaattgcttgaacctgggaggcagaggttgcagtgagccgagattgcgccattgccgcactccagcctgggtaacaagaaggaaactccatctcaaaaaaaaatagataaaatatgtgcatgcgtgtgtatatatatatatatatatctacatatctatatatatatatatgtaatttgaaatgcatatatttttaacttcatatgaaggggtcatttaaatagtcactattacaatattcttgcctcgggttgctctgtttttggttttggttttggtttctgcatctctatttcacccccagtcattaatagtgttaggaaacataaggactcaggaggtcagacacggttcatggtgtctagaggtgggatctgcagcatggcacaggagttccttcatgatctctctgctgtgtcctcactgccaccttcacactcataaaggctcagcaaccaatatttgcagccatagcctggatcgccccagccttgattgcttgctagagagggaaaagcctaactcatttttctagatgtgggtcacaactcacctaggaaccctaacaggataatgcacttcctttaagactaatctgctaggtgcctccctccatgggagctgcaatgagtggttggtctgcacttgtgtgtttccacactggaccaagataaatcttgaagggcaaatacctctgctcctatagggtctgtgcagctctatccactgccaaccagcgattcaaacatttgatcacaagcatgcattttttttctattcattaacattatcataacagaagtatgtgaagcagaagttatgggtaagctgtttctcattctggacatgtttgattcagctggtcctcctcttggaactttgaacttagagtatgtttggggcgttaccttcagttgttagtttcctttgcgaaaaactagccctgagggtttctttccatccgttctgattagcactcaaaaagtgactggcatgagaatctaaaccttggcctaacagagaatttctttggcgatctggccatcctcacagagccaaacctccattttgttaagaaatgagccaagtatttgaataatcaccccagcaaatattctaatttttccccttttccaggtggtgtcaacttaaaatgcagcctacgttaaaattatgccacagaggtgaataatagtgggaactttcctttgacaccatctaaatagatttttttaagttaacatagtttttcttgattttgaaaattatacatgtgattatttgaaagaaaagatatacaagaaagaatcctatggcagaagtaaccattgtaaagattttgctttatttctcttccaataaatgaagggcttcactcatgtgatttaatcctaaatttgccatacagcacggactctcaaagatcgctccatgaaggcatgcagagtggcataaataaagactttgggaaaatgtcgaaatttgaaatccttacctctttccctcggagtccagttcccaacaagtaaacttgactttccttctgataacggatctggatgttgtaaactttatctttgtacaacaccatgaggacatatggattggttgttgtttttttagagctgtctctgaccagaaatgtgccatcctaaaaagacaaattcctgttattatgggagcagtaaaagtcaatatttttgttgcttgtaagagtagtagacaagcctctagggatctgacaaacatgtcagttgcactttgcagcttcttgagtgcaaaacctgtcattcaacgaacattcagttctccaaacagctacatatcccatgtgtcatgagttattttgttattaagaaaggcaacagagattgtatcaaagaaatttccaagtcaatctcgttaaagcctcctgataaaaacggaatcttttgttcagtaataaataatgggtggttgagtggataaaaggccaggagaaataaaatactttattggttaactcaagatatatcttcctagtattcctgtgagttaattccctaaactttcttttccacatccaaagtcagaaaacatccacatgccatgaaattcacccttcttaaaaccctgtgatctctagatagtctttccttcatcagacccttgagcaaaattgaatgcagatgttctcttttcttttcttttttctgatatttgctaaactactgttttgattgtcctgtactttaaatttccattcaataaattattgctacataatattaatactgtaaagatctaatattaaaatagaattaattggtaaggactcctttaaactactcccttctcctcataccaaatcaggatagctttaaatagccatgagttggcaataatgactttcctttgttccttttattgcaagttaattgagcctgtcagaacatctctgctaaacaaacatacttctggaccagtgattcacagtcttggcttcaaattagaattacctgggaagtttgaagactcccagagctgacacagcacccccagaataattagaatctcaaggtgagacccaggaatcgggatttttcaaaagttctccgggtgatctaaatgtgcaactactactgagaactactggtgtggagtttaagtgtgaaagatgaaagatttttgctttcccatttctgataaataaatctaaggtaaagtttcggcactggctacgggaaatatgtttaagactttatgatattaaaggactagctagaaacgtctagggcaaaaagcaaaaagttgctgccatctctttaatattggtcctttcacatcaacatggatggcacgtctgtgttaagaggaagatagaactggtacgatgttggaactttgaaagagagtctccttctgacaccatgtgattcctatgacaagacagactctttcattaataaaatctcctaagatgctgccaaccaaatgactgccttgagattcttctgccagcctaatgattcccgagcctaggaatccctgctatgggtgctggtagttgtgaagctggcactaatgggtctcctaggtattacagaaagcaacagcacctagcagaattcctagcctgtaattggtactcaggacaggtcagttcccttctctgccattaatatttacaactatgttaaaataaactatagcacaatacctggtttatctttctaagagcagcttctgcctctggtcgggtaatataagaaacgtaccactcttcatttaatgaattctgaaaatgtaaatttttagaaactgaataaattttacagttacagatgtaagtgaaaagaaaagcctctgagtaatcatttccataaatcaacacctcaattccaggaggtctgaaacatttgttttcttaatttgcattcagagtcatttagctggggctaaatagaagatattttgtgcgaactgctttttatcatgacactggttgcaaaaatgcctgtgaataagagttccttacagtatggaacctcttcaggaaagatacagatacaataatttcttcagtttagcataataacctgcttgattaaaaaaatgggttattgagcagttaagtgacgaatcaaggtcataaacataaaaaacaggattatttttcttgctgtttaatgcaaaacacatgtttgccattgaaagcgtctgaaagaacgccaagggaaaagaacatattgttcatctggatcttctcctttaacttttttttcaaataaataaaataaaacaaagggaagataaaagtacagaagaacattcaatgggagtttctggtgattcttttaccagggaaaaggcaaacaaacaaaaataaaaacatgctctcttacctcttcctccgcgggggatgggggccgaggtttgtttggaagtggcaaggggaagtttctgccttcggctctgataggtggtctgttgctagggccttcaaaagtatagaattctgacagttaatttactgtaagctattgtttgctgctatcaaaacacaaaacacattccccccactcccccaaaaaaatacccttgcgattggtcctatagttcgcattttaagaaacaagggcttcaaaaataattttcatctgtttgaaaccatgggggctgctcaggcattattctgtaatcatgccagtaaaactttgagaagagaacctcaactttgagtgatttttctaaatgtgcatgttacataatataaagtgactagatccctttataaaaaaattcgcaattgttttaatgaatgtgaacgtcaaaatgaatgctcaagagacaaatttttcatagattcttataatatcatcataggcagaatggattcccaacagctgatgtagggacaatgcaatgatgaagataattatgttcttaatgtttccacaaaaagaaatgtaagtgacccaagagaagacaaaattaccttgagaatattgctagcttttagaatcaaagttggctacccgctgttctaactaaacaggtagactgttcaactcacatagaaggcactacagatcaggaagtttttactgggcaactattaattacccagtgcttgtgcctcatcttctctaaaactcttttttctcatttacagttccttgaaactttaggagaatgtttcctaatctcaggaaaggtttagttgtgtttattgcagttgcccagggtattttctatgtgccaggctgtggttaaaaacagaaaaattctgtgagtcaaatgttctcttaattatttaaccatcattcattcataccttcaacaaatatttattcagcacaactctgtccagatcttgagtaaggtatcgtgtgtacattttttttaatcctcacagcaacattacaaggtaggtattgtcttcattttgcatatggggaaatacaggctcagaggctaagcaaatcatgcgctatcagtggcaaagccaaaacttaaacctgtggttaccaaatgctactgtgcatgagtcagaatccctgggcgacttgcgagcacctggggctcagaaatctgcatgttagcaagtacttccggtggttctacaccacggattgtcactacgtctaccttgttacaccactgaggagaggagagtcacctgtaagggctaaagcctcctgagccgcatcatcaagattatttatgatggtccttccctgtttttaaacaagtctcctgagccacatcaacaggattgtttaagatgctccttccctgtttctaaacaagctggccctgagctgccagtgccttccttctccaagttcccagtgcctagacagatcttccccatccccattttttttgcagtccaacacttgcacttttataatgcttgttgaatgaatgaaacctaacaatacaggagagtaacagaaccaaggcccgcattgcatggccattctacagttaagaaatgattctctttctgcctctgcacctgcaggccagcatcatagagttctaagttacaacagagaagcacatacacttttttattgcagtcacctaccacccttaatatctagactctcaagggagtcatgacaggtttttgggcaatgcacagcacaaactttatccttctgatgttggaacaaccagtagaaccagtagagaagaccgaggaccaggtgtcctggcagtcttaggggaaaagagatcaatttggatcaagctaatgttccaaaaataattaactatttgcattaataagccccatcacagactcataaaactggagatctgtggaacttgctttggaaaataatgctgtgatgtgtctgggactcagatggctacagaggcaaggaggtaacacaaatgtgtgtttgcaaaacacagagaattttggggattgtggaaaattaggggttgggcgagaaactgtgaaaaccatgtggtgaacgtggacaccaccataacctcaaatgcttagaaaacattgaaaacttagtgggtgccactggcgtcagcagtgggatctcgcccctctatggaatgatgcatccaactgaataccctagatgtgttcttggaaaaaatgttgattctcaggctatcaactcacatttactaacatagttttctactgaacacacactggcccgtgcacacactgcatgtggaacatgactgcaaaaaaagtggcttttctgttgtcattcttcacagcattttttaaaaatttaagtcaacatttaaaaattaaataatttcacttttcttgagaaaaaaattggaaaatctggcaatgctaagccagtttcctggaatgctacttactagagttgggtaactttccctagtcatttgatgctcattcgacaagcatttttaaagtgcctaccaagtgcctgtcacttgcaagtctttaaggataaaaagcacaaattagtcctgccccagtgcctttcaaagtggttcatgaaccagcagtcacagcatcgcatggaatatgttagaaattcagaaactcaggcctcaccccagacctcctgaattagaatctgcatgttaacacaattcccaggtgatctatatgcactttcaagttgcagaacactctaagcgaatactaatcatggacgtccagaggtggtattattaaaaacacaggtccctgacttcactccggacttactgaatcagaatctgtgacgttaagttctcttagtttgtattttgaacatgctccccaactcacaaccatggacagattgatcatggaaatctaaaactgcagagaaaggcaaacaggattctgaggattccgtagggaaaccggagctggaggaatagttctgcacaggaagattggggatgagggctggcttcctggtgaagtgtgtgtaggtgtgtccatgtatgtatgtgtgtatgcatgtgcatgtgtgtgcatgtattgtgtatgtgtatatatgtgtatacctgtgtgcacatgtatatatgtgtacatgtgtatgcatgtgtgtgtgtgcatgtatatgtgcatgtgtgtatgggcatgtatatgtatacgtgtgtgtgtatgtgttgtgttttaggtactatcctatcattccgacagcccttggcacactgcagacacggaattaaatgttgaatgaggaaatcagatgcttttaggaaacaataaaacctttgtcgaaagcttttgggacaggttagggatccagtcataaaggcttgatggctgaagcacgtcacaaaagcccagagtacaaaccttgagagaagtatggtggcagggaggcactctgtggaaaactgctgttactgaggagacagaaaaagaacaaaatttatttggattggggtgatggggccagacaggggagctgggttagggaagccaggctgcaaatgcttcttgatttggtatcactttccctgctgcccccaaaaccatgggggctgggcacagggacagaacacagcacacagggaatggaactacattccgctgtggaccatgccaaagtctaacaagctttataaagcagaacagcaacaacattcaactgtgtaaagggcacttaacagttactttaaaaattggctgcaacttgagctctttgagttgggagaatacagaagtcctcttctcagaagacttcccttttgctaggaaattatattaatgggcttgtctttggtgagcagtgaatccccagggcttagggtctgcaaggagagagtaagccaggtgagaagggaagtgcatgttaggtgggctctgcagcagacggtgatagcatttgcagggctggggtggggaggcgggcccagagggccctgaaatgcagtctgttccctccacactgagcagcaactcctgcacccatcagtctaaacctttgggaaaagtctgctctgcacagcaaccttgtgtgagtgggattttgtgcaaatgaaggatggggttggggctagcatggaggaaagcagcaggagggtcagcagacaagggcagcagatgccagcgggaagagggagaagagcagcagaaactcagggccagagggtcccagggcagaggaaacattgtgagaatcctgctaggagttggtgggggtagatgagtcttgtgggtggttgagttttctacaatattagggaaggatcttggcttctctccttgaatattaagggagaaggtaagcctacagggctggaggacttgggggacaccacaggctgcccgtgggcttgtttggggacaatgactgggcctttctcctgttcatgcatctgcccctgggcggcctcataccagccctgagaaacacagctgctactgagaaaacagggggacagagactgcaatgaattcctagcatcagccaagcacgaggcgcattttctcagtctccccaactaagatgcagatgaacttcaagtacttagactaactgggtttcttaattattgttgtttgtttgaactcataaagtgaaaatattctttgttttctaccaaaaggcccattctatctggagggatcaaggaggaagtcaattcctcacccctctcacctcaagcagagactcagaggacactggtggattaacatatcgttcttaatgctcagtttggttttatgtcttaagacccaaaatgttcagaccctactatctacccgtcatttccttctttctcaatctgcctggcattacttcagtactggatggacctaaacattatattaagctagaatttcatgacagagctacaaacctttctgagaatgctccaggcatgtgagaggatgggagagggttcatgggacttggcttagtagatcttgaagggaaagtgttggagctcataggaagtagtgctggctggggcaaaggtctctgatgcactgtgcagaagtagaaaacaatgaatgagattggcaggccccagctgtcactaagaaacattccataaccgccccccagttagaaacagctagtataaagaggacacaaaaataaagcagatcagatgtaattaggaagtagtaggatggaaccttgctcccagggtgtttctagatgacttaaccaccatagaatccatttacaaaggggcgcagatctagatgatactctaaaatacacattgattttgtttttcatttttgaaatgttaacttggcagaaaattgtcagctggaaaccttataaatttcagaaatgatttacaagttttgttttatgaaagtcaaaattttatgctatctcattcattggcagttactgattctttacccacgtgtgttagaagacataaatgtgagaaatgtttccatcaaaccatgcatgcaattttacattttgtgatacaattaaataatctgcactgttacacatgaatttagtcttcttcggtaatctaaccaagtaatccattttacgatagttatgcagtatgccaattgacataagtctacttaatactaatttaagacttataattgattctatggggttcctgtactaaacaattccacttgaatgcctgagcaggaaaatgaaagaatgagttataggctgtaagaatgtgtttccgaacataccatcatcttcatcctgggaaggggaagaaaaaaaaagatattaagctatcatcaaaatacaattcttaaaataaaaactgcatttctcaatcaaataaatcaaataggtatctgtttctttctctggcagttatacatcttcataataaatatactgtggagaataatagaagttgctaagtgttttacaatttcttaatacaaacagtcatctaagggcattccagtatgagactctcctcatatactcagcatgaaatagattctgaggtgcctaaaagggcccaaagatgtaataatattgacaatatctacaatgtgtccaaaagattcatacacaagatttcattcagttcccctagtgaccccccaaaaatttaacatcctcattttacaaaagcatgatgctgaggaagcttccttagcttgccaggagttgcagagatggattcaaccccaaatatgtctgaccaaagctcagtcttctttttggctctcttttgcaatggccactcttcttaagatcaataagaccatatttatacggtggcttacaaggttcatctacaaccctcaccatttttatcttcagagcaaccttgggaaattagacaagggaggggctattttctcttccactcagataagaaatgaggttcaaagagaaaaaatgatgttgccaccaactagtagaccaaaagggccagcttgaacttgtttggttaggccagatctgtaatgatgaaacagcatctttctcaaagtgttgttagaaggattaaattagctactacttgtgtctggcttatgttaagtgctctttaataaaagtttgccatcatcaatcctatcacacactgagagaaggcgaaaaaggccacagtcaaaatcattcatcccagttggccaactgggagtcccagcaaagagctgcataaataaacacacatgggctcataaaccccacacaacaaaatcacttttcaatacttttgcaagtatattccctctggttccagaaaacacaactcccagattctcatgagcacaagtgtcaatccttccagagacagggaacctggaatgtgatgttatcctcactgtccagccttacctctgccttgttcctatctctgcagccaagccactgttctcactgtccctgcagcctccgtgggcactggtatccacctgctcaggacactcctgaggggaatccccatgggctttctttaagaatgactctattctgtgtcctccctatcattgaatgaccagcataaatctcacctcctctaggaagtcactgctggctccttgagccacatggcacactttcttccctcagccccacagagcatcccgtgattgcatgctgtctggcatgaggggttgtgagtgtgcctgcctccataagatctcagcacttcatcggaacaagcacagcatctagcacagagctgcaaaaatagcaggcgcttttgggctgagcccttgaatgacagcaggggtctgatggccttcagagggcttatggtgtagagaaactcagcagatctgggttcagatcctggctctttataagcatgcaatttgcaaagagtatcttattccttctgagcctcaatttcctctccgtaaaagagaaaagatgtttccttatgggttcattatactcatatgtaaagcgagaaatactcaactatcctggttttcctaggatggagatagttcttgggacaggggacttttcagtgctaaaactgacagcatccctcgcaaacagggacaactggtcatatttaactggcatggcaatgtgcatatggtaagcattcaagaaatgctatttcccctctttttcaggttgtggaagtattgaaaaggaaaacagtagccttggaaatttaggcatggtccaaacttctggccttcccttactttatcctctttttctccttgtgccctgtaattaccggcccctggtaatggagctgcaattaagccagccactctgggagctcttagagggacatgagctaaacaacacagcatgatgggctccagacaatgaccaaggcccaaagacagaggcaccagcccttaagagacgagacccctgggtgcaggacctgctccaggttctgggccaaggccaaggtggatggagtcccaacctcctaagagcctatgcttcttttccctgtatcaagcacttacaaactgacattttgtacttacattctctcttctgtctggtccccatccatgcctgaaatgaattagggcaaataaaaagaactgagcatgaagagtttcaaagagccagccttagaatacagttttgcttcattgaataatgagaaatcgaacccactgagcctagggaagatgggaagcaacagacccccacagagcaggggagagggggtggaagggagatctggttactccatgttctgccatcattgcaagctgagctaggcaaacctttgttctgcataactaatgcagcaaataattatgtgtgtgtgtgtgtgtgtatatatatatatatacacactctatatgtatatgtacacacacactatatgtatatacacacacacacacacacacatgtggtttagtcagcaaactaactctttagtagctattaaattttactgagctgttgtttttcccaagaaatgaaaacattttaggtaatattctcccttgctcttgctttaaaacagccctctcagggcccaccttggtgtaaagagaagacaattagaaaatgttgctgctttgggactattccaaagggggcttggtacactttgcccagatgaatgagctagtcaaacagacttggggacagctgccttagggctgcgacaggcatctgcactgcctgggccgtataatgtcctctctggggagaaggggaagagctggacaatttgttgaacacctcctgtgtgtcagacgcttcacacatcatcatctcattctgtgtttatttaaaattttggaattttgttccttatgagtttgctgcatttattttgattttttaaaaacattactctaaaatgttatcaaactccattactgaggaggttttttggcacactttagccctggtcctaatttaatcctcacaacagccaagcaagggtgatagttatgacccctgattcacaaatgagatggaagctttggttgtattctttgcaagtagcaaggttggccttaaccccaggtacatgcgcgccatttggtaaataggctgaaaactacttcacagcaaagttaaaaatactaaggcagagctcagtattctgcaattatcaaatgtggttgagcagtaaggaagacacttgcggtgacctgaaaaacctcccccaaccatttcctgtctgctacctgtattgaaaaataaaatggtgagtacagttcctatgcactgtgaaggctttgctataacgaggttggaaaactcaatgaaatatttgactggaatctctaaaaacagcagtcaccccttactcttgattagatgtcactctactcatttctcagtagagtccatttccttcaaagagaccctgatccttcatagccaacctgtgaagcctgaacatccctcaagccacagcaagaaaaggcccaccctgcccgggagcaccgaggagcctcggttcccactgcagagtcagcacagggcagcctgtctgccggccactgtgagtgacaagctcaagcaacaccagacaattactttggcacaggtggcttcttccctggcagggggctgctcctttcatgtctttccgtggtcggtggtaaaggaggcttttgaatcttgggtaaatgctccccgagtgacctgtggagttcaggaaaaggatgtgtaagaaacaaactttgccgaggcagagttctacagaacgtcccatgtaccctcatgtagatgcaacagtcttaccttcccgctggaatcgagggctgcaagacaggaggaaaaatgtatgagtgtccaagcacttttcaaagaataaggacaagatgtgaaacaaacaaacacaaccaaaaaacaagttcacagcttaccttgtcagaaaatggtggtttctttcctgtaaatgacagagagcagatgggccatgagttcagaacttcataagcatgaggtttaaaaacacagtttgatgaaactatgagtctgaaccctcttgggggttgatggggtttaagcattaaagaatcagaaacttcagactaggaagggtccgttagagaccaccaaattttataagctcagagaaattaaatggcttgaccatttaatttgaaggtcacacagctttgtgtacatacaagtagtgttgtggattctgtgctttttttaaataaaatcacattttcttttatataactgatgatcaaaaggattaatgtttccttgggattttatgcctctttaattggccaaagtatttcttctgcagcctaagttttatttttatatctgaaataaatccacttgccacggagagggtaacttttatccaattctgtgaaacacttgatattaaatgaagcactccacttagtttctgaagaaacttttcacttggggagagcatttcaggagactctcctggtatgctgcaaatcttttttgtctgcttgtttttagttagtattgtttgttttgcttttcttctagaacggatgatattcaggctccctgaagaaatgccaggtgtacttgataattgtgcatcacaaagttattcaaagtaatttaatttgtattctatctaaagtcccctagaataaatatgccctttgtcttcaatgtgatgaaaatattactaacaaaattcaaccaggtctagaagcaaatcccacatgaccaagaacaagttatttaaggtttttgaatcccaatgttatcatctcaaaatgaagattatagactaaaactctataggtttgccataagaattgggtgacaatttgcatgcaggatcaggcacttgattgtgaaagttggtcatacaaattgggaattttatcacctccaaggaaaacagagtcgagaagccagagggaaaagcactcaggacacataacattgctccagaaatgtgattctatgtgaggttggctgttgtaacctgaaaccagtttcatctagtagttgctgaaataatctgctgcaactcgaagattaattttgccctctgccattgctcaccaatcaaaacttgccagcccccagaaccgatgaactttctcaaggagcgatattgtaacacttctcctttttataaaacctccaatcttctttttgttcttcagacatactgaagaccctgaagaccaattgccccaaattgcaattctttcttcctaaataaaacaaatttagagattttcttctacgtttttattttgactttgatatggtccatgtgggctgacaattgttagttaactcgcctttctttcccttccttccacacccaggcacagttagtgccctatggcgaatggtgatattatctccctggagttgtattttcacaacgtgatttattctttaaggaccaagtacatgccaggcccatgataagaatattgcctcactgtgaagagcttactgacactgagtgtggtggctcatgcctgctgggaggccaagacaggagaatcacttgaggccaggagttcaagatcagcctggtgaacacagggaaatcccagtctctacagtatatttaaaaattagccaggcatggggacatgcacctgtaacctcagccccttgggaggctggagaagaaggattgcttgacccgaggagtttgaggccgtaacgagctatgatgctgtcactgcactccagcctaggtgacagagtgagaccctgactcaaaaaaaactaaaaataaaaaaataaaaataaaaaggagcttgctggtaatggggagagttttgacggtataaaagatgcttataaaagtttggtttggggtggaacctctactttagaggggcacccaggaaacttaaatttatattctttggcctgaataagtatttcaaaatttgcctttttttttttttttttttttttttttgagacagagtctcgctctgtcgcccaggctggagtgcagtggcatgatctcagctcactgcaagctctgcctcccaggttcacgccattctcctgcctcagcctcttgagtagctgggactgcaggtgcccaccaccatgcctggttaattttttgtatttttaatagagacggggtttcaccgtgttagccaggatggtctccatctcctgacgttgtgatctgcccgcctcagcctcccaaagtgctgggattacaggcatgagccaccatgcccagcaaaatttgccaatttttgcatattctctgagcatgttaaaagtctcaggtggggtgtaaacattttaagaagacagtaatccttccaaaacatcacagaaaacggactaattcaagggtaaaacagaaattgtcagaaaagtgtgtcatttaaaaatgcttttaaatatagaaaaaaagaatattttaaaagaataacttttgtgtcaggaggtgattgcgaaggatttgatgtcagtgttccacttttctgatgtctcggctcgtggtagtgagcagggttggaatctgaagtcaaatctatcttcatttccatgtaattatacagctctctacagcagacaattccaagccaaaccagccagcacagctttgcatgacacagcagagctgtgatgtagttcggggaaagagcagcgagcagcagcctcatatccaagaactgaaagtcattttgttgacagacaaaaagggattgaggccacagaaagctaaatgccttgctcagagcatagccaagaaaggggtgggggcagctgggattctgggctcctttccgttcagttgcagagttccttcctcagactcatgtagttcacagcaagttaaaacccagggtcctcaactgcagcctgatatggtggaaaagagcccccacttagaagtcagaaagacaagtgttcgaatttaggcaaatttaggcaaattattcaacttctttgacccttaattttatcatctgagaagtgaggttaaaaatgcacctcctttgttgagttgctgtgaggattagagatactgtaggtgtatttgtggtaggtagagcacttgccccatagcagttgctcaataaatggtagctaagaattgaattgaaaatagctgcacgtgaaggtaactgcaatccaagaatattctgcgtaaattgtgaagaaaaagcactgtggtatacccaatgtttggtcaattgcatacctaaaacaaaaacatccctgacatttgaatagcaccttagggatttataaagcattttctatgtacagaacatccaccttacagattaggagactgagctctgaaaaactaacatccctgtggtctgtgagctattaagtagcaggcaaggcagcagacaacagctcccccaacccttttgtctcaattcaggtcctctctctgtaccctaaagcctcttggctgaaggacaatgggatttgtatacacagatcatccacatcacatagagaagcagcacagcccccagaagctgcaagcaggagctttctaatgaggctgatatgggctttggtcgctactcccaacacttggtagctgtgtgatcttgggaaggtacctctttgtgtctccgtttccttatctgtaaaatgaggatgattctactagtctccacttcctagtattgtggccatagttaaatgagatggtacatgtgaaacgtatgcaggaagcactttataacagcttatcattattactatgcattaaatgtgaatcatacccacctagtgtgaagggttctctatcaaacggagctaatgaacgatctaggggaggtttcgtgcttctgtctattgaaggagcagggactggaaggggaaaaggctgacatcaattaaaagaagaaagcagtcggctgggggttgggcggggctaggggagtgcctggtgggaacagggcaagagagagcagcccttgtactcacgctttgccgttttgtggtttctgcttctgctgggttcttcgtggttggtctggggtgggggcagtggctgcataaagatccaaacgttaggaagcacttccaatacatcagcaagagccggcactcccaaaacctgtctggatctgctcacttttcctcatcttcatgttctgcctacaaacatccatgtccatttcttcactgaactaccgcagtagcctcctatctgagctccctgttctagactctgccacgcaagctcttttctgcaggcagcagagtgagcatgtcactttcctgctaagcctcctatcacattagaaacaaaattgaaactcgttaatgtcctgcgaggccctgcctgagctggcccatgtctgccctctcaactctttcctgtgatcccttctcagtactcatggggtccctaccatagaatcttcttgcagttcctggaaaatctcaaggttatgccctctttggcatccctacacttgtttccttctgcctagaacgttcttctcccggctcttcccacaactggctcattctgtcccaggtccttgtcacctcccccccccataccgtcatgttacctggtcttccgtcccccgaaccacacataactactcaaatgatctctttcagacatctgtctaccgtctgataactagccctagttgagttttatgaaagcagggaccttatttatcttgttcacactttatccccaacgcctagaactctgcttggcacatagtagctgctcagacaatatttgctgattaaataagtgaatcctgcatctcaaaagaaggtcttcaaatctcaaaagcaatatacatctgtagataaacttgtgaagggaacacattcctaactatcaagtccttagtctgagcttctcagggtcactctgggaacttatcagattcacaaggaccgggctgtatgctcgaagaaggagaaaacggggtttgctacctctgtctcctccggtctgaaggctcctgtccttggaatttcaggtgtcggccagaaggtggcgcaagtctttttgcaggagagaggaaggctcggtacccaggcaacaccagtaggtgccacggacttaattcggttctctttgggtttattttacagttttcacttctctcaaatagtgggaagtaaataaaaaccaccagtattttaccccaaaaaagaaacacgtgtgaatgcttgggtttgcctttccccagccgagggaaaagattataatcttttcttacaaaattagaatgagataaagatgtttatagttttatttttctctctggcggaggaaataactgcagtggacaccaagtactgtaaaagaacgggaggaggcctaccgagtgattccggccggctggtgggggcgggagggcggccatcggtctctgggggggcacaggaggctgctggggggttttcccagaggggggccggtctgtggaaacacaaggttattaaagtgaaaggggagtatcggccaagctcaggggtctccaggaacagatatgcagctcggggcaccgggggtgcatgatccttgacccccaggcccacatgagccccagccacggggagacccagcctggatctcacccacccctccctgcccattttttctgtcctagtttgtgtcactctccttatacacaggctcagctttctttgcatttcacaggaataggtatttatcagagattttgccaatcaagaaaggcctctttgtaaccagctcagccagaactggaagggaggattttcagacaattttgtaagaagtaaacatacgcatacctctgtatgcagacacacagatatacacatgtgcacacatgcatgcacacacatgcatatatatgcacacacctgcatacacagagacacgagtgcacacagacacacacacatgccaaaaatctcacaggcacacccagctgcctgtgcagggtgaagtcagctctcactgccatagggatcttgttctgtctgcccttccttcccctctccagtgtcctgggctatctcctccctgacacttcctcattttgctcatctcttcccataaagggaggagctgatcaccaacttctgttaccagaccacagactcttaagtggaagctagatttgcctcgagcagaaactcacattatctgggcagaaactcacattatccacatctccacggaagtgtccctaggccaggttgacaggctggcaatttcctacccctttgacagggaaaggccaggacaagaccatcaagcaagaggggtgagtgggtagggcctccttacgctttgtgccctgggtgcctctcttgcccgactctagtcccagccttggggaggtgcagctcttccacagggaaaagggtaggagcaaggcccagcctgatctaattccaccctgctccacccgcactggccatctctcagcttctctaataggccatgctcctttgagcctcagggcctttgcacagccatttctactgctccaaatgttcttcccttaccacatccatttccacttggccaacttgtatttatcctttaaccttggtttaatatcacagcttaaagatacaccctcaggcaaacgctccagcctcatctgtgcttgtcttcgtgcctctgtatcacggtttcaccaagtaacctcatggctcatttgttggagggtgcgtcacctgccagactgtcagtcccttggcgagggctgtcttattcactctgtatcttaatgactggcacacacaaggcactcaacaactgactcatccattgcttttccggacctccacttccctgtatatgaaacagacttgatcatggttgtccttattacacagatgtttaaaaaccaccatgagatattgagacagcattttgtgaaagggctttaaaatggaaatgggttataccgcataaaggattaaatggtattcgttttttgtggtactgaccttcaattttcagcgtactctctgaaagtatattatttaagaatatatttgtttattttctgtcaacaccactactagaatgtaagccccaggaggcaggggctatttcttctttcctgatcatttctaagcactgagaatggggcctgggctcccagcagatcaacaatgtttgttgaatgaatggagagagaagtgggctaaaaggacagatagacaataaaaatcgtaaacaccatctaatattttttaaagttatagtcaaaccctactcaatatcttcatgtttattctagcataataatgccatgtaactataatttggtcaaaagatggggaggaacaggaaagtactcttggagtacctgagtaaactgcagaatgagttgaaactgccaaatagccttaggtggtagttcaatgctgatatcagccaccataggcaagaattggttgcagtcttagtagtcctcacaggaaacctatgtggtctgtacatttattatcctatttcacagatgaggaaattgaggcccagagagacagagttacttgtacaaagccacatagctgttaagaagccgagcagatatcgagacccagagctttctgctacatgggcaagctggggcatcagccttccatgcagcagtggcgagcttgcctttgggctgctcgggccagaaaatccggaaacgggcccttaccgatgtacatggagttggagttggggaaaggcttggcaggcaggatggagttctgcagagcttcctcgtcattggagggtggcggctcataatccgcgtcatcttccacgggtgcctcttcctcctcattgggggactcatagtctccatcatcctccccatcctggtcatcattgggactttcataatcgtcttcttcctgcccacacagtgatagggacagtgcagtttgtagaggctctgtggccctcgatgtgcctgtgcctactctctccctgccaagcctcacaacagtataacccgggaccaggcagcctgaagatggttactcccattttacagatgaggaatctgaggtcagggagcactgtaccacaggggcagcaagtcatggacttgagaccttggtgaaggtcttcggaccacctttttacacaacacctttctgcacaacagagagagaagaaaggggaaggatgctggaatagaaggtaccggaataggctctgtcttgagtaaacacattttttgctccaggcatcaccatgagaaagactaaaggcctggagcatttgtgatgatactagttaattgccatttctgttcaagggtgcctgtgctcaaaaaatgtcctctcattataacctggtgcagcgttgaaggcccggctaaggggaaaaacagataaacaaagcctgttaagtggaaggcagattaagttgtgtcgaggaggggaccgtcagaggctgtgctgttctttttgctgaaagttgagtgtatcaacacatccattattcatgaaatctgacactgagtttgaagctgttctcttggaaagaatctctaaattttagattttttattgtattttatttttgcttcttcttggatctcagggaaagtaagcccgaggtgctggatgcttgcctttgaagcagtccatgaaggtgaatgagcatcagaatgacctcccaagcaaaggcggcaccatcagcagcagtgatgagcgctcatcatggtcatgccaaagtccagggggtgagtcaatgagcccagacctcaacactcaagggcagtgtgggaaaaagcaatgggaagtggccactttttgaggaaagaaatgttccagtgtcctagaaatcctgacagctttgggtggcctcaggcagactgtctttacgttgttctgttgagagagtcctgtgtttgtttttgacttgaggaatattaaaaacatcaacaacagaggggcaaagtgagcattgggtgccttcccaactccaaaaaaagactttgtcctgccctgtcagggttcttataactttaggagcaggtgggcagagccccagaggaatgctgcttcagatcaagagcctcagcatggaggtccgcaggcacgtggcctccctccaggctgctgaccctttcctcaccctgtctaccctaggcccatcattcctgactttacaccagctctttaccccatcaacctttctcaaatgacagaattttcctctctgcttctagaacaattattttctcccaatcatttggctcctaaatttgtatgcatgatgttgttgctaattatattctgccatatgtgtgttaaagtaaattaaaatggagaccaggcctgaagaatccctgagcagacaaaaccagttgggcctcatcagtgacctaaaccttacttgatttgcagcataagcaaaagttaacttgggctatttcttgtaaatgcctgtattaaagaaaaacagaacttaagcccaaccaatcagaagtagccagccaactcataattatataactaggagctttccagcaagatagactaaatgagatcggttataactgtaacccatcaaatattttctttttttttttttttttttttttttttttttgagatggagtctctctctgtcaccaggctggagtagtgcaatggtgcaatctcggcttactgcaacctccacctcccgggttcaagcaattctcctgcctcagccgcccaagtagctgggactacaggcacgcaccaccacgcccagctaatttttgtattttttagtagagatggggtttcaccatgttgaccaggatggtctcgatctcttgatcttgtgatctgcccgccttggcctcccaaagtgttgggattacaagtgtaagccaccgcacccggttcaaatattttctttgtattacatctacattcactttataaatgcttgtccctcatccttcttcagcaaagcctccttctggtttggtgctgcctgattcatgaatcactgtttgctcaaataaactccttaaaaaaaaaaaaaaattgcattgtgcctcagtttacctttttaaaatggggtatccatactgtaaaatgcttatgattgggtcctttatctccactcatttcccagtatgcccttgcaaagagctgggcacataacggagctgccaagctctatagccactagtgaatggaagccctcagtttacagagaggatcgaagactagcctcaggcacagcacaagagaggctgcatggcaaggattctgcctctgtgagtaaacagaaacattccagcggaaactctgggctattttccctttgtaccagagaaatctgtcaaattccttcattttcaggtagaaagcataaacttagctaaatcttttttttgttttttttccaattaaatactttcttttaccagaatcccaataggtcaagggacagtttgtttctgccttctgaaggcactagaggtggcctcttaccagaaggcccacgtgactgagggtctggttacctgggtcctaggtctgcctctaactaactttgtgttctacgcacgtcacgttctgctctcctgtggactcagttgcctcatctgtaaaatgaacagattgggctacggtccataatagagttcttagcctgagactgcttcatgggtggtgactgtgtatacaggttcctggggaggggttgtacaatccgtcagactctcagagggggaactgtgacctttcaatgtaaaaatcaactggattgcaccctctttgaggtcttttcagggccaacagttggttctgaagttcttttccctccgtgtcaccgatggggacttaagtccatgagaaaagctacttgagagtagatttctaggagtgtccatttttggagacgggggggtagtgggtgggggttggtaacagtgggtgaagtgcagtcagcaaagtacagcctagggccacgtgcagcctaccctctgtgtttgcaaatgaaggtttatgggcgcaaagccaagcctgtttgtttgctcattgtctgtggctgcttttgtgctccagtagcagagttgagtagctgagacagagagtgcatggctcccaaagccaaaactatttcctgtctggccctgtgcagagcaccttttctgggccctgggtgggtgtgctggcatcatgttagagccccgcttcacttggctccatcctggctccttatcacaaagctgccctggacactgctgtaaaggtgcaagaacagcccacaccatactcacaaaggacgaccagcccccattgtcctcttcgtggctttctgtggaaggagatgacaccaccatcagcactgaagaaaagccaccacttgagggaaagtcaaagcagcttccccatctgatgccttccctcaccaatgccccttccctggcctccacctacctcccacacccctgcaggtttagccacttactgtcagctccagcgaccctgcccaaggtgctcattctaccagagaaccagggggtggcgatggttctcaacctttctcgtgtgtaacagtgacttaggaagtgctttaagacctgtagatacctgggggcctatgcctacagcttctgactcagtgggacaggctgggccccaggaatctgcattgcaacactatgtgcaactgaacagttgaaaagctgctttactgtaatcctagcactttgggaggccaaggcgggcagatcatgaggtcaggagatcgagaccatcctggctgacatggtgaaaccccgtctctactaaaaatacaaaaaaagtagctgggcatggtggcgggtgcctgtagtcccagctactcgggaggctgaggcaggagaatggcgtgaacccgggaggcagagcttgcagtgagccgagatcgtgccactgcactccagcctgggcgacagagcgagactctgtctcaaaaaaaaaaaaaaaaaaactcagatgcagggggactagctaagctcaggtgctcactcagaggtggggtccctctgttttcctctacagagctcccagagctcctcagtgtgtctctgaagatggtcccagcagaacaggggccataagccaggtggcctgcagagcaagatctcctcccctccatctagacccaaacccttttctgggtaagaactggctgacagacaagtcagtaaggtcacctgaatgaactcaaggagccccaggaaccagaaaggcaagaaaactgaaatacctatcacctcctaaagcaatcacctctgagccctgagagctttacctgtctcttcaggaaaccgcgggacttggggtctgcaaaggtaaatagcactgcattaatggtcttctcgatttaaggggatctccctctttcctcaacctggtccagcgagagggagtccccagtggagggcatgtctcactgctcaagagaggtttgtatccttgctgctcagcaactggggctaggataccctgaaaattctggaaatcaccaagccacatcagtggcatgactggaagctcatgactgtctgatgctgtagaggaagttcccctgatgtcccagacccagggacaggatgcagagcaggggagggaaccccttcccctcgttggacaccatcttccagacccctgggattcaggggacaaatgcagatcaaaaagtagggcaaaaacagttctgtgcctcccttttaaggttcaactcgggactgaaaaatcttgcgtttccttacaccagccgcactcacttgcgtgtgaagatgctcctcctctcttcgttcttgttgatttcctgacttaacttactgagaatcctgcaagataaagagacagatgaagagataaaaccatcactcagtctcaaccttccccctgacccttgatatcccctggtctatagaaacttggggcaccagggccaactttggccaggctcctctttgtcacctctgcagggaccctctgctcttcacttcctcccagaacttgccatcttattccccgggccagaccttcctcctgcccaggaagccctctctcctccttgctgatctgtgtctggctgagccttccaagtccagctcagagctcccccttaaagacttgtcagctcacacctggctttccctccaaaaatcaggagccttaggatctggatacgatagctgtgtattttcttgtcttactattcctggggctgaggtcccctggcttttgcatgacctggcagtgctgtcttgttcctaagaatcttcagaccatcatctagacccacaggaatcagctgctccttggagatttcttatcacaacctctagtgggctgttctgtggcctgccttctccttccatcttcccctcccagactcccacttggtgatgcggattcttataaaagtttggggaggtattctctataaaggcaggggttgcagaatgagagactccctgaatcactcatgcccttgaggccagctttgaccaagacacttgaagatactcttagtccctgggttccttcatgtcagaactagcaaatccccaaatcccaggatggagctgggggagctggggcaggagggctttgccgacagaaccatatctccagcatgccctagcaacaagcatccattccaatctctcagatatccagaactcgagactgcagccccacttagtacccactgatgagaccagcgagacccttagtagtcaataggcttagtgtttcctcgagatttggggcaactggaaggaacctcagattatcagtccaatttcattttacagaggagatggcagatggcggatcatgaagtcaagagatcgagaccatcctggccaacatggtgaaaccccgtctctactaaaaatacaaaaaaaagctgggcatggtggcacgtgcctgtggtcccagctacttgggagactgaggcagaagaatcacttgaacctgggaggtggaggttgcagtgagccgagatcacaccactgcactccagcctggtgacagagggagactccatcttaaaaaaaaaaaaaaaaaaaaaaagggagtagcttgaagccacatagtagttagtggtaaaggccaccccttttcccacaactcacaccagcaccacaagctagcctttctaatttccaagccagtgccctttcaacgcacacacccctgtgtcagttccctttctgctgcaagctctctggaggcagatactgttgagtccctggcctgcctatgagaacggctcatgatctctatttcttctgcttaatgaccatctcgaagtaacaagtttagcctaaaataaacttgctaagttagcaaaggaagtccttagcagccaccatttctcgattcctccatcacctcccctgcccctcaactccctcatttctcccaagatatgggctccaggctgggcgcggtggctcacgcctataatcctagcactttgggaggctgaggtgagcagatcactgaggtcaggagttcgagaccagcctggccaacatggtgaaaccccgtctctactaaaactacaaaaattagtcaggcatggtgcacgcctgtaatcccagctactcaggaggctgaggcaggagaaccacttgaacctgggagtcagaggttgcagtgagctgagatcacgccactgcactccagcctggggacaggagcaaaacttcgtctcaaaaaaaaaaaaaaaaaaaagaaagaaatggtatccaaacctcctacctcattagagcaatgggataaacaaattttgataaacacactggtacttaagaggaaagagaaggaggaaggggagggaaaggtttactctctgtaataatattgttgacaactccaggcttttgtgactgggcagagagagcgaggctttaagagcagcagcgggggcttcctagttgcctcctgaccatgccgtcagaatgcttgtgacatggttctttttggttcccttaagtggttgtttcaagaagacgatgggcatgtgggataaaaggactcctacagagctggcaagggagccccgttagtgtcctgtgtcctggccgtgtcaggtggtgctggctgcagcagccactcccattctgtcacctgtttattcaacaatgtgcactgagggccttctaagtgctgggaacttagaagtgctcaaggtgcatcaatgagcaaaacaaagatccctgctagtggagaggaaactttaaggaggtgaaatgtgctgcatatgcaccatgcacatgcagagtggggggctggggagggggatgggagtgcaggggggggctgggggggatgggagtgcaggggtgggggctggcgagggggatgggagtgcaggggttgggggcgggggggatgggagtgcaggggtggggggctggggggatgggagtgcaggggtggggggctggtgagggggatgggagtgcaggggtggggggctgggggggatgggagtgcaggggtgggatgcggttgccatttaaaatgatcaggcctcactgaagaggtgacatttcagtaatgacttgagcgaggtgggactgaggctcacctcaacgccctcctcctacagagtttgacagggctctgaccagctcacaaggctgctttggatcttgaaagaacctcctgctctctgcggtgttgcctctcaccagtatctctagcagccaggctggaggctgccggggctcgaattgggtgaggaaggaaatgtcaaaccgcaggcctcagcagaggagcagcaaagagctgagtgggggcagaacaggtcctggcagttggcttgcagcaaagtgtgggctcccagggtcctcctgctttaaggggctacagaaagcaccttccaagcctgtgggaccactgccagggtctggtggacggtgcaacagtgatggtgggcatagcagggaggtggttgctatggctattgctaggtgcaaaccttcaaattacaccctacccccagaggaccaagtgacagtgagtggagggaggtgactcattctcccttcaccccataaacccctggcctcgctcaggaccagagcaagaagtgatgggggctgggcagccatagacagcagtcctctctgcttgcctttgtttaagggactagctggccctggaaatgggctgaacctccccacaggaagccaggcccgtgtaggaaggcagcattctacaatgacctaggttccagcccagctgcatccctaacttacagcatggtgggggccagtcttcatcttctcagtctaaggtctctcctggtaatgtacaaggtacagggcctgcaggcacagacagtctaactacaatgtctggccccaagggtggcgcccactgtgtgatctcagacaaggcagctgccctcacttggccccagattccttatcagcacaatacaggggttaaacctgattagggaatccctgatgggcctgatcatcatgattacttagctgtacctgttgcaaacactgatcaccaggcccagcctagacctacctgaacggactctctgaggagaagcctgaggctcagtgacatcaaccggcccccacgtgatttttattatcatccaaaaagcttgtgaaataaatcctgctattcttgacactgatgaaattgtttgtttgtttgcttgttttaaaaaaggaggagaaggaaaggcaggagaaggaactttgtgattatgaagggagtgaaacaggagagtgggggtatgcggggccttagctggcctctgatgtagccctttaattctccccacacttgaacaacagtgaaggaagccctactagtgggtctagaaatcaactttgctgatgacacaagaggaaagaaactatacaagaaaagaaggctgccaggcaggtggaaaaggagggagagagagaggggggaagggaagggaaggggaaggggtatagaatagaaaatatcagtgcacaaagcatgcagtaggaataggcattgtcctgtgaaaattccatctttgtttcctctactgtggcacgtgtagctgtgtactggcttatgatgtagagcgcattcttgccacagctcacatagtaagagctttggccaacttctgaccaaagccctcccacagtgggagccttattccctgggctcagatttcagactgcctgctgatccctcctgggacaaggctcccggctcctgggtagggcagatgcctctccccctgtgctgttctctcagtgggaccctggaactctccttctcctccccacccctcctccctgcacacattcccactctcagccctgctctcgctctgcattccaatcctccttccaaggaacaaagtgttctttccgtctttaaagaccagcccccttgaaccaagagccaaaccttctaaattctatccttgtcacctgagaagccgggggcagccagatgttttaagactcaggaaggagcctttcaccatcacctgaggcctcggtcgagagtgtaagagtaggacataataatttgaggacacagtgttctccttacttgtcacccatgtcccctacccctgtagttttacatggagtgttttcctggtgcctcacgatcattttcctggtagacaagtataattattctcatttttacaaataaaaaaggcagggctggccaggtgtggtggctcatgcctgtaatcccagcactttgggaggctgaggcaggtggttcacttgaggtcaggagttcgagaccagcctggccaacatggcaaaaccccatctctgctaacaatacaaaaattagccaggcatggtgatgcctgtaatcccagctactcgggaggccgaggcaggagaatcgcttgaacccaggaggcggaggttgcagtgagccaagattgcgccactgcactccagtctgggcaacaagagtgaaactccaactcaaaaataaaaataataataataataggcaaggctctgagggaggcatctgtctaaaggcacgtgaccagcatttatggggagaggaggcttcacgtcgagtgctgtgggcttgcactggaagagaagaagggacagccaagggaggcacctttcctgtggcagggcccttgaggactgacaagagctgggtccctggacggcaattagccactgaatgggacaggggaggaccatgttggagagaggccctgttttggttttgctggggtctggccatatttcttttttttttgagacggagtcttgctctgtcccccaggctggagtgcagtgccacgatcttggctcactgcaagttctgcctcccgggttcacgccattctcctgcctcagcctcccgagtagctgggactacaggtgcctgccaccacactcggctaattgttttgtatttttagtagaaacagcgtttcactgtgttagccaggatggtctcgatctcctgaccttgtgatccgcccgccttggcctcccaaagtgctgggattacaggcatttgagtggccacattctttaacaggcatgagaatgttcctttcgcctctgcgtcccttcctccacacctttcctgtcttctctgtctcaggtagagaaataggtacaaaggagatgcctcagtacgttgtttctgccattagactcacagccttacaggaagacagacaaatatttctgcattacttctcagcttgagtcttaggttttcccagcctaattgcaccattggtaatggctacagggataaccagcagaaagagcatcatccaatacctaattgctgcctgcaccacccaccccgtcactctcttctccgtaaagttacactgtgcatttaaatataaaacttataacatcccatcctttaatgaacttcaaataggcaccagcagatttgaacgtgtattcgtgtattctatcgatttaaccagaccgttgtcagctgtaccatgagggccaacctaggccctataaagggagccttcattttttttctttaaaaatcctccacctttacaatgttgcaggtgtcttgggatcaaccatgtcctgagagagtgactgcattttcaggctgagagagccttccttaccacaacttaccttcttaaaaatctatttaatacttatattgtaaacgtcagggaaggaaatagagacattcagaagagtgtaatattgttttggttttctgtacatgaacacaatttcttttccaaaggcctttggggtaatgaacaagacaaataaacttatgtacaagagatggaatgaataaagtattgaacgcctgtaagtatccaggacagcaccaggcaatttctgtgtgctgcctcctttaatattccccactcctgaaaagttagctcttttcccttctacagacaaggaagctgaggctctgattgcctaaatgacttccccaaggtcctacagctggtgggaggcaaagtcagctttagagcctggatctccctcactccaaaaccctatgtcctctctattctttaattcctcctctccagaaagatagaatagttaaaaagctaaaattgttctaattgggattttacataaagcaagaatagccaacacttattcagtgcatattgttattttcccattatttcccctaattttcccattaaccctctgaggtaggttctatcattattagcattatacagataaggaagctgaggctcggagagctgagctagcttgccctcaagtctcacagcctgtgaatggaaggattgggtctcaagcatctgacctcagagcctgcgctttttctcactaagctctcctgtctgcctatttataccccaaatagtagcacttaaaattggtgagcttgtagagtctctctaacccattccttccttttatagtttaggaagctgagggtggtctagggatgtgtcccaggtcacacaactcattggaagtagagctggaattggtccttgttatacatttctgccaagagggacagtgagtctctaagtcacctcatcagggcagcctggaccttcccttgatattttctccatcattctccatattaacccttcatgttctatgggcaggcttcacagtctttctagggtgcacattcaaacacattggaggaggggattacatcgcaggccaagcttttgttttagtttccagagagctaaagaaagatcccaccccagcccattcgcaatgtgttgataattctcccgttcacactaaccagaaaccatttcccacccctaccactttctccaggctctcaaaaaagccagaagacatcagttgagcttagccttaagatgaaaaaggatcttccaagctgaaagtgccttctttatctctgtccttccactgttctgattaaatctcttccatccccccatcttcatagctacagccctaggggaggctcctagctcactggcaggatcttggtcaccaccaactaactcagtcccatgtccccagctgggctgtcctccaaatcatcacttacatgccctggacagagataagacacaaatttaccttgatgctcacttcactaacactctctggctcctgagaatggctcacgggacctttataaattgagggacacaccccacaacaaccactcacttcagcctctttgctttccactcccccaggtatatgccccagctgctctgccccactgccgctccaccaggcacactgggtggtgcctctgtaatatgttcccatttctagaatgtcctacaatccatccctcctatttcaagatttaacttagggtcccttcctcccttgtctgccctgaatactgtggggaaaattactcctgccttcctacgagcgcttgaacttgtgcatgcatgtaccattgcactgttgtaattgtagtgtaattgctttgcttgtctgtctgacctccctttagaatgtgagtgtcctgaggatgaggattctgtcccatgtctttgcagcctgaataattttaacaaaggcctgacacattgtagttatctaacagcagttcattaaatgaataaagtattattgaaatattaatcttgtatagggaccacaagatgcaaactcaaatgccctcaagggccacgtacatacacagacctaagtagttaccatttctggcacccttcattcctatgtacacatccctttccacttgaaggacttttaaaaagcacctgtggcagtacagttcagattttgtgtgtctgaaaaagtctttatttcgtcttcatttttgaaagatatttttgcctagtattgaactctaggttgacaatatttttcttttgctattttactttcgagaaagctgttgtgatccttgcatttgttcctctgtatgtaatatgtctttttttttttttctgactgcttttaagattttctttttatcattggttttgagcaatttgattgtgatgtgcctcagagctagttttcttcctgtttcttagatttggggtttgttgagcctcttggatctgtgggtttataattttcatccagtttgaaaaatttttagccattatgtcttcaagtgttttatttctgtctctccttccccgctcacatacacattctttcctctcctttagggactttagatatatatttggttctttgaaattgtcccaaagttccttgatgctttttttttttttttgagatggagtcttgctctgtcacccaggctggagtacagtggtgccatctcagctcactgcagcctccacctcccaggttcaagtgattctcctgcctcagcctcttcagtagctggaactacagtcgcctgccaccaagcctggtgaatttttgtatttttagtagagatggggttttgtcatgttggccaggctggtctcaaaatcctgaactcaggtgatccacccacctcagcctcccaaagtgctgggattacaggcgtgagccactgtgcccggccccttgatgctcttttcagtgttttgttttagttttttttctctgtgagtttcaatttggacaatttctattactgtatcttcatgtctactactattttcttttgcaatatctaatctgctgttaatcccaagcagtgtatttctaatctcagattttatagtttacatttctagaagttctgtttgggtctttttttgaatttcttatgcccaaatttaacttctagaacacatgaaatacactcaacattctccttgtctgctaattctaatctctgtgtcagttatgggtcagttttgatgttttagtttttctctttgttgtgggttatattttcctgctcatttgtgtgcctgttagtctctgattagatgcctaatatcataaattttattttgttgggtagtgaatatttttgcattcctataaataggtttaagttttgttctgagatgcagttaagttacttagaagcagtttgtttcttttgggtcttgcttttaaggttttctagccaggacctgaacaatttttagattagggctaattattccccaccactaaggcaagatccttctaggcactctaccgaatgactatgttttccagccaggctggtagaaataagcaccatttccagccctgtgagtggctactctttcctccaatactgttgggtagttcttttgccacctacaggtagtctctcctttcatgcatggactgatctgtgctttgctaaagaggggcccctctgaagctctccagaatgctctctctatgcagctctctcctctctgacacccgttgaatgaactctaggctcctggactctccgctgcctcctcaactcaagtcgtccaccagacccagcactgtgctccctgctccctgtgccaaggcctggagattctcaaagcagcaagcaaccataggcttcaccgcctttgttttccatccctcggtgtctgatgctcaatgtcttgaaaattgctctttcatatattttgcctggttatttggttatttcagttgggaaagtaaatctgatccctattacttaatcttgttcgaaagccaaagttcccatgatataatataaatggttgacgtaccttaggacgatccctcagggaatggtgggaccctggtgaactggggagcacaaatcccaactaaacagggcagcagacatcagatccggctgactattgccacagtagaatataagccctcaattgccacatctttcacttgtttctaaagaggctggattttgtgaaagttttcctgatttcaaagcacagtggtcaccaaatttaacatacctgcagtctgggactagcccaccagccaccaattctgacacctgtgtggaaagttccctcttttgcaaagaactatggtttatctctacaacatcacatttctgcaatcatagaaatgttctatatctgcactctccagcatagtagtcaccagctatacgtagctattaaaatgtggctagtgcctcaggggaatgaattttaaatttaattcaaattgaagtagccacatgtggttagaggatatccttagaaagatcaagccatcttcaacaatacgtgtccctggagatagacagcaccaaaggcaaatccttattcctctcttttccctcccccttccggacaagggaaaccctatagtcatgctaaaaatattctccttaattgagctgccagcattcctacctattcatgagatctccccacctcctactcctttggcctacttcccttttattatgatgagctctgagacccttagagtaagagaagggtccttatagaatgtccagagaagagaactcaaactggtaacacacagactatatgtagcccttaggtgtgtttactgtggcattcacaatacttgaaacatttgagccaatgtttaaaaatggagatatagcacatgaaacccatatttctagttattcttgataaatttgaagataggacattgttgggtccacattagctggagctgaggagctgctgcactctttgaatggaacatatgatatctgatttgccacaatccccaccattctctattgcttcaccaacaatgaggctttgcgatggctacttttttcatcatatgataaccgtgctattatttttcttataatggagaactatttcttcatacagaatatttaccactgttttgtccaatgatgataaaacaaaacaaaacaaaacaacggggctttgtgttttcaacctgaccaattttaccatttatagcacctgcctggctcctgtaggtatttgagtgtgtgagacctttactagagggatgaaaaatacatggcatgacatgcatactgcaacttcccctttcagcacctatggcagacatgaatgatcaatcacagctccctttcctcgggattcttctcaacataacacccctgtcagatatttccaagcactcagtatcaacacataattatatccattgctgtcatctgctttggctctcattttactgtgtgagaaatggaggtcaagaaaacttaagccatcactgagtcagtggtgatgccatgatgaaaccttgacactgatgctattttcacaggcccaagcaccccatgagaagagaggaaatgaaaacattggccagagttgggcttgtttttggcaagagcatccaggtcaccagctgggctggatctgtgacttctgttttccagctcttcatgtaacttctgttccccacatcctgcccttgccctcatccttcctacttgctttcttatttcaagccgacaatgacatagaactgacccagcccccactcacactactccccattcccacctctgctcccagatcacccatagagttggaggagtacttacggcacccggagcttggggaacttctggatgtcattttctgtcaggttctgaaatgaagacacatatggcaggcaggttacaacccacagaaagggctctgagcaggaggggaagagtgatacgtgaaacaatatagggagtggtggggactgtggcaaacagaggagaaaccgccctgcccacccaccctccccaagtaggcagcctctagatgttttgcctaaaagcctgtgggcctgctgttgctggatctgcttttacaaagggaatccttaagtctgggttttatgtgaaatgctctgagttccaaatgttggcaaataattttgacttaaacactgtgagagctaaatctgtgaaaccaaacgactcgttgtgtgggctgcatttggccatgttaggacctcttccctacaccccagacctcaggccctctcagtctccacaaggtcagctgcagagaagccagcctggaggagtctgtgcctcttttaccaacatcacatcccagagaacctctttcaccagggttgttggtagaattctcaagatatggggatgccatgaaaaggctttcttgagggaactgagaagggaggggagaaagaaactcatatttgtcaagaactaactctgggcctccacctcttaatgctttagtgaatcctcacatcaactctgtgatgcaggagttaccagcattcccattttgaaagagagaaagccgaggctcagggatatcaaggggatttccacttgtgggggatgagctggggctggaattccactctgtgacatccacagtctattttcttcctgcaaacctccatcctaccacgtctgatccttttgacggcccctgtggcctatgttggagaggattatggggggaaaggtgaaaggaggcatctggaagggaggaggagaggagagcatgtcagaattgggagcagaaaagagactgggcatgctttccatagaaccaatgatgagccaacaaagggctccaccaccattctagttaaggccagagggctgggtagttagggtgggagctctggaatcagatgggctgggtttgaattttggttcattcacttagcagctgtgtcatttagggcatgcactttgcctctctgagcctcagtttccttatctgtaaaatggggaccataataataataatgatacccacctatcaggattgtgaggactgagtgagatgatgtatgtaatgtgttttggcacagtgcctggcacagtgtgtgactgagaaatggaggagtaagatgaggaattactacccctggtggggaagcagcaggggtctgggtgagtcttagagtttagtgtttttgcttcttttccgttctgggagctgcctgtcaggttttctgaccactggaaagatctgggcactcttctttgagatcagctggcacagaggctggggctagggcatcttagcaatgtgttcactggatccatctgatccagctcacaggcatggtttctgatctggacgctgatcagaccacctgcggcagggtggggctggtgaagggagtcagccagaagtcctgagggcatcgggcttttggttaagcttcttaactactccttttctttctttctttctttctttctttttctttctttctttctttctttctttctttctttctttctttctttctttctttctctctctctctctttctttctttctttccttctttctttctttcctttcctttcctttcctgtcttttcttttcttttctttctctttttttttttcatcactgagcagcatctccctgcttctgaactactcccactcagggaggtaccaagactcatgttttgagtgtggtgtgaggagttgaagccttcctaagggctgccagaggggtggcggctgagcactgagcagctggccaccagcttctgctctgctgagacgagggcgtaagctgagggaatttcaggaagattgtggaggaggaggtggacatgagcctggctggagacacagaggagcagggtgtcaggaaagaggaagacattcagaacggggacaagaactgtgaggaaagatgagagatgttgaaacagaatttttggagagttttgctatgtgatgtaaccccctcctccaccttttccaaaagcctccagtaaactctgggttatttgcatgatgattttggagttaagatttatggctttgtgggagtatgattatatgctgtgggtgttgagaagaggggtacagaaagaggaaagccacaaactgggccctggtgggagaggcaatgtggcagacatggctgcttgcctacccaatacccactctccctttgttttcctactgacaggtcctgggtttcattcagggcagtaaatgtgcttgttcaaaatatttaactctccaggctcccttgcagatggtggaggtcacatgactctgttgtggacagtaagatataaccaaagtctgctggatggagcttctggaaaagttactacttccctggaaaaaagggagcatgcatttaccattcaccatacaccttctcctctttgcctttctccccgtctccctgcctgccatggagatatgatgcctaaaggtggagtagccaactgacaactgttaggacagaagccacaggctttttccatcggttagatgaagcctgggttcttgatgtcttctttcaccatcccctggcacccgcctatacatttattacttgaaacagactgacctttatttggttaggccactgtggtcaggtttctgcaacatggggtcacatgccttcccaactgacacaagtctcaagctccttttctcttctttttataacttctagaagcatagcttctaccagataaggatctaaccttttcagtggaaaacaaaaatggcaaagaagtaaagaaagaagagagagaaagaagaaagaaagaaagaaaagaaagaaagaaagaaagaaagaaagaaagaaagaaagaaagaaagagagaaagaaagagagaaagaaagagagaaagaaagagagatggagagagggaaggaaggaagaaaagaaagagagggagaagaaagaagacagggaaggaaagggaagggaaaagagggaaggggagaggggaggacaagggaaggggagaggggaggacaagggaagggaggaaggaagaaaggaaggaaagaaggcaggaaggaaggaaggaaggaaggaagaaaggaaggaaggaaggaaggaaaaataactagggcctttcacttttgccttcaatagcagagtggccctggatattacagagctggaaagggtgatagattagtaattagagcttagatcaagcgtcccaaattgtacccagtgcactaggggtggagggtgggtttcagcagaagctgcctttacatcccccagttgcagggacaggcactggattcttcttcttttcttctggttcctatcaccctactttgcacttcctcctcttcatacaatgaacagaatgtgccacattgtctgaaggactgatagaggactgattggagcagaggaaacatagctgcctagataccatctctcaaacaaccctgttctaccaggcctgacactcgcaccaggactgttgtggggaattacagagccgggaggggccatcacccactatgacccagtccaatgtgctcagtcaacagggtaggaagcaaggcaggctcagagagggcaagtacttgctcagggtgacccaggcaacagggcgtcgtaggcaccatcctcaaagatgtcttcctccctttccattcaactgtgataagtctctgttctcagtgctaatagcaccagaatgaaatatttgggtttagcagtaatttgcaagaatggcactaaagctccaggaattctactgactcaaatctcaatacaaataaataatactgttaaaaagtcaaatggtatcagactaaattaagtgtatgccttagttcaattagtaggtatgtgacatagaacaaatcacatcacagctctgcatgtgtttcctcatctgcaaatgaggtagttggaagcctttctgaacatacctttctgctataaaacaagtttctagaaggcagaaatcacatcttagccatttctctatccccaccacctataatgctctccagtatgtaaaagcagttcgggaaactgcttgtcaagtgaacgaataggcgaatgaatgaatgatttaggtggacagtgaataaacatgtcttacatggcacctggaagcaaaactcagaccaataggagcacaggttagtttcagcacaagacttgagagctgcctagaaaggggcagatgactgtgggtggtggtgagctcaccatcactgaaggaattcaagaagatgttggtagcagagatgtaatataagaaatggattggtgttctctgggggcaagctggagcttgtgatctctctggtctcatccaactggcctgaagtctcatggtcaagttcccttactgacagtgtcttacagggagacacaacttagcttactctattcactctgaatttaaattaggaacatctacccccatgagacccttgaagtcttattttcaaagagtaaagcaaagttcccagaaaggatggattggtgcagtcagggtctttcttaacccatgggcaaaggtgtcatttcagggaaaatgctcaaaccacctccccgaccacaacctagcacctctgtctccaccattagagctgcatccttttccctttaatggcttagtctttaatacatacctgcaccttggtcttagacttcaagctttttgaagtataatacagtggagacagccatatcacatgtgtgcttgatgcaaaatcagctttatgaatttggtagtgagaaagaaggaagtaattgaaacaatgagggtgatgccatcctttattccactcatgagtatgtgctccagagtgagagattggaggtgagaagcttctgttcacccatatggtccttcttccccttgggcttctcaaaggatggatggcatttaaatagattttccagattatttgtttactatacttggattcctccttaaggtgtaagtggaagatcagagaggggttctggatgataggatcctgaaaggtagtgagagagggggccctaccaaatttctggaaaaagcaaagggatcctcgggtgtccccagggaaagggtaggccagttggccctgcagccatggggaaaagtgccgaacagtcttggtttcagtgtgttggactagccagagcttaccaagaagcgagccccatcgatgtggtacttcttcactgccttctcacagtccttatagttgagctgcaaagagaaggggaaggtgttgttagtgacgggcagtctcttaccattggttcctctcccttgcctgccccagaaacttagcactttgcggtacttgtggctagccaggctccccactgccctcccttggctaacagagggcccagtccccacctcagcctcgctttcactacccccttgggactgcctgaaatggagaaattgccttgctctaaggcttcggggccaacccttacagaaagactgccttcaaggcatgcagagctctgccctatgctcctcaggaaggagagctaaaagaagaaaagaaataccatccattgtctcgatgcccagagacgacctcggtgtttctttccatgctttcttcctagcatgtttctaaacataattgaggttatgatttatattcaatctcattattctgacttttttctcttaaattacctaaagggataatataaacactgcctagtgttatgcaaactcaatttaaaataattttaatgaccacaacattatttaatcatgcccttattgctgaacatttagattatttaccaagctgctgtttcaataatgataataaaaacggcgaacaattatcgaaagctttctgtgtggcaggcagtgtaccaagtagttaaactagtcttcaatcatttaaccctcacattttgcagatggggaatgagaggcacagacagcaagtaacttgcatgaggttccatgggttttaggtgacaagtttcagaacaggctttaatgtctctttcagaaatattccccttttaattacagcataacttatatacagtaagtaaaatgagcaaatgaaaatgcagcttcatttgtttgcagtacctcatcccaatcaaaatagagacaatcatggatactattttgcgaacttttttctccctctttgagataaattgtttaagtcagaacctcagaaccgagttatataggatccataggaacgagcatttttaagatcttggttattttcctagaccaatcagcaatcatatgaggtgctagtttcaacttgtcctcaacagcataaatgttcacatttgaagtatctctcaacttgctgctttggggtggagcatttgaggttaaatgtttctccttgaggatcctaggttcttctcacaagggtgggcctcatggtttgtggcagccttcttttggagcacattttaagccatatttttatcttatagctagcaaatccaaagaataaatacaattgttatgaaatcttagcttggaagggtgggatgattatcacactcagaaagctgacttagaagttgatattgaaagcacatcccatctatggagccctggtatcccctttatctacaggcagtggggggtaagtggttcttggaagagtcaactgcctttaattcatcattctcactgttatcattatgagataaaccagatgattttgaagagtgctaactttgtgtctagatcagcagagagtcctgcagactgggacccaggcatttgattctgctccagcaagatctaggcttgtggacctcaaatctgtatttttaaggagcaccctagacgattcctatggcatccagcattggtaggcactggtccagaaaagttacctggatttgtagtaaggaagactgaggcctctagagggaaagaggctggtctaaggtcacacagtgagctgggataccagctgggaccccacctgggattaggacacacagctctgagccagtgcctctccactgcacgacccaaggatgttctcctgcaagtcaaaaggaattggagagattgaacaaatatgtaacatggtctctgtcctcaggagcttatattccagacacaggacgaggtacccatgtcagagacaagaagacgcaaagtcccaccagtctgcatgggtgtccccagctaggagccagttaatagagaaggtaaaagggcagaaggaacacgcattaggatccatttgtctgctgagtgccttgcacacatcatttgctttaatcctcacaaccaacccattgggttagttactgttcatatctctatttcactgatgaggaagttgaggcacagagaggcaaagcaactacaggaaagtcgccaagctagcaggtggcagagccagggtaaagtgtgtccgacctcagagctgagtcgagagctgtctccaagggaggcctgaccccactacttgggtagagtttgcatctgcagatcaattctttacatgtcatgtttgacagctaagatccattcccaaatgactctgcggtccattcgtttggtagtttctttcagggggctgaggtactcagaatctgaagggtttctatccaagtctgtggagggactagaacttccaggatcacagatttgcctcagtctcctagtttcttccctcagtccatttatggcagaagaaggaacctgcctgggtgctgtagatttgtcctggggtctgagatctccaggaagaaaactctcccttcccccagctcaggcagtgaggtcttcctgtaccatccctgacccgtggtccatctccctgtactgatgggagttttagggatcaattctctgttgctcaattggattgtataattctcctggtcacacctgaatgttaggcctatctgtgcctctcagcccgtcccaagtctttctcttcataattctcaattcctttctttttcccttatcaaggtaacatgccactttattccctcttggcaaattttaccttgttgccctatcttatttggtctatatttgagcaagatatttagaaacatccttcaaaaaaccagttgcgcaacaatatttgctgaaatctaagtttattatgaccttgcagaaggaaaataacagaaatgaaagcacaaaatatggcaaaaaacaggatctgtgaactgtacccctaccataccacacctagttcaacatgttctcattttcttcttcaggttgggggagaacagctgtgactataaatgcctcggaaatgcatagaccccaggtttggctatacgtcctagggaacctcgtctaccctcttgaatctcaatttccccaggaaaaacacgaagctgaattagatgacttctaccatcttagctttacaatctcatctttatgacagtctggaatatcaacagaatccgatgccagcctgcagggatgagggtgttagaagcttaaccgtctcgcacaagtcatcttaccacatggtcagggtagagggactataactaagtcatgtggcttgagatctgcccaagcagatgcgttgtccccttctgccaatgaccaagcacagggatccttcaacctttcctctaagtccagaagataagacagcaacgctctggtcccagcaccgccacaagcctcttttcctctaggggcctcagttttcatagctataaattggggctcacatcagttttctgtcctgcttcacaagactctcataaggctccaaggagactgccccaggcgggagcttgaggaccccccttagggtcgtgagcagtgaaagcccaaatgctgtgtctggcactgctcatcatagtcctctatccagccctcccaccctgcctattctttctcctgcctccaggacaccacgtctcccctttctagtaagtagcgttgatctcattagcagttacaacagttctctgcatctcagagcatggactttaaaaccagataggtgtggcttgagtcttgcctctatcacatgtagtccctagggcttcggaccatttcacttccctgagctgattttgcagctgagtcaaggggataacaatgctgacctcacaacatagtagggagcgctaaatgggacagtgcctgtgagacaccgaattcaaaccctagcacataataggcacatactcatttgagggcttctgctcccatccttctctccggaactcatggtcaggaaaactcagcggtctatatggcgctcactcaaccagtaaagttgccatagggttccattgctatcttatacacctcccacattctgccccaattccatcgtcaagcctcagctcagcccaccaagggcactagcatcatgaccattcacacaagagcaaggcttaccttcttgaaatagtcagcaaggctgtcggggtcccagcccaggacctctgagcgaaagggcacattcctcagtgccatggctgctctcccgggaagaagctcacaagctgagcatgggcgcttcacccatgggcagagaagctcaaatccagagctcggaggcgttcttggctcttccaactcccagctaccctgtggaacacccctgttggagccgatgtcttttctggcgtagccagatcccagaaagcaacggcttcctctgcgaacaaatatggtctcttc

SEQ ID NO: 1845 - DNA, 54858 bp, Homo sapiens
  source 1..54858: mol_type = genomic DNA
agctatccaataattatttattgaaagaaatgacgggatgaatcccagactccggagtaagccaccccctcacacacacacccctcccctgactctcaaaatccacagcctgccacagcagatttgctaaaaagcaaaggcaataataaccctggggtccgtccaactcatgccctgtacccaggccctaggagggcgagggcttagtaggtatcttcagggtcagagcctgagtcctcgccttgttggttctgaatctgactttgcttccggtacaaacaggccacctgcggagagagggtgggacggggtggtcagaagctccctggctgctcccacctccacaaggttccagagaggccaccacgctaaaaagctggtagggccaagcagctgggcggcccacccctgcttcccaggacctcacctgagcactggtggtggcctgctccggctgcttgtcttcacggactcgaataaaccgagggaagcgaagggagatgcccttgtcactatccacctgcggaagcgggatggagactcctgcggtccagccccagcgaccccctgctcagtctcctccctcctccactctggactgtttcctgatccacatgacggggccgaacgatgggttgtcataaggattaaacaagttgacaaagtgcttggaacagtacccgggcacagtaagtgctcaagaaatgctgcctgttggccgggtgcggtggctcacccctgtaatcccagcactttgggaggccgaggcgggtggatcacgaggtcaggagatggagactatcctggctaacacggtgaaaccccgcctctactaaaaatacaaaaagaaattagccaggtgtggtggcgggcgcctgtagtcccagctactcaggaagctgaggcaggagaatggcgtgaatccgggaggtggggagcttgcagtgagctgagattgcgccactgtactccagcctgggtgacagagcgagactccaactcaaaaaaaaaaaaaaaaaaatgccacctgctacagccgttacgataatgacggtaattcgggctgagaggctgaactacggcgccagggtatgggttctagaatctgactgtgggattccaatcccagctcccaactctcaggagccgcgtgatgcaggggcagttactcaggctctctagggctctacatcctcaccgtaaaatggagatgtttgtgtcactacgtcttacggattttgagaggattaaatgagtgtctatgagtgacacgctgatgaccacacagtgcccactgcacagcaagggctggatacacaccggctcctgtgccttgttactaagggtccctggctgtctaacgtgcagcatggtaaaacatttttaaaaattagatcaaaaatgtaagttcttggctgggcatggtggcccacacctgtaatcccagcactttgggaggccgaggtgggcggattgaggccaggtgtttgtgaccagcctagtcaacatggtgaaaccccgtctctacaggcacgggtcaccatacccagctaatttttctattttttggtagaggtggggtttcaccgtgttggtcaggctggtcttgaactcctgacctcaagtgatctgcctgcctcggcctcccaaagtgctgggattacaggcatgagccactgtgcttgccctgggaattcttttatttaagaaaagaattttcttttctttttttgagacagagtcttgctttgtcacccaggatggagtacagtggtgtgatctcggctcactgcaacctccgcctcccaggttcaagcgattctcctgcctcagcctcctgggtagctgggactacaggcacccgccatcacacatggctaatttttgtatttttggtagagatggggtttcaccatgttggccaggctggccttgaactcctgacctcaagtgatctgcctgcctcggtctcccaaagtgctgggattacaggcacgagcccccatgcccggcccatttttaaagaaaaaatgttttgatctttttatctgacactcaaataaaatgcaagctcatcttcctgatccttacctggaagagcagatgtgagccaaggtcccctccctactctgctctctgtgtgcccgcccagaatcccacacagggccacggccaggtcctctgccactcaccaggccccgcgcagcagggtagatgggagagagggagaggtcagcgcacttcacctcccacacagcgctggggtccagccagtggtcgggaatcacagcgccatctatccgcacgtaagggcgtgggctgggcagcaccagcgcctgcagtgagcagaggaagagaggaacagagggtctggaatctcaaagtcaaggccaagtgttggagggctggggagagggaggaagggaaaaaaacaggcacccccttgaagtaaacagaaataggaagtgaaataagggaaaagaaacaagacacccccttgaagtaaacagaaatagaaagagaaacagaaagtgaaagaagggaaaagaaacaagacccccttgaagtaaaaagttgagaaaggtgggagttgggaggaatgggagatggaaagaaatgaaaggccctgggggctgaggcaggacattaaagacaaaaagaggcagagaaagggccagagacctggaggaaggagacagagacacagtgggacagggacagagatgtagagagagagggcaatggagagagagaaccaaagagtgggacagagatggtgtcagggtccgtgtgtccccacccacatcttgtcttgaatcatagctcccaaaatccccatgtgtcgtggagggacctggtgggaggtaactgaacgatgggggcaggtttttcccgtgctgttctcgtgatagtgaggaagtctcacgagatctgacggctttataaagggcagttcccctgcacacgctctcttgcctggcgccatgtaagatgtgcctttgctcctctttcgccttctgccatgactgtgaggcctccccagccgtgtggaactgtgagtccaggaaacctctctttataaatgatccttttttttttttttttttttttgagacagagtctcactctgtttcccaggctggagtgcaatggcatgatttcagctcactgcaacctctgcatcctgggttcaagcaattcttctgcctcagcctcccaagtagctgggaccacaggcatgcgccaccacgcccggcaagtcttgggttatttcttcatagcagtatgagtatgaaaataaactaatacagatccaatatgtaggacagacactcatgcctgaaatgcctgtgaccatgacaacattcattcacattgatcagggctcacaggcacttcacaaggagcagctatggcacctgctgtgtcctttggctaacccctggtgtgaatgaggcacagggcttggggaggtgaggctgcttgagcagggtcaccagctagtagccggcagtgctgagacatgaacctggagatgctggactccaaagccagctccactgcctgctgccctcctgcccacacctggagccccaagatggtggaagccaagagccctgcatggaaggactgtgctgtcaggggcaggggggagaggggtggaggctgaggcgcagccgccatggctcaccttgaggctctggtgatgctcctccagctcctcatcactgaagccagttccaagctgcagggaggaagcgggaggtcagaggctcagccagccacaggcccagcacttgctcctgccatctaaagctgtgtacactcatggcccccaccccactctggtctacgcagtatccacagaaaaccagggaagtagggagctgggggtgcggagcatccatccagagactcccgggtgggaatgttctcccagcaggcctgccgtgaaccactccctgtcttctgctttatggagaaactcttgctgcttccactgtctccctggccccaggaagtcactcccttatgctcacccacatcctcactgcccagtaactggctgtcctcacttccagtctttttttttttttttttttttttttttgagacagggtgtagctctgttatccaggctggagtgcagtggtgcaatcttggctcactgcaacctccacctcctgggctcaagcaatcctcctgcctcagcctcccaagtagctgggaccacaggcatgcaccaccacgcctggctaattttttaaaaaagtttttgtagaggtggggtctcactatgttgcccaggctggtcccgaactcctgggctcaagtgatcctcccacctcagcctcccaaagtgctgggattacaggcgtgagtggccatgcccagcccatctccaatgttaacactgccaagagcttctttcacctaccaaaataggaaaggctaaaaattagcagtaatgctggatgctggcagatacgcagcaagtgggcaataatcaccaatataaacgtcacctggaaagccccttttgcattgagagtcttaaggattctttttgccttttgtcctgacaatagctcatttaaaaatctattctaaataatgcaaaatggtgacaatgtagattggtggccaaaacatttgtgatttataaaagtcacttctgtcactgatcgtttaggttaacggacactaagtaatcacattacccatcagaacaaagccggcaacaacttccccacacagccacggggagctggttcaggacacagcactatgtgctatggggcacagcacttgaaaactcttgtgcgggcattcaggtcctgttgccatattgcttaagggcatatacaacactgaaaacaaagtacttccagggtaaaaaggcagaaaagaaaattactcatagagaaggatcacaactttgcaaaaatgtaaataaaacattccctcaaatgtcactactgcgtgtctctgggtggtacgattctaggtgatattttgttctgtttctgtggcaaaagacccaaatttgttggagaggggaatataggaaatacgtaagaaaatctagtccaaaatgtgcacagctttaagaaaaactttaacttgaaaaaaagtaaatcactttacatttcccagaattccttgcagctaggggtgagccatggagcaaagtgatgagcaacagaacttgagcagaaggtgttcactggctgaggctgactcagggtccaaccccctttgctcttccctggtgcgtggagcaggcatggccatgagggctggaactcctgcagccacattgtgatgatgaggccagaggcacatggcagaaaaaaaaaatgtggggacaaaaaaaaatgtggggagaggaggaacctgaatccctaatggcatcagactgccccctccacacttctcatttcataacaaaaaaattcttttcttatgtgagccaccactatttgtagctaatctcaatctctcactgacacacattcctgacatctttctatcccagcctgtttttctatatgaagcaagagttgctcatagaaccagaaaaagtaaataaaaactggggagaacggatccttcacagggggatgtgagcacccctcggtctgggttgtgcaataggaaatacccccgggagtctaatctccttccctcctgcttctgccatcagccccagttccccaggaccttgcatatggcctgcagctcctcactgtcctcgtcgtaggaggccagcaggaagcccccgtaccggccggcccgcttcccccggcccaggtaggcgccgatcaccaccaggtccagggtgtcacccacgccatcaaggtagtccttcttcagctgggagaaggggaggcaagagatgagaagggggagcgcccaaggcggggccctcactgctggggaggggctcctcagtggactgaggagggactagaagtaagtctgaagggaacttccagaaggaaccccaaggatggcccctgggaagagactggacatgggaagggtttctaggtttaaataagaacaaatggggccgggcacggtggctcatgcctgtaatcccagcattttgggaggccgaggcgggtggatcacctgaggtcgggagttcgagaccagtctgaccaacatggagaaaccccgtctctattaaaaatacaaaattagccgggcgtggtggcgtgtgcctgtaatcccagctacttgggaggctgaggcaggggaatcgcttgaacccgggaggcggaggttgcagtgagccaagatcgtgccattgcactccagcctgggcaatgagagtgaaactccgtcttaaaataaataaataaataaataagaacaaatgggaaacgcaggcgggatcgatgggacctcaggagtcagccttgccgccgtctttccctcaggacagagacgtggccaactcactctggccactcctccaaagggagagcattttcccattcgttcagaaacgttcactaagtgctaaccatgtgccaggcagaagctcagccctgggggcacaacagtgctatttcctgagacaggaaaggtctgtgctggagggaaaccagccacagacagacataagtacacaggaagagctagtcagcaggcctggccggctcagtgccacaatgcctcccgctccagtccccttgtccacccctcactgcccctctccactcaaacatccatcaactcttactgatgacaggctcctgctcgctggccctcaacacacccgtcctccactcgaggggaaaccccaggagcttcgcacaatgacaacctgtgactcccggcacggaacccccactgacttcctgaaaccttcaagaggaagatccagttttatctcacagtggccccaggtgctgcctcatctggggcctgctccccactctgagctcacctcccgcctcgcctgcccttgctccctgcacacgcagaggctgctcctccctcagggtctctgcaccgggggttttcctccctagtgctctgtccctcactttgggaaagactcttcctgatcatccggggcactcccagccccgccttgctggcccggagctgacttgcttttcttcatggcgcccactcctgcctgactttctcttattcatgtcctggcttaattcctgcccaagagcctggcccgacacgggcggcaggctcaggagagagacacctcatcacgctgcacctcgtgggatgtgcggtgcttgggctggggctgttctccatcagaactcgtgagcaagggctcgcagcagggagaaggtctgaactcagttgcagcagggggctggggtgggattgtgaaaaggggccctgagctcagacagggtacacagtggaggctcgaaatccactgcctagctgggacagacctccagacccggggtggagaaggcccagttgggggtcgagaatcaccttgagccagttgtgcgatctcttggcgatctcgtaggtggcatcaacatccagggtcttcaccatcagcccctcgcaggagtctgagggagacacagaagcgtggtccttgggaagccctggctcacaagcgccggagcaggcaggattctggtcaaacggtccaggactggggacaggctgggaggccggggtcagcgcaagctgcagacctcaggagagaaaagtgagcaccctcacctttcactgactgctccaggaactcggcgatctgctcgatgtccttggtgtccagggaggtggcgaagacaaactcgccctctgtctccacaaagttctcccggagcagctgccggcgccgggaaaggggctcacgtaccagggactgcagggccggcagggagaagagagatgagacatctttgtgagaataaagacaataagccctaaatgtgaggcgaacaggacatgtgcgggtcacaactagtgacagggttcgtggaaagccttgagagggaagaaccctgatgtcagaaggattctgagagcttaaagcatggggctagtcactggcaagagggcccgacaccatttagagtcggtgacttcaggagcatcagacggggggctgcggccttgctggagcttgaattaacactttacgggcatctcatcagttttgttttttgtttttgtttttttgagacggaatctcgctctgtcgcccaggctggagtgcggtggtgcgatcttggctgactgcagcctccgcctcctgaattcaagcgactgtcttgcgtcggcctcccgagtagctgggactacaggtgcacatcacaagagatccacccacctcagcctcccaaagtgttgggattacaggcgtgagccactgcatccagcctcatccccaagataattaaaaaaaaaaaaaaaagtcctcctttccttagaattccaaaagttttcactgagtttttccagcacatttacagttttgtgttttgctttgaaatcagttccagctggaccttgcaagagtgtgtgtcagagaggaaggaggtgatctgagtgtttttaaacaaaggacaaagcagttgtctccacatgtcaacactgactaatccgtcttgtggctttgaattgcttttctcttttgttcgatcggtccccacccacgcgcagtgtttctggtctgccctttgctcagggcttctctgtgatgatgttaaactaccttcaccacttgccctccagggggacattcacgtgttttccatggacagcttttttctgttgtaaaattgtgctcatgaacattttgtatgaaaagatgagagagaggagccacaagggttaagcaggtacaatttatctggggtcagaccatttcaggtttacatcccagccacacgcttcctagctggtgacttcaggcaagcgtttccctctgtgtacctcagagctcccatctgtaaaatgcagcaatacctactcagggcacgtctgggaagatcagctgagcccgtgctacccagtgtagccgccaccagccatgtgtagcaattgagcccttgaaatgtagcaagttcaatcggagatgtgccaagggcaaaacagtcactggctttagaagacttaatccaagaaaagagtgtaaaattccatgttaataatttcttatattcatcacacattgaaaggataatatcttagacattggattaaagaaaatatgattttatctgtttcttcttaccttttaatatggctactagaagctctaaaattagaaatgtaggctactgcagtggctcatgcctgtaatctcagcgctttggaaagcggaggtgggtggatcacctgaggtcaggagttcaacatcagcctggccaacatggtgaaaccccgactctactaaaaatgcacaaattagctgggtgtggtggtgggtgcctgtaatcccagctacttgggaggctgacgcaggagaatcacttgaacgccagaggcggaggctgcagtgagccaagatcacaccactgcactccagcctgggcgacagagactgtgtctcaaaaaaaaaaaaaaaatcatggggatgaggacacattaaacagaaaaaaaatgatatacttgactacataaaaatagttcatccatgttcaactactactaataaaaaaatttgtaaaagtaatagctcaaacaagtcctatacaacaaaataggccatcaataaattttaaagaaggaatatttgaaggaatgagaagaaatatttgaaatgctcatgggagacaaaggaaccagctgagcagggatgatcaaatcctgcagaaaaacccacaaagtatccagtgtttggaaagcacctgatacttgactttcctctccccagacatcacgggaaacaaaaatcagactctgactgtcttcctacagtaatttcatgtagtgaaacatcagtctgcatcatgaaattgggggtttgagcatcaaaggcatctctgcattagaaccactaccagctccacctgtcccggcgaaggacagatgggcctaacggagaaaaaacgtttacagaccaggaagacatgagtgagaacccaccagacaggcaggcaaaagacacgcggaggcaagtcacggaacaaatgcacgcggccaacaaacctgaaaagatgattgatcatcaatatccattaataagacagaagtgaccaagttaccacaagatcgtggttcatctaccagatgatcatctgggatgggccgggcgtggtggctcacgcctgtaaatcccagcactttgggaggctgaggtgggcagatcacgatgtcaggagatcaagaccatcctggccaacatggtgaaacaccgtctctactaaaatacaaaaaattcgccaggcgtggtggtgcacgcctgtaatcccagctactcgggaggctgaggcaggggaatcgcttgaccccaggaggcggaggttgcagtgagctgagatcatgccactgcactccagcctgggcaacagagtgagactccatctcaaaaaaaaaaaaaaaaaaagattatctgggatattgatgattgcagctaattttttttgagagcttccatgtactaactactgagttccacacccctatcccactgtttagccctcaccctaacagataaagcacctgccactgttagctccttactgtagatcaagaaactgacacacagagaggctgagtcattcatctgtagccatgccgctaggaaggttagggctgggatatgacggcatgtggcctggctccagattcctgacatcctaaagcaagctgttctcaaactgttgtcttgaggcctctttaacactcttaaaaattattcaaggccaggcgtggtggttcacgcctgtaatcccagcacttcaggaggccaaggtgggcagatcacctgaggtcaagagttcgagaccagcctggccaacatggtgaaaccccgtctctactaaaaatacaaaaattagctggacctggtggtgcacatctgtaatcccagctacttgggaggctgaggcaggagaatcacttgaacctgggaggaggcagttgtagtgagctgagatctcaccactgcactccagcctgggtgactgagcaagactcttatctcaaaaaaaaaaaaaaaaattcaagactcactccatagagcttgttcatgtgggttacataatattatagttacacctattagaaatttaaaatgagaaattaaaaaaataaatccaatatgctcacccaaataatattaattttttttttttttttgaatagacacaaggtcttttctatattgcccaggctggtcttgaactactgggctcaagcgatcctcccacctcccaaagtgctctgattacaggcgtgaaccacagtgcctggctctaaataacatattttgatgaaacataacccaagttttgagaaagtggtgagactagaggcattattttacacttttgcaaatcctctaatatctggcttaacagaggctggattctcctgcgtgcttctacgacacactcttctcgttgcaggacctgaggaagatccacctcacgccaatgtggagttggaaagagagggaccttgaagatgtccttgaaagaatcttaaggaacctcaggggtcctcagaccacactttgagaactgctgcccaagtgtggcttcctggccatgtgaagtggcagagtcggaaatggaagtcagaggggcagctgccaggctcacaccccaccccgtcacccctcagctgcccctggacaggaagctggaactcacctctccattgaggtagatgaggtcgaaggcgtacaaacacacctgcacctggatctcagacgcatccacctcctgggttggggcacaacggagttcgtgagtgcaggaaggtgagacggggcactgtgcctgaggccgacagcattcatctaccggtctccctctcgccccacctaactggctgcccatctgtgagggcggccatgctgctggctccaggtgctggatcgttaacggctctcagctaattccgacaacctcattccccttcaccagatatttgctctcctagacttttctgcagctaatggcagtgacatggcacagttctggccaatgagatggaaaaggggaaacctgtggggtgcaggttgtggggttttccagaacagatcttctttcatagtaaaacaacagagatgcccgaaaagggcccttcccctcttcctacttgggatgctgggatgagaatgcgatggctggagctgtggcagccattctgcagaaggctgagagaagtgcatccagactgacactctgcccttctgggcactgggcaggacccacagccaggactgggtggaagatgaggaagtacggggccttggcaggcagtggagcgggtgatgctaccttgcgtttgcgggtggtgagcacttggaatggctggatctgcttcttttcccggtcccaagccacggcttcggtgtccaggatgaaggatgtgaccgatgggagtttaatctgaaaagtgaagggagagacccagggcctgagagaggtggaagatgaggtggaaagacaaacacggggagataaattcccttttccttctgcagctctcaagatgcactaacaaagaggcaggtgcacacagatgcttttcttttattccccaccaagaggagacagaaactaatgtctctgagaatgtaatatttggtctcacaagctggaaacctaggagctcttgtcatctccctcctcctgtcacccacattcagttcctcagtgaacctgatgatttcctaagccgtccacttcccaccaactccctgctcagcctcgcctactgggcttccctgtcctgcaccgatcccctccaatccagcttccccatagcagccagggtgacactggcaagccccaaatccgatcacagcacctccctgctaaaaaccatccccatgattccccaaagctggggggactctcccgggtcagcctgggtcgtccctcgcctcacctggccccctgagcctctcttcaccccagcacgtgagcctctctgtttctcaaataagtgggcaatgcctcttccactactgggcctttgcatgtgccgttccctctagaacccctgcccctgtctgtctcctccactggcaagccttcttttccctcaagggaacactgttgcccaagccgggggcagcattcatgttgtatcctggagccaggtagcttccctgacaccaagtctaagccacacctatttctttttgagtcagagtctagctctgtcgcccaggctgcagtgcagtggtgcgatcttggctcactgcaacctctgcctcccaggctcaagcaattctcctgcctcagcctcccgagtagctgggattacaggcacatgccaccatgcctggataaattttgtattttagtagaaacggtttcaccatgttggccaggctggtctcgaactcctgaccgcaagtgatctgcctgctttggcctcccaaagtgctgggattataggcgtgagccaccacgcctggcctcttttcttttttgagacagtctcccactgttgtccagcctggcgtgcagtggtgcaatctccgctcagtgcagcctctgcctcccacgttcaagtgattctcctgcctcagcctcccaagtagctgggactacaagagcacgccaccacatccagctaatttctgtatttttagtagtcagggtttcaccatgttggccaggctggtctcgaactcctaacctcaagtgattcacccgccttgccctcccaaagtgctgggattacaggagccactgtcaccggccaggcctgtttgttacataggctcacagaatgctggtcctttcctgtggagcccggatctccacatataatttacagagccagctgcaggactctctggtgaaggtctgcctgctctgctgggctgtgagctcagtgagggcagagaccatggcaggcctgttacactcccagcctccagcatggggcctagctcggagcagatgcccagtaaatacttgctgaacgaatgagcaaaagcagccagatgcaagagactagtgccatattataccaccaacaggaagctctagaacaggtaaaaccaacctgtggcgaccaaaaagcagacctggggttgcctctggtggatgcatggtgttggacagaggagggggccttgcttggccagggacacaaggaaatatttgattttttatttttatttttttgagatggagtcttactgtcacccaggctagagtacagtggcccgatctcagctcactgcaacctccgcctcctgggtacaaacgattctcgtgcctcagcctcccaagtagctgggactacaggtgcgtgccaccacacccagctaatttttgtatttttagtagagatgggatttcaccatgtcagccaggctggtcttgaactcctgacctcaggtgatccacccgcctcagcctcccaaagtgctgggattacaggcgtgggccactgcgcccagcggaaatatgttagaatgatgagaatgtggaaatattttatacattcattggggtgtcggttacttgggtgtatgaacttttcaaaactcatcaaacagcatagtgcacactgaaaatcactaacttttagggaaattacatcttaagaaaattgatttaaagaacagtgcttggcacggaacaggagctcccctaacacgtgcactgaactgtgcctctctctgtcactgtctctaacaggcagaatgatgggcaccgtgccccctgctttcttaaataacttatttcctatttaattaggggcaggcaaagagaaaggctctttgataggggactcctcgaacaggcacgagacccctactgggtgcagagaagtccccaactctggggcctgtgaggcccagccctgtatgactctgagctgctatttctgaggcttggggcctatccacaggctggccccctccaaactcgtcctgactcctcctccccgcgttcctggctggagaggctgcagagttagactctggctttccgaggctttgttgcactagggtggccatggaacccagtgctggacagtgactcccagctgcagtccacggcgggggaggggttgtgggtgggaggtgtccaggaaagtgttaactcaagctagaatcccttttccctctttctgtctggaagaatgacatctgtttgggaaactctaaggggacaagcattggcactaaaagccaaccagccaaggacagcaggggatagaggtagcgataagcttggttcagggggacatcagtgctcagccaagtcggtgctggggtgcccacctctagatgtgagaaaaaatcatatgggcttacaccacgcaggactgagtgctctgtcatttgcagccaaacgcaacctgatctcctcccaataaaccccgcactgtgccacactggcctagatgggcctcaggcctttgcacccctgaccacagaccctggcagagtgcaagtgtgtggcagacgcccaccttggggatgcggctgatgatgtccgggtacttcccagtgttgtcttcctgattcctgctgaagatcttcacctccccgccttccagggcgtggatctgtcacgatgggagaagggaggggaaatcagctgagtcccctcatgtggcctcagctttctcttctgaccccacctgcactggtagaaggttctggaagctctggaggaggaactggtgcagagacttgagcgaatcatctcctcagttccaacagcacctcccagccctgctctggaaggccctaccatcattttcttcttcatttccaatccctacacctctccccatgtaggcacatgcaccttgctgcatgtgggtgctgatttgtttaaatgtcattatgctctagatctcattctgatttttttttgaggcggagtctcgcccaggctggagagcagtggtgcaatctctgctcaatgcaacctccacctcccgggttcaagagagccttccgcctcagcctcccaaggagctgggattacaggcgcccaccaccacacctggctaatttttgtatttttagtagagccaggctggtcttgaactttcgacctcaggtgatccgcccaccttagcctcccaaagtgctgggattacaggcgtgagccactgcgcccagcctctatgtctatttattttaagacagtccggtcacagcccttgagcagggcggcatatatagcatcttatatgtttgttattatttccaggaacagttgtcaagaaatcattgtcactatcgtaaatcatcttgtgtcttttttctcaacactattttggagatccatctctgatcctgtgtctgttggatccaccctttttttttttttttttttaaaagatggagtctcactcttatcgtggaggctgtagtgtagtggcacgatcttggctcactgcaccctctgcctcctgggttcaagcaattctcctgcctcagcctcccgagtagctgggactacaggcacacgccaccacactggctcatttttgtggttttagtagagatggggtttcaccatgttggccaggctggtctcctcaggggtccacttcctgtaactgccccgagccctgtggctcccacccactttgcctgcttacctatccccaggtgagaaggccccacacttgccaggacagaagagacacaacacattcttacagaccccaggaccaaggacgcctgaggccctggatcacaggacacacatgcacgtcacggcatgaaggggtcatgtaggcacctcccagaacggctgttaaaatgaacacacccaccagcagcatcagcggagcccacgtttcatgagctcccactatcatcggtcaggactctggaggattgtagcttcggataagctggtgaggtagttaagaccacaccctagaggccaggcacgatggttcatgcctgtaatcccagcactttgggaggctgaggtgggtggatcatgaggtcaagagatcgagaccatcttggccaacatggtgaaacctcgtctctactaaaaatacaaaaaattagccgggcacggtagcgggcgcctgtagtcccagctacttgggaggctgaggcaggagaatcacttgaagccaggaggtggaggttacagtgagccaagatcatgccaatgcactccagcctggatgacagagtgagactctgtctcaaaaaaaaaaaaaaaaaaaaaaaaaaagaacacactcactgcatggaggtggatgctgaagcccagagagatgagcgagggctcggcagtctgtggcgcaggccggcttgaagctcaggcctcagtgaccccacacccctgctctttgacgttttcctgtctgtggaagggacatgtcccactccccatacctgtgccctctgcccgtcatatttgtattcgcaggtgaaagctgcctcctcaaagcgtttcaggacctcgctgatgccccgggtgggatgggccaacattggtttcaggggaatccctgggaaaggaggagagtgagttagaggagagggaaggcaatggattagagggggaacatggagaggagaactgctaatgggccccaggaccattctgctttcttgctattcagtcacgaagcctcccacgttttagaaggggacctagcctcccactggggactacagcccccggccttccttccaggtgggaaaggccatgtgattggaacccacgcagcatgtgcaatgtctggctcacatccttgcaaggaatctggttgcctcccctccctcctctgcgtccctcctcccacaattagaacagggaagtgagccacatttgatcacagacattggggtgacaacctttggagggcagagggacacaggaacctgggtccccgggtcatccctgggacacagctgcacacctgtaccttccctggccacctcccttgctctggacacttctgtgtgacagaaagaaattctatctggcctgacccactgccttctggcccatttttatttacttatttattgtctcactctgtcgcccagctggagtgcagtagcgcgatgacggctcactgcagccttgaactcctgggctcaagcgatcctcccacctcagcctcccgagtagctgggatcacaggcacacgccaccacgcccggctcctgtttatcacagcagtgtcacctacaccctatctactccacaaggggaaattccaaggagaaaagcagtgggtttcagcaccagggaggagcatttggttttggtgggggagaggactctgcaagttctgagaggggcgcctacgatggccaccctcacgccgactcaggagggagcagggctgctgccaggctggtgagcgcccctggggcctgtacctgggctcagcttgcagtgctccgggagacgttccaggccgtgctccagcagcacggggataattcggtccaggtcgggaacctcgctggggtggcgggtgagaacaagataggggaagcctttctagaactcacacagtttggaaagagagctcggcctgctcccagaagcctgggctcctggatgcctctgcccactgagtcaccacctgccaagctcctcttgccaccctgtctctgtgctctcccttcgtgtcactatctgttgctttgtctcccttagtctggccttgcccctgttccctatctgtcaccacgagaccagcgattctctactcggctacacaggagaccactcaagaatacagtttttaaaaaaaggtttttggccgggcatggtggctcatgcctacaggcatgtaatcccagcactttgggaggccgaggtgggtgcatcacttgagcccaggagttcaagaccagcctagccaacatggtgaaatcccatctttactaaaaatataaaagttagctgggggtggtggcacgcgcctgtagtcccagctactcaggagactgaggcaggagaatcacttgaaccctggaggcggaagttgcagtgagctgagattgtgctgctgcactccagcctggatgacagggcgagactccgtctcaaacaaaataaaaatagacaaaggttttcaaggctaggttccacctacaaagattttgatgtagctggtgtggggtaggcctgaggtcagcagctgatagagccccacgtgcaggcagagttgagcttgctgcccgggcctgttcaccactctctgctcagcacccagtggggggccctggcccagagcaggtgctctgaggccatctgtggaactgccatcggccctcctgcctctgacatcctctctggggcagtcatgatcttggagtcaccagccctgggtcagctgctggcctaggtccctccacatggctctctctggagccctcgtggccgctccacggatgtcctctccatgactgtcaagacccttcaccatgtgtcagtcacctgctcctctctgggtcccttaaggcctttctgcatgcacagccctgtctggcactcagaaacctcatgttgccggctgccctcccttgctgtcagcgtctttcttttttttaagacagtctcactctgttgcccaggctggaacgcagtggcgtgatctcagctcactgcagcctccaactcctgggttcaaatgattcttgtgcctcagtttcccaagtagctgggattacaggctaatttttgtatttttagtagagacagggtttcaccatgttggccaggctggtctcaaactcctgacctcaagtgatctgcctgcttcaggctcccaagtgctgggattacaggcgtgagccactgtgcctggccgctgccagcgtctttctatacctctcctggggtcactgacccttcactgtttgccaccttcctgatctttgtcaccatccttgtgtcaagcaccagccttgtctagatcaccacctctgctctcagtcaccccgtgaccggcactcgtgatgcctgtccgtcacttcactggccccacccactgctcctctggctccacccccaccctggcactctgcccacagcccctggcaactccacccactgcccagctctcaccagaacgtctgcttcaggatcatgccttgctcctccagccacgtctttctggcctctgctgtcttgcccttcccagcatccaccatggctggtgggaattctaagaaaagacccaccagaggctttggaaggcacccacatccttggctacaccagggtgcagtgggtggtttgctgtatggcaaggaatgcagatgccgcggcccaagacgccccctcccccccacccaggagagaggagcctggtatggcaggggcccgctggggaaggggcgggcatgggcctctgaagaggaggggggaagcctgaggtaactccagcgagggatgcagagacgggccacaggagctcaccttggcccgggggcgtgaggctcactgcctgggagagggcagccagcaccgactgctctgccagcccaaggcgcagccgtccgctcagggacctggggagagagcaggccagggaagggggcttgtctgcacctccccaatcttgcctcctcccttctctgatctcctcgaccttgatgtatgtagaccctctcctcaaaaaccagaagaatcttcagagcctggaagggaccccagatatcacacagccccatgtgacagatgaggaaactgagccaggcagtaatgatcctgcccactagcatagactggggaggggcacaagtaggtgcaccagcacctcccatctcagctgccctgaggggttggcgaggcttgaggaggatgagtcagggagagaactgagcctggcgcccgccctggtgactgtaatggtcaggaccccagcatggtccttgctttgagccagtggcaggagacaagtggcttagtttgcctccccatgtctccatttccccttctataaactggaggtgagggtaacaagaccagtctcacagagttgctggtaggaactgatgaggtaaggcacggggcacagggcagggctcccaagaaatgctccatgatgtgagccctcaatggatttgctctcactgtcatggcaaacaaaccctggcttcctgctgcagggcccgcgcccaagccgaggcagacctcaccaatcaatcacagcatgcttcacccacaggggcccaggggccttctctagacagcactaccaagggacagaagctggcctgtgaaaggaaatggtgtcccttcccactctttaggggctgggcctcctgctcatgcttttctcatccaaggatggtcagggcatttgtgatgattccagctgccagtccctccctcctttcacctccgagcctgcagtccccctctgtagcctcacaggcccacacgcttacctagcgatgaaccgggcttctgagtggcggcaggccacaaagaggcctttgatgatgtctatcttcttggctgtggactggagagtcaggggaagagccgtcagtgcctggtgaaggcagggaccacacctccaccccaccagccgtgctgctgccctgcattttggaatacctgccctccttccctcaccccatccccatgtcccagctcccatggccgcccactcttagggcagtaagaacgagctagctctcctccttgcctccctctccctttatccaggaagtatttactgagtcctgtcatgtggcagccatggcattaggtctgctagactctgaagaggagactcccctaggattgggtgcaggaaggaggagaggaagctgtgcaccccatgagaaggactgatgcgacccagctgatggtctacccagaagccttcctgacacacgcgtggcctcaggtccccaagatgtctggggtccgggatgagcggcccgccccactcacagcactgccagtgagcctggcgatgtcgcggaacttgctgaagaccccggaggcagtgagcggaggtggtggcagcatgagcctctgggtgctgcggctgttctcggccaccagccccacgtcgcctttctcggctgcctcagcccggacggactccagctgccgaccttcaggggagagcgcgggtgggggtgtcgagggtgacagttgtggctgcgtgtctcccttctctcgcggcctggatgaattttctccagctgtgtgtgcttgtggcgagtccctgcacctccctgtgtctaacgctcacccacttggtagaaatggcttggggaacgtgcccccagccacgctggctgtaggaagtcagcaaacatgcacgtggagccaggaaagcggtggatgaacgagcatgaccacactcaggggagacatctgggccggtgtcatcagggcgcggatgggatttaaagccacaggcgggacaaggtcactagggaagtgagtgtggacagagcagagaaggccaagggaccctttcctctggcgggtcatgaacatctctggcagtgaccaaagacccttcggcttgttttggagccaccagcttacacacgtgggatgtgctctggccccacttactgtccagagctgggtcccatgggcgcctgggtgtaagagctggggagatggagcctcaagtcacggtgacagctgtgacaagcagctctcaacctatcagaaccaacacacccttgtcaccagatactgtgtgtcacctcttttctggtctgaaataaaatgtggagataacataacctgcctacacctatcgagataacgccctaaccctaacacagaaaagaatgaaagggaaagcaatccgtaatgaacgaacaagtgcgcgtttcagtccacagatgctcagccgcggcacagagcacatgaaggtgggcctcgcgcctgaagcgaaactgccacaaatgggagagccgacagtgtgagcctcaccaatgggatgttatcgaatcacacatcaaaggggacgggattctccaaagtggccaacaactcacaacaaacccgggacttggacagccacgggggccacaaggcggcacggagagcagtgtgagtgtgaacacgacccatcaagggtggaggcatgagacagtggaagaggccccagctgccatggattgttgggcaggaaagccagcatctgcaacttcttttgtgagaaaaacagatccttctttgtccaagccaatgtagttgggttttctgttacctgcagctcagagtattcttaaccgaccccgtgtgtgctgggtctggtatgacgtcagtgctcccgaaacacatcttgagtgaatgagtgagaaaatcttgagtctcatctcctctggctcccataagcccgtaactctttcctgatccaagtcaacctttctcagtccctctgtcctctcatgaaagcctgaaacccctgccttccctaaatgttggtgcccatggccctaagccagctccagtgctcccagcacatcctctccccaggcggatgagaacccaccagtgggtggtcatccctcctacactgaccagcccgaaccctgggctctgagccagacctggtgagcctcagacccgtttccaaacttcctggatggccctgggggcccacagatagaggttgctcatgcctgccccacgctggggtgattaatgccccctgcaggtgcctgcccctcaccagggtcccaagctgccgacggctttgtcatccatccagtcacccagggagatcctggaggcattcctcctgcctcctcaccctgacatccactgtctgccagatctctcctgccctcttctctcttctctacagctggggtccagctcctcttccccctggatgctgccccttgcctgctcacaatccttccatggctccccagtgtcctcatgataagcaccgagcactccaggcccttggcaggcgggccatccgcatcaccagcctttccacccagcactggcggctgggccccttcaggctgctggccccccacacaccatgttctttcctcccactccttccaatccctccagtcaaagtcctttcagacctctctaagccccaaccttccatctcagcccccaaatcctgctgtctctgcctccagcatctttccccagccctccccttccctgcaccccacaccccctgtcccagcacatgcctggtcctccctcacctgaactgctgcccctgtgttctctcccacacccctgcaaatctgtccccatcaggctctcctccctctcagccttctcctcaaccctgtttcacagcctctctccaccatctctccgatccacctgacctctgcattttctctggctgagctcctgtccttctggtccctccaaccacagtcccccttacctgtggcctgggccactgccttgagaaggacaccatcacccacgccaagctccaggccctgctggggtggcccaaggtggttgaggctgaggtagaggacagggaggaggtctggaggcgacagggccaccacggagcgcagcaagttgctcagcgtctccaccatccggagcctggaggaggggacgggggtatgaacacgtggttcctcaaggtcaaagtgtggtgtcggggtggggtgggtttaagggggtggacactagaaagaaatggagaaagaagaggaaagggctcagaacagtcccaggctctggggcctggagccatgaggacaatcacagattgctggaggtgaaaccgcctttgcaaaaccgtaactgaggaaattatgacagtggaaagaaatcacacctaaccgattccatcttgcttctaacctttaagctgtccttgttcagtcctgggcataggcagaactaactttgggaaggaatttggttcgtggcttgactctgaaacgaaattggtaatagccctttctggaaaagacccctttttgcctaaggacctgccttcgcaagactcacaaattagctacaagattagaaatttaggtttaggggtcacgcagcctctggcttccccgattgctcctggggataacatcactactgtaaaacctaagatgagtgcttaagatagtttgcagaccctgcactcagtctgacgccacccagactgtaatctggctcaacaagttctgccatcccacccaggaacagaagacagcaagaaaacctcccttcgaccccctgtgagtccatcttcaacctgaccaatcagcactccccacttaccaagcccctacacgccaaattatctttaaaaactctgctccccacatgctcagggagactgatttgagtaaaaatgaaactccggtctcccgcacagccagctctgcgggaatgactctttctccactgcagttcccccgtctagataaatcggctctgtctaggcagcgggcaaggtgaacccaccggacggttacagtgggggagtaacttggtgtgacggtaacaatgatgaagatggtgatgatcagcccagagaaacgacagctgatgctacggagcattttctaaattcaggagctggctttgagcactttgcaccttttttttgagacggagtctcgctccatcgcccaaggtagagtgcagtggcacgatctcggctcgctgcaacctccaccttgtgggttcaggtgattctcctccggagtagccgggactaccggtgcgcaccaccatgcccggctaattttttttaatttttagtagagacggggtttcaacgtgttggtcaggctggtctcgaactcctgacctcaaatgatccgcccgcctcggcctcccaaagtgctgggattacaggcgtgagccaacacggccagccctttgcaccttttaactcatagaatcttcacagctcccctctgaggtaggtaccattattatttccattttacggataaagaaacagaggcaccgaaagagtccgtggcttgcccaaggtcacagagcgagtaagtatgaagctgagatgtacaccaaggccgtgtgcctgaggactgtgctcccagccaccaagctgcaccacctctaaaacgaaaaccgtgtttctgtctaaaacttcaaagctggaaagaatggctttgttactgaaaaacttagggggcctcattagaaacagaagctgggtttttcctacagaagtctcattaccgaggtttttaaggtgcagagaagaaatacaaaaaccaacatcagggaaatccctcagtaatcattgtaggcaaaagccaccattggatggtgcagtggatggaacagcccccccaaaattcaggtccactcagagcctcacaacatgacctcatttggaaagaaggtctttgcggatgtacctgtagattaagatgagagcatagtgaatgaaggtaggctctgaatccaaaaagcatccttacaaaatacagaagagggccgggtgtggtggctcaggcctgtaatcccagcattttgggaggccgaggcgggccgatcacttgaggtcaggagttcaagaccagcctggccaacatagtgaaaccccatctctattacaaatacaaaattagggccgggcgcggtggctcacacctgtaatcccagcactttgggaggcggaggtgggcggatcacgaggtcaggagatcaagatcttcctggctaacacagtgaaaccccatctctactaaaaacacacacacaaaaaattagttgggcatggtggcaggtgcctgtagtcccagctactcgggaggctgaggcaggagaatggtgtgaacctgggaggcggagctgcaagtgagccgagattgcgccactgcactccagcctgggcaacagagcaagactccatctcaaaaaaaaaaaaaaacagagtgctgggaacagcctgaaatgctccactcatgttggggaactgagaaatggcatgtgccatgtgagaacgaagggacactacagagcagtcacaacaggctcgaaccactcaaccaacatggacacatgtggaaacgggtttgatagtgaaggcaagcagaatgagccgtacccatgataattttgtttgtttgtttttgagacagagtctcactctgtcacccaggctggagtgtaatagcgtgatctcggctcactgcaatctctgcctcctgggttcaagtgattctcgtacctcagcctcctgagtagccgggattacaggcacccgccaccatgctgggctaattttgtgtttttagtagagatggggtttcaccatgttggccaggctggtcttgaactcctgacctcaggtgatccacccaccttggcctcccgatgtgctggaattaaggcatgagccactgcacccagcctccatgataatatttatataaactaaatacacaggggcgagtgctgggggtgaggaggacaaggagagaagaggaaatggggacagagaagggggctggcagggaccagcgatgctaacatgctgctgagaaggaccagggtggggcagtgctatgcactgggcatcactggggtgggacgctctgcagggaacctctgtgaatgagtagggggtcctcgctataactgagacctcaccttcttttgtgaatatggagacatgtaagcaagactgaagtcacttttgatgactcagggtggactagaagtaatcacggactgtgtgcaatggtgccagtcatcccgagatggagcctgtctccttaccctgcacatctgggctcgccccttgtgtcttgctctgaccatgagaatgaggcagaaagtcaagaggacctgcagccgcttttgtgaccatgtctgacatccatgatcatacgcccgagcggggtcagaggccaagttgacagggtttggcggaacaaggcagcacagaccgccatgcagaggacagacccagaagcgaccccgccccccacccaggcagtcctcattagttaccgagcagacacctcctcgatcttctcaaacgtccgggccacagccaggtaaggaaccctagggaaggaaaagagacgcaagagtgacagtggtgcaggctataccatgctgcccgtctgcacccttgcttcctcacgcctcctcgggacacccttgccaatacccaaatgcatgagctcacttcccagggctgcctctctgtccctttcaatgctgctgattgtcgccaaaacacaggagggagagacttgaccatttctcccaaccaagactctgcttagagagcctccggtggcaacagggaccggagggggacagtctgaaaagggagaaacctcacttctggcccggtttccagcaggcatcttccacgggatgatagttgttcttggcaggattgtaaccagatggatccaggggtctacggaggcaaaacggagattgaattgcatagagccctgggtcaaagcaaagtcattccttccaactgtgatgtgccaggctctgttcaaggcacacggtgcagagctggatgaaaacaaagtttgctaacctggagctcacattccagcaggagagtcagaggaaagtgggcaaaaagcccccacataaacacatcattaattttaggtgttaaaaaaatctttcagaaaacaaaagaaagccgagtagaggaagaggatgagatgagggtgctgcttcacagggtggtcagggaaggccggagacatctgggcagaatgagggaggggttagcacagtgggcagcaggggacgagcattccaggcagagagaatagcgtgtgcaaaggcgctgaggtgcagacaaacttgagaaacagaaaagggattgcgtagctgagctgggacagagggaggtgcgtatagtcccgggtgtcgcaaagtgccaggtgccatgctaacaccacatcgattaacaatcagacatgggaggaagggacctttccttttttcttgagacagagtctcactctgttgcccaggctggagtgcagtggcatgatctcggctcgctgcaacctctgcctcctggcttcaagtgattcttctgcctcagcctcccaagtaactgggattacaggcgtacacgaccacacctggctgatttttttgtattttcagaagagacgaggtttcaccatgttcgctaggctgattttgaactcctgacctcaaatgatctgcctgccttggcctcccaaagtgctaggattataggcgtgagccaccgtgcctggccagaagggacctttctaacttccttttccggataaggaaactggggcacagagtgattaactcacccatggccacacagctggtaagcagcgcagctctagagacagttcccaacctctatttttttttgagacagggtctcactgtcgcccaggctagagtgcagtggagcaatgcgcactgcagcctcaacctccagggctcaagggattctcctacctcagcttcttgagtagctaggactacaggtgcaagcaaccatgcccgactgatctttgtagagatggggttttgccgtgttgcacacgctggtgtctcactcctggacttaagcgatcctcccacctcgacctcccaaagtcctgggattataggcatgagccactgcgcccggcctcaacctttatatcgtaagtagctcacactgaccccagccaaactctgcattcagactcatctgggttccaatctgctctgccccggccagctgtacctgctgaggaagcagcttcccctctctgaaccacagcatctccatctgtctggggagctaaggggtccctactatgacaggttgtcctgaaggttacataaaaaatgacagtgagggttcccactcctgggtgcacttcatggaacaatgaggactccccagccccaggcctacatctgtaccaaaatggggacaagggttgggggggagaaagagacctcaggatatttttcagctcttcagctgattctgatgctcacacagggcatggatggccaagacagatagtgccactgcagggctgtgcatggcctttggtatgaacttggggtttaacaagcggtggccggcattacaatgaggcagcagagtgtggtgggcaggggagtctagagccagtcagcctggctagaaccacaatgctgccactccccacctgtgtggcctgagcatggcattaaaaacaaataagaatagtagcagcagttaccgtgacaacatgctggtcataatcaaggccagaccctgggctaagtgtttcacatcctcagaagagagacacagaaaggctaagtcacttcctcaaggtcacacagctgagagaggtggagctgggattcctagccagtcctcaatactgtcccacctccccgctttacttttctcacccaggaaaccaggataacaacagaatctactcccagcagtgttgtgaggatttggagcattgcgtcagggaaagcccgttgctgagtgcctggcacgtggggaagagtgggtggaagaacatgcttcctctcatcactgtgcccccatctgagaggtgaggaaattggagagtgggaaagtttgcctgtctcttggaggcagccattggagacagaggggaagtgaccaggctaggaatggtgcaagaaaagcagtcatgcctggcgtggtggctcacgcctgtaatcccagcactttgggaggccgaggcaggcagatcactgaggtcgggagtttgagaccaacctggccaacatggagaaattaaaggggtttggaataatccctgctgttcagcagaaaggacaggtgggttaaaaagtatgacgcagtgagtccaaaatctctttgatgtcatgcctctacaaatgaaacagataacgacaagaaattctttcagctttaacatttcatgattaaagtttaagtctaacaaaaaagtgtctgtctctattaaaaatacaaaagtagccgggcatggtggcgcatgcctgtaatcccagctacctgggaggctgaggcaggagaatcacttgaacccgggaggtggaggtcgcggtgagctgaaatcgtgccactgcactccagcctgggcagcaagagcaaaactccgtctcaaaagaaagaaaagcagtcgtagtatcacttgaaatagaaaacagaactttatatacagtaggacactgattttatttggaaaacatatttataaatacacaaacacggacacacactcaggaggcacgatatggcaatggggaagaaataactgctaggaatcaaaaacattccttagggtcccaggcctggccctacccccacctccctgtgtgacctggcgaggcccgacctaacctctctgggctaatcatgtcaatgtgtgtaaaatggctaaagtgctcccttcctccacaggaatactgcagagaggacgttaacgtgctatttaacctccttgataaggtctcaattgggggtacaaaattgatgtcaagaatcctccgaacacttttttgttagacttaaactgtaatcatgaaatgttaaagctgaaagaatttcttgtcgttatctgtttcatttgtagaggcgtgacatcaaagagattttggactcactgcgtcatactttttaacccacctgtcctttctgctgaacagcagggattattccaaaccccttttccgttaatttttttttagctttcaggacatcaagaattcaagaggggatgaagtccacgctgctaacaccatcacattgtatttgaaaacacaatctttagaggaaaaaaataacttcagatggatatatgattatgtaagaaatcaggctggccgtggtggctcatgcatgtaattccagcattctgggaggctgaggtgggaggatcacttgagtccaggagctcgacctgggcaatgtagtaggaccccatctctacaaaaagtaaacaaaaattagcccggcatggtggtacatgcctgtagttccagctacttgagaggctgaggtgggaggatcccgagcccaggagcaccactgcactccagcctgggtaacagagcaagaccctgtctttaaaaaaaaaaacaagaaacaaaaaacaaaaaacccaaaaaacctaagttctataaagaggaatttttgtctgatttgtttcctaccagatctcaggcacctaaaatccagtagctaacacgtaatcagtcctttgtaaatacttactgagtaaataaatgagtccatgattgactagtgaaaaaaaaaaatctgaaagtgctcatttaaatttctttcatggcagatttcctgggcttcctaggggccagccccagtgctgggagctaggcaagaagactaagaaggctgggacctcccacagccctggctctgtgggaaggagcttatgtctggttagggaggctctttaccatgtgacaagacataaaagacagtctgactcaagtgctggggacacgcacctcctctcacacatgaagggagaggcacccggcttccctaagcaggtgcaataggagttggggcctgagggaagcctgctgggcagggtgggttagggacagtgttgtaggccggggtcaagcatgttcagaagcagggaggaggctgggtgtggtggctcacgcctgtaatcccagcactttgagaggctgaggcggccagaacacctgagattaggagttcgagaccagcctggccaacatggtgaaacccggtctctactaaaaatacaaaaattagccaggcttggtggcgaggcacctgtaattctggctacttgggatgtggaggcagaagaatcgcttgaacctgggaagttgaaggtgcaatgagctgagatcgtgccactgcactccagcctgggcaacagagtgagattccatctcaaaaaaaaaaaaaaaaagcagggaggaatgacagcacgtggggacatggtgtgcagagggagcaggaaaaggctgcagatgccaggaggctgcaatgtaaggtggacagggctggctcatgagggcactgggaagcccagcatatcctctatgctggggagaatcgcagatgggttttgagcatggcagagatgggggggtgacctcattactttataggatatttatccacccacgcatccaatcatccattcagccagtcttcagtgcggcctcctgtgtgcatgttagatgtcgtgggaatcagcccagacatctcttcaaataattaacaaaattacagtgaagcaattaattgcttaacaacctattcagtgtcccacagccccagcacactaagcacatcacgagggctggggcagggcggccggctctctatggttcatcctcgtgggccgcccagggctggcaaagaaggggtgttcagtgaattttaaggcagagtagacgcgcctgcaggcttccagcacatacactaaatctggtgagttcaggccaggtgtactggctcacgcctgtaatcccagcactttgggaggccgaggtgggtgggtcacctgaggctaggagttcaagaccagcctgaccaatacggtgaaactgtgtctctactgaaaatacaaaaattatctgggtgtggtggcatgcacctgtaatcccagctacctgggagaatcgcttgaacctgggaggtggaggctgtggtgagctgagacagcaccactgcactgcaggctaggcgacagagcaagactctgtctcaaaaataaaaaatctggtgagttcagagccagaggaacagagaggtaggaagtgaggccagagagggaggtggcagccagtggccaaatgggcttagattttctcctgacggctctggggaaccctagaggggcagagtcaactctgggtgttagaaagatcccccaggctctacggggatcagactgaggatgaaagactggaggcagggtcagagggtggctggggccacggtcagcaaactccgaccctggaccgtttctacaggttctgggatctaagaatggttttgcaacaggggccaaatgtgtcccataaagcctaaaatatttactctctggctctttatagaaaaggtttgccaagtcctgcaagaggaggaagcctgagctgggggtggggctgtcggaatgcagagaagggaacacatcccgaagaacctttccagacctggacactgactcacccctcagcagctccctcctttcctggagcccctggctcctcttccttcacttcttttttgactgctggcttccggggggctaggaatgaagacagaaaacagtgggtcttttctccttccggtagcccccacctcccatccattctgcacccagcaccaccccagtgctcagggagatgggagacaggctggtagagacaaggccgactttccaaccagcaggaaaggaagaagggtcttcgcagcatctcaggcctctggagagaggctcaccagcctcctgcctgtacaaccccgggaggtggggtgagcaagggaaactcactgaagaagctgctgagcgtcttgggagctctgcggggaggcttggtctgctcttcctcctcctgcagttcctgcttcgtggccacctcaggctctgaaacgctttccgtcggggtctctgcttctgcggtgagagagctcagacggtgatgcaaactctttgaccctgagactttttttttctttttttttacccccaagatcattctgaccctgcagatggaagatataactacacctacccttttcctttctgttagctttgagctgagatctcaggcctgctgtctactcctcagtgctaactagcggaattctagcacttggcctgaaataggagacttaggaatagtggtaaaaagaaatctcatcgtcatgagaagaaaatattcccactcctcccagcagctgcagaaaatcagatacaactctgtatccctaaaattctcccggcaagtgttgtttctaacacaggggcctcatggacacttggaccaccctgagagggtaacttcagcctctaaaatcctgtaactcagtttggttgtctaacttaattaataacatttaatttacacctatgacttctgaaagctatgaatactttttatcttttactttgtctgaggcgggggagttcttgctctgtggccaaggctggagtgcagtggtgcgaccataggtcactgcaacctccacctcctgggctcaagcgatcctcccacctcagcctcccaagtagctggaactacaggtacgtgccaccacacccaggtcatttttgtattttttttggtagaaatggggtttcgccatgttgcccaggctggtcttgaactcctgggctcaagtagtccacccacctcagcctcccaaagagctaggattacaggtgtgaggcaccgtacccggcctaggaagattttttaaagaatggctggctctttcctcctttcccacatgcatggggaaaaataataattaaaaaaaaaaacccgagtaataaaaactattattcttctagattcggcatttaagcaataagtttgagaatctatgccttgtttaaattaatcatcctccaaagacttctgaccccaaaatcaggaggtggggcagggcggaggagaggaccagaaactcactggaggtctttaggggcttgggaggcgtggtgggctggtccccgtcttctccttccttctctgtggccacttcagcctctgtgaggctttctttcggggtctcctcttctgacgatagacagaacggtcagatggcaaaaaaatcccattgaacctacaagggcattttgactctggagacagtctgccctcatctgtcatctgttcttttttttgagacagagtttcgttcttaccgcccaggctggagtgcaatggtgtgatcttggctcactgcaacctctgcctcctgggttcatgcgattctcctgcctcagcctcccgagtagctgggatgacaggcgcccaccaccacatccagctatttttttgtatttttagtagagatgggatttcaccatgttggccaggctggtcttgaactactgacctcaggtgagccacccgccttggcctcccaaagtgcaggtcttacagttctatcttgtgccaatccaatgtgcctgtaaagcagtgggccacgtaagaccctgctccttgtcaaccccaagcaaggcagcgaccttgagggggtccagcccgtttgcctatgtagccgagacataaatggtgtgtctttccttaccaatgattcctttagtgttattcaccccaaaatagaatctgaaagggttaaaaatgcaaatgacagcctgttatagacaaaaataaaaatcttcaaagttaaaaaaaaaatcttacctctagggtcacaatacaaactacaaaaaccaacttgggaaaaatctgccttagtagaaagaggccacccccgccacccctcactggacactgacagtggctaaaagtgtagtttacaataaaatttgtactaaaaattgtcaataagaaatcaaatcttttttttttgagacacagtctccctctgtcgcccaggctagagtgcagtggcacaatctcggctcactgcaacctccacctcccagtttcaagggattctcatgcctcagcctcctgagtagctgggactacaggcgcatgccaccatacccagctaatttttataattttggtagggatggggtttcaccatgttggccaggctggtctccaactcccgacctcaagtgatccacccgcttcggcctcccaaactgctgggagtacaggcgtgagccactgcacctggccaagaaatcagatcttaaccaaatttaaatctgccctggaaaatggaccttttatttgtttgcagaaacaaaaaaccaaatgacgttaaaggctgcaattggtgtaatctcatgcaggccccagatgatcaatcgatcagatctttatggctgttttcggtgggttcaccaacatgcagggaactcactgggcgctgcaagatattttagatttttcaaaggaaacccagcgacacctgctggccagtgtgtgaactactagttcgaggtatttcagttttcagtattaaatcacattccttgcaatgacattgcatctctgcaaagctgggttttcataggttgctgctataaaaatcaagtactgtacaaaaatcaacatagaacaggaaatgacgttggcagttttcaattgaattccactgtttaagatgttacagagtatccaaggcatttcccacaagtaattatggttatttaagaacaaaatacaggctgggcgcagtggctcacgcctgtaatcccagggctttgtgaggccgaggtgggcagatcatgtgagctcaggagttcgagaccagcttggtcaacatagtgaaaccctgtctctactaaaaatacaaaaattagctgggcgtggtggtgtgtctgtaatcccagctactcgggaagctgaggtgggagaatcgcttgagcctgggaggtggagactgcagtgagcccaaactgtgccactgcactgtagcctgagcgacacagtgagactgtctcaaaaaaaaaaaaaaaaaaaaagcacaaatattactttttttccaatgtatgtatagtatctaatagttgtttggacataactacttaatagaactgataaggtattggcctaggagcatcataaaaaaattactaagacatcaagggtgctgtgaactaagaatgtttgggaactgcaactttatggtaaaatttacaaggaaaaggaaatcatttagaggaaaaatagtttccattaaataaatataaaaatagcaaataaaaatgggaaactgtgcctgaattattactaaattaagatgtccaaacaaatatatcccacaatgttttcagaacaaaagttcccatattggtaggtggaattcctggatgcctggacacaggcatcaaatcggcagggtccaaacatcctgagctctcaggcccctgcccttgcagatccaaaacacacacacacacacacacacacacacacacacacacacacacacacacacacctctccttctgggggctcaccttcctcctcctccttcctcttggcttcacacacacacacacacacacacacacacacacacctctccttctgggggctcaccttcctcctcctccttcctcttggcttcacacacacacacacacacacacacacacttctctccttctgggggctcaccttcctcctccttcttcctcttggcttctctgtcctcgtcctcactctgctcttccaggacttcctgaatggtccgtttcgggagctgcttccgagctggggaggcaaagggcttggtgtatctgacctcgctggctcgtgtgctcccatcccggagagctcacacccactgatgtagcctctggaaggctctgggccctctccccttctctgcctgcacacagtcactgccccagtgcaggccgcacccttcaatccctcctgcttcctggctgtgtgaccttgggcaggttacttaatttctctgtgctttgctctctcacgactgcagaatagaaataatccccacgagtaaacaatgatgtaatgtacttggcacagtaccgattccagcaggtcccctgagctccccactgctcccctcagatcttaactgcctccaagtgttccagacagcttccccggaacctcagaagtctggaagtggcagggaataaactagccccaggagaggccctcaccccacgatcggcaggagttggtgtataaataccccagctgcctcgcatctcgggggtcactctggagcatttacaccgttccccagagaatcccacaaaactaagctccagctgcccaacacatagcagacccaacagcacatcctgtgttggctgctcccctgtcctgaatcaccctctgttccctgcacctcctaaacaaaccacttgcacttgaatccctgtttcagagcttcagaacctgcttctaaaagcctctaaactcagatactaacccatgatgaagagctcacacaaaggcagttgtacccatcttcactgttatatctcatgttggccattgcgccacctggtccccggtctcccggcccccagtggctccttcacgtggccccagagggaccttctatcagcatggctggcactgtctctccctgctcaaaacccttccatgactccacattctctgctttatccaggataaagtcttttgatgtctaccccgatcctacctaatctctctccatctgaccttctaacccttcccacaccacatactccaccttcttttatatcactgctaaactggggtgtttccagacacaccaagctgtgtcacccctccaggcctcagcatgtgaggtttgggacatagctcaatgttgctccctctgaacaagatcccctgacacacccccagggccaacctcagcgtccacctggagctcccagcatgccctcagccacactgtgacttccttatggccacctttcattcagggatgaacctgcctccccacctcacagcccttccatggctcccaggacccacagcacgaagcccaggctccttagctgggagtgcaagaccttttgagatccagcccccactctcctctctagctcacctctcaccacgtgctatcctcaaactctccctgcttcccaggtcgcatccgattctccagaaacaaggaagtagatgagaggccccaaacatcccatgctgttcccatctcgaggcctctgcacgtgcccttcttgtctgaaatgcatgcatctgtcctttctcaacatggccaaccccaacccatcttctaagactcggctcagccatcacctcccctgggctgcttgacttctgagctcccagagtaccctgcgtcacccagcatcgtccgatggaaagatctggcaagccacgtatgtaaccttaaactttcttgcagccacgttaataaaaagggggaaaaaaccaggttgaacttggtttgaagagtctattttgctcaatacatctaaaacagtatgattccaacattctgttttcatgctaggtcttcaaaatccaatgaactcactgcacatctcaagttggacaccagattttcatcggcaacatgatctgtgtaggtttcataaaatgtacagctattcacataccaaagctgttccaaaatgatgtggaaaaagtgcaaagtctttacgcactgaatcacatattagctttcaaatgtaaattcaactgaaaggatctaacatgaaagattcagctcccctgtcacactcaccacgctaaagcgctcaataggctagaccggacggcaagggctcacactgccccgcattacgaatgggtctctcgccctgttcttaccccacagcaaacattccaagtcccccttaggacaaagacgctgttccccaagctggttttccaggaccttctcacctcattgctcaccatccccaatcctgcgctctacacgccagcacaccaggccctcagcagcccccaggccttctcaatttctatgttccccttgcctagcatgctcccctcctcctttgcttgttgcctcttctttgtcctaaagggctcagcttggttagcctctcttctggaagtctcccttgagccatggccccgcgcttgtgttcccacatgagctgtgaggcctccatctcagcgcataactacagtcacaatgacccacaatgactgagccccgactgagggctgggcccagttctgagcagcgtacacgtgttatcttctaactcagatatttctgtgcggtaggtgctatcattatcatcatctctacagataaagcaacctaagctcagagaaggtcagtcatttgtcccaggtcatacagccagtggatggtggacccgtgctcttaaccacaacactaagaccagagctgttgtaaggatgactaccttggatgggaatccaagtggggagaaaggcaggcgactggctgggtgcggtggctcacgcctgtaatcccagcactttgggaggctgaggcaggcggatcacgaggtcaggagtttgagaccagcctggccaacatagtgaaaccccgtctctactaaaaatacaaaaattagccaggcatggtggcgggctcctgtagtcccagctactcaggaggctaaggcaggagaatcgtttgaacccgggaggcggaggtcagtgagccgagatcatgccactgcactccagcctaggcaacagagcgagactatgtctcaaaaaaaaaaaaaaaaaaaaaaaagagaaaaagaaaggcaggcgactgaaggggcaggggcccgtgtgttctcacctgtgcgacgcttcggaatccctgatggggaactgtccatgggagaggtgtcagagagggaagcattgttctcaggagatgtggcaggacggggcggggagacctgtgagcagtccagggcaggcttctggaagaggaaagaacagttctagagtgagcgggggaaggagggactccattttccaaaagttgagagtagaggggactgaaacctctctgtctaccctcctttctgaccctatggtctcagccctaactcaggggtggcctcttctcacctgggccatcatcccgccctccagtgcaggatcatggtcccatcaaggacccccatagctcttctgttttctacagtaacagaatcttcgattctcctgcttcagcctcccaagtagctgggactacaggcctgcactaccatgcctggctaatttttgtatttttagtagagacggggtttcactatgttggccagctctacacaatgggatgtcaggggaaatgatgtacacctcttcgtatagttttatttttatttatttatttattgagacagggtgtcattctgtcgcccaggctggagtgcagtggcgcgatctcggctcactgcaacctctgcctcccaggttcaagcaattctcctgcctcagcctcccgagcaactgggataacaggcgcccgccaccacgcccagctaatttttgtattttttttatagagatggggcttcaccacgttggccaggctggtctcgaactcctgagctcaagcgatcctcccgccttggcctccagagcactgagaatacaggcgtgagcccccgtgcccagccttctctccatacagtttagatgtttgttccctccagatcgcatgttgcaatttggtctccaatgttggaggtatgacctggcgggaggcattcaggtcacgtgggcagatccctcatgaatggcttgtaccctccttgtggtaggaaccgagttcttcctctcctggttcacatgagagctggttgtttaaaattcctctcttgccatgtgacacacctgctcctccttcaccttccaccatgactggaagcatcctgaggctctcaccagaagcagatgctggcactatacttcttgtatagcctgcaggaccgtgggccaaaataaacctcttttctttataaattaactggtctgaagtattcctttatagcaatgcaaaatggactaacatgcatttcctggttcaaataacatccacttaatgttgagtggggtgccctcctcttcctgttggcagaatatggatgttcacagggacaagggcatctacagagagcaaacgacagcacagaggaagcctgggcctctgaccctgtgagacggtcacatgaatcccggactctgcactcaggagagagaaaaataagtttgcgtcttgcctaagccactgctaccgtgtctcggtttcaaccactcacttatcttcttacagggccctgtgccagttattaagtgattttctctcagctccaaacctgtcactgtccagtctccttcatgctgccaggaccgggactccacaaatcttcttcttgctctggcgccacctgggcatcaggcagtgccaatggagggaagcagagggcactgcatgactggaggcacagccggcttgccgggggcagctgctggatcccactgacagttttttctaacattcacggggcttgccacgtggtacctgatcagagaccctggcatctcccacccagtgctcccttcctgaaagatcagagttgcaggctctcggggcaccttctctaagctcagagacctgccagcagtcccaccacagaggtgtgaatttcagctcaaaagccacagggatggtcactgcaccccacagttgctacctccatgatgccttagagttagttctctttttagcccttcagttacctatttaacaactgcatacctagtgaccatcctttaaactccctctgttcaaatcactggtatggtttctgtctcccattgagaccctgatggagatacaggtctcagataatttttttttttttttgagatggagtcttgccctgttgttcaggctggagtgcaatggcacgatctcggctcaccacaacctccatctcccaggttcaagcaattctcctgcctcagcctcccaagtagctgggactacaggcccgtgccaccatgcccggctaacttttgtagcagagatgaggtttcactatgttggcctggctgctctcgaacttctgacctcgtgatccacccgccttggcctcccaaagtgttgggattacaggcgtgagccatcatgcctggccagatgaatattttaaacactgcccaggactaaatgatctctgcctctcttctgcccaaaactcttcctagctccccagaagcctcagggtaaagtctaagctccaaaagagatctctattctaatacctggaacctgggaatatgttaggttacatggcaaagggtaattgaggttgctaatcagctgaccttccgatagtgggattaccctggactatccaggtgggcctgatatagtcacaggggccttcaaagtggaagagggtggcaggagaggaaagtcagggtgagatgtggccacagaagaaaggcacagaaggaggcaatgccacttgcttatttatttatttatttatttattttttgagacagagtcttgctctgtcacccaggctggagtgcagtggcacgatcttggctcactgcaagctccgcctcccgggttcacgccattctcctgcctcatcctcccgagtagctgggactacaggcgcccgccaccacgcccagctaattttttgtatttttgatagagacatggtttcaccatgttagccaggatggtctcaatctccggaccttgtgatctgcctgcctcggcctcccaaagtgctgggattacaggcgtgagccaccacacccagccacttgctttgaaaacggagaaaaggggatctctagcagctggaaaaggcaattcctggattctcccccagagcccccagaaatgaacgcagacctgctgacaccttgagtttagcccagtgcaacccatttgagactcacgactcccaaactgtaagacaataaactgacactgttttaagccactgcgtttgtggtcaattgttatggcagcaaatgggaagctaacataggtggtgaggaaagtttcgctgaggaagtgatatctgagcaaagcatggaagaaagcaggggactgagccaggcgtgtatctgggaaagagagttttaggctgggaaagaaggtagtggcccagaggtggaagtgcacctggtgggtgtgggaagccaggatggagcgagctgaggaggagctgtggatgcggctgcagatgtgatgggcgggggaagagaggagcagcaggaggggcctgggaggtttccacaaggcctggctttggcctgtggtggtaataccagggggtttgggcagggagtcacaggacctgacctcaccactgacagaataagcagcaccacgctttggacatcatccacaaagcaatgaacaagcattaaatgacttaaacaggggaagagagtggtccaatgtatttggagaagttaaaaagccctctgaccacaggagaggctagatatacttttgaacccttatttttttgcttttttttttttgaagcaaggtcttgctctgtcaccccggctggagtacagtggtacaatcacagttcactgcagccttgaacacccgggctcaagcgatcctcctgcctcagcctctcaaggagatagcaccacaggcatgcaccaccacacctggctaatttttaaaacatttttttgtagagatggggtctcgctatgttgcccagcctggtctcgaactcctggcctcaagtgatcctcccacgttggcctcccaacgtgctgggattacagacgtaagccattgtgctgggccttgagcccttgttttaccatcaggcattattctcagatctgtatgtaaatcgactcatttcatcttcccagtcaccctatgaggaaggtgttaccaggagctgcatgttacagttgaggcatccaagacctaacgtggtgaaggagcccacccgaggtcctagggcaggggcaattaggaccaggttgtgtctgcccccgacacaaccaggaaacacatctacctctcccgggcaatttctccagaattctcctgaacagctgctgcactctgttccaaaggttaatgggaattagtttcttctggtaaaaatgggcagggtgatggggacctacctggcctttagcagggctaagggcttcatcctcctcttccccttcgctgcccaggacccgggccgccttcctccctggcctcttcaccggagagtcactctcggacaccactccattccactccttcagtgccgccctggaaggtggggaaatgggggtgtaaaggggcgactacagcaggcagagtgggggcactgcccgcaaacactttggtttctttgctgtttccttcccttcctttcaagcatccaatgaacattttctggttgtctcctcagcaaatctcatcatttcatccatcagtgcattaatccacccgcccactcatccactcacccacccatcacacatctctggaagtctccagagtgcctgccctgtgatgggtgatgctgaggagcaaatggagtccctgcctaaggttgccattggtctccagcatctattgggatgcctttttttttttttttttgagatggaatcttgctctgtcgcccaggctggagtgcagtgggccgagatcacaccattgcactccagcctgggtgagagtgagactccatttcaaaaaaaaaagagtactgttgtcttctacttagatgagacagcatcaagacgtggccagtggccagcggccagcttctctgcattatggagaatgtctggttctagaacgaggccaagacctgcagaaacagagacgtacagacaactccgaggccctggatccagctgtgcctgcagctgctcttgctcttggacttctggccacctggctgaaaaagttttttgggccccaagacattttgcattaggtttgaacacttgcaaccaagacaatcctgactgctaaaggaaaaaattcaccatatcccagccctgtgacatactttggagggggctccgtctctctgctgctattggatgcctccttctcaggcttctttgctttaccctctttcttggggtggaaaaatgacctagaggagcataaaagggggtaaaaaaaggagaataacagcaccaataccctgcctatctatgctgtatcctataacttccttttttttttttttttttgagacagagtctcgctctgtagcccaggctggagtgcaatggcgcaatctcagctcactgcaagctccgcctcctgggtgcatgccattctcctgcctcagcctcccaagtagctggaactacaggcacccgccaccatgcccagctaattttttgtatttttagtagagatggggtatcaccgtgttagccaggatggtctcgatctcctgaccttgtgatctgcttggcctcccaatgtgctgggattacaggcataagccaccgcgcccggccgcatcctataacttctaacaccatttccatctcagcacataacagagaatttcaaataagccctttaacttaactgataaggaaactcagactcagacaaaggaggcaacactaatttttctgccctaacgcacctgcaagatatgatacatcccaagttttattcaacaaatattaactatgcactttttaaatcttttttttttagacagactctcgctctgttgcccaggctagagtgcaatggtgtgatctcggctcactgcaacttctgcctcccaggttcaagcgattctcctgcctcagcctcccgagtagctgggattacaggtgcccaccacaacgcccagctaattttttttgtatttttggtagacacgggttttctccatgttggccaggccagtctcaaactcctgaccttaggtgatccacccaccctggcctcccaaagtgttgggattacaggcatgtgcccccgcgcccagcctaaaaaaatttttttttttgagatggagttttcactcttgttgcccaagggtggagtgcaatggtgcaatctcggctcactgcaacctcggcctcccagtttcaagtgtttctcctgcctcagcctcctgagtagctgagattacaggtggccgccaccacgcccggctaatttttttcatttagtagagaaggggtttcaccatgttggtcaggctggtctcgaactcctgatctcaggtgatcctcctgcctcccaaagtgctgggattacaggtgtgagccactgcgcccggcctacctaagcacttattatgtgccagggcctgttctgggcctgaggggtttggcagtgacccagacacacgaagttcctgccttcaagaagctaacactctggtgaagggcagaaatattaagcaaacaactaaatataaaatgttggggcctggcatggtggctcacacctgtaatcccaacactttgggaggccgaggtgggcggatcacgaggtcaggagatcaagaccatcctggctaacacggtgaaaccctgcttctactaaaaatacaaaaaaaattagctgggtgtggtggcaggcgcctgtagtcccagctactcaggaggctgaggcaggggaatggcctgaacctgggaggcagagcttacagtgagccaagatcgcgccactgcactccagcctgggcgacagagcaagactctgtctcaaaaaaaaaaaaaaaaaaaatgttggaaggcgtgaacattaaaaaaaaaatctggtgaaatctgaataataaagtatggagttcagttaagagtaatgtactgacattagtatctcagtggtgagaaacggatcatagtaatgtatgatattgacaatggaaactggccaagggtatacaggacctctctgtactgtctttgcaactttcctgtacctctaaaattattccagaataagaggtttatttaatcttcaaaaagaaaaggaaaaatcatgcaaaagccagtggacagaaagcaatcgaaggcaccatcagccctggagagacaatccccagattcctcatcacgggagaaaaacggaacccagcatttgtgtaagccactaccgcccaggtttctgggatggatgcccttgtctgggtctctctaccatccattttttcctcctggtaacagcccctccgttttcctcttgggatgcttcttaccccacattctctcagtacacacgatttgagtgggctggcccttttgcctgtgaccaggggtggacacgtgatccaggctgcatccctgtggctggttcagggataggtatgtggcccaggctgggccagtgaaactgggctctaacaccctctttccaaggggaccgctaagaggggagagcccgcctgagggtgaggacaacctcaaggacagtagagctgaacaatggagagagacagattcccagggaggaagttttggcaactggatcgaaccaagcctgaggctgtttactccagcaggtttcaatgatataagtcaagtcatgccctttcttgtcttcctgaagccggactgcattaacacgaggtttctcaacctagacactattgacatgttgggcctgatggttctgtgttgttgggggggctgtcctatgaattgaaggatgtttagcagcatgcctggcttttagccactagatgccaatggcaaaccctctgtccctaggttgtaacaaccaaaaatatctccagacactggccgggcgccgtggctcacgcctgaaatcccagcactctgggaggccgaggtgggcggatcacgaggtcaggagtttgagaccagcctgaccaacgtggtgaaaccccgtctctactaaaaatacaaaaattagccaggcgtggtggcacgtgcctataatcccagctactcaggaggctgaggcaggagaatcacttgaactcatgaggcggaggttgcagtgagccgagattgcgccactgtactccagcctgggtgacagagcaagactccaactcaaaaaaaaaaaatctccagacgctgccagatgttccctggggagcaaaattgctgctgactgagaaccactgcgttagggtttctgctccttgcaactaaaaactgttgttcaatacactgtcttccatatcccacggctcattttccatactacttgactcctggaaattccaactcaaaatctaacgtaagagtttttgtttgtttgtttgtttttttaagtacagatttagagaaagaaacagaggacttggagaaggaaagactcaggggcaagggagggtgctcacatgatacttcgctgcatgttggcgtcagaattctcccttcctgtccagcacttttcttcgtctgtcagctgctcctggaacagaaatccaaacacttgttgaggtgattggttgtgcagagatctaaacacacataaaaccctttctttaagaaagaaagaaaaaaaaaaacagaaacatgaatttccccttcaaaaagaaactcctgtttttatgaaccaaaataatttgctggtgagatttactggtgcagaataaaagctccaaatcagagaaaaagataagaggcctcctttaccataagaagactgtttttcatctaatatgaggaatagactgaggacctgaaatgggtttttttggagttaagtttaaaggttagtgaaaaattgttttaaggtgatgacataattccgtgaaacaactgtggaagcttataaaattgtacccgctggtctacataaattagctcttgggcagtttctaaggtatgctgttatttcaaacaaagggcagaatatcacagagtgtgtgctactgaactgtgtaaaagagaaaggctataggtcaggcacagtagctcacgcctgtcatcccagcactttgggaggccgaggtgggtggatcacttgaggtcaggagttcaagaccagcctggctaacatggcaaaaccctgtctctactaaaaatacaaaaattagccaggtgcggtggcacgcgcctgtattcccagctactctggaggctgaggcaggagaatcgcttgaacccgggaggtagaggctgcagtgacccgagattgtgctactgcactccagcctggacaagagtgaaactccatctcaaaaaacaaaaacaaaagaaagactataaatgtatccacatatcttgtatatgtacagaacatctcagttggaagacaaaaaactggtaatgctgtcgcctcaggagggacagacgctggagggagattttttaatatgcatgcttttgcaggcagaacaattggaatacgttaccccttcacaatatatttttaaaaattaaatacttttttaaaaagtctgttatttaatgaaatcaataacagtcactggggcttccacagtttagagtaactctaatgaaagggttcctaggccgggcgtggtggctgctgcccataatcccagcattttgggaggccgaagcgggtggatcgcctgaggtcaggagttcgagaccagcctggccagcatggtgaaacctcatctctactaaaaatacaaaaattagccaggtatggtggtgcacacctgtaatcccagctagtggggaggctgaggcaggagaatcacttgaacccaggaagtggaggttgcagtgagatcatgcactctagcctgggcaacagagtaacactctgtctcaaaaaaaaaaaaaaagaaagaaaaagaaagaaaaagaaaaagaaaagaaagggttcttaatctggggtccacaaaacccaggagtccaagagcagaactcaagtggtctatgaaatttgacaggaaagaaattacgactttattcttgtaaacttctaattggaactgagcctttccttccattataaatattaaagatataaaaaattataaattttctatatctttaatatttataatggaagaaaataaattacacattataattatgtaattataattatttacattatatttccttccactatgaatatattttttaaaaaaggactagcaggacctctgcgtggattgcttgagttgagaccagctcagaccagcctgggcaacagaaatggttttctttgactttcccttcctttgcacagaaatcttcttcaacccatggggtcccctttcgttttctggaatcagtactctctgtcccgcaccacacgcctctaagtctccactactctctacagccttggccgccacatgttggcaccacaactcaaactcaattttggaatcaaaaaactcagtaggccggcactgtggctcacgcctgtactcccagcactttggaaggctgagacaggcggatcacgaggtcaggagttcaagaccagcctggcccgcatggtgaaaccccatctctactaaaaatgcaaaaaattagccaggcatggtggtgccagcctgtaatcccaactactcaggaggctgaggcaggagaatcacttgatcccaggaggcagaggttgcagtgagctgagactgcaccactggactccagcctgggcgacagagcgagaccccgtcttaaaaaaaaaaaaaaaaaaaaaaaaacaaacaaaaaagaaactcagcaatttccaaacagagtttctcagggccagttggggagcaggaagtaagcaatgcttcaaccaaacagttcacacagaaagcaggttagggacttagccaccaaaatcctgagggcaaaggagaaaactattacgatccctcctgagtgctcaactgcctaggtacttgacattctcaattatactgactctccacaacaactctgttacagaaactaaggcacagaggggttttcaaaggaacttaacctgcatctatagtacgttccaccccaggtcggcctgctccacagctcacctcttaaccaccagactgagttgcaagggaaggagaaatacataagcgtttactgggaagcctactctatgcctgacaggctgatcacattctcaaataccctcaatcctcaagtcagccctccaagacaggtgagatcatccccactttatagatgaaggtaatgaggacagaggaacatagctggggttcaggcaaggcttcaaaacccggtgtggctggctccaaagcccacgttcctttctccttaccacggtactcaaggctggcttctcaactctgtgtactgctgagttggggggaacaaactggttgatgcctctggaggaccacctggcgtctctatcggaacggcaaccccacttctgtgtatttggcccacagagaccctcacaggtggaccaagtgaggcacaaagttacctgctgcagcactaactgtaatgagagaagactggaaactggtggaatgtctacccttagggaactggttccctcattactggaataccatatggtagaatattgttcagggttaaaattaaatgaatgatggataaaaggtataggagttttttggggggatgataaaaatatcctaaaatcgattatggtaataactgcacaactcagcgcatacactgaaaaccactgacttgtacactttaaatgggcactttaaatacactgaaatacactttaaatacactgaaaaccgctgacttgtacattttaaatgggcaaaattgtacactttaaatgggcaaactgtataattgtgaattatatctcaataaagcggttaccaaaatgaagagataatgacaggaaaaatatcaagtaaggatgaaacagtactcagtaataaaaagaaacgaagcactgatacaagcaacaacttgggtggacctccagggcattgtgcagagtagaaaaaaggtaacatcctaataatatatgattccatttacataacaatctccgaatgacaaaactagagatggtgaacacattagcggttgccaggggcctggggaggagttcttatgtggagagggaactgttctatatcacaattacgatgggggttacacaaatctatacaaggaatcaagctgcacgggcacacagatgcacaatcacactcacaccacacaaactggtgaaaactgaacaaggtctgtaatctagttaacagaactgtattgatgtcaatttcctggtttcgatattgggactacataagatgtcaccattaggggaagatggatatactcttttcacaacttccttgaatctataattatttcaaaataaaaagtaaaaacaagaggtaagctccatccctttatcaagcatacattaggccagacgtctccccattcagatgattctccatcttttacgagccctttacctagacctggaccttaccactgacctctccctgacaccacccatctccctccagtagggcccactccttccaggtgatgctgctgcccgcgatttaccttcttctagccccgccccctcagcacttccaggtggcccccgccccctcagcacttccggttcccagccagccccacccttggcacctcccccttccaggtggccccgcccacacgcaatcttttccccggccccgccccttagctcccttcagcccctccccctcccagatagccccgccccctcggggggccttccgatttccagctggccccgcccacacagttttcccccccccggccccgcccctcagttccatttggcctctcccctttccaggtgaactcgcacctcaaggcctcttctcagaggacctgtccaactgtctctgtctctcgtctaccctctacctggcccccctccctctgggagacacctctctgcactctccggcggcccgcagcccgcgctcttccgtctccaccgcgctctcggcagcctcagcgtccccacgcccactcctctgcagacaccccgacatggcgaagcataggccccaagcattcggcgcacccgccgccctccgcctcccatctgcttgcggacggccccacttgccttgcgttggtcccgcgcgccgctgcccgggcaacacactcagatccgccaggcgcgcctctg

SEQ ID NO: 1846 - DNA, 10925 bp, Homo sapiens
  source 1..10925: mol_type = genomic DNA
ttaatagtgcattaaatattttatttaaattaagaagtataacaaaatcacatacatttgttccacggtttgaataaaatttccaataactttcaaataatgcacacatagtatcgcatggatcaaattccgtacatttcaatatggtcatgagataggctgtattccaaaatttggtatataaatccatacataatatatactatatacattgactttaaataatctaactatgtcatttttaaaagtcaaagcaacttatttctaatgaaagttacaatatgcatgccatattgacacctattcaatagataaaatctaggaaaatcttttttgtgaatactatttatactggaatgcaaattcacataaaaatacttcctttaaagcatgttctatttcacacaagaaattaaatgtgagctacttttaaaattgcaagctttatttttaatcaaaccaattcaattttaagtttttagatcattaagtctcatacaacttcctctaatttagctaaaaccatcgacagggttttattgttacatttggccttaaccttaaaaaacaaatttgtttacatttcatatttaaatgggacattttaaaccctgagtaaaaagacatatttttacaagtccagctgtaacaattctaccctattttcttgcagtgcttttattagataaaaactattgttaacgttttgactttttagaatatactgtttagaaggttaatgctttttcatgactttaaaagtttctaaatgtattttattagtatctaagtaaaaattctagatttctatatggatattataaaaacacctcttctttagactgtttatttcaccttgatcataaaaaatcattgaatactacattcaagataatttttctttcttggctttgggctattgtcttttcaaccttaaaagttaaaattattgttttcctatatgtaatgatactttttaggcatagatttttaagatacaaaaataaaatgtagtttagtattttatcattaccacctgctgcaatgagtctgccagatcagaggctttcctcactaggaaacctagctttaaatcaaatactggttttcttcttgtaattcacacttgtctattgaatcagttacccaactttcttttaggattttaaactttctcttaaaagttcttctaaaagctttaaaatctgcaacacgactatgatcttccccaattattacatgagacactccctcagctaaacaagaaactacttttgctccatgaaaccgaagctccaaggctttaatagctaaccttgtcccctcatttttggtactcaggtcattaataacagcatacgagtccaaataaacggtgtggcgtcgaaacatactgagaggagagcaatcccaggaataccgatattctaaatcagcaatcagagaagccatttcttcaggagtctgctcgttagaatttttaattcctgagaatacttccttcagttggttcaagtctgtatcaatgaaataactatcaccatagcaatcatattcacgggcaaaatgttctttggttgatgggcacatatgaatcataaagcgaggctgccatggtacaaagcttttggtcttaaaacattctaaaagccatgcaggcttgacaacatcatgtttatttgacaaaattatgtttttcactctgatgttctcagaccctgcaattacacagtacgtgtctgggcctggattttgtactatataaccaccaaattctgcaattctgttctccaggtcaggctttggctggctatctgttccactcataacacaaaactctacatcttcaaatatattagaaattttgttaacgttagtaaggttaggtgcttttaagtgctcaataattccaataactttcttcatctttggggcagctttccgctttttttcttgtggttcatcatcaccacctatataaaggtgtttagatgcgagcttaccagatgccttccccctaagttgttctaggtcgtccagggtcatgcactcatgccactccttgtcatctcttatcttttcaattcgtggaaaacgcaaggtgcagccagttttatacatatcactgggtacgatctctgctgctttaatctgaacaatgacagaattacaaggttcaatgtatacttctggcttctctgttccacataaaatgctgcttggtggagcttttctatgaaaaggcttccaatacttggccaatttcaaacccagatcatacagttctttcatggtgcagccagacccaacacgagagagagtatgaaacacagatggcttctcaccaggagggggcttctctgctactgcacacagaaaatgagacatcattccaccccgtgatcctttaccccaatatcctccaacaattaaaatgtccaattcatccattagtccactgacatactctggtttaatttttaaccacccttcacctcttttgtctggcttgtagatggatagaggttgttttaccataattccctcttctcttttatctattgcttcattcaatgcatcaattacttcattcttagtatgagcttgtgttttctgcactatttctattctacctggaattggtgtaaaaatactactaagaatctcatacctctttctcagagtctcatgccctagctttttattattaaccatcaatacatcaaaaacacaataacaagtttgcagatcagaatcctctaccattcttttaatatcaaacttagttcccttttgcatgaaagtttgtgtattaggattataggccatcatctcaccatcaagaatacagatttgtatatctgctttgaatgcattatgaatgaatggggtaagagaaccttcagtaggagaagcaccaaactgatcagtgtagttatatccatttcgagagaagtatttatatacatctccatctttgtgcatttgcatacgttcaccatctagcttggtttctatgtagaaactctgatgtttcatatccttctcaatgtgctcaatatctgcaatagcagctagcattggtttaaatgcagaaaataaagtgatagaaatatcactgagtcctacagaaggatcatgcagttgcctacagactttttccagatctgtagtgacattatgcaactcagcagcatcattatgaaaaacagaaaagatagtttgctgactaacaccaagctttaaatcctttatgatcatccgtataagccacttttgctcaagtgctgaactctgagttataagttgaagaaggctcttttttattaggtcttttcttttagcagaattattgctggcaattgagtctaaaaggtcgtttacttgctgtatggttaaacttcctttctgtaaacatcttggcttcaacacaaaatatgcaatcattgcaaagtctccagcatctccatgagttccagtgggtgttctgtagtttaaaagtttgagggcatcttttccatctctaggtaaattaagcaactcaatataaagcttagcaagcatagtttctttaattccataggccattctctctctttctagctgaggaagaattagtctcattgctggataaaaagagtctgtgacatctttgtggttcttatgaagagcatcatgaaattttctccaagaatctaaaaattccctgaagtgtctgattttttctgcacgtcctttacttttctgtattcgttctaaagttgaacacaaatctgcaaaaggaacgtgagatgcaacagtttgtgaagtttgtgaggcagccatcaaagcggtgatgaatcttctcgtttaactagtaaagcaaaaagagaataactttaagtaaaagataagattcaactaaatatttaatgtaaagatcttacaaagatcactgagatcataataaatgtttattaatgtttactaaaaaaaagatcaatgctctaaatgatgtatcttttcaacctctacatttaataactgttttgctccaaccctaatttgaagttattatgaaaagtatcatcagctatatagctgtatttcctgtatttataatacagaaatcattttaattttctctttaaattccagttattctatgtattaattatttagcacataatacaaacaaatattgctaataatggtgacaaaaaaactcatcaggcttaattcacttcacttctgagcttctgagggaaggcctttcatgtatgtctcttctttccctgtcagactaccacatagcaccagaaatgaacttgatcttcgaacagatatttttaacaaatcactcatttgctgaactgaaatttgacttcctagaaatcctaatcataggcagggcccttgaccaaaaaacaaaacaaaggaaaaaacaggtaccctcttcttccagccaaacaaagcctacgtctatgtttcctttcacttcttcactgctagctatgccaaatcacaccagcattcgattccaactcaaaatgccctacccataaaatcctcactttatctattttaccatagttacttactgtcttataagtataaatttattagtatgctgcttttttcatatttccatgccagttattccctgagtatttaatgactacatatgagatgtgctacatacactgtgctaggggaaaatactgcatgtttctgctttaaaagaaaatatattctgtaaaaaaaaaaaaagaaaaaaaagaaaagaaaaaaagggggggagtgtagtggaaactgagtataataaaatgccaagtgctttaacaaaataaaacaaacgtaaaatgtcctgaggggagagcttttccctaaagtatctgctaaagtcagagaagaaataatgggtaccttgctaagctagggcaagaatatttcctaaaatttcacaagtgtaaatttctttagttttaaatattcatacaagttctactggaagataaatatattagagtaattttaatatggtttaaactatgtaatgttaaataacttttccaaaaaaagatttcaagtaaaatgtatggtccatgaatagaaactatgttttatcctgtggtttcagacccctcctggcacaccaccatgtatcccaggcagtggagttggagaagttttgctgggagtggggagatctattacagtgcagaaaatatgtgactccccatcttccaattcgcaaacaaatgagcaacacacacatgcacaaggctacattatctagtatccagtaaaataaatcaaatggctaattacaatactacatttactatactgtcagtatctagaggccaggaattgtgctgtaatttgtgctctagtggcagacatgtaggaggtttgctgaatgaattactgaacacctagagttgactcctggataagcacactagggaaagctatggtctggttacataccacacactcacacacgcacgcagacacacagtgggtgagattcagtttggttaaaaatattcagtagctctgactgccctggcaatggtttacaacagccatttggtggcctatagagaaaaaaggtgcacttctcagtctaatttctgacaaaggaaacccagcttctactgagtgggttagatcgagggataaacgcatgacagaccactttcctgaaacttttatctttgaatatactgttgtttcctctctctgaatctggtttgcataactgactgtaacacctggttatgtatgttcactgccctatctcccaaaatttgctccctcaagggagtaaacagggtacacaatgctatatctacaatttctatataaactatgtaaaataaagtaggttaactaatatttctttaatattcaaatattggtatatagtttctacagatatatctatagattctacatggtctcaaagttaaagtttcgctcaacaaatcccaggcaaggacttaaattactttataatgacaaaatgtaggtaatggtgtggatacacatgtatcctaaaatggctacgcctataacaaggattccaaaattgccataaactagtcgtaagtatttttgctcattacaacggcataaaaagtcaaagattaggacttccattcatttttacatgctaattttattttttggattctgaggattttagctgattcattccatttgcagtaagacaaatgaggaggttcctggttagggctcaggttttagactctaataaatctgagttcaaatgtggatggtaacatttaacagctgtgtgatactgggcaattacttaatttctctaagcttcagtttcctaaagtataaaatggggttaaaaactatgtagaaattagaatgaagataaaaatcagataatctacaaaatgtgctttaaaaagtagtaagtcttgataattttaatactataatgcttgctgatccaagcaacatttaaaatataaatattgcaaaatattaacgagataaaaaggtgggaagaagcttcactctttaacaataagcaaagctttcaggagaatgaatgcaagcaattagtacacaataacgattcatcattcattcagttctgactaaattgtcctgaagtgacacatgaaaataaaccggcaggttttattcagtgactatggaaggtgattaagtgctatgctattgcacttaaaaaagagagaggaaaaaaaggagtaagtgacgaatgcaactgaagtatccttcatgcaacccttgacaagctgtgtttccctaggaaacaaagggtttacagctgcctatcttccacagcacttagtgacaatttgggacaatctcagcaaaaagaaatgagcagacaaagacgctagaagggctttgggatcccaaaagttaatgaaagaccaagtgtaagaagagaaataaagtaattccctccaagcctaaagtctctcccgctccaatgccccctgtaccctctcggaaaatggaaaatccctaaggagtctacatcattcctctgcccgttccccctactctcccccaacccttcacggattcccagtgaatacctggcctcgggcaagctccgttacctctgtgaaccagagaatcccagctgtaaaatgagatcttgatggtttcctgcggggttgccatgagaaagaatcaacatgtacgcaggtaaagcaggcaatacagttccagggagtcaaaaacgggagaaatcgtcccacgacctggggcttgggtctagatgaagagcacagcatcaggaggccaggcttctaatgcggcgcagtctacagcgctgtggactcggcaactcccatcacctgccgctgcacaaacaccctgcttgctgcccccatagaccgacccccgcctgacgcctcccagacccccccacctgacgcccctcaggccccccgcctgacgtcccagacacccccacgaccggatcccccagacccccaatctgacgccccacttcccctacttgactccccacacatcccccgcctgacgaccccccgacccccgcctgacgtcccagacaccacccatctgatcccccagacccccaatctgacgccccacaccccccacttgactctccacacaccccacacctgccaccccacgtaaaccccgcctgacacctcacagaccctaacctgacgccccacagacctcccccgcctcctgccgccacacacaccccaaaccccgccccgaacaccccccacctgccgccccacagattcccccctctgacgccccacagacccccaacgtgacgccctacagaccccaacctgacgtcccacagataccccgcctgacgccccacagaccttcccccggtctgttgccccacagacttctcgccgcctgctggaccacaccttccacttgactccccccacaccgtcaatctgccaccccccaccccccccaccccaaccccccccaacctcccaaccgcccccacctgccaccccacacccttcccacctgacgtcaagcctgaagctcagccgctaagccggaagctggcgccagaagatgccggttccgccagctgctcgccgcgcaggcgcaggggagacccggggccttgcagtcaccgggctcaagcacgccggcgcagccaggctcgcgatgggaggtgggggggccggcagccccgtggggctgcggaggcgggacctgcaggatcctggttagggtcttgagtacacacggctcctattggcctcggcagcagatgctctctgcaagcagttgatccacacgccagtggattttgtctcgagggagacctaagatcactttgtgctctggctagtgatagcctctaattcttgttctctgtacgtaaaacagtggtaactatactgatttcgctggttgtgaaaactcccaagagagaacaggacatcctcccaactcaaaacgttggttgtttcatttaaacttttaaaaaataggcttttgcaaactatatagagctgtttttttttttaaatgatgtttgctactgtggtctcagttctcttaatacagaaataatacataacaatacataacttacaatatagaaataaaccgttgcatgaccagaaatcaactatggactcttctagtatctgtttaaggtttaaaaataaagttatttaacaaacctttattgagcacctattattatatagtaatggtgctagatattcagggtggagagattataaacaaccccagtttttgtgttccaggagctgttggtttccaccgaatttttgctgtggtcagtcctctttcgccatggagaagtgagaagttattcataaagaggggtggaaacaacttttagaactattttattttagcataaaatattgctttacaataaaataaattttgctgcagtgggccctgataaaacatattagagctgttaagtgcccttagaggttgtgtaatgtataaaaacctcctttttcaaaactgacacatttcattcagtgctagtttgtagcggaggttccgtctagcccaagaacattcagttatttacttcgtatgtctaattgacctaatatgcctgaatatctaaaatcatctgtgatgttgtaaagtctcatgatattgttttgtgagtatctgctcttcaatttagttatcaatttattttggaggaaaaatgaatagtgttaaggtagaggagcctccacttgcccatcttaggagagggtacctatccgtgtacatttgtagcttgttcaacctctactgagctcctacaatgtcagaagctggactttgtattagttacatgagaagaaccatgaattatgaaaccaggcaaactccaaattgattcaaagcccagtctccatttcatcatgttattttagttgattggttcaaagacaatcaagggtttttttcactaagtatcttctagagttgccatgattattaatttatttatgtaaatggtctactttatatatgcttggcacttattccgtgatcaagattaggaagctatgattcaagaacccagctttgacctggagctctccatctggtagcaagacacatatgttcaataacaacaacaccacaggccgggccagtggctaatgcctgtaatcccagcactttaagaggctgaggtgagcggatcacttgaggtcaggagtttgacaccagcctggccaacatggtgaacccccgtctctactaaaaaatacaaaaattaggccgggcctggtggctcacgcctgtaatcccagcactttgggaggccgaggtgggtggatcaccagaggtggggagtttgagagcagcctggccaacatggtgaaatcccgtctctactgaagaaaaatacaaaattagctgggcgtggtggcgcatgcctgtaatcccagctactccggaggctgaggcaggagaatcgcttgaacccgggaggcgggaggttgcggtgagccgagatcttgccattgcactccagcctgggaaacaagagcgaaactccgtctcaaaacagcaacaaaacaaaaacaaaaagtagcggggcgtggtggcgggcacctgtaatcccagctaggtcagaggctgaggcgagagaatcgcttgaaccagggaggcggaggttgcagtgagccgagatcacgccattgcactccagcctgggcgacaagagcgaggctccatctcaaaaggaaaaaaaaaaaaacccacagatttatgaaatatcctctgtatatataaaataggggacatagaataaggaaagcccaagggaggggaggcacacatctgtaaacaagtgtgtacacttcagtgcacaggggggttgacagcgaagctaatgaagcccaagttttaagggcccatttttgcgaacacttccaaggccttgagaggggccctaacgaggtgttcccatggtcgtgtacctcggtaaaatttgcaaaaataagacaattttacattatttttctttaaaagggctctccaaatggcacaaggttcaggcctcacaaaacctgcattcgcccttgacagtccactctcgtagaggtaaaaggagaaaaatagttatggaagcgctttaaatcgtggacctcattgcgacacccttaacaaccctatcaggcagaacaaattgctccgcaaacctgcggcttgcagagcgatggtggactcccgagctcatcgggtccggcacctcttcaccacggaggcctcgggtacggaactggagggagtcctggtgctcggaggagggtggaaggccaagatccctaggtcctggagcagggagccgggcccacgccgccgaggtatcttttccgtccgggccaccgtcgcgggggctcactggc

SEQ ID NO: 1847 - DNA, 7339 bp, Homo sapiens
  source 1..7339: mol_type = genomic DNA
ttaatagtgcattaaatattttatttaaattaagaagtataacaaaatcacatacatttgttccacggtttgaataaaatttccaataactttcaaataatgcacacatagtatcgcatggatcaaattccgtacatttcaatatggtcatgagataggctgtattccaaaatttggtatataaatccatacataatatatactatatacattgactttaaataatctaactatgtcatttttaaaagtcaaagcaacttatttctaatgaaagttacaatatgcatgccatattgacacctattcaatagataaaatctaggaaaatcttttttgtgaatactatttatactggaatgcaaattcacataaaaatacttcctttaaagcatgttctatttcacacaagaaattaaatgtgagctacttttaaaattgcaagctttatttttaatcaaaccaattcaattttaagtttttagatcattaagtctcatacaacttcctctaatttagctaaaaccatcgacagggttttattgttacatttggccttaaccttaaaaaacaaatttgtttacatttcatatttaaatgggacattttaaaccctgagtaaaaagacatatttttacaagtccagctgtaacaattctaccctattttcttgcagtgcttttattagataaaaactattgttaacgttttgactttttagaatatactgtttagaaggttaatgctttttcatgactttaaaagtttctaaatgtattttattagtatctaagtaaaaattctagatttctatatggatattataaaaacacctcttctttagactgtttatttcaccttgatcataaaaaatcattgaatactacattcaagataatttttctttcttggctttgggctattgtcttttcaaccttaaaagttaaaattattgttttcctatatgtaatgatactttttaggcatagatttttaagatacaaaaataaaatgtagtttagtattttatcattaccacctgctgcaatgagtctgccagatcagaggctttcctcactaggaaacctagctttaaatcaaatactggttttcttcttgtaattcacacttgtctattgaatcagttacccaactttcttttaggattttaaactttctcttaaaagttcttctaaaagctttaaaatctgcaacacgactatgatcttccccaattattacatgagacactccctcagctaaacaagaaactacttttgctccatgaaaccgaagctccaaggctttaatagctaaccttgtcccctcatttttggtactcaggtcattaataacagcatacgagtccaaataaacggtgtggcgtcgaaacatactgagaggagagcaatcccaggaataccgatattctaaatcagcaatcagagaagccatttcttcaggagtctgctcgttagaatttttaattcctgagaatacttccttcagttggttcaagtctgtatcaatgaaataactatcaccatagcaatcatattcacgggcaaaatgttctttggttgatgggcacatatgaatcataaagcgaggctgccatggtacaaagcttttggtcttaaaacattctaaaagccatgcaggcttgacaacatcatgtttatttgacaaaattatgtttttcactctgatgttctcagaccctgcaattacacagtacgtgtctgggcctggattttgtactatataaccaccaaattctgcaattctgttctccaggtcaggctttggctggctatctgttccactcataacacaaaactctacatcttcaaatatattagaaattttgttaacgttagtaaggttaggtgcttttaagtgctcaataattccaataactttcttcatctttggggcagctttccgctttttttcttgtggttcatcatcaccacctatataaaggtgtttagatgcgagcttaccagatgccttccccctaagttgttctaggtcgtccagggtcatgcactcatgccactccttgtcatctcttatcttttcaattcgtggaaaacgcaaggtgcagccagttttatacatatcactgggtacgatctctgctgctttaatctgaacaatgacagaattacaaggttcaatgtatacttctggcttctctgttccacataaaatgctgcttggtggagcttttctatgaaaaggcttccaatacttggccaatttcaaacccagatcatacagttctttcatggtgcagccagacccaacacgagagagagtatgaaacacagatggcttctcaccaggagggggcttctctgctactgcacacagaaaatgagacatcattccaccccgtgatcctttaccccaatatcctccaacaattaaaatgtccaattcatccattagtccactgacatactctggtttaatttttaaccacccttcacctcttttgtctggcttgtagatggatagaggttgttttaccataattccctcttctcttttatctattgcttcattcaatgcatcaattacttcattcttagtatgagcttgtgttttctgcactatttctattctacctggaattggtgtaaaaatactactaagaatctcatacctctttctcagagtctcatgccctagctttttattattaaccatcaatacatcaaaaacacaataacaagtttgcagatcagaatcctctaccattcttttaatatcaaacttagttcccttttgcatgaaagtttgtgtattaggattataggccatcatctcaccatcaagaatacagatttgtatatctgctttgaatgcattatgaatgaatggggtaagagaaccttcagtaggagaagcaccaaactgatcagtgtagttatatccatttcgagagaagtatttatatacatctccatctttgtgcatttgcatacgttcaccatctagcttggtttctatgtagaaactctgatgtttcatatccttctcaatgtgctcaatatctgcaatagcagctagcattggtttaaatgcagaaaataaagtgatagaaatatcactgagtcctacagaaggatcatgcagttgcctacagactttttccagatctgtagtgacattatgcaactcagcagcatcattatgaaaaacagaaaagatagtttgctgactaacaccaagctttaaatcctttatgatcatccgtataagccacttttgctcaagtgctgaactctgagttataagttgaagaaggctcttttttattaggtcttttcttttagcagaattattgctggcaattgagtctaaaaggtcgtttacttgctgtatggttaaacttcctttctgtaaacatcttggcttcaacacaaaatatgcaatcattgcaaagtctccagcatctccatgagttccagtgggtgttctgtagtttaaaagtttgagggcatcttttccatctctaggtaaattaagcaactcaatataaagcttagcaagcatagtttctttaattccataggccattctctctctttctagctgaggaagaattagtctcattgctggataaaaagagtctgtgacatctttgtggttcttatgaagagcatcatgaaattttctccaagaatctaaaaattccctgaagtgtctgattttttctgcacgtcctttacttttctgtattcgttctaaagttgaacacaaatctgcaaaaggaacgtgagatgcaacagtttgtgaagtttgtgaggcagccatcaaagcggtgatgaatcttctcgtttaactagtaaagcaaaaagagaataactttaagtaaaagataagattcaactaaatatttaatgtaaagatcttacaaagatcactgagatcataataaatgtttattaatgtttactaaaaaaaagatcaatgctctaaatgatgtatcttttcaacctctacatttaataactgttttgctccaaccctaatttgaagttattatgaaaagtatcatcagctatatagctgtatttcctgtatttataatacagaaatcattttaattttctctttaaattccagttattctatgtattaattatttagcacataatacaaacaaatattgctaataatggtgacaaaaaaactcatcaggcttaattcacttcacttctgagcttctgagggaaggcctttcatgtatgtctcttctttccctgtcagactaccacatagcaccagaaatgaacttgatcttcgaacagatatttttaacaaatcactcatttgctgaactgaaatttgacttcctagaaatcctaatcataggcagggcccttgaccaaaaaacaaaacaaaggaaaaaacaggtaccctcttcttccagccaaacaaagcctacgtctatgtttcctttcacttcttcactgctagctatgccaaatcacaccagcattcgattccaactcaaaatgccctacccataaaatcctcactttatctattttaccatagttacttactgtcttataagtataaatttattagtatgctgcttttttcatatttccatgccagttattccctgagtatttaatgactacatatgagatgtgctacatacactgtgctaggggaaaatactgcatgtttctgctttaaaagaaaatatattctgtaaaaaaaaaaaaagaaaaaaaagaaaagaaaaaaagggggggagtgtagtggaaactgagtataataaaatgccaagtgctttaacaaaataaaacaaacgtaaaatgtcctgaggggagagcttttccctaaagtatctgctaaagtcagagaagaaataatgggtaccttgctaagctagggcaagaatatttcctaaaatttcacaagtgtaaatttctttagttttaaatattcatacaagttctactggaagataaatatattagagtaattttaatatggtttaaactatgtaatgttaaataacttttccaaaaaaagatttcaagtaaaatgtatggtccatgaatagaaactatgttttatcctgtggtttcagacccctcctggcacaccaccatgtatcccaggcagtggagttggagaagttttgctgggagtggggagatctattacagtgcagaaaatatgtgactccccatcttccaattcgcaaacaaatgagcaacacacacatgcacaaggctacattatctagtatccagtaaaataaatcaaatggctaattacaatactacatttactatactgtcagtatctagaggccaggaattgtgctgtaatttgtgctctagtggcagacatgtaggaggtttgctgaatgaattactgaacacctagagttgactcctggataagcacactagggaaagctatggtctggttacataccacacactcacacacgcacgcagacacacagtgggtgagattcagtttggttaaaaatattcagtagctctgactgccctggcaatggtttacaacagccatttggtggcctatagagaaaaaaggtgcacttctcagtctaatttctgacaaaggaaacccagcttctactgagtgggttagatcgagggataaacgcatgacagaccactttcctgaaacttttatctttgaatatactgttgtttcctctctctgaatctggtttgcataactgactgtaacacctggttatgtatgttcactgccctatctcccaaaatttgctccctcaagggagtaaacagggtacacaatgctatatctacaatttctatataaactatgtaaaataaagtaggttaactaatatttctttaatattcaaatattggtatatagtttctacagatatatctatagattctacatggtctcaaagttaaagtttcgctcaacaaatcccaggcaaggacttaaattactttataatgacaaaatgtaggtaatggtgtggatacacatgtatcctaaaatggctacgcctataacaaggattccaaaattgccataaactagtcgtaagtatttttgctcattacaacggcataaaaagtcaaagattaggacttccattcatttttacatgctaattttattttttggattctgaggattttagctgattcattccatttgcagtaagacaaatgaggaggttcctggttagggctcaggttttagactctaataaatctgagttcaaatgtggatggtaacatttaacagctgtgtgatactgggcaattacttaatttctctaagcttcagtttcctaaagtataaaatggggttaaaaactatgtagaaattagaatgaagataaaaatcagataatctacaaaatgtgctttaaaaagtagtaagtcttgataattttaatactataatgcttgctgatccaagcaacatttaaaatataaatattgcaaaatattaacgagataaaaaggtgggaagaagcttcactctttaacaataagcaaagctttcaggagaatgaatgcaagcaattagtacacaataacgattcatcattcattcagttctgactaaattgtcctgaagtgacacatgaaaataaaccggcaggttttattcagtgactatggaaggtgattaagtgctatgctattgcacttaaaaaagagagaggaaaaaaaggagtaagtgacgaatgcaactgaagtatccttcatgcaacccttgacaagctgtgtttccctaggaaacaaagggtttacagctgcctatcttccacagcacttagtgacaatttgggacaatctcagcaaaaagaaatgagcagacaaagacgctagaagggctttgggatcccaaaagttaatgaaagaccaagtgtaagaagagaaataaagtaattccctccaagcctaaagtctctcccgctccaatgccccctgtaccctctcggaaaatggaaaatccctaaggagtctacatcattcctctgcccgttccccctactctcccccaacccttcacggattcccagtgaatacctggcctcgggcaagctccgttacctctgtgaaccagagaatcccagctgtaaaatgagatcttgatggtttcctgcggggttgccatgagaaagaatcaacatgtacgcaggtaaagcaggcaatacagttccagggagtcaaaaacgggagaaatcgtcccacgacctggggcttgggtctagatgaagagcacagcatcaggaggccaggcttctaatgcggcgcagtctacagcgctgtgg

SEQ ID NO: 1848 - DNA, 8091 bp, Homo sapiens
  source 1..8091: mol_type = genomic DNA
ttaatagtgcattaaatattttatttaaattaagaagtataacaaaatcacatacatttgttccacggtttgaataaaatttccaataactttcaaataatgcacacatagtatcgcatggatcaaattccgtacatttcaatatggtcatgagataggctgtattccaaaatttggtatataaatccatacataatatatactatatacattgactttaaataatctaactatgtcatttttaaaagtcaaagcaacttatttctaatgaaagttacaatatgcatgccatattgacacctattcaatagataaaatctaggaaaatcttttttgtgaatactatttatactggaatgcaaattcacataaaaatacttcctttaaagcatgttctatttcacacaagaaattaaatgtgagctacttttaaaattgcaagctttatttttaatcaaaccaattcaattttaagtttttagatcattaagtctcatacaacttcctctaatttagctaaaaccatcgacagggttttattgttacatttggccttaaccttaaaaaacaaatttgtttacatttcatatttaaatgggacattttaaaccctgagtaaaaagacatatttttacaagtccagctgtaacaattctaccctattttcttgcagtgcttttattagataaaaactattgttaacgttttgactttttagaatatactgtttagaaggttaatgctttttcatgactttaaaagtttctaaatgtattttattagtatctaagtaaaaattctagatttctatatggatattataaaaacacctcttctttagactgtttatttcaccttgatcataaaaaatcattgaatactacattcaagataatttttctttcttggctttgggctattgtcttttcaaccttaaaagttaaaattattgttttcctatatgtaatgatactttttaggcatagatttttaagatacaaaaataaaatgtagtttagtattttatcattaccacctgctgcaatgagtctgccagatcagaggctttcctcactaggaaacctagctttaaatcaaatactggttttcttcttgtaattcacacttgtctattgaatcagttacccaactttcttttaggattttaaactttctcttaaaagttcttctaaaagctttaaaatctgcaacacgactatgatcttccccaattattacatgagacactccctcagctaaacaagaaactacttttgctccatgaaaccgaagctccaaggctttaatagctaaccttgtcccctcatttttggtactcaggtcattaataacagcatacgagtccaaataaacggtgtggcgtcgaaacatactgagaggagagcaatcccaggaataccgatattctaaatcagcaatcagagaagccatttcttcaggagtctgctcgttagaatttttaattcctgagaatacttccttcagttggttcaagtctgtatcaatgaaataactatcaccatagcaatcatattcacgggcaaaatgttctttggttgatgggcacatatgaatcataaagcgaggctgccatggtacaaagcttttggtcttaaaacattctaaaagccatgcaggcttgacaacatcatgtttatttgacaaaattatgtttttcactctgatgttctcagaccctgcaattacacagtacgtgtctgggcctggattttgtactatataaccaccaaattctgcaattctgttctccaggtcaggctttggctggctatctgttccactcataacacaaaactctacatcttcaaatatattagaaattttgttaacgttagtaaggttaggtgcttttaagtgctcaataattccaataactttcttcatctttggggcagctttccgctttttttcttgtggttcatcatcaccacctatataaaggtgtttagatgcgagcttaccagatgccttccccctaagttgttctaggtcgtccagggtcatgcactcatgccactccttgtcatctcttatcttttcaattcgtggaaaacgcaaggtgcagccagttttatacatatcactgggtacgatctctgctgctttaatctgaacaatgacagaattacaaggttcaatgtatacttctggcttctctgttccacataaaatgctgcttggtggagcttttctatgaaaaggcttccaatacttggccaatttcaaacccagatcatacagttctttcatggtgcagccagacccaacacgagagagagtatgaaacacagatggcttctcaccaggagggggcttctctgctactgcacacagaaaatgagacatcattccaccccgtgatcctttaccccaatatcctccaacaattaaaatgtccaattcatccattagtccactgacatactctggtttaatttttaaccacccttcacctcttttgtctggcttgtagatggatagaggttgttttaccataattccctcttctcttttatctattgcttcattcaatgcatcaattacttcattcttagtatgagcttgtgttttctgcactatttctattctacctggaattggtgtaaaaatactactaagaatctcatacctctttctcagagtctcatgccctagctttttattattaaccatcaatacatcaaaaacacaataacaagtttgcagatcagaatcctctaccattcttttaatatcaaacttagttcccttttgcatgaaagtttgtgtattaggattataggccatcatctcaccatcaagaatacagatttgtatatctgctttgaatgcattatgaatgaatggggtaagagaaccttcagtaggagaagcaccaaactgatcagtgtagttatatccatttcgagagaagtatttatatacatctccatctttgtgcatttgcatacgttcaccatctagcttggtttctatgtagaaactctgatgtttcatatccttctcaatgtgctcaatatctgcaatagcagctagcattggtttaaatgcagaaaataaagtgatagaaatatcactgagtcctacagaaggatcatgcagttgcctacagactttttccagatctgtagtgacattatgcaactcagcagcatcattatgaaaaacagaaaagatagtttgctgactaacaccaagctttaaatcctttatgatcatccgtataagccacttttgctcaagtgctgaactctgagttataagttgaagaaggctcttttttattaggtcttttcttttagcagaattattgctggcaattgagtctaaaaggtcgtttacttgctgtatggttaaacttcctttctgtaaacatcttggcttcaacacaaaatatgcaatcattgcaaagtctccagcatctccatgagttccagtgggtgttctgtagtttaaaagtttgagggcatcttttccatctctaggtaaattaagcaactcaatataaagcttagcaagcatagtttctttaattccataggccattctctctctttctagctgaggaagaattagtctcattgctggataaaaagagtctgtgacatctttgtggttcttatgaagagcatcatgaaattttctccaagaatctaaaaattccctgaagtgtctgattttttctgcacgtcctttacttttctgtattcgttctaaagttgaacacaaatctgcaaaaggaacgtgagatgcaacagtttgtgaagtttgtgaggcagccatcaaagcggtgatgaatcttctcgtttaactagtaaagcaaaaagagaataactttaagtaaaagataagattcaactaaatatttaatgtaaagatcttacaaagatcactgagatcataataaatgtttattaatgtttactaaaaaaaagatcaatgctctaaatgatgtatcttttcaacctctacatttaataactgttttgctccaaccctaatttgaagttattatgaaaagtatcatcagctatatagctgtatttcctgtatttataatacagaaatcattttaattttctctttaaattccagttattctatgtattaattatttagcacataatacaaacaaatattgctaataatggtgacaaaaaaactcatcaggcttaattcacttcacttctgagcttctgagggaaggcctttcatgtatgtctcttctttccctgtcagactaccacatagcaccagaaatgaacttgatcttcgaacagatatttttaacaaatcactcatttgctgaactgaaatttgacttcctagaaatcctaatcataggcagggcccttgaccaaaaaacaaaacaaaggaaaaaacaggtaccctcttcttccagccaaacaaagcctacgtctatgtttcctttcacttcttcactgctagctatgccaaatcacaccagcattcgattccaactcaaaatgccctacccataaaatcctcactttatctattttaccatagttacttactgtcttataagtataaatttattagtatgctgcttttttcatatttccatgccagttattccctgagtatttaatgactacatatgagatgtgctacatacactgtgctaggggaaaatactgcatgtttctgctttaaaagaaaatatattctgtaaaaaaaaaaaaagaaaaaaaagaaaagaaaaaaagggggggagtgtagtggaaactgagtataataaaatgccaagtgctttaacaaaataaaacaaacgtaaaatgtcctgaggggagagcttttccctaaagtatctgctaaagtcagagaagaaataatgggtaccttgctaagctagggcaagaatatttcctaaaatttcacaagtgtaaatttctttagttttaaatattcatacaagttctactggaagataaatatattagagtaattttaatatggtttaaactatgtaatgttaaataacttttccaaaaaaagatttcaagtaaaatgtatggtccatgaatagaaactatgttttatcctgtggtttcagacccctcctggcacaccaccatgtatcccaggcagtggagttggagaagttttgctgggagtggggagatctattacagtgcagaaaatatgtgactccccatcttccaattcgcaaacaaatgagcaacacacacatgcacaaggctacattatctagtatccagtaaaataaatcaaatggctaattacaatactacatttactatactgtcagtatctagaggccaggaattgtgctgtaatttgtgctctagtggcagacatgtaggaggtttgctgaatgaattactgaacacctagagttgactcctggataagcacactagggaaagctatggtctggttacataccacacactcacacacgcacgcagacacacagtgggtgagattcagtttggttaaaaatattcagtagctctgactgccctggcaatggtttacaacagccatttggtggcctatagagaaaaaaggtgcacttctcagtctaatttctgacaaaggaaacccagcttctactgagtgggttagatcgagggataaacgcatgacagaccactttcctgaaacttttatctttgaatatactgttgtttcctctctctgaatctggtttgcataactgactgtaacacctggttatgtatgttcactgccctatctcccaaaatttgctccctcaagggagtaaacagggtacacaatgctatatctacaatttctatataaactatgtaaaataaagtaggttaactaatatttctttaatattcaaatattggtatatagtttctacagatatatctatagattctacatggtctcaaagttaaagtttcgctcaacaaatcccaggcaaggacttaaattactttataatgacaaaatgtaggtaatggtgtggatacacatgtatcctaaaatggctacgcctataacaaggattccaaaattgccataaactagtcgtaagtatttttgctcattacaacggcataaaaagtcaaagattaggacttccattcatttttacatgctaattttattttttggattctgaggattttagctgattcattccatttgcagtaagacaaatgaggaggttcctggttagggctcaggttttagactctaataaatctgagttcaaatgtggatggtaacatttaacagctgtgtgatactgggcaattacttaatttctctaagcttcagtttcctaaagtataaaatggggttaaaaactatgtagaaattagaatgaagataaaaatcagataatctacaaaatgtgctttaaaaagtagtaagtcttgataattttaatactataatgcttgctgatccaagcaacatttaaaatataaatattgcaaaatattaacgagataaaaaggtgggaagaagcttcactctttaacaataagcaaagctttcaggagaatgaatgcaagcaattagtacacaataacgattcatcattcattcagttctgactaaattgtcctgaagtgacacatgaaaataaaccggcaggttttattcagtgactatggaaggtgattaagtgctatgctattgcacttaaaaaagagagaggaaaaaaaggagtaagtgacgaatgcaactgaagtatccttcatgcaacccttgacaagctgtgtttccctaggaaacaaagggtttacagctgcctatcttccacagcacttagtgacaatttgggacaatctcagcaaaaagaaatgagcagacaaagacgctagaagggctttgggatcccaaaagttaatgaaagaccaagtgtaagaagagaaataaagtaattccctccaagcctaaagtctctcccgctccaatgccccctgtaccctctcggaaaatggaaaatccctaaggagtctacatcattcctctgcccgttccccctactctcccccaacccttcacggattcccagtgaatacctggcctcgggcaagctccgttacctctgtgaaccagagaatcccagctgtaaaatgagatcttgatggtttcctgcggggttgccatgagaaagaatcaacatgtacgcaggtaaagcaggcaatacagttccagggagtcaaaaacgggagaaatcgtcccacgacctggggcttgggtctagatgaagagcacagcatcaggaggccaggcttctaatgcggcgcagtctacagcgctgtggactcggcaactcccatcacctgccgctgcacaaacaccctgcttgctgcccccatagaccgacccccgcctgacgcctcccagacccccccacctgacgcccctcaggccccccgcctgacgtcccagacacccccacgaccggatcccccagacccccaatctgacgccccacttcccctacttgactccccacacatcccccgcctgacgaccccccgacccccgcctgacgtcccagacaccacccatctgatcccccagacccccaatctgacgccccacaccccccacttgactctccacacaccccacacctgccaccccacgtaaaccccgcctgacacctcacagaccctaacctgacgccccacagacctcccccgcctcctgccgccacacacaccccaaaccccgccccgaacaccccccacctgccgccccacagattcccccctctgacgccccacagacccccaacgtgacgccctacagaccccaacctgacgtcccacagataccccgcctgacgccccacagaccttcccccggtctgttgccccacagacttctcgccgcctgctggaccacaccttccacttgactccccccacaccgtcaatctgccaccccccaccccccccaccccaaccccccccaacctcccaaccgcccccacctgccaccccacacccttcccacctgacgtcaagcctgaagctcagccgctaagccggaagctggcgccagaag

SEQ ID NO: 1849 - DNA, 750609 bp, Homo sapiens
  source 1..750609: mol_type = genomic DNA
ttcacaacatacaaagaatttatttatgcaatacaggccttttctcaaatatttttcacagaattccacacagtaatctactagaaaagtagaattatacaccaccaaataacattgtttcgtttcttagtacaaattgctaatcaaaaggaaggtggagatgatagtttaataacaaatagtaaaacaggtgttgctgaatacagcacccggtagcctctatttgcaaacccggggagggaagggggtgccccaacaaaacaacagtggctccgcctcattgtccaggcacaggcaaaccgcagtagtgagctttggtacttgcatttactttaaaagaaaaacaaatgttgtgagctcaagagcatttccatcatttcgttttgttgtgctatgaagatgacagatcaggaaaaaatggtaactatttcacacttgctataaattagattccttgtgctaaccacacaataaaatagcctcccccaaaccatacttttctaggtctaaaacatgcttgaagaacaatattgatagacagacttaattgagatgttttaaattacatttaccataatttaaacattactatttaaatcccagaaatattagtgctgaagaagcacagttgtttggaaaaatacaggacccaaattacagcatcaaattttcctattccaatattgtaacccacttccccactgtgaaaatcctatttctcaagcttgtagatgcatgggaaatgttcttcataatattatagctggaataagtggtttacttgctccactgtatgtttccataattggtgaaaatagacttctcattatgactaaaaatatagattttttaaaactacagaacccagcagccagttttctgctttgctaatcccccccaaaaaagtcaagcaaagactacaaaaatagcaattattaataactttaaaaaatattttgcttctttgagcaaatttaagttacattcagatgtggtagaagagaatgatgctccaggtacttctgctcatcctaggggcagagttgatgtacagctgtcaccatcagtagcgggtttggtattcatgatgccaccggttaaagtcgttgtaaaatagcacaatgcttcctgaagccatgccagaaatgatgcacctaggagaagcacagagagaaggacttttacaaacctgtgtgtcctagagatgttactaaaaactgctctccccaaatccacaaggtaaatatagaagctggcagtgaaggctccaatttgtgggaactaaggtatgtatttcatgactaaaatgtatccctgagtaagctcagagtactgcctctgacactccacaaggatccaagccacagcttgctttttcattgaaagggtacggacagctggtatgtgcaggatgagtaactaaaatctgaacagatttgtaactaaaatctgaacagatttggtaatttctaaagggggactgggctggcaagacccatccattatataagcaacagactcaaaagaaggaaccacaatctcaaagtaactgctggtggaaagaagcagcacacactcaagtgacaagagacaccacctctgacaggtacagaatcaatgaagagtgaaaaagaagagtgttgttgaccataatttaagctggtctcccctctgtggagaagtagtctatgtccatcatgctctgggtgaggacctagtcctcgtaacacagtaactcaccgaaatcactgaagataagaacttctgcaagcttcttggtctcctgtccccaaagaggtggtgcagggaaagagatggagaacataggtgaacctaaactgagcatagccagatttttctctgtgtagtttggttaggaccagcccttagaagccatattcagtatccttcctagtacctcgtatcaaaattaattaggaactaaaatgtgtcactacaaaaaaaatcaactaaaaacaaaggaagacagtaaggaggaaatgagagacaaaactctaaggcagagagaaaattaaatagaaaagtggcaaaagtcagtctttccttatcagtcattaaagagattaaattctccagccaaaaggaagagattggcagaatggataaaaaacatgatccaactatatgctgtctacaggagacccacttgagatctaaagacaaacatcttgaaagtgaaaggatggaaaagatattccgtgtaagtactagcaaagagagctgaggtggcttacactaatatcagacaaaatagtctttcagtcaaaaactgttacaagagacaaaggacactacactgagaaaagggtaaattcacagaaatataacaattatatatgcatttatcatcagacccccaagatacaaagagcaaatattaacagaattgaagggagaaatggttctacagtaatagttttagacgtcaataccccactttcaataatgggtggaacaaccaggtggaagataaggaaacaggacacttgaacaatacgataagccaactggacctgacacacgtatatagaacaccttcccaacaacaatagaatatacatttttttgcagtgcgcatggaatagtctccaagataaaccatatgttaggccacaagtgttaatgacttagtaaagattaaaatcacaaagtagcttttctgatcataatagaatgaaactaggtaccaataactgaaggtaaactagaaaattcacaaatatgtggaaagtaaataaatgatgagtcaaaaaaaacaaacaacaacataagagacatcagaaaatactgagacaaatgaaaaggaaatacaacaagccaaaacttatgaaatgcagcaaaagcaatgctaaaatggaaatttttagctgtaaacacatagatttaaaaatatctcaaatcaataacctaactttacctcttaaggaactagaaaacagacaaaaccccaggctaggcagaaggaagaaaataataaagaacagagtagagagaaataaagcagaaaatagtaaaatgattgataggaaaaaacccaaaaattggttctttgaaaaaataacaaaattgacaaacctctagctagactaagatgacttggctgggcatggtggatcatgcctgtaatcccagcactttgggaggccaaggtgggtggatcacctggggtcaggagttcgagaccagcctggccaacccggggaaacctcgtctctactaaaaatacaaaaattaactgggcgtggtagtgggcacctgtaatcccagctacttggaaggctgaggcaggagaatcacttgaacctgggaagcagaggttgcagtgagctgagattgcaccattgcactccagcctgggtgatagagtgagactccatctcaaaaaaaaaaaaaaaatgactcaaattactaaaatcagaaataaaagttgggacattactgatttggcagaaactgagttcagagagactattagaaacaactgtataccaacaaatagggcaacctagatgaaatagacaaattcctgaaaacagtataccaaaactgaatgaagaaatagaaatgattagacttatgacaagtgaagagattgaatcagtaatcaaaaacctcccaataagaaaagtcctagacaagatggcttcactgatgaattctaccaaacatttaaagaagtattaacaccaatccttctcaatttcttcttccaaaaaattaaagaatccagaacacttcctaagtgattcaataaggccagtattaccatgacaccaaagccagttgaagacattacaacaaaagaacacacagaccaggatacaaaatactagcaaactgaattcactagcatggtagtgggaatgtacaccatgacccagtgggattcattctgggaatgcaaggatgactcaccatgcaaaagtcaaccaacatataacatactacattaacagaacaaacaacaaaacaagcccacatgatcatctcaactgatgctggaaaatttgacatgtgacaaaattcatcatccttttattatgaaaacaataggagtagaaggaaactacctcaaatgataaacagcatgtatgaataactcacagctaacaccacactcgatgaaaaaaagtttttcccctatgattgggaacaaggcaaggatgcccactttaatcactcttatccaacagtactgaaagtcctagacagagcaattacacaagaaaaaagtatccaaattggaaaggaggagtgaaactgtctctgtttacagatgacatgatcttgtatgtaggaaatcctaaaaattccacaccaaaacaaaacaaaagagctaataaatgaattcagcaaatttgcaggatatacaacacgaaaatcagttgcatttttatacactaacaaacaatgagcagtccaaaaggaaaattaagaattgcagtgagccgagatcatgccattgcactccagcctgggtgacagagcgaaacagaaacccctaacagccaaaacaatcttgaaaaagaagaaatatgttagcagttgcacattttctgatttgaaaacttacttactgttgttacaatgcgacagtaatcaaaacattgtcacactgatataggcagaccaacagaagagaaagttgagaaataatccctcacatatgtgctcaaatagggtgccaagacctttcaacggagaaagcaccttcttttcaacaaattatgctgggaaaataggatgtccacatgcaaaacaatgaaggtggactcttacctaccattatattaaaaaactaaaaacagatcaaaaacctaaatacaaattaaaactataaaacttttagatgaaaacatatgggaaaaccttcatgaccttggattttgcagtggcttcttggatatgatatcaaaacaaaagagacaagataacaaaacaaactcataacaaaaaataggacttcataaaatgtaaaatcagggctaggtatagtggcttatggctataatcccatccctttgggtggctgagtcagcaggattgtttgtttgagcccaggagtttaagaccagcctgggcaacatagtgagaccctgtctctacagaaaataaaaaagctgggcatggtggcacatgcctggagtaccagctaccatgtagctgaggcgggagaatcatttgagcccaggaggttgaggcttcagtgagctgtgattgtgccactgcactccagtctgggcaaaagagtgagaccctgtctcaaaaaacaaacaaaaagtaaaatcttttgagcatctaaggatattaggaagagagtgaaaagacaacatcactgatcattagggaaatcaaaaccacaatgagagaccacgcctgttaggacaactgttaaaaaatagagcaaggtgttgataaggatgtggagaaattggaacccatgtaaaatggtacagccactgtggaaaacactttagggtttcctcaaaaagtcaaacggaattgccatataacccagcaattccactcctgggcatacacccaaaaggactgtaaaaagggacttgaatagatatttgtatgataatgttcatagcagcattactcaccatagccaaaaggtagaaacaacccaagtgtccatcatcaacaggtgaacgataaacagaacacagaatattcatataatattctgatacgtgctacgacatgcaagaaccttgaaagtgttatgccaagtgaaataagccaggcacaacacaacaaatattgtatgattccacttaacagaaggtgcttagaagaggcaaattcatagagacagaaagtagcatgcacatgagctggtgggagagagagtcattaacatgcagagcttctgtttatgatgaaaagggtctggaaatggatgatggtgatggtggcacaacactgtaaatgtacataatgccactaaattatatatcgaaaagagtttagatggaaaatattatatgttgccacaattttttttaaaaggaacaaaaatgagtgactatacgttaagaggaaataaggtgccagataaagatgatccccccaaaatctaccacttgagagcttttaggaaataagccctatctttcaggggactctccatatgcagagatatgcagagataaaggcattttacattaaacatctttacagctctttcaattttatttactgataaagatgatgatacttcttcaggctggcaatcgccgaataggagcagatctggtctgcagctcccagtgagattgacgctgggtggatgatttctgcatttccaactgaggtacctggttcatctcgttgggactggttggacagtgggtgcagcccacggagggcaagccgaagcagggtggggtgttgcctcacccatggaagcacaaggggtcggggaattccctcccccagccaatggaggctgtgagggactgtgccatgaggaatggtgcactctggcccagatactgcgcttttcccacagtcttcacaacctgcagaccaggagattcccttgggtgcctacaccaccagggccctgggttttaagcacaaaacagggcggccgtttgggtagacactgagctagctgcaggagtttttttttttttttcataccccagtggtgcctggaatgccagcgagacagaaccgtttactcccctggaaaggaggctgaagccagggagccaagtggtctggctcggtgggtcccactcccatggagcccagcaagctaagatccactggcttgaaattcttgctgccagcacagcagtctgaagttgacctgggacactcaagcttggtggggggaggagcagccagggagccaagtggtctggctcggtgggtcccactcccatggagcccagcaagctaagatccactggcttgaaattcttgctgccagcacagcagtctgaagttgacctgggacactcaagcttggtggggggaggagcgtccgccattggtgaggcttgagtaggtggttttaccctcacggtgtaaacaaagcctctggggagttcgaattgggtggagctcactgcagctcagcaaggccactgtggccagactgcctctctagattcctcctctctgggcagggcatctctgaaaaaaaaggcagcagccccagttaggggcttatagataaaacccccatctccctgggacagagcacctgggggaaggggcagctgtgggtgcagcttcagcagacttaaatgtccctgtctgacagctctgaagacagcagtggatctcccaggacagcatttgagctctgctaatggtcaaactgcctcctcaagtgggtcctcaacccctgtgtctcctgactgggagacacctcatacaggagagctctggcggaggcccctctggaatgaagcttccagaggaaggaactggcagcaatgtttgctgttctgtagcctccactggtgatacccaggtaaacagggtctggaatggacctctagcaaactccagcagagctgcagctgagaggcctgtgagaaggaaaactaacaaacaggaatagcgtcaacatcaacaaaaaggatgtctagacacagaaaacccatccaaaggtcaccaacatcaaagactaaagaaagatagataaatccacaaaaatggggagaaaccagtgcaaaaagctgaaaattgcaaaaaccagaatgcctcttctccaaaggattacaactccttgccagaaaaatggaacaaagctgaacagtttgagaaattaacagaagtaggcttcagaaggtgggtaataaactcctccgagctaaaggatcacgttctaatccaatgcaaggaagctaagaaccttgaaaaaaagttagacgaattgctaactagaataaccagtttagagaagaacataaatgacctgatggagctgaaaaacacagcacgagaacttcatgaagcatacacaagtatcaatagccaaatcgatcaagcagaagaaaggatatcagagattgaagatcaacttaatgaaataaagagagaagattagagaaaaaagaatgaaaaggaacaaacaaagccttcaagaaatataggactatgtgaaaagaccaaatctacatttgatttgtatacctgaaggtgacagggagaatggaaccaagttggaaaacactctgcaggatattatccaggagaacgtccccaacctagcaagacagaccaacattcaaattcaggaaatacagagaacaccacaaagatacttctcaagaagagcaactccaggacacataatcatcagattatgtgaaggtagaaatgaaggaaaaattgttaagggcagccagaaagaaaggtcaggttacccacaaagcaaagcccatcagactaacagcggatctctcagcagaaaccctacaagccagaagagagtgggggccaatattcaacattctctaagaaaataattctcaacccagaatttcatatccagccaaactaagcttcataagcaaaggagaaataaaatcctttacagacaagcaagtgttgagacatttagtcaccaccaggcctgccttacaagagctcctgaaggaagcactagacatggaaaggaacaaccggtaccagccactatgaaaacataccaaattgtaaacaccatcgacgctatgaaggaaactgcatcaactaatgagcaaaataaccagctagcatcataatgacaggatcaaattcacacataacaatattaactttaaatgtaaatggactaaatgctccaattaaaagacacagactggcaaattggataaagagtcaagacccatcagtgtgctatattcaggagacccatctcacatgcaaagacacacataggctcaaaataaagggatggaggaagattttccaagcaaatggaaagaaaaaaaaaaagcagggttgcaatcctagtctctgataaagcagactttaaatcaacaaagatcaaaagagacaaagaaggccatgacataatggtaaagggatcaatgcaacaacaagacctatcctaaatatatatgcacccaatacaggagcacccagattcataaagcaagttcttagagacctacaaagagacttagactcccacacaataatagtgggagattttaacaccccactgtcaatattagatcaatgagacagaaaagcaacaacaaggatattcagaacttgaactcagctctggaccaagcagacctaacagacatctacagaaatctccaccccaaatcatcagaatattcattcttctcagcaccacactgcacttattctaaaattgaccacataattgaaagtaaaacactcctcagcaaatgcaaaagaatggaaatcataaccaatagtctctcagacgcagtgcaatcaaattagaactcaggattaagacactcactcaaaaccgcacaactacatagaaactgaacaatttgctcctgaatgactactgggcaaatactgaaatgaaggcagaaataaagatgttacttgaaaccaatgagaacaaagacacaacataccagaatctctgggacacatttaaaatagtgttttgaaggaaatttatagtacgtaatgcccacaagagaaagcaggaaagatttaaaatcaacaccctaacatcacaattaaaagaactacagaaggaagagcaaacacattcaaaagctagcagaagacactaagatcagaggagaactgaaggagacagagacacaaaaaacccttcagatcaatgaatccaggagctggtttttttgaaatgatcaacaaaatagaccactagccagattaatacacaagaaaagagagaagaatcaaatatacacaataaaaaatgataaaggggttatcaccactgatcacacagaaatacaaactaccatcagagaatactataaacacctctacgcaaataaactagaaaatctagaagaaatggatacattcttgggcacatacaccctccaaagtctaaaccaggaagaagtcaaatccctgaatagaccaataacaagttctgaaatcaatagcctaccaaccaaaaaaagtccaggaccagacagattcacagccaatttctaccagaggtacaaaaaggagctggtaccattccttctgaaactattccaatcaatagaaaaagagggaatcctaactcattttatgaggccagcatcatcctgataccaaaacctggcagagacacaagaaagaaagaaaatttcaggccaatatgcctaatgaacatcaatgcgaaaatcctcaataaaatactggcaaaccaaatccaggagcacatcaaaaagcttatccaccatgatcaagtgggcttcatccctaggatgcaaggctggttcaacatacacaaatcaataaaagtaatccatcacataaacagaatcaatgacaaaaaccacatgattatctcaatagatgcagaaaaggccttcaacaaaattcaccaccccttcatcctaaaaactctcaataaactaggtactgatggaatgtatctcaaaataataagagctatttatgacaaacccacagccaatatcatactgaatgggcaaaaactgaagcattccctttgaaaactggcacaagacaaggatataccctctctcaccactcctattcaacatagtattggaagttctggccagggcaatcaggcaagagaaagaaagaaagggtattcagataggaaaagaggaagtcaaattatccctgtttgcagatgacatgattgtatatttagaaaaccccagcatctcagcccaaaatctccttaagctgataggcaacttcagcaaagtctcaggatacaaaatcaatgtgcaaaaatcacaagcattcctatacaccaataacagacaaacagccaaatcatgagtgaactcccattcacaattgctacaaagacaattaaatacctaggaatctaacttacaagggatgtgaaggacctcttcaaggagaactacaaaccactgctcaaggaaataagagaggacacaaataagtggaaaaacattccatgctcatggataggaagaatcaatattgtgaaaatggtcatactgcccaaagtaatttatagagtcaattcaatgctatccccatcaagctaccattgactttcttcacagaattagaaaaaactactttaaatttcatatggaaccaaaaaagagcctgtatagccaagacaatcctaagcaaaaagaacaaagctggaggcaccatactacctgacttcaaactatactacaaggctacagtaaccaaaacagcatggtactggtaccaaaacagatatatagaccaatggaacagaacagaggcctcagaaataacaccatgcatctacaaccatctgatctttgacaaacctgacacaaacaagcaatggggaaaggattccctaattagtaaatggtgttgggaaaactggctagccatatgcagaaaactgaaactggaccccttccttacaccttatacaaaaattaactcaagatggatgaaagacttaaacgtaaggcctaaaaccataaaaaccctagaaggaaacctaggcaataccattcaggacataggcatgggcaaagacttcatgactaaaacaccaaaagcaatggcaacaaaagccaaaattgacaaatgggatctaattaaagagcttctgcacagcaaaagaaactatcatcagagtgaacaggtaggctacagaattggagaaaatttttgcaatctatccaactgacaaagggctaatatccagaatctacaaagaacttaaacaaatttacaagaaaaaaacaaccccatcaaaaagtgggcaaaagatatgaacagacacttctcaaaagaagacatttacgcagccaacaaacatatgaataaaagctctttatcactggtcattagagaaatgcaaatcaaaaccacaatgagacaccatctcacacccttcagaatggcaatcattaaaaagttaggaaacaacagatgctggagaggatgtggagaaacagaaatgcttttacatcgttggtgggagtgtaaattagttcaaccattgtagaagacagtgtggcaattcctcaaggatatagaaccagaaataccatttgacccacaatctcattactgggtatatacccaaaggattataaatcattctagtataaagacacatgcacatctatgtttattgcggcactattcacaatagcaaagacttggaaccaacccaaatgcccatcaatgatagactggataaagaaaatgtggcacatatacgccatggaatactatgcagccatacaaaagaatgagttcatgtcctttgcagggacatggatgaagctggaaactgtcattctcagcaaactaacacaggaacagaaaagcaaatacctcatcttctcactcataagtgggagttgaacaaagagaacatatggacacagaggaacatcacatacgggggcctgttgtgggggtgggggcctaggggagggatagcattaggagaaatacctaatgtagatgatgggttgatgggtgcagcagaccaccatggcacatgtatacctatgtaacaaactgcgttctgcacatgtaccccagaacttaaggtataatttaaaaaaagatacttcaaagaaatataaaaagctttgcatcactgtaatcagagcctttgctacttaaattctgtctattccttgagaactcagcctttgtccaagagtggcaatgtcatcagaaagaaaatcacactttttaaaaaagtgttcttggtttgattgtacaggtgacccccacaactcaactccatcagcccatttaaataaattccctctgcaggttttactatacaattttgaaaaaaaaattttttttttctgtagagacagggtcttgcaatgttgcccaggctggcttcgaactcctgggctcaagtgattctcctgcctcagcctcccaaagtactgggattacaggtgtaagccaacacgaccagtcccctctgcagtttttgaaacccctatttgtagcccatgattccagtgttacctctggtcgtaagacagcgccatggcccggattccagcgtcacatcctggataggcaaagagctgcttgaggtccgacacctgccggaccacgaccactcctctgtctcctcctgtgagcaggtactgcccatctcggctcagctggatggcctgtgagacacagcaacattcagtagaaatgtggttctaggaaactttcggcccccaccctgtttttgagtcattcttacaccagctactacggtgcagagagaagagagagagatcctcaggagtttttagaaaatcgtgagttgtagaagatctgccatttttcaaaaaccaaatggacaaagttcatcaatgcttgagattgttttggctttgcttttttaaatactaggtagcaaactcttccagttctacaaatgctactggaatggtgtgtgttgtggactgggaccagtgctctaatgagaagccctggcatctcttcatttgcactgcagacatgctaataagcctgttttgtcccaagacttggcagatggtgccacctgaccttacatcccctctaatcccctgcaactccagctggagggaggcggccagcagcctcggcaccttccctgagcctgctggattttgacagcagttgggaagaagactttgtagagagctacaacaacttccagggtgattaaatctcagttcagcattttcttgctccagggctgacagtgctccagcctgtggtttagtcagctctaggctgtgcccctctgtcctttcctactagcgctgaacagacagtacaggctcagaatttgctctttgatcctgtaaaatgggcatccatgaatgaaagcctgcgggccaagtgcagcccactgcctgtttcatataattgtttaacattttttaatgcttgaatttttcatgacacatgaatatttatatgaattccaaatttgaatccccataaacaggtttttttttttcccccctcgagacagggtcttgctctgtcacccaggctggagtgcagtggcgcagtctcagctcactacaatctccacctctcaggttcaagtgattctcatacctcaacctcctgagcagttgggattacaggtgcccaccacaacacccgtctaacttttgtatttttagtagagacggggtttcaccatgttggtcaggctggtcttgaactcctgacctcaagtgatccacccgctcggactcccaaagtgctgggattacaggcgagaaccactgcgcctggccttccataaataaggttttaccagaacatcgccacacctattatttgtttatgactgctttcacaggtagttgcagcagagaatgcagaaccctcaaagctgaaaatatttactttctgtccatttatagaaaaagtgtgattactcctaattgtccctccctcctccaaaagccaatcctattaccccttcctctcctcctgcctggtacctccaagccttgctttcttagcttattaagatacaaatttcctttctttagtggatggcatcagagttttaaagccactacaaacacctgtaatcgcatgtccacctggacacaggggaatacagattgtgctggcaagccagaaagaaaaaaacctaatttctgatacattgacactgttctacattcagttctagcatagctgccttaagtcttcactgtttgacatatcttttaaaaaatcatagaaaggcaaagactttcttagccatttatttcacattcacccaaatgccaacttttagtagtcccttaaatacagcttattctcaagaacacaaaaacacatctaggaaataaaaacccatgtgtggaagacagttagttacatattctctaagttttgttaacacagatattaagatattttcaagatgagcaaaaatcagtatccttttcccccactcatttcacaaatggcaatctctaggggtgtctgggaactgcagtggagactaggacaaacaattatttgctacacttataaaattcagctgatgaaaatccattaaccttatggttgtagttcatttgaatttgatacttgaagctttttactggataagtgttatactaaaacaaaaccactgatctttaattctttgttctagtaaagaatctctaatcctgcttccatctgaaattaagtaaaacctgggctttagggactatacagtcatcagcattcaaaacattttaatgaatcagatgcctcccaaggtgaaaaaagatttcgctggcctctttcaggagaggccaaattcctctggcggcaagagccagggtaacatttagcaagcagcacctgatctcccactcaaattctgacaggccgcctccgcatccaggttgggttgtgactagaggttttcagagggccccagacacatgttaatctcatcccctgaaatcctgagtgctctggacaatgccgtggctgcacgggttttaaggaggtagtagcaggccacagcaatctgctggggatgaccacattctaaaacagcctcaggaagggaaaacaaatgcattcccctgggtgaatggtggttctcccttgtttaggacaaaataactttgctgctctgtacaggctgcctccttaaatatcagctattcataaagacatctcaacactgtctagttgatggactgtgatatgctgctaaccaaaatgccacagagcaatctggcatctaaaataaaaataggtgggaagtgcagagcttccccaggctgcctgcctgcagggttcttggtatttcacagaaacttaatttctggtctgagctgatgactaatttgtttccatggtgtccattccttatatgggctcagattgaggaaggagctggagattctgccctgtggtgtcttggattcccagcctgtggcttccttcctcgcctcccgaggtagtgagctgtgaaagtatcagtctctggagctgtgggcaggtattgctcattttaggcaagctcgctttaatcacacagttgccacttgcaagttagcatgataaagtgcaggagtgctgggaaaaaggcaatggattgtttaagcctaaaatccagtgggaaatattaaagagggaaaaagcaatggctacagggcagagaggagaagcatgtgtgtatgaatggtctgcagaaagcctcccactgctgcctcaaggaacttcccagagcccctggtactaactgaaatgccacagaaattgcttcagtcagccagggatctcaaattattttacagatttattagcgtagctgacaatataatcgcaactcaaagtgacagattatccacattattattgtaaagaaaagaggaaaagaaaatcctctgatgtgtacttggtttaaatgcagcattatgggaaggtagggaaaaataaaagcgagtacgagtgtgtctctgtgcgtgcctcgtggaggccggcagaatgtgatggagagaccgcagagaacagtggagacaagaaggaagccgtccactgaatcaagaaatgaatcccaggagacagagcagcaagggtccttcatttcctcaatgtaacctatatgtaggagctttgttccctgagaccagtatttacttaggagaagggggtgatcagactagatctgggaaagtgggagaatttatgacatctaagctgcataggtcagaatagcaatgagtgaaatatccagagctagcccaacgccagggtagaagcccctgtgaccctactcctgcccccaacatgtcctgggtcccctcattgtatacagctcacatgccccgccctccagcctgattctggaaaatgaggaccaccccagctttattttactttaaccttcaccaaggagtttggaggtaagaaacaaaggaccttgagaaactagcctctgaaaagaatagttcttactctttttctcaatgtctaatacttgtggagtcctgtcctggagatgaagcaagagcccagaaggtccactggcggtgccatttcgggtagacccagtgggagaaaatgcctgcctaattcatatcataatttgaagcccagcttctttaacatgtttttggtcttgttgtccataaagaagtcatagctgaaattaataaacctaaatagtcataatccctactgctcccaccaccaagctattcagatgtaaagagaatccagttttaagtgtcatctaatgtactatttcagctttcatactcagaaaacaatgtgcagtgcattttcttagaaaaaaagaaatgagcagtgccactaaaagccacccaggatggcttcagaagcccctaagaaaacctcttctattgaaggaccgtcctcagctgcgctgagtgacgtggtcagcacagctggcactgctgtggtgtgtgaagtgtgtgagccttgtctgagtgctacctaaagattttttgttggtatggaaaagaggccctcggcaatccaaaaatagaggtttctttcgcgaaccctctccctccccacttgacacacgttgaggtaaaagtcgtgaatgctgaagagtccccagggcactcactcttatgttatcatctgtttccatcgtggcctggagttttccattcacactgaatgtacagaagaggccgttttcatagaatatgacacaatgaccctctcttgaagcctgaatgagttttggtttcaggcagttttcaggaccctccaaggtcctcaacaagtctccattcatggaatgtatgagacatggtccttctgagaagagaggagaaataaaaggcaaaattattgaatgaaaacagacaatatgatctgaatcttgagcacagatcaaacaggattatagaaccacactatagatgtagaaagcctttaaaaaacttccatcttacgtgtaagttattttgcaaaatctcctcttcatgtttgccagatctcaccttccactcaggagaggagagaagccaaaccatgtaagtccaagttcactttcctcaagagacaggaagttactctatgaaattcattatgctaacaggcaatacaaactggaggaactgagaaacaggataagcttcaaattctagcacagcttcaaggaggctgggatgcaaacaaacaagggctgcgggcaggtacactaagacctctccctgcaccttgcaggagccccaacggccacggcactgtgggcctatgcagggacagccagctcaatcagcctctgagtgccttagccctcttcccccgcaactgctcactactttttttacactgaaagggggtccctggtagttcctctcaacctccaaaaaattcacacaggaacccttcggccacttctccttggcaactgagtgaagccacctccctgctgccttcacagcaaggagcagcatctaccactcccaacgcctgggtggaccaccaggccaaggtgccagagaaggacaggcagctactgggagcccacacacagccaagctttttgtttctgttgagtacctgctgcatgcaaggcaaagaaggaataaggaacaaaaattgcttgtgtgatgagcaagttccaagagatagtcagataacgggggtcactggggtatgcgccctgctactctactggctaaattactcatggccacatggaatcgttgccttttccccacaatgactattgaaagcttgcccttttaaaaataaggcttttagctctttcttgaccactcaggtagttgataaattttttaaatatccacaggcagtgtttgctttacacagttccagcatgcatgaatttcagttatcactccttaaataacaccagccctccaataacatagttcaaatttaggttgtcatagtaattgcataaagtatgcacttttgtggctagctcttcagtccacaaatcactatataaataacagatgtgcatcatcatcatcagtgaccaatcacatcactcctttcaaaatatgtcgatgactgctcactgcattatctgttattcagttcccacacagacagcaaactgtgcagctgtgttgcttttttgtctcccagtgataaagccatgtaacatttcacaaaaatggataatcaaaaaggggtattggccaacaaagatgaaactgcagtaaagaaatggaaaatgataaaactgaaagtacaatttgaattgaatataaatggaattatagaagagcgagctgcctgtgggatgctgaccctgctgagacactgtagatatgcagccaggaagggaatgaaggaacttatcagtgtaagttagggaagaaggtgtaacaaaaatgtcccagaatttaaaccagcaaaagcctcacattaaaggaattctagggaatatttcatgacattgaaagcacaaaagataaaatgttagatgctggttccaacttagaaaagagtatgacagctccccaaggcatagaaaagatgctagctccttacatgtatataacaagaaggcagtaagcactgttcaaactactcttgatatgtttttcacaaataaaataattatcaatgtatcaaatgttttaaattacagtgtattaagtacatgtgagttttactacttttttcatgttatatgtataactgagtatgagtttttaatgttttgacaaaattattcttagagacagggttttgctgtgtcacccaggctggagtgcagtggcatgatcatggcttactacagccttcacctcctgcaatcctcccatctcaccttcccaagcagctgggactacaggtgtgcaccccatgcccagctaattcttaatttttttgtagagatgggggtctcactatgttgccagactggtcttgaactcctggcctcaaatgatcttcccaccttagcctcccaaaatgttgggattacaggcatgagccaccatgcccagcctgacaaaaatttttaaagaccatggaacaattgtaaaatttaccaatgattattcagatcactttgtatggtttcagttggcgtgctcacttttacagttccatactactgtgcaaagaaaagatgacctgtaatatataataggttcattttacgactcctgttggctcaggacgtatgaaattattgagtataagggaaaaatccagtggttatagaattattgctatcattattactatttcaatgttttgaccaaatttataaacataatcctttaaatatttaaaacaccttattaactagactaataagtattacattttaggacacagaggagctgatccaaatactctgtttccccaccagataaacccaaaagatgtgagatataatactttgttgtgtgttcagacttcagctcagagcagagacagagagatggatagactattatgatgggataagtaagcaacgaattggaaacagctccattcctagtcagatcctgatttgttgcatgtgctctaagctcgcttaatatcttgggcctaaatatataatgctgtttccagcacaaacctccaggcaaaccagcttaagtatctttctactccactctcaatgccactgtggcccctgcctcattaaaacagacagggtcaggggcttccattcagatataagacggaacctggcccagtaatagctcagaagaataaacaaatatacaaagacgttccttgttcctgcttcaggggaatatgaatattaacaggatatgtttgtaaaaacatcttaaactccttagagcagtgctgtgaaacagaactttctacaatgatggaaatgatctgtatctgtgctgtccaatgtagtggccactagccatatgtgagtactgaggacctgcaatgtggctagtgccacgaagaaacttacattttaattttatttaattttaaataatttaaatagttccatatgactaatggctatcataacagacagaagctttagaaaaaaggtaccaaattaatctttggtaatttgtttctagaagacagcaagaaatgcatccattttgtgaaggtaccacaggtttaccttgtgaaccactcaacaccaggcctagctccgcacacaccgcagcacatgtgacctcatagtcatggccggtcaaaatggcccgaggagcagcagtctcacctttaggaaaaaacagataaaaagaacaaatcaattcaatttcatgcatattaaataatcaacaacttgctcctaatttccatcatgcctatttaatttatagtttgggaatttgtccagcaatcctactttaggactagatccaagttacatactatagtttgattatgagggccacatcctgctaaaatgtcaagtaacctttatgtgattatcaagcaacaatggttgaaaactcagggttaaatacaacaaaatctgcattccaaaatgcctcataaaaaatcagcccctcaattagatgttttatggtcagatgattataaaattaggaactttggctcaatttacatttcaaagaaaggcctcgcccctccttcctccttcctcatcctttgtgggccgctgaaacccatcataatgaagacagtctgaactagacttctgctacccccacagtaattctgcagcccctctcttaaatatgtattctctctactaagcttatgtatttttctgatatataaatttcatggatatatttctctgtggttcattcaaataaccgaaaaaaaacccaatataagaaacacctaaaaaaaaaccaaacccttacagataagtctacagatagtgattgaaaatgaggggcggtgggtagagaaggggggacagaggaggagtatccaaaaactggcagatattgccgaatactttcacaacttgaaagaacaagtcatcctgtatgtctgtcccaaactaaaaagaaaacgtatggttggttggttggttggttaataaggaacccatcatgactaagtaaaatggtaatggtcttgatttgtggatgggttcgtgccaagccacaaggataaactggattccatgtctagcctgaagaatatgatttgaagactaaacggatcctttacttttatagtctctaaaggtaaagatacaaaaagtctttccaagtggagagcaggattctattagcattcccgatttcttgatttggattggttttatagtatgcttgataactaacactgtgtaatccagaagagacaaatgtgcccacagagtaagtggctaccaccagctatggaactctgtggaagagaatcgcttgtatcttaaccccagacacctgactatccttggagcagtcacccactcagaggaaggaagtccagcagctcaggggaaacccactggaaacctactgtacttggaaaggcaaatgctgctgtcagaaaactaacccggcttccaaagcaagggttcttccagtaggtcactgggttatttgaaattttatgcaaaatgtatctacatgcctgtttttctaggtagcaggggaggaaaataagttttactgaatggacagaggtccatgaacaagaaaaggtgagaggcttctaccctgaagggaggtctggtctctgtgcttgtagccccacttcacctggagccagcagtcacttcaggtctagcttttcacaggacagttccaatgcatgtaccagagtacataatgcacggccatgtccctacaatgtccttcaaggctttggtgactgtaggtaatcctgagtgagacttaagttgaaggaatgccacacggaactttgcaccacactggcgtgctatgtgcagccagctgctggacctagcctacaggcttagtgataaagggagaccaaaaataacatacaaagaggcaagggggtaggcagaacaaggggcttcgtttcatttgattccaagttttaacacttctttgggaggcaaacttaccttaattagaaagttgacatttcccaagccacaaagaatttgtcacaagagcaattttgtttcttacaaagtccagaaatttgggaaaattttaaagaaataaagcaaataatgtaagccaatctgaactacttaagcttctgttaggatccacaaattttttttttttttttctgagacggagtctcactctgtcgcccaggctggaatgcggtggtgcgatctcgactcactgccagctccgccttccaggttcacaccattctcctgccttggcctcctgagtagctgggactacaggcgcccgccactgcgcccagctaattttttgtatttttagtagagacggggtttcaccgtggtctcgatctcctgacctcgtgatccgcctgcctcggcctcccaaagtgctgggattacaggcgtgagccaccgcgcccagccaggatccacaaattttaggaagaagtatactgttttaaaaagttattggccgggcgcaatggctcacgcctgtaatcccagtactttgggaggccaaggtgggcagatcacctgaggttacgagttagagaccagcctggccaacatggtgaaaccctgcctctactaaaaatacaaaaaattagtttggcgtggtggtgtgcacctctaacaggtaggagaattgcttgaacctgggaggtggaggttgcagtgagccgagatcacgccactgcactctagcctgggcaacagagcgagactccgtctcaaaaaaataataaaataagaagttatcaatactttagccctgattcttggttttccttttccccagaaggctgtacattccacaaaaataccatacaatgttgtttctgaaattactgtctaattagatccattggcaactttttttttttaccagcaattaaaatcactaagatctaaggaatatatttttggtgtgattgttcttttttttttttttttttcttaagttaccatttcatggatggtgaaatttgtgttttaacttgaattgtcttggaattcctcagtggaaagtgaaggtttgaaggaaagctgatggcaaatgaaggcattctaagtataagacaaagtaaacaaaggacagatagataatggtggtcccagaggatgatgtcacttaagaacatcaatgctaactttttgttttcttgggagcatggtggaagaagggagaggattgctgtcaattttctttctttctttaatgtaaaagagttgaaatactgagcattttctatgactacaaagttaagagtttaggaagcctcgtgattaactccagaaggtgggttaagatataagcattattttttttgtaaactcgtaagatttttatcattatgctttgtttacaaaatactagtttccaataatccaaactttattaaatcatttttcactccacagatcagaacacacacacatgcagagtaatttcaaaactggaaaaggatttcttcttttcctagggcctgatctctaaataaggaactattcaatgctaggactttggcttcaaagtttggcaaaatgtttgctaatcccggaagcaggttagacagttcaggaaatacaaaagagagagagagaaaaaaagaaaaagaaattaaaagcataagggtagacttatgatcattaggttctcaggtaaccagttttacagtcactggatttccagtaaaaagacagcgctacttaactttcctcacctataggaaatgtacattactggcctctataaacccacatacatcaatataaggagagatatgtcatttcctctaagaaaagctgtttccaatcttctttaaagattgtattccctttattatctgctgtacagattgagcattctttacattttctcctcatcaaaaagtacattcaaaataaatacctactacttgatttttataagttttataataaagagcttgaaatagttacacttcaatatagcagatatatgatatgggatttaaatctaacaggtcaaaactgtttaagttcaatggacattttgggaaccacttgcaatgaaattactgagggtagcggggataatcggaggcagagcagaggctttacatgtggctcacagaatcgatctttttatgtctctgtagttacactgtatacatcatcctggatcacagcagagccaaagtgacaacatcccacagaaaggaaaggcaaaatccctccatatctgtgtacatttctgtttggaaagcctagaaacaaaatcttggaaccatataactcattctcactgcagtgttctcagaaatctgcccctcccaactacttgtcagcccacatagttaatacccagggagaaataatcagctcaaacaagatgattctggccatatgttacttttcaaagatgccaaaactatcaataatctctcattgaagtctctaaaccaaacgaagaacaagaaaaaaaaatcttctgaaaaatatcaagttaattcttctgataaaaatttgcaatagttaagggatacaaaaagtctttacctttgctttctgagatagtaggatctcccaaaggctagaccataaagcagaacagattcccttaagaaccttttaaagtcttactgcttgaaaaattgtcatggccttcaataatgctgagagaaaaatttatcttgctgctagtttaagggactacatttcaaactcttcttaaagaaaaataaaaagagaaagaggacagacttctaggactgctttgaaaagcttgagcaattacttcaaaggaaagggtgtctttgtccagagagcacgtttatgactactgatgcaaatcctaaccaaaggctgaaaaggatacccagtgcatctttatggatggccttaaaggaagatgaacaagtcaaatgagattaaagacagcccaaattctgctgcaaataccagggcacatcaggttttacagaggcacttctctcagtacgtaatactagatatcaataccaacttacagagacaactataacaacctaacttgcatttaagcaacacaagatctctatactaaccacttagcatttatattggacttatgttttatttatttattttttattatactttaagttttagggtacatgtgcacattgtgcaggttagttacatatgtatacatgtgccatgctggtgcgctgcacccactaactcgtcatctagcattaggtatatctcccaatgctatccctcccccctccccccaccccaccacagtccccagagtgtgatattccccttcctgtgtccatgtgatctcattgttcaattaaacaccaaaagcagtggcaacaaaagacaaaattgacaaatgggatctaattaaactaaagagcttctgcacagcaaaagaaactaccatcagagtgaacaggcaacctacaaaatgggagaaaattttcgcaacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaaaacacatgaaaaaatgctcatcatcactggccatcagagaaatgcaaatcaaaaccacaatgagatatcatctcacaccagttagaatggcaatcattaaaaagtcaggaaacaacaggtgctggagaggatgtggagaaataggaacacttttacactgttggtgggactgtaaactagttcaaccattgtggaagtcagtgtggggattcctcagggatctagaactagaaataccatttgacccagccatcccattactgggtatatacccaaaggactataaatcatgctgctataaagacacatgcacacgtatgtttattgcggcattattcacaatagcaaagacttggaaccaacccaaatgtccaacaacgatagactggattaagaaaatgtggcaaatatacaccatggaatactatgcagccataaaaaatgatgagttcatgtcctttgtagggacatggataaaattggaagtcatcattctcagtaaactatcgcaagaacaaaaaaccaaacaccgcatattctcactcataggtgggaattgaacaatggacttatgttttaaaacattaggtgaaatattttaacaccacttggcagaatagcaaacgttttcattagttgtgtttctttggtgccctcgcaacattaagtatatttatcaaacagactccgaaccacttaaaattacacctgaaagaagagaaaagaggaatttctctagtatcttgctcataaatatccagtgagaagaatatttcataaggcctatatccatttaggaaaacaggtgacaatccaggtacaaatagatctgacatgtattttctggcaaacttgtagttactttataaaaagtgaatgaagttcttggtgttttggcgtcatctccttactcttatgaaaatcagatcactttgaaatgcagtataacgttttcacttgtaggttaaatatgttgttattagcagagtgaatcctcttcattccattttctcaataccatctattaggaaatgaagcgggattaaacattttcctattcctagttttgtacaactaaaattatttcttccaattgatacttagtttagatgactcctggctgggccagaaaatcacatatcccacttgttcacccattcattccttcactccttcattcacttaataatatttattgagtttgtattcttaagatatgtgaggtactatggaaataaggaaaggagtaaaacacagccttttatttaaaaataacttgattttaaaggatcattggatctggttttgtcaactgtactataaacctgcaaattataattataaatatctatgcttgtaaaggtcaacataatagtactgaagtccataccacttgtaacaactaattttgtatgcaaaatcaatatttaacaataattaacatgcttaaagaccaccaatataattttcttcattagtaaaaatgtatcatctgaacttttatagaggaaaatcaaaatataaaacctggctttataaaaaaagtaataatttcaatagaaaacaaattaagaaataaaatatatttgtttaaaaagcccaaatacataatgaacttattaggcatatagattatagataaaaaacaaaaatatattatacaatatatgccagtcatttcctaaagacggatacctctattttacatgtgccttttgtaccatttagttacaattgattactacaaaacattcatgtgaaaactgaatactaagctttctcatgcggctcaccataatggtaaatcaagaaaggaaatggctttgctaaagcggaaatgagcttagatattaaatgtttcttaaaccttttccattaacttcctagttttacaatggaaattatactgcattttaattatgcttagaaaaactacttgaaatttgtcctatacatttcatcttcaccaaatcttttcccttcccctattcatcatggtctctttggtgaaaaatcacaatttgattagacatatagactatagatgataagccatagctgcatttagagtacaacaaccatcagacaggaaattttagtagcaacttcttgtaaataatattagaagtattaatgcaagacaagataatgttggtacaaagaacaactgtaagtccttggtatataacatttctcctcttctctctatgatacatataaatgttggtaacacgggaatcaccctctaagactaaggttgacccttgaacaacataggtttgaactgtatgggtctactcatttgtggattttcttctgcctctgccattgagacagcaagaccagccctctgcttcctcagtctactcggtgtgaagacaacgaggatgaagatctttatgatgatctacttccacttaatgcatagtaaatatattttctccttacgattttcttaataacattttcttttctctagcttactttattataagaacacagtatatgatacatataacatacaaaatatgtgttaaccaactttatgttatcagtaaggcttccaagtcaacagtaagctatcagtagttaagtttctggggagtcaaaagttatatgcatgtttctgacggtgtggggggttggcaccccgactcctgtgttgttcaaaagtcaactgtacattagaaaatgggtttatatgagtgtgtacctgcaagtgtatacttaaaagtataccccttaaatgtatatttgaaaaatacaaaatcttaccatgacatgtactgtcataagaactcagtataatacagttgtctttttgtgtctctcgcaaatactaagaatgctttagtgataggattgcatcaacttctctatagctgatattctaattaaatgtatagtttagataactctgacctagactgcctgagtttaaatctaggctccagcacttgctagctatgtgagctcccttgggcaagtttccataattctagtaaggagatcctaaaagtgtcaaggcccagggcagaaagtaaaggcatatttataatttctccatgcctcatctataagtcaaggatactaacagtagataccacacagggctactgtgaagattaatgagttaatatgtaaagcactcaggatggtgcctggcatgtagtgagcacccattagtatcatataagtagtagtagcagcaggccaggcgcagtggctcacgcctgtaatcccagcactttgggaggccaaggtgggcggatcacaaggtcaggagattgagaccatcatggccaacatggtgaaaccctgtctctactaaaaatacaaaaaaattatctgggcgcgctggcgcccacatgtagtcccagctactcgggagctaagtcaggagaattgcttgaacctgggaggtggaggttgcagtgagccaagatcccaccactgcactccagcctggtgacagagagatactctgtctcttaaaaaaaaaaaatagtagtagtagtagcaacagaatgatcccttttttcactctgttataaacactcctttcattgaaagtatatttcatcctatgctgcataaaagctaattagagatggttctctccttgataattcatataaattctgatacaactactaatatttggcagcctagaggctaacagtggggagtgaaggtacagtacagtaatttggtgcattccccaaattaaaatagctttttttttttttttttttttttttaagacagggtctcactctgttgcccaggctggagtgcaatggtgcaaccacagatcactgcagccttgacctccctgggctaaggtggtcctcccacttcagcctcctgagtagctgggactacaggcaccacacccagctaattttttttacttcttgtagagacagcgtctccctatgttgcccatgctggttttgaactcctgggctcaaacaatacccttgtcttggcctcccaaaatgctaggattataggcatgagccactgtgcccggcctaaagtatctttattgtctctgattatcaaggtagtacatgctcattataaaacattcagatacttcagtaaagtatgatgaagaaaatgaaaaattgcttccaaatcccactacctataaataaatgttgctaatatatgtcttgtgatcatttcatactttttctatgcataaatgtacatagaatacaagtgtatacacatataggcataggtacttacatatgtagcttcgtgatcttttacacttagcaatacaaagagtgtatccctccatgtcaatattacaaatttatagtatctttgttaatgcctgtacaggacttcattacatggacatatcattactatacttaactaatgtgcttcttttttcctacttgcttgagacttcatttgttgttttcccatggaggggcttggtctttggttctaggtaagctatggctcctgtagctgcatatgagtgtctggtaacataaacatggtaaaattctaccccccaaaaagaaaacaggtagaaaatttgctgaagtgaaatcttattcagatttgttgcaatgcaacattgtctgatttttatgaatataaattaaaactgaaaattggttttatctatttatcctaaatacccaaattatttaaaattctttataatacatcctccttaacatttttaatgttcttttgttaaaaatacgtaagtaagggactctgaaaactatagaggagtttcatatctttagctattaaacactcctgaccccactcacccaaaggaaataaggcagtctctcagttgtgcaaagttacaagctacaagaatgaaagcttaaaaagctcaacagtcatgcagccttaagccacaaaaggcagaaacaattcagagaatttttttcctatataaaaacacttcaaatccaaaatctgaagtcttatcaaacacattcattttctcacttgaatgtgaaaaaaattactgttaaaaaattaccagataaatgaaatgtaatgatatacttagataatggccctgttaaaagaccaagaaaatcaatttttaaaaatttgttaacacttataaacttctgctctgtaaagcgatataaatgagcatagcacataaaaattgaggtaactagaaaaaatagggtttaactgttgcttcgtaaaaaaaaaatcagagatttaaatattgaatttcatataaaaatggttatcttttcataaattatcagtaatatctagagtaaaatgtgagttacataggcacaaagctgtcgtagaatttctcttacgaaatgagcgtttttggaaggtagtaaagtcagtctactatgttgttccaggaagctttaattaagtgtatccttggtagttctaccaataatgttatggaccacccccccgcgcccacccccaccgccggcacagagttctgcaatattttaaaagcagaagaatcctacgtttagttgactagaaggaatttttactttcttagactaatgccaactattgtttgaaattaaatttcccatatgagcataaagtgtcaagacaactttctttggcatggcactattaaaaaggtctacatatgaagatactcaatctgagggtataaatcatcaattcttctgttctcatatttatatggctataacctatgggctgaatggtacagtcatttttctctgcaaccaaacaaggtaaataaatgtgatatattggcatatcaccccaccactctgcatatggtgcacattaaggttgtattcatttgccatatgaatataattcctttttaccacatctactattagttacaagcagtaaatacagagttgttttgctggaacttgagggcctgcattgcatcatggagcactaaacatcctggaccttctggagaatttcatagacatacttttaatgtcacctgaacttgaacactgccaacataccatttgaaaacgcttcttgataaatgcttcaaggaaaaaataaaaatacagggtagctgtagtgtgacagtacattccaaatgcaggcccagaagggaaggtcttgatgagacacacacaagaactcttgttcctgacaaaggatcagatcaagagtcatatccaggtataaaatggtttcttgtttcaagcattactttcttattcagaatctagtgaacataaggaacctaaacataaaataccatccaaataacttcctcaacggtaacttattgaagagctgtgatcaagaagctaacaagtttatttcatcaccaactgtggtgctttgtttcattaggcaaatattgtgcttgctttttccttacacaaaatatttatcgtacagttgcaaatccaggttagggtagggtaaaaggaggagtaaagtgatttctttttaagaactcatatggttcaacacaaatgtacataccttgacatttgtgacccttaaataatatatcacaggcaattaaaaacaaagtacacctgtcttaaccaagtaccaattttcatgtttcccaacattaagtccccaaatgcatccagcagatggtgctctaggacacctacttacagagagtaatattgtttatattacatccacctaaattttggcaagacaaagaataagaatttatcagtagcttcagtaaaacatactaggcttcacaataaaaaggacataattcctaaatatgtgtacaaaaatatgcatacacataagcacatgtgcacagaggcagccagtaaataattcacacctggacatgttatgatactacttttcttacagacttgatgagtagtctatgtgtatcagtagtatttatagtcacatggcaagatcattctaaattcattaaaaaaaatttagaatgccttaaagttagaattcatttttaattatagcaggaatgtctcattagggtgatactagtaaaattaacaacagtaggatttacggtaatgacttaagtgattgatgagcgtataacaaaatgaagttttagacagagaaaaagcagggcagctatggcatacagtactttaaaaaacagctctgtggtctgttagtgctagccttatggttaataaaaccttctttctaattaacggtgctgaaatattcttaaagaacagaatcttgttgttatgaagaaaagttaggtttttttctcagtagacgccaatcccataaaggagaaagctgacatagattagcatgtctgattgcaatgaggaaaagaaaaaaaatgccacctttcaatcaaatcaaaaccagaatgcgagaatggaaaatgtattactgaaatactacacacacaaatctgtgcaacaccctcacagttagcaaccatttgcttctgaagctgatcgaatgtggctttaaaagatattattcagatatctaaaaatacctaataaacatttaattttttaaatccatgtttatgaatataaaagtgaataaataataactgttttgtatatattcatcttgcttatctaaataagatcatgtcaaagtttaaagtatttatttatcaatggaatgcactggggaacattttctccaaaatttaaaaatgtacagtctggagagcattattctgaaggtgaaataactatctcaggaaaagcactttggtgacaaggctcagtcctaaaacacagagtactaggacaaggagagagagatgccatgctttcatgtacaaaacatctctcagtgaaatattcttggttaatttcattttttaaatccctaattaaatggaatcctatattcatttttcttctcattgaaaaaactgcattccacaggagataattattacaaaacaatagagtcaaagatgaaaaactatctggtatacaggaaaataagccttttgctatgtagtctaggcaggcttcataaaacatttacactttttaaagccccaaattacagtatttataggttttacacttgatcttagccaaaaggctgagaagcgatgtatttataggttttatccagtttgaattagcctgagattgccaaagcagtatgtatattaatattagataatatgatatttttaaaactttgtcatacagctatcaactttacatataacatcaatattagatatggaaaaaacagtgtatgtaggcttatgaccctagaaagtaaaatgactacctattcccatgattttttaaataaaaaaaccctgagatagacctataaaatgcagaaaaagcaataacctggttttcttttatctattttcccttcaagaaagaaaaagtctacaataaaaaatttaaagttgaggtattaatgtgcatttatagaacatattgcaattatatgtatatacacgcttcaccacttcttaaaggtcatttacattgtatctaagaggtacaatataggaatacacataacctaaaacccttcatctgaaaagctctgacttcagcagctgcattgtggaaccatcaatgagccagaggcttataaaatccgaaccagcttgcatgaatgtttgaaacagtttacacacggtaacaatgtctttgtttttgtttgtcattttcttttgaaaagcgtagattgcattttccatttttctattctaatatgtgtaaattctcattataagaaaaagtgcctatttgtctttctcctggattcatctttcaaagctgaagcaaaattaaatcggggcatcagacattatacaggggcttgaaaggataaggttcactttgagaaaggtaatttaattcagtcaagatacattacaattttctaaaatttttattagatgtgctgttatattattcttttattgtttttcttttcattgctagcattactaggaggtaatgtccaccatactgcagacaatgagagggtatagatgaagtacgctatgaaaaatataacattataatatttactctaatgccaacaagatggtgttttgtggtgatttatttgctctaatcatcctgtgcttctgataacaccttaactcagttctgttgttgctttcattttacagacaagacagaaggaccacagcaaagcttggaacttagattttttttttactacaaaccccaggatttgttcagtcctacttaattcgttttttaaaggccatgcatgtaaaaacaatctctaggttgagttacaaagtatttaaacatatgaaaatatatttaaatgtatacatatatcatgatatatatcatactttcttcctttgcgaagagctgaaaattcctaactttaaggcatacttaactttctgaaatgcaatagtaattacatacaagtgtagctaataggtctttagctgctttttagaatacacattggtaatgacggtgtataacatagagaacatgattaagtaaaataaaacaagaaaccaagaacccaaatatctatgtgtgttcagatttctttatgtgcatgaaataccttacatttttaaggcaagaaaaagttcttaaatattttgagataaatagcaaaatggtagatttattatcaattttaaatataggtttgcctgagataattgagtgaatctcggtaactggatttacagaaaccagaaaaaagaaattgaaaggagtcacttattctaagaggacagacaggaagaaggaccagaatattgtgttcatgatgaaaagaacatggtacttttcaaaagaatatgaaaaacaaaatccctgaaatttgcatctttgtaatttctattgtaattacagagatgtctgtataaatgtgaaatacatgtacacctactccccgacatatacacacactacaatttgatcacaaagtctgtattatcaatagcatcacaggcttaacattatttttcatatcctatttgcataggaaattatcccttttttgattaaaacaggaaatatctattagacgttcattgaataaaaactgtatttacctatcacatcaaagtctataatgtacataataagaaacagctttgaaaaatacttcacacacacttcttttaacattatactagcatttgactaaatgttttgaaaaaaaggttcattttcatacaaatattatacatttaagaacagctttgagaagtcaatccaagatatgatggacttaaacatatttagaccatttcacaatctggggtggagtgacagagcaaggaccgggtattcaggtaaagtcatcaggaagaatgtgatccttccttaaccaaatacattgcaacttgccttaaattaagaaactgtaaatatttaagagcagttaaaatgctctaccttctgaagtaaaaatctaaagctattcttgcaggaattctacagtgttgtcataatcattttaattaaattctcatttttcaggtggtccctttaattgttttttcctacttcttaatgtgtttttctaaagccatttcttttctgcagctgtgtgcgattggttttaatggtagctgcttccttttttgccttctgtgaattacaattttaaatggttacacattttttgttttactgccttcagcatagtttcataaagatgtttaaggctgttggtgaacattttcatttcccatctgaaaaaccaagagccaatttgagtattccacattggccttttatgacctgttttatctttttaatacataaatgaaagcataattttatcaagactagtttgtttctatgaaattattatttttattttgttcttttaaaatatgaattcaataaacaaggtaatatgtgattgctcttttatgctgtatcttcatgaataaaaactactttatttggtgacagctatttccaatgaagaactagaatttttggatcataagaatagcctataatatgaaacataagatttcatgcttagattttaattatcaatggtcacaaaattgataatgaggctatttggatcattcttaaattataataaataaaaaatacttgataatcctgtctcacttttaccataacaaaaaggtaactttactgcaaaatgttattctctacatccttgtaaaagtttacttaaaaaatgagtcatacttactgcctgggttatctccaatcccactgcattttccattccaataccacagcaaaagagttgcatcacgtgaccctgagagaatgtagcaatttcccccaatatatgactcagaacgagcaaggcaagtgacgacatcccaatggccaaacaccacttggatcaatcttcctgtaatgcaaaacaattttctttaaaaatgctattaaaaaaataaaaattctagtgaacagataacttgtaaaacaacgaagctatatgaactctgatggtcataattcagattttataataatttgacatggtccaacctaacagttttctttgcatgctaacaagaacaacaaaaaaacaattgaaaattgttaacatttttgaaaggcatgtgttaaaactatttcaacaaataatacttgaggaccatggcactgtatcattacaaatggcttctataaattacaaatgaatcatgtttactgattaaagcaggcccaggagaacccttttggaaccattttaacactttcttgagttactctatatgattcaaaattaaacttagttgcttttctgtaaaagtactcataatttagatgtcactaataaaaacctatttctgatttactgaagatttaatgtatttcttgttttaagtgatctatacaaagacaatataagacactttggagagcttctaccttttcaaatcaggattatatggaaattatgatgaaagaactaatatattgtgattgcaatttgagccaggtgattctttgtcttaattttctgatgaaaattccttgagggtgaaatcaagatggtaatgactggggacaaaggagaggaacccagtaaacttactatatatctagggcttcaaacacagaacagttgttcatgtaaaggtgtcagaaaaaaagtaaagccctcacccttttttgttatttttatttatttatttttttgaggcggagtctcgttctgtcgcccaggctggagtgtagtggcgcgatcttggctcactgcaagctctgcttcccaggttcacgccattctcctgctcagcctcccaggtagctgggactacaggcacccaccaccaccacgcccggctaattttttgtatttttagtagagacggggtttcactgtgttagccaggatggtctcgatctcctgaccttgtaatccacccgcctgggcctcccaaagtgctgggattacaggcgtgagccaccgtgcccagcagccctcaccctttaagaatctttgtttaaccagatatggtggtagtaattcacacaaacttgtctaaacaattaaatagctgtgacagacccccattccatctttagaatttctagcttacatatttcctttgaaatgtctacagagtctacagatgaatgccatacaatgtctacccttaatattcagcatggctttctttttctttaaataagtttttatatttcgattataaaatataattccgatgttcaagaaaaaaaggctactaagctgaaaattaaattaatatgcctaaataggttatgtgtttaacccgtaatacattgtaaacttcttaaaaggttaaggtcccaagtactggcatatcaagtgtatttaacttttcaagataataaatataagataatatttacattaaatttttaaaattcttgattttaataaatctaaggcttattatgaaggctgaaaatttagaaataaaattctgaaatattatctaaatcagatggaaaagtcaaatacatgttttcattcatgagtggcagtcttgcatatagcctacttctaataaatttaaaatcagattcacttcaatctcaagttgcaaaactaatatagtactttttttctcctgtgattaagggagagcagacttcaaagcaagtgtctctagctgctaaatgttcaagatgttcacttttgaatttcttcagccttttaagttgacaccaaaacatttcattaaaaaataagcttatatcaataaagaataaaaaagaatccaagaccttcaagaactaaaaaaaattgagcaaattaaatgtgaaatatataataatttttacttcatttccaatttacatgacaaacagaatgtggaggttcagtggtaaactggcggggatcagattacacgcaggccttacataggataagacaaaagttaggtagctgaaagcagtcttattaataactagaaaatcaaaggttaaatccatgtattttaactactgaaagaaatacatcatatatacatcatacatcatgaatacatcatatagtgatgtgatcatagagtatatatatgacttctgctttagcctatgcctaaatgctgagagcacataaaatataggtgtgatttaaatagattatgtatgggcaggcttatttcagatttgaaacccaacaatcagtgggttgtaggagtgaggaggagtgaaataactaaccaggtacttgaggtagacgacatagaggaaacccaggtgttcttagtgcagtaggaggcttgcaaagaacagctattcacttggtaacttaatttccaactcatgtgaggacaaagggaaaaaatgtagctgtaaaggtgggatggattaaatataggggcagagttttacaagagtcacatggtaattctcatgagttgaagtcactgctctgtttctccaatgtcagtgtaaggaaacatacattcagtcatggtggttccttttcaaaatttttagtgttttgattgttttccaaaaagttatcacaattagttttcattcaacaaatacttagcacctattaagtgccaagcattaggccttcttacctgtatacagtggtgaacaaatagacatggtccctgccctcatagcctttacagtcttgtggggcagacagtcattaaacaaacccagactggtatataattatgaatagggatgagtattataaaagaacaaggttggattaatgacaataacaagatagaacaaatttacactgggtgtcagggaagatctaaatgagagagtgacatttaagcagttacatctaaagggttttatatgttaacacaaattaactttattctttacaatttatactttgggctcaactctggaaaacattatttttttaagtttactttttcctgttctggcagccttcctcagcaatatttgttattgctataaggttgaggttcactcctcctaaataaatcacagcatataaatacctgctgctctttttggtaaattattttctgataatcttataagtgttcctcaacctttattttttgtttcctttaataccagtccacctctccacacactaatatcaaatattaccacaagcactagaatatcccttttttgacagaacaaattttctagttaatgttttatttgacagctgtgctacaaataaaaaaattcaagctcaggactctgcaccactgaatctaaaatgtggcctgaaaataattccgactgccaggggaaggttttattgttgcctctgctgttctggttgtggcccgaaaacatgatttatgtttaaagaatttcctgttacaatccatgtttctcctccctcctccccaatctaataagagaaggatttttttttttggcttgtgtgctaaaatataattgaatttaacacttgtgttagctttgccattatatattactgatcatatgattttcccttgattctgtgctaaacttaagaaaaaatatttaatattcctattgttgtaaaatcacagacacatatttaccttaactgaaattattttaaataaaactagcatcagagtttttatacaagatattaagaaagacaccaggactatcgtttgagattttttttatacaacttttctggtaagtataaatatttttatttcacaagctaagtcagtcccactgaaatgaagtttaaggctattccttatttgtacgttttatacacacaaacacacacatttttaaagacattagaaggtattttgaaagagggaaaagaatgacatcaggtttattaagtctaatgtaacatggcaaacatactaggaacttagtgttacaaattacagcattttcccaaaaaaatcagtgactgactggtaacacctagatgagacaacatgctatgatcacaaagtgtgctacatttaaaatttaaaaagctaggtccaaggcctacttctgtcactattagctacatacatttcaacgaattacataatctctctaaacctcagttttattatctgaaaaatggggataagacacctgtctacttcacaggattattgtgagactgaaacaatatctagtatgtgagagaattttataaattctataaaattgtgtgaatataggattttaattattagtgttatatgaaagtgaagttagctttactttacaaatgttaatactgagtgtctttaaaaaacaataatatagaatgtcaacaaactaaaaacactcaaatgtcaaaaccaaagattgacatggtttgtgattccatttatatgacattctgaaaaaggcacaactaaagatgaggaacagattagttgttgccaggaggttgagggtggggtaaaaagttgacttctagtaggtggcacagggtatttgggggcgctctgcaccttgattgtggtggtggtgaattactctatggtttgcactgtaaaccaaaaagagtggtttacagttctattagttctatattacagtgtaaaattcattttcatgtttaaaaatgttttaatcacttaaaaaatatatggaaaaacaatatgaagtccaaaagaatatttgagaaaaactccaggagtttaagaccaccctggacaacagagtgagaaccctgtctctataaaaatttaaaaaaaaaaaaagcaaaaaaaacaagaaatagctgggtgtagtggcatgtgcctgtggtcccagctacttggcaggccgacgcaggaggagatcacctgaggccaggagtttgaggttgcagtgaactgtaactgtgccactgtactccaactgtctcttatactgtctccaactgtcttctttaaaataggcagaaaaaaaagacatgtccaagactcaaagaggagtgtttaggttcaatagtaatccaccccatagacttaaacatctagtaaaagcccaaataatcaaaaaggcttgaatggtgatgttttctttcctacacctacagaataaagatgcaaactataagaaaaccatgtcatcaattccatataacaaacaataaagattaaaaagatgttcaagaacaaactccttgaataaccaaaaattaattgttctataaactatattaaggcaggagtatggactcaaacattttataaagattattaataagactgaaagatgatttaccataaagcattcaaataactagaaattttaatttaaaagatttttcaattcctacaacattaaataaagatatatgtaggcctttgttccagctgaaatatctactgtcataatatacagtcatgagctttataacacaactttttggtcaacgatggaccacatatatgatggtggtcccatgatattataatgaagctgaaaaattcctgtcacctattgacatcatagctgtggtaacgttgtagtgcaatgcatcactcacgtttgtggtggtgctggtttaaatggacttactacactgccagatgtataaagatacagcacatacaattatgtatagtgcataatacttgataataaataactctgttactggtttatgtacttattatcccatactttttattgttaaagtgtagtctttctacctataaaaagaaaaagttgattctaaaataggcacaggcaaacccttcaggaggtattccaaaaggcagtgttatcacaggagatgaaagctccatgcgtgttcttgcccctgaagaccttccagtgggacaagaatgtggaggtggaagacagtgatattgatgatcctgaccctatggaggcttagcctaacttatatgtttttgtcttcgttttctaaaaattttttaaaatagaaaaaaacctatacaataaggatatatagaaaatatttttgtacagttgtacaatgtgtttgtgttttaagctatgtgttattacaagaattgaaaagcttaaaatcattaaaaagtttataaagtaaaaaagcttcagtaagccaattattagtaaagaaaaaattttaaaaacaaatttagtgtagtctaagtgtacagagttttataaagtctacagtagtgtacagtcatatcctaggccttcacattcactcactgctcactcactgactcacccagcgcaacttccagtcctgcaagcttcattcatgggaagtgccctatacaggtatgccagtttttatcttttattattattattttttacttgcagaagacaatggaatggtttttatctcttataccatacttttactgtaacttttctatttttagatgtgtttagacacacagatacttaccgttgtgttataattgcctacagtatcccatatactagtatgctgtacagatttgtagcctaggagcaataggtgaccccatatagcctaggtgtatactggaatatcccatctagtttgtgtaagtatactctataatgctgcacaacgataaaatcccctaacaatgcatttatcagaatgtatgcctgttgttaagcaacacacgactgtagatcaattagctctaaagaattaagagctcattttaattattttaaatatcaaactatatatttactataactttatttcatcctgtaacaatttctaaaatattttaagggacaccattaaatttctcaacgtttctcaatttcttacatgcaaaaatttgtaaacatttactcagccggatctcctacagtaatactgagctcagcttggtttgtcccttagggagatgcatgtaaatgaatatatagactgaaaatttttatattttaacaagagctcctgtcacacataaaagcaatagtcagctacttttcttcatgatggtgtagatttcagcaagattctaggcagaattgggtggaggcaagatatctactgccaagagttagacttaatgagtctttcaagtaggaaaaagaaaatcctttaaataatacaaaagtgagaaaatacacttctgtgtgtgtgcacttgccgtaagattatgcatatactcatgcatggtatttacataccaggatttgccttcaaaatgaatcatttattctgtaagcatgagcttgggtcacaaacctataaaaaactgtctcttacaaacatgctgtagcaaatttaatagtggactatatatagtagattattatttgaagagggaaaacaatgccctcttctccctattttgtaaattttaggattttgtaatttttggaaggaagcagataagaatgcatcctaagcctctcaatactacttatagtaaactttagttcactgataaagaaaatgaaaattacctgtgtctgtagaatagactctgaaacttttatcccagaagccacagacgagaatatagcggttgtctgaagtgatgacaaagcactgggaatgcacttgaatactttggtctaaaaggtcagtgatttgcctcctgtgcattcctgtattgctggctgtaagaatagggaggaaaaacaactattaaatccacatgggcaaagaaattctatagtgagggagaagaggagacacattcccagataagagtacttgatccttaattctaagtataataattgaaaaaccgagtaggaaaacatatccaattgctggaaaaatgtgggtagctaaattcaatatctcagttaaaaattttgcttagaggaaagaaagaataacacactactatttaaaaatagaacacaattcacagaacatgctttctagctcttgggcagaaccaaactagattacaatctccagattgcatcacagttaggtttgtgtttctgacaatctcattacatttattgtcatgagaatggttcatgttgtgacaatctattacctttaacattttgtcacaaggaagagatattaggatttaaatgtcatatatttgaaatattgtagcatcttgtactactttggctttaacgggtctttaatttgactagatgggaactcccatttcccctgtttacaactgcacttgcatgtaaggaaagggtagaatgactgtttattaaagattcctgtaattgaaaaagtcaaagcacagcagactgccactttcttactccttatttaagcaataaaacaagacagccttggcagtgtgtttcaaagtgctacggtgcacctgagacggggtttgtcaccaagaaaaaggtcagacatagagcaacaccgagcacatgggaagagtaataatcgtccagaaatacaccatcgactgtgccattatcagaaacggaatcttcactgagatgacttttttggcattgaggccaaccaaatagaaagctttgtttctagtgatctaagggttatttcaccatcatctctccagtacaagtaaggattctgatgctgctaaagaaatttgattgtaccagaaatcagaacaaacaaacttctgcatccgattattaagcttttcaccataattttcaattttttgaaaaatcaaacatagaaaaatatttatatgctattcattgtatgtaataactatattaatgtgggtagtttaatagaaagctcaggaagtaaaacagaagaaaaaaaagtattcaaaatactctccagtgctgtgctgggagccactggggacacagaggactgatggatctgttgccctcatggcacacacaacacggcacacacgtacacatacatgtgcaacactgcagaaattctgctaatgtctgtggacacaaccatttaagattattggataactgtttgataatggaggcttcatatgcttttggaggattaatgggctagaaagtgacagcagtagtgaaaagggcagaatcctagttgggaatcattttttccctctccttctaacaaagggaagttgctggcagataataaaagcttttgtggatatcatagtgttactacagagagacagtgtccaccaacagcaatcaagtatcccattgcaatgaagttgtatgatacaatttttttttaaattccaagaaatctagcaattaaaacaaggtatgtggtactttctgcactggttactgcagtactttgttccacatgagagctgtaaacatgtttattcttgtcagtgtttatgtgacttttgctcctatgatataaactttcgctgaactttcttgggggattgggatgatctcttgggaggacctcagcagatttgggcatgtacataattttgaattgagtgaccacaaagtacccattggcaaaggcttgatgccccctcagcacacacatgaactattttctaagcaagtgcttacttgtaatttaacattgccaagtcccccatccagctaaggtatatttatctagataagcagtcttcaaactagggtatgcatacccctggaggtgtaagacttcctaagagatacacaggttcagaagttaataccagtaattttctaattcctcaactttaatatattctactgcttgaaattgatttgcctgagaactctcctgtgagttttcctttcttacctcttctttctcacgcccttcttctactagataaaataaagacatatttcccttccacacagaatcttactatgtgctttagctgagtgtaatttcttgcccccaataaagggacaattcaaaatactgaggtaatactgaaaagtgaatgtataagtatcaaatcattctgcaagtcaggtggtttccaatttactgctttcaataaaatggaataaggatccaatcatgctgtcaattggtagataattaaaaataagttttaatgatagactgttaaaattatagattacttaataataaaccataaaaataactcttaataatagatcactatatgaattgccactaatgcagagagttcaaagatttgagtggtacagttgaaacaaagctctttcccatctattttcctaagtgagtaacactgctcagaggttccatctataaaaacaagtaagatagacctgctgatgatgtatttttaataaatgttcattttatgtaaataaacatttattaaactttataatataattaaataaatacattaatatttgtaataatcactcaatacagataaacttattttaaaggctgagccttatggtcataggaaattttaaaatttaaattgaacacatatgcttaattttgcaaacacatttttatggctgaaaagcataatagggtaatcaattttttaaagttaacataaaattatctgggggaagtagaatgaaaatataaattcaagataaaaaagtaataatgtgaaatttccatatgttaaggggttttcaatgtattttttagaaacagaaaatattgaatatcaattcactctgatatttagattctactggatatattaaaattttgtttactgagtatcaattcactctgatacttagattctattggatatattaaacaatttttacactatgccagaatgtataacctttgcaactatttgaacttgtgatgaaaacttttagatgtcaacttaaaaattgtctgagaggatacatggttttaaataattcttttaggaggtagaagtgtaaagtctgttgaccagtgatctagggcagggacagcaaaactagggccaaaggctgaatcctgcccatgcctgattttgtatatgtagttttattagaaaagagttatgttcattcatttcttttttatttatggtggcttttgtgctatactggtagagttaagaacagcttgagtttcccttatctgaaacacttgggaccagaagtgttttagatttcagatttttttttcagattttggaatattttcatagattgagatatcttggggatgatagccaagtctaaacacaaaattaatttgtttcatatagaatatatataatgtatatatatatatatatatatagcctgaaggtaattttatataatattttaaataattttgtgcctgacataaagtttggactgtgtttgaatgtgacctgtcacatgaggtcaggtgtggaattttccacttgtcttgtcacgttggtctttaaaaagtttcagagtttggagtatttggggcttgggatttgcagattagaggtgctcaacctaaaatatttactatctggccctttaccaaaaaagtttacccatgcttaccctaaagggttacaacaattgatgaattcatttaattagacttgatagcataggatattcattgtcaaggtgcaaagaaaatgatgggtctaaaattcagaaataatgctttaaatgactcagcaaatgggctttattattttcctgacttttaaactacccaagtgagcattttagtttttttaatatatggcaaatcatatctactcaaaacaaaacaagatttaagaaccagagtggtatttatccttcatgtagataattacgtattagatttctgattatacttggggaaatgataaatgaattggtttagagcttaaggttatttctgttcatcctgatagtctacctgctaatggtagccatttagctctccattgaaacaatgccttttaaagacaaaaatggtaactatataaagggaacatcttggattttaaaataataaatctgcttcattcatatgctttctttaaaaacattaaaattctaacaaatttatttgtgccaggaaaatctgacaaaattacaagccaaatatctatgccgatagcattacaccacaggtaggcaagtaagtttttattctaaaagttattaaataacatcttcaaaatcgaggcttaacattcttagtgatgccacatttgaaatccccacacgtaaggatgaaaaatgctaaactagagatttcgactaatctactcaaaaagcctaacagcaattaaatattctaagtcatctgctgcagatgctcatttcatcccaatggctctttctggtcgcctccctatttttttctcccctgaacaaatttaacctccaatggcaatttattgggctgtaggaccctaggaaaatgaatacaaatatcttaacactaccattggctgggcaatatatttcaactttgaaactgctctgcaattgcacattaatcccctcagactgaacagaaggtctaggaagaaaggattgatctcctttaatgatgaaaccctggcactacagttttatttttcataacgcagtgctgctaagaaccccactgttattatgaaaattttcctagcaaaggagctccatcacattaccggtgcaccaattcatcataacgtgccttgctcctgctcatcaacaagtctgagtgatgaaaagatccaatattatcctgacagtacttcatgcgcattctcaatcacacattattacagcatccatattaattttcagtgacacgcgtcctaggcctgttcaaattaggcaaaccaacgagggggagttgatgaaataccagcatagccacagctcattgcattccaatttgcatgcaaatggtttatcaggaaaattccattcccagcaaccagcaagtgaaaaacaactgtaatctacacttcagggccaccatacagagcttaatgaatcgcaaagagagaaggaagtgacagacctatgagaggatcgatttccactggcagctggtatggctggtcttgtacagcaccttgatgagctggaattcacaaaagataaagaaaaaaggcattattttttatatactaaactacataaaaatgcataagtcaaaccttatgtagaattgtttccaatctctaaatctttcatgcagttttgtgaaatttaaagaacaaaaatccaggtgcttttatggctagcttattaaacatttattttagattagtgccgctctgaactgtgccatcagcagtggctccagtcctaggccataagctatagcagatgcttgactggcaacctctgatgctgcaacaaaacaaaattaagtggtaaagcgcactgaaaacaaaatgtgacaaccatctgctgactgtagcaaatactatttttttgttacttcttaaaaaggcagttttgaatgctacagcacaaaggatctacaaaaatgtcaacttatgatggagaaagggaaagctctaagtcagggaacatttagtgtttcatccatcacttaaaatcaatcaattgaaagtttgaataaaaataaagaaagctatccgcagataaatgttttagttaaatgcatttggctgaaatattttcttaaagattggattgagggtttaaaaagaagttttattaatatttaatatttccatggtttcaatttaaaaatactctgagaaggagatgaataacaaaaatcaatctatcctaagaatactttgttcaattctcaaaatggttttaaagattcaggcatacttattttataattgaagagaggttttgcaggctgtttccctctgaaagggagaaggactttcggtagagaggaagtatatcaggaatcaggaactacctgatgcaaccttgtgcaaatcataaaccctaaaacagggttcagaatagattatcttttcagcttcatagttctgacagttaaattctgggcccttttccaaactattttccccaaacgactcagccattcaccctgctcagtatctactttttatagactcacaagcattcacattattgcttggttggtattagagctctgcttaatgccattgataccggtgggctaggggaggtccccaaacaccagtgggacctcaaccctggctcttgacactgtggtgagaagaaactcaaggacaagtcagaaaatagtgaaagtatggagatttattgcaaagcaaaaagtacacactcaaaaggggagtgtgggtgtactcaagagagagtcgtggacaaggggcgttggggttcctatctttatgggtttctgttaaccaaggggtggaatgttcatgaagattcctggaaaaaggtggcaatttctcagaactgtggtgccatccatttttacaccaaatatgagtgctcctggaacggtcatggccctggtgggtgtgtgatttgtatgttaatgagcatataatgaggtcctatgtgaaacctagatcaaactcagcaccatgttgggtccagacagtctcagccagcttggcctgcaccctggttttttcagggtcttatcagatcttagcttctgcagctatttcaacagtttccttttgatagtcaagaaactgctgcctggaattttctattctcctgtgattaccatatattattcctgtcttaccataagattttaggaaatctatctgtctttgaggggctgaaaataaatatggggtacatttcaataagttcattagattattttatacttactctgtcatagtttctccagttagtaaataccaactttttaaagatgtttggaaggtcattaatactgataaaacacctaagtacagtattggcactagaaattacagtatgtataagaaactaaagtagctgaagaaaagaaaccacaacggctcttttaaaaaaaacccaaaaggtatttgtctttgctgattactgtctctgctggcaaagaaatcacaggatactcacaagggaggaccaggaaaaatgcactacagcctctggtctacccaatagtgccacttacttccagcaataccagtgtcaatcaacattaatacctttagaatttccctctacttctctgataatctgagatcttagaaacatttaaaccaaactgtcagtgaaatgggtttaaggaggtttgctgatgcttcaaatcctacttctgccactgactggctgtatgaacttggtcaagttatgtaatctctatgtttcaatttcctgatctataaaataggttagattgaaccatatgaaattgccaataactgactgttttgacctataaaaaaacgcgatttcatatggtttcaacctaagtacagaacctacatcctcaggttgttaagaagattgagttaatacacataaaatgattaaaacactacttgaagaggcatgaaagtttatctactccagccatgttttgccagtgaggacactgagcccagggagctcgccttattctgcatcaaatatgcccagtcagtggcagagtttgagcccaggttttctcactcggattttatgaccacctctcccctctttcattagagcaggaaagttgggacctggattcagcactgttctttttggccaccagttagaattttttttaagaagaaggaaaatcttagaaactagaaaaatgctctataaacatttgctggtgttattctaatttttggaggttttcaagatcctttgaatgagaagggaggttaaagattatttattttctaaatcagacactactcaaagaactgaggggaaccagctgtctaatgaatgagctatggaaatcatagatcctcagaaaagaaacagaacctaaaattaaaaaaataaatattgtaatatggatttgatatttaccaaagaaaaactgtcagggatttttgatgtttgttttaaatcaaggcatagtgacaggtaaaggtagcaagagatagaatgaaaggttagatttatgtaaacatacctaaaatgaagcatagacttaatataataaacgcttaatattcttagttgcaggtgcagctcaaattggagatcacattctagaaagataactgcctgtggtgtattcccatatgttatcgctttttgtatttttctggtgaaaagttgctgtgtcatactgtaaaggcagtatgtatggaaagggtgaagacaaacatctctaatgacatggttatagacacaatgaaagctcactgaacagaaatataggcaagattctgcagaaccttgcagttcccctagctatcttacagaaaggtgagccaggactgggaacagttggatgcatcctaagtggtactccagcagtgagactctacccctaaatcactttacatatttatttatagaaaaattggaagtggagaagataatacctgaccactaggtattaagggaagcaagctttgtagtgagggacaccagcttgctggaaaggtgaaagccagaagcttagtcatcaacgcgtagggtcttaaatgcttagggttatcagtgctaaaacttgaaatcagctggagaccgaggagccctgtggttgagccagctcagttcccgttgagccagctcttcctaggctaaagtaaagatgggggcagagtacagtcagggctttccagcagttgcaaggtttgcccctcctcacatctgatgtcactctgtttaaactgaagaagctctcagggctgccacaaacagccacccaggataagcatcatcattggtggtcctgaagtcacacatgctggtgcaaagctctaagggtaaccgcacatagagtaggtaaatcctctagtgtatttgatagaacatatcaccagcatgtttttcttctaaaaagtgtttagagaaacaaaaaaatcacgtttcttaaataaattgtaatatttagtcccaaaatataagtatgttattttcataaatatttacttctgtaagagaagtttacttaaagaaaaaagaataaaaggacataataatagagatattaaatatctgcctccatttttactgtctctaccttttctgaaatctattttgtagtcaaatattggcatttatttgcatcgtttcatttccaatatacccaggaaaatggctatatttaatcaattctaataccaactacagattctttgtggtaggtataccttattgagcttagtcaatgtaccaagtttttgtttgaatgtcaattctgttcccttgtgaaagctgttgcatttaatttggcatgaggtccttgttcaagaacttgtatttttgcaaccatttcaggtattctaacgagcagtgctttatgcacacttcagagatttaatgacaatttcatgaactattaaaatgtatcttttaaatttgcctacctaaaacaacggcttgggaaaaaagtctataatctccagaagtttaaaagattttccttcttcttaaaaaaaattctaactggccaaagagaacagtgctaaatccaggtcccaactttcctgctctaatgagagagaatacattacagaggggtggtcataaaatctgagtgagaaaacctgggctcaaactccgccactgactgggcatatttgatgcagaataaggcgagctccctgggctcagtgtcctcactggcaaaacatggctggagtagataaactttcaatgcctctttaaatctgcactgtttatgattctaatggttatttcagttgagcatgactgtgttgagcatttaatggaagaacagaaggtacttacagatattcaatattttggctatgtaatttaagtgttcttttttttttctattatcctcaacaaatactaccaatactaccatgccaagcacaaaaaggtacagtttctggcacataatagacaatcagaattgtttactgtggctggacatagtggctcatgcctgtaatcccaacactttaagaggctgaggcaggaggactgcttgaggccaggagttcaagaccagcctgggcaacatagcgagcccatctctacgaaaagttaaaaaaaattagccaggcatggtgctgcgtgcctgtagtcctagctaatcaggaggctgaggcaggaggattgcttgtgcccaggagttcaaggctacagcgagctatgatcacaccactgcactccagcctgagtgacagagcaaggccttgtctctaaaaacaaacaaaaatttgtaaaaacccaagtgtttattaagtaaaatgaaagtaaaaaagagaaacatttgataaataaataaatatatactgtttatggacataatatagaatatcattatattaaaatactatattagaaacaatatttatctccaagaataaagataaaccaccagaagctaaaaagtagtttatgtttttaacatttgtactatatgcctcacgtgggccttttttaagcctttcaaactattaaacaatttgattcagactaatgcttgaaaattaaaagcttaaatgttgagatatgctatatttaagtgggtattacacagtgttcagcagttaccatgccttataatggtatttctttacttaccaggaaggttgtgccatttgttcaccgcaaataacctgttagcagtgactgtgatcacagcgggagttgccaaaccaggctgggtgttggctgccacgtgagtaacaggggagttggagggaaacttgaggaccatgataacatcctgctgggctttgtctgtgaacatcaatggactctgcaggaggagatactgttgagtgggcatgacaagacccaaatagacaagaaggaaaagatgaagaaagacaagaaagagagggggtgcaggaaaagaagaggaagaccatattaacatgagttgtaagtggaagcacagtgagcagaaaggcttgtagaaacagcagtcatgatctgttattcatgtatgtcgttagttggaattttgggggactgaagtagaatacattaacagaaacactttaaaatttataaattttatgagctccctttccctccccactgccacgaaaaactaaaagaatgatttgatttagattctacacaggcaaagtgctggggattgcattaaaccattctggttgctatcgtgtcacataatgatcttttagcactaaaaaaacagtaagaatggacaacaggcataaaagcaagacaaggtaatttccaaagatcatcaaaagttgtgttgagttagcaggaagattttgacaactacaaagaggtaatgaaaacaaatacatttataaacaatagttagactgcatgcatatattattacagtagagaaataacttatgaacgtaatatacaaacttaattataaaggtgtttgaaagcaatgcataaatgtacttgtaaaaacaatatatttatatagtgtaccaaatcataaacactgcctattgtaatgcaaatgctactgctttctgctgtagctaggaataaagagaaatacctaggtgttcctcttccctgttggttaaaaaacaaacaaaactagagctcaagacttttttgatttctccttcaaaaaacagagtaattgaaaatgttaaatgaaacactgtctgttctaataaccagcaaccaaataaatcttgaagactactaaggatttggaacattcttacaacccatatgtcataatccaagacatatataacactgctctgatttattggctttatttatactttgtggtggtgtgctatcatacagtaattgcactgtacattttcagcaattctctcctaccatgtctgttttctaatagctgattagtatcattcagaattgaaacactttgatgaaatgcttctggctgctttccttctgccatatttcaaaacaccaggtaatatgtaaatgtggaggcacatatatttaacacatatttattcagaactggtaataaaaaattaaatacatttgcatttttattatcagtccttttaaaaaagttattaagagtacttagaaaaacatattgcactaagaattcctatttgcactctttgcataaaggtgtaaataaaggcaactaataagctacccggacacccttctgagcaagtggctaaaagccaatcaatattatgagttaatcctccctggatgctcattcaattaaaggtgtcagtaatgcctcatctgatgtggcctcaattaagtccaactatctgatggtgtgaaaacacagggggatacagcaacagcagcaaaaccagacaaataggcagccttcgtgtgcctgctaattactacacctggtgtatattatggttcatgcacttaacgcagcacgaggtggctttaatttctgctatatttgtgtgtgtctctgtgtgtgtgtgtgtgtgtgtgtgtgtgtggggatgcattgatggttgatgggggagctcatctgaatgttactaaaaacaataaatatgtggcctttgatttttaaaaccctagtatcactagtttttgtcacacaaagaacgttttatatagtttttaaggaattctgtgaaattaggtaaaaatgagaaacagggagcaacatgaaggaaaatatcccataagctaattttaaagaagtcctgggaaaaggaaatgaacatcatttccaagtaccaagtcttatttttcaattatgtagtttttaaataatatttacgaaagtcaatttataaactcagagaaaatcagagtacaacataatcataaaatctcactgaaaggaagtacatacatatttctgagcttaacagctcatactataaatataattaggctcaaattgaatagttccaatgtttatgcccttaaaaaacacaaaaaaaatctctcatgtgtaggaagaatgtcttgtttacatagtgactctggtgggccaactctaagccacacggcaaggaccagccaccttccacagcaagctgcagacaccatgtccagaaatgtccactgccttcgtacaaatatctgtccctctagtctgctcctccataccccatcctgactagagctcctgatgcaggcaagtagcaggaaactctcttgggcgtttcatcatatatccttggctaaaaagcatgaatgagaaacaccagaaataagaaaaccataccccacactactaggctactctgcagtgacagcagcagctgcagatgagcagagcaactggtaaaacagggataagagaaacaaagcctcttttaatactgggtacctctgtgagccaaggctggggtacaagtaggaaattgctagccaggtttcatcagttttcccagattaagtatacatttgttgacaactctggtttctttttaaactgccttttccccatgcacatatggacaaagcgaaaaacacaatttgtgcaagtctgaagaggagttcaggtattcaattcagaggataaaggtaatggaaaagacggcctcccatccttatatgagcatgagccttccccgccttctcaccctcgggatagcaaagctgctctgcctgtatgagccaataagcctctgccatggaagaaggctgggcagtgaccccagcagaaagtcaatggagcagaggaggtgcttccatttgccagcaccaatgcagcctgagtctcaatggcaagctattactaaagctaattccaaatgcaaacataaatcattcttactatttttatggcactatcttccattgttcttgctaaatgtttgctatctatgtagtcttctgcccactaaagtcactcttcacgttcatctaaatctgattttactgatttaaaaacatgtaggggaaagagtgatgcaaacaatttttaaaatgtgtatagcttatgatggccaattcatactgctagataaagaaggagaaaaaatcttggaagaagaaagaaaatgacaaagagcacagagggaaaaaaagacacagaaggtgatgtgggaagagaaaggaaaaaaaaaaaggaaaaaagagccagaggtagcagggcctcctctctatttcttactttcttcactgctactctttccttcccagtatttatcaaaattctgctatctctacaccacaacatggaatttgactttatataattgttaattatatttacgggaacagactttgtagtttctattcttaatttaaaacagcaatgagcaacttctttttatgagggacaattgaaaaacaatatgtatagtctattccttaaaaattattttaatcacgcacttcaatttgttactctgccaatttttttttcctcattgaagaattttccccctgaaatttcaggaactataaaggtaaaatggccaccttattttgtagctcaagtctatttccgtacccatgattctgggctgacttttgacttgctttgaccaatgaaatgtggcataaatgatgtgtaggttcaaaagcaagcctcaagaagtctggctgcttctgtctgtcttcattctcatgggactgctcctaccatgggagcggcctggtctagcttccttaaggatgaaaggccacatggaaagagaagcctggctacatcagcccacccccaagcagtgtgtgagtgaggcgaggtgaaaagagcagaaaagattttcatctaaccctcagaatcatgagaaatacaatacatgattgttttaagccactaagttttgggtggtttgttataccaaaccatcatttttctcctcactgtggtccctgaccttcagtaacaatatcttatgtattagaatttgttttaaaattcccaaactgaaaaatatattgggatgtaaagaataaacacaacagcaaaactaatctagaaactcagagaatcaaaccagaaaagtcatcaaccctatgtctggagtcctttatcctacagtgaggattcatgacaattatggacctttcaattctgtaacacaagacaccaactgatgaaatacaagagcactggagcaacatttaccttctcaaagattccaggagacaatgcaataacatctgctggttgttagcaggttaacaaatattgcataaaaaaacaaacccacatatggtggagaaactcaagcacaatgaaagactgttatgaatatcaagcggatctgaaggagaggcaagaaatgaggagagtaaaaatagcacttaccacttgcatggcagaacctctgggaggatggggctctatgagtagttgagaaggagtctgtccaaaacttcggatttgagcttcaacagcctgaaaagggcaggggcaagtctgaaggttaagaggtgctaattacaggaaatagaaccccaactgtcacctgaaaatatcattccatactctggcttgtttcatgctgaaaatcaacctgtgttttcacagtggggctaaccacctggcaagggcattgagggtgaggtcatcatttagaaccgcagaagctgttcctctaaaactctgcaaaactttctcatcttgctcagtgatatgaaacagaaaccagctattacaatcagaaattgtcctttttggcttcatctctgttttcttgcacttggttttcctgcttgcatcatccccaatgatgaaaagctaatcttttacaggtatagagaaaaactattgcttctttgattctaggtcccatttcatcctggggagtaaaaaggaggaaaaaagaaacatagcacctgtgaaagtggcttgatgctatattaattttgccataggaagagcattattgttgactgtctctttgaagttagacaactaaataacaaagtaaaagccatatgttgcatctaagcatgagatggttaaaccagggagtcactaaacatgaggaacgtgtgtatgtgtgctctttttgaaagacgtgtgcttttgcaaggcactctcctactatggctcttggtgcacacatagcacacaaatgcccatttccatcaccaaccacccatcatgggaaactgctaaatgccaggtgctatcacatctgtaagcattgtgtttacttgtttatatctgtttcttcccagtaaaatacaaaagccatgaaagcaggaccttatgtatcttcttcactgttagatccctaaattggctgaatgaataaatgctacatgctgggtgaggggagagaaggaagcaaacacatataaaggctacttcgacactcccgtaacagtcagtatgcttaactcccaggctaaaaggatgaggaaaaccctcaaattaataagaataaaaattggagccaaaaggaagtgaggtagggactaggatcattttcagaacatcatctcaaatattttctgatagagtgaaattaatttatgattaaacatcaagaacaagcttgagaaaaaaatcataaaatgggaacctgaaggctaaaggtagtcacaaagaaggaggtagcaacactgctaatttatgatatatgaacttatggacttagtttatgaatgagaactttatatctttttgaagaacagctggtaaggatgggcatgatggctcacacctgtaatcccaaaccaagacaggaggatcgcttgaggccaggagttcaagaacggcctacatagtaagaccctgtctctacaaaaaataaagaaaattggctgggtgtgctggtgtgtgcctcaagtcccagatacttaggaggctgaagtaggagaacagcttgaggccaggagttcgaggcagcagtgagctatcattgcaccactgcactccagcctggacaagagtgcagcctggacaagagtacagcctgaacaagagtgcactgtacaagccagacctgtctccttgacagttgccttctgtggttcctgcccggcagcccacatgcctccctgattaaaaggggagggaggtggcaaagaacttattgcttcagcacttggcctatcatgtcagatggctcagagtgctaatcctgactgtgacacttatctgctgtttgactttaggcaattagcttatctccgtttcccatctacaaagagatagtaacaatacctagttcacataattgtttggaaaatgaaataagataatgcatataaagtgcttagcacagtacctagcacatacaaagcactaaataaaatgctgtactgtattattatttcatgtgggagttggtgtattccccacttaacacagctaaaataaagaaggaagaaatgcctcaggagtttatgtaggaagagaatgagaaatacattatttaagaaaactgaaatctggcttgggatttcaaaatataccacagggctaagagcctagagacagagagatttctttggaggttctgagagcagtccaaaacatgaggaattatacacctgggtccttatggaagctatggtaatagtaacaaagagatgaatatgtgaaccagctaaggaaaaatcaacaggtcttagggactgatgactttgagcaataaagaaaatacaaaactaattccttttcttaaaaaaaaacttgcatgtttcagagaatagtaaagcaatgagcagaaataggaatacaggagtttctgttagggaaaacaagtttggcaggagaaagacagtaaattttacgtcagacacatggaatccaacgtgatagtgataaccatttatctaggtcagtatgtccaatgtgtaaaagcctaagaatggctctgaggtgagagaagagaggtattgattttggtgtcattcatataaaagagaaatttaagttacttttttttttatctttctctcttgttgtatatgtgtgcatgtttttaagcagcagaaatgacctcctttttgaaatgaaatatcacatgaaacctcaatacatggagatagggttattcaactttacaggggtgaaaccatccctaacaagcctcctcatcagcctctgagacaattctgagaattctttagggctctggagcacagtttgaaactatactcgttaagccctaggatgaaaatacatgagacccagacacaaaagcacctagagcagaacctcaagaagtatttatatttagggtacaaatgaggaagtaatgaagaagacagagagagggcagtcagagggtgggtgggaggaaaagcagcatagagtgatatggaagccataggatgagggttttgaagagagaatgggcagtaacgccaactatgatagagaagctatgaatgatgacattgtagcatatacatctttattatagatacaaatttaatataactggccttaatattacatatagtgttttgcacttaacaatgttttgagatgaaaggttatggatgagacaacttctgaaaataccaatctcctctttttaactaacttaactttaatcttaacattttaatacaagtggcacattactgaaaactctgaggaaaaggcttttttaaatcacgtaatatagtggtctgattattctatctcaatgacagaataaaagctatagtctctcacacaggttaaataataatcaattttctttccaagtcttgaaggcatctgaaaaggctgtggaattctcagacacaaatgctttacttcttaacgaacctttcagttcttgatattaaaaatgcaacagaaaggactttttcaagtgtgaaaattatagaataagattgtaaggtaatgactatgatctcaaaactttatagtcacactgtatatcatcaactgataattccagttctcctccttgtttttaaaattcatttgccatttttcattcatcttaatctctgaagcaatttacagagattctcccttctgtggcttcaatggcttaatgcttagactggctctgtagtctactcctttaatctctgtcttttgctgacttgtcatccataaataaatttattactgtgagttctcttttagcactatgattcactcaacttaagcttgctttcttggaaattttttctactgggcctcaaactctgcccctatctgaaaggtttccagtcctatgaccagaggattgcccactcccatgaagtttgccctggccatcttgtgtgtaagcacatgtatgtcttagcacatctaaaatcttaaaatactattttttattttagcatttctcagtcaagaattagattcttctgattttttaaagctcagaatcttgtctacattttaaaaattttacctgtttcacatataaagtcactaagcccaatcacttcgaagtttatcacattcatcactcctttctgaatctaggccccttataatttcaagtatcgattattataacagtctctttgctggttttccccctctattcagtttctgcctccagcatatcctgcagaactaagttttcccaaactcgcctttatgcaatatttctctgatcaaatgtcttcaagtgattccagtaattaaaagataaaagctaatgccaggcattgcaggttttcctatctctctaacttttattctctcattctatctattaccttataccagtgttccttttcagtcaagctggttttcttctacaaatataagccatctctgccttacattttctaccatgccactgaccctcctagaatggtcactcttatcttcagttttctaagttctactcctctctagaaaaccctgtttgagttctaccaagtttccctaatcttgttaaataatattacacctgttcatactgctcattacagtatatacttgattcagaatttcctgtaatgttatttatgtctgtcactacaactacactataaggcactggtccccaaactttttggcaccagggactggtttcatggaagacagtttttccatggacctgcttggaggggtggatatggttttgggatgaaaccgttttacctgagatgaccaggcattagattctcatagggagcgtgcaaccgagatccctcgcatgtgcagttcacaatagggtttgcattccgatgacaatctaatgctgtggctgatgtgacaggggtagagctcaggcagtaatgcttgcccaccactcacctcctgctatgcagcctggttcctaacaggctgtggctcggcggtcagggacccctgctagaagggtctgaataccatatatgtgcaacaggtggaacagtaccttgcacatagtatttagacaacaaaaaatttactgagtgcctgttatatagcaagctagccaggaacccttatggctcatctatggttggactggggacaaaaccaagcttgagagatgagcacacttcttgatgagggctgactgaggttgcaggggaggataaggagtgttaagtaaaggctggtatttgctattagaaagaaaccaaatgagtctctcagggaagctctgaaagatgtcactaaaggcagtaattctcatttcttcagatccagcatactggaggataggacaacactccattgtctcactatagtagtaattcttaaggtcaagtgagaaatcctggggtaatatgtatgatttgaaaaagtccctcaagtgattatgtttcttgccttatcttcacttgcctattcagccctctatatagagcaataaaaaatttaaaggcataaatgaggtgtgaaataacaggaaacatacaagcatccttaaaccctgtacggttcagcaaggtgggttggtaatagggtagcttaacagacattaccaaatgcctcaactgctcttaatgaactctccttcacctagagagttttggtgctaggtgatcactttttagacattcagttatgtaacattttttgttatggaataggataatgaatccccacatatccattagccaccttcaataattattaagacattttggctttaggttatcttaaagtcgggtcaatctagacaatgtcctagatagattcattgaaaattaacagagtgcttctgcctttaaacaatttattttttttaacttctaatgcaagactatactgagaataaaagtatcttacaatgaccaaaaatataagcattagctggcagccttcatatttcttctaaggggctgaatatactcagacttgcaaggagatgttcaatccttaagttgcaaatttgattatgtgactcaaagccttccgttccaaatccttaccctgggtagcaccacagcataggattaagtatgcagacactggaatcagacagcctcagttcaaatcttaccactatcacatattagctcagtgattctgggcaaggtacttaaccttctgtgccttaatttcctcttctaaaaattgtgataataactgtcaatattttattgagttgtgaggattaaatgagataatataaagcacttagaacagttcatggcacatactaagctatcagtaagtgtgtgatattattacagcatatatattaaagacttaacacagtgcctggctagggttaagcaagcactcaataaatgttaccaactactcatctttaagatgaatagttatctagccccaaccactgtccatttcaccactctataatgtgacatataatcaacatcatattgcctttaaacccttgtatatattttctattccttttctctgtgtggtttctttcctcctcattcttgaagacttagctcaggcatctctggcctctgggagatctttcttgacctcacccagactgttgctgtccctccctttttgctcttgtagcaacatgcataaacttttactgcctatttatctaatattctaattactggtttaattttccaacttattgatcagactataagtctcctttagatcagagactgcctaatatttctgtgcttctacagcttggcacatagtaggtgctcagtaaatatttacccagtgaatgtccatgcaaatcaacttaatttaggagggatgcagctaagaaatgcactactaccacaatcacagagcagtctagtgttgaataaaatattatattaaaacatttcaaaaaaagcttgctttattaaatattcttattcatcaattcccaattatttctgtaaatagcctgttactactttctataataaaacctgaagtcagcaggcagcattccagatgttgagatatatagtaataaaaaagactatgcaaatacttcaagacattgcagtaaaaccacatatttatattttataaacagcatctcaaatattacctagagaatgtattaatggatcttcaaatggaaatattatgaagagattttcaacaagctgtgtattctatagtttttgtgtgtgccaactatttcatacttgcatgattttatagctatatatagaaaaagagacaatatatatagagagaatatacatacacatactagacagaatgaaaggaagaaagaaataagagataaaagtaaaggaaagtaaacttggcttagtgacagtgtagtatttggcttcaacttaacaaagactattttagtctctctgacctaggctttttaatctaactgaggaaacaagttaactcagtacagcacttagtaaccaacaataaatattgtaaaattttatttaagatgtagggtaggggagaaataacttaaacatatggacacaattaatatatatgcccttttttttaagcacacaactctgatattgtattttatcacctacatatttacatctgaacgcactataaaattggaatagggaaatagagacaaaataatttattaagaaaagatatgtcatttattaatatattaaaactttctcacattaccaaaattaagttcaagaaagctgctgtaagattctaatccacctctttaccaagaaatgtttaagcattccaacaagacttcatagattaaattcttttcaatatttaaaaagtcacactaagaccatccagtgatgtctactgtggtatcataccattacttgtgccagttttcttctttcccttcagatgtttgaacttaaattgtagaacacttgctggatatttgacaggtttctactcaaagtttactgtctagctgactagcctcagtgtcctttggaggtatggttcaactttagcttcgatatcagttaagtttaaaaacatattaatcaaatgactacttaatcatgatatggttacgtttgtatttaattcctaaaggaaaaaaatcctgataatattgtaactgctaaggccaaaaaaggacccatagcaagtaaatatatttggtaaaaatgggatgaaaatcccaaaagagaaaatcagagatgtttggatgacatctctatctggcttaaaagaaagaaaggcaaagcatcattagaaacatttggaaaccagactcccacttaaccttaggaaagaaatacaaagttattaatagtttttagttgtcagagcaataaattcacaaaattaaaaagtagtataatgaacctaactcaaattatttaaaaagagtcttctaagattaaaatgtaaatattttaaatgcctgagaaataaaatacagaattcaaactttataaagcataaacataagagataaatagtttttcaagaaaatggatacaccaggatatggaatatttaaaactcaagcagataaatgttcaaaatatacagcagaggatattttcaatgaaatttgcaaaataatctattaatacatagaagagtaaatgaaattcaacagaagtgattctatgtaaatttggacttgaaagacttaatgtttttagttttgagaatgcagacataaagacagatatctaagaatttagataaaagtcaagtttgtatgttatatatatgtatgtgtatatatatataacacacatatacttacatgtgttatgtgcatacatacatacatatgcatgaacacttgcatgcaaaatctggggggtatattccaaactattatttgctattttctctgatggaggaaggatgaaaagattggcagaataaaaatttatactttcctcatttttataccaattgatatcttacacaaagcatgtattatttttgaaataagcataacaaaacaattttcattttgaaaaaatctaaaagacaatttaaaaaaaaaggtctgcaaatatttggtatatcattattaagttttttttgttttgtcttggttttttttttttttttttgacagagtttcgctctgtcacccaggctggagtgtggtggtgcaaccttgtctcactgcaacctccgtctccgaggttcaagtgattctcctgcctcagcctccctggtagctggaattacaggtatgcaccaccacacctggctaaattttgtatttttagtagagatggggtttcgccatgttgtccaggctggtctcaaactcctgacttcaggtgatccgcctgcctcggcctcccaaagtgctgggattacaggcataagccaacacacccagccccacttctatgaattttcataaggaaagaatcagatgaagacaaaaagatttagatataaagaaagttattatagcactctataacagtaaaaattggaagaaaaaaactacttaaactctgataatggaatactatgcagccattaaaatgagttgaatacacctgacatagaaactagttcataatataccaaagaaagaaaaatttctaactaccaaagtatatagagtatgaccttatttcagcaaaaaatatatgtgtatgtgtggctgtgtatatatatatacacacatatatacatatatatatacacgtatatatgtgtatatatgtgtatatatatacgtatatatgtgtgtgtatatatatatacacacacatatacgtattatatatgtgtgtatatatatatatacacacacacatatatgtatatataaagcacttagaacagttcatggcacatactaagctatcagtaagtgtgtgatattattacagcatatatattaaagacttaacacagggcctggctagggttaagtaagcactcaataaatgtttttgtttttgtttcttttttgagataggatttcactttgtcacccaggctggagtgcagtgatatgatctcagctcactgcaacctctgtttcctgggtgcaagcgatcctcccacctcagcctctgagtagcagggagccacaggtgtgtgccaccatgcctggctgatttttgtatttttgtagagatggtgttttgccatgttgcccaggttggtcttgaactcctgagctcaaatgatctgcccgccttggcctcccaaagttctgggattacaagcctaagccaccacgcctggcgaagccactgtgcttggcctttatgaagtttaatttatccattaacataatagcaagaaatacatatatttttaacttttattttaggttcagaggtacatgtgaaggtgtgttacataggtaaacttgtgtcctgggggtttgtggtatagattatttcaccacccaggtattaagccccgtacccaatagttatcttttctgctcctctcccaaggaatattctgtaaccatctaagaacaacttcagttgataaactggtcaaaaacttaaatctatagaccttgctataaaattaattttgttaatattgagtttacttttttaacttatctgtatctgattccaaggatcccttagttttagcaatttttgccatcatttagtattaattaaatacaaacttgtttaagtaaataatgtgttttcctccaagaagcactcagaatgcatcaggtaactggaaacaaatacatatcatgatggaatggagtacataaaaaataaagagaaagagcagcttgttaaataaagtaaaacatattttaaaataataatgcaaagaaaagggggagaaggaaaattagggagggaaaggagtatttatactagcatatctactcaaataatattattatggaagttactaatgtaaaatatgatgtaattataatttgtgaaaatgcacacagatttttccattagtgcctgtaacggagcccgtacttttcaggcacattaaactgagtcccaacccagcctcactacaatctccagttcttgtagctgtccatctactacagcataatcccagctgccaatctgaaagaaaccagctagtcagagcagacacaaccaacagaaacaaacgtcactcaataatgttcagcggcactgtgttcatggataatttcaaacagtatctctgtctagaacattgatgtgctcattcaaaacacctccatctctggctactggaaatgagtagataaagcagcctgcctagaaaaataagtggaatgtcttcaaagaggttgccaatgctaagaagcaaatgttgagaaaacacagtaaaggtcttaaaggaaaaaaactcaacaatatccagagagttaattttcacattaagaaggttaaattatttctcaaaaccaaacaaatatgtttaaactatgtcatgaaaagcagcagtcattggttattcatttgctaagagtgacctagatgaagtaaagatggtgcctgaaaggaaacaggggttcatgacaaaagtcatcagtataatagaacggctcagaattctgtaggtagttaataggaaaaaaaatcataaaaatattaatattttgcttcatgtccttgagtgtataatttagttacacctaacttaactagtaagtctgcaaaagacataataatgagcaaaatacaaagagtagctttactgacaactttgatgctcatttaattgaataagggaatttttgtctgattattgtggttttgaagtaaaagaaagtctggcataattttatggtattttaaatgtaggttttcaattaaaacctgactaatccttaccgtttatttggcttctcattgtacagttcctgccctgcactgtgtcaaatatgccatctgtgtaacacacttttggccagaggtacttcatgattatttctataacactttgaattgtggctgcatgaaatcttaacttcggtattcaatactcctaatttactatattgctacaaccactgtaatcgtgtcctactcttaaatctcaccacagtcacaacaaagattcttgcgccacctgcttgaaacaggcttacagaccactcccccaactatttaacaaatgttaacaatgctataaatactaattgtgtttatgctttctgaaagattcactgcagccagtgttctgcagcagtgttggagctgctgactcccaccaacagactgatggaattctaagccaaaaatgcttttccttggataagatatctgatttgctactgctgtcatgaaactggggtcatgtaaacttaaacactgctgctgcttcttttggaaaacagacctcagagtgattacgcatagctaagacagcatttggaaggataaatttggaagagggaaaaccaaccactgacactaaacacaacttagggaaaattttcaggttttactttcatgttgaggtcacttgtatacagtaattctttaaactgggcaatatcacggctctcccctctcccctatttatcaatgcaaatagagctgagttccattttcaaaaggaaatttaaaactttaattaatttctgaactcacataaacataaaacaatgtatttacgtgaaaagtaaagaagaaaatgacacttttagaggaaatgtaccaagtacttataacaaagtacaagatgaaaaagcacagataatattgttcatattaaggttgtctgacagcaacatctacctgcaagtatctttcagcctttgaagccccaccccttcttccaacctccagtgtaccccaagatctgccctggtgtcccttatacaacaactgctccagcctctgctgtgtttgtacttttcctttgatcaaaacctactgtccagtcttactcacagacagccacatgattggaaaggatttttttttaaaggatttgtaaccaaataagtgatctctaatggtagaatttcaggcattaggaaaggacaatgagttctgtagcagaggctttttttctttacatacacatcaaagtgcatcaaagaggaacttatagctagacattaacatgtgactctggcattagttaccaatttgaggatgagagctttctagtctctcactttatactttttgtattatttgactcttgaaatagttaacatgtattgctttgataaatacatttttaaagcactttgtataactatttaattatacacacacacacacacacacacacacacaagtagtgaacccagagttctagaattcaggaatcttaagccaaaagccttcttgcttttagataatgacaaaaactacaattaacagcgatacacctaagatattttccctgaaagtagaagtgttctttgtgctctccctcaaatatgatgggaaaaatgaagaaataaactcaaatgttaaaaagtatgaaaactcccatagctcagtggattaaataacatatatagaaaattaagagattggaggtactctgatttctgagtgagataaaagttaagaaattgtaaattccttcattcctgtcaaagttacacgaagatcattatagacggtcagtaccctaacaacattgaatgttgagaaagaacatggccaaaacccagaacgcaattacaaaagacctctgaacagccaaaaacgaagtcagtattcatatcctcatgttaacatacattgcttgttcaaattttcaagaagcagattctttccccctgaaaagggagaaagagttgtgtttggctttttttctctctctgattttcaagagacataattttttagaatatagaaagaggcaaattaaagaattccatgatctcattaaccaaagataatgaccatgaacattttggggtccataattccagacttttcctcatgcatttgtattttatatgttccataacattgtctattattcactgtaatatggcaaaatattcttccatggtaatacatatagatttacacagcaacatttttgatgatacacagtattctactgtgtaaatttaccaatatttaattaactacttctctactggaaatttacgttgctccttttcctttttttttttttttgctattatgataatacggtttggctgcgtccctacccaaatctcatcttgaattgtagttcccacaatccccacatcgtgagaaggaccccgtcggaggtaactgaatcatggtggtggtttcccccatactattcttgtgatggtaagttctcacgagatctgatggttttataacgggcatcctccttcgctcagctctcattcttctctctcctgccgccttgcaaagaaggatatgtttgcttcccctttcaccatggctgtaagttccctgaggcctccctagccatgtggaactgagtcaattaaacctctttcctttagaattacccagtctcgggtatgtcctcatagcagcatgagaacagactaatacatatgaactatataactgaatatttttttcacacttggtcaattattacttttggttagagttctaagtaaatagtacatgaacattttaataattgatacagattgctataaagattcaacctattttcatcctcaccaaatatatgacagtatctgttttctcatactgcaccaacattaaaatttttattatttttaatcttagataatctagtggacacaaatgttattgtgtgttcaatttaatgtcattgattaatagtgaggatgaactacttctcttactgggtcctgctctttgcccaggctggtctcaaactcctgggcctaagcgatcctcccaccttggcctcccaaagcattggaattacaggtgtgaaccactgtgcccagcttaaagtgcttttcatatgtgacttgcatttcatctttcatgagttttctattcctgtactttgttatttgttgttgctttagatgtacagaaacatccttttcatgtagtgtttatacgtgaatatattaatttccttaaggatttttagctttgatattagacttacaaaggccttccccttcatgtaatcaggaacagaaatgtcagtgtgacaggacacatcgatgaggaagagaacagacgacatgagatcagggaggtatgcagggccagatcatgtgagtcaagcagattttattctatgtttgatgtgaaataggaaagtttaagaaggaagtgaaatgatctgacttacagtttcaaataccactttggcagctcggtggaaagtggactgtaggtaggcagggacagaaaaaggtgacctggtctactagcgttagtccagtggggagagtatggtggcggcttgaactaatgatgaacagatatgaatggtttccaaatatgttttagagatctcaccagcctagctgctcttttgagacagagtcttgctttgtcacccaggctagagtgcagtggtgtgatctgaactcactgcaacctctgcctccccagttcaaacaattctcattcctcagcctcctgagaagctggaactacaggcgcataccaccacgcctggctaattatttgtattttaatttttttaggaacagggtctcactatgttgcccaggctggtcttgaactcctgccctcaagcagtcctcctgcctcagcctcccaaagtgctgggattacaggtgtgagccaccttgcctggcctatcaccaacttcttatgctctcccttcctaccacacgattttttcaagtcatagagccatactgtgctcttttccacatgccatactctccgctttgaatgtcccttccatttcttttgcttcactgacttaactcaaatttcttaaggattatgttcagacagttgatactttcttaacctgggttagaaatgtctcctttgtgctcccgtattcagtgactgtcacattgccatatatataatatatatatatttatttacatacacacagacatatgcatatatgtgtattttttaaaaaaatatatttcttacctactaaacttcatcaatgaactatttcatactaagatactaatgtctagatagctttcaacctttgtatattgcaaatagcatttatatgaaaattaatgggtgaattctggataaggatatagaattgttctagaaaccatgcctatagatatgattatactttaaatatattaatttaaggaaaatacttatgttaaatcttttagaagagggaaaattattttataaaatattcatcatgtatttaatttgtggatttcgattttaagagaatttttttaattcgtaaaaatagttattcttactcatatctgaccctgagttcaaatattctaatttttatcttttttgaaaatttcttctttccttgggttttacgtttttcaaaaatggggttagaaaggcttaataagattgtgtttgaaagaaaagacatgaatgagccaaatcaaaatcagcagaataatcagaaaatgaccaacttttatttatttgtcccttatctataaaagaatatatgtaatattgaggaactagaatagattaaaaaaatgttaaaggcagtgaaaaaaagaatagtgccaaaatacagagaaataaagaagagtaaacagataaagataagactatattcttaagttggggtcacaagatattttttgaaagattagcatatttgtccgaaaaagaattctttctggtgtgtgatatatgtaaatgcagacatagttgtatattgataacccagctgttttctaaaaattaaaaacaacataaaagtttaatgtgctgcaggctgtttctctgattactcttcctcctcttatggttattatttctatcgtttagtgctctttttatagagagattatttttatgatcacttactatgccatgtgtattaaccattcattataaaatggaaactttctcaagaagaatggcgcttttcccaaaatagtaggtgattacatgacttgtatgtacacaacttgcctctgtatgactgggaacgtatttccagactgaattaagtgtatagaagtgaacagaaataagtaaaagtatagctactgaacagaaattagtctaatttgcttttgatactggaaaggtacaaatctatccttgtaccatgattgtggttttgcagaaataatgctttaatataaatcaagcagatatacaaatgtgctaatattaatgatattaaagcaccttagagaaacaagattctgaagaaaagagaggcgtggcctggaggtgggggtggggagtaaattagtagaaggcaatagtgaaagtttcacaactgacatgaagcctgtgacaagacttgacttggaggctgtcccaggctgggcactgcagggacatgcttggctgtgggagagcagtaggagctaactccctggtgcccttgtttagctgtactccgatcctaaagttttaaaggaaacactgtttatgaagacagagaggcagtcattaaccatcccttctaacagttctccaccctcacagcactttgtatcaccttacccacttctattttctttatagcacttgttataattgaaattacagtctttaaattttattttctgtgtgccccattagaatgtgagctccaggagggaacagactttgcctgtcttgctcatctccacatttttagcatcctgaacaaaacgaatatttgttgaataaatgaattagtaatgaataaaaggataaactttcccagtttatcactcccttccttcctttcttatctactcaatccagcccaggttcacgtttcatcttttctacaacatccctttaacagtttcatcagccacccttgcaccttcaatcctttttcatacatttcaccatacttccatggcaaaccccacctgtgtctatctttctgtctctctctccacaaacacacaggcgtgcacacacacacatccctctctgttcaacttttttctacacctattctcctgatgttgaaaacacagaaaaacaatattgaaaggaaattataattattgagcagcacccattaagtataaatattatctcatccttagcacaaaccctcataaacagaatcttgttgcctttccacctcattcatacacatttacttacacaagtccccatgctatccgtctactctccaatctgagatgaggccctattgttccctcctgttcagtgcttatctctatctatgctctgggttttgttcttctccactttcacacagagcttgatagtgtattacacactttctctcctgcatgtctgacatgcttccctccttttggatctttcccattaatatagaaacatagtccaatatttactcattaaaaaaaaattatcctttagagcaactgctggcgcatataaagatttctttttgtggtgacaaaaatgctcttaaattgtggtgatgcttgtacaactctgtgaatatactaaaaactatcataaactttaaatgggtgaattgtaacatatgtgaactatatctcaataaagcttaaattattttctttatttactgtgtttacttcaacatctcccattcataacacaatcctctactttctaagctatttctctaagatcaccaatgacctcttagaaaaatccagtcagtactttttagttcttatttgttcaatcttctttcagattctaaacaaacatattagtaacatggggctatgtcaccaaccttcagtggttccctactgccttatgatgcagttaaaagtattattttttaaagatagggtcttactctgtcgcccaggctggagtgcaatggcaggatcatagctcaatgcagcctccaactcctgggctcaagcaatcctctcatctcagctagggctatatgtatgtgccaccatgcccagataagtttttcatctttttgtagagatgaagtcttgctatgttgcccaggctggtcttgaactcccagcctgaagccattctcttgccttggcctccaaaagtgctggaattataggtgtgagccaccatgccctgctgaaaattatgttttatggtattgaagactgtttaagatctggctcctgtgtctctctctctctcatctgctaacctttacttcattccacatataccatattctctagccatctcttttatctatgtgcaggaagggtatgcagttgcctctgtgtaggtaacttctgctcatgactctacccaatgatcttattcatccttcaatatgcaactccagcctctcattctctggaaaacatgcctggattctgtcagtttgggcttagtacctatcctatgcttgtgcatacatacttacatatatttatctctgtactgaatttatcagattatattataattgtttagttacacttattttcccattagataatgaactctagctgagggagggcagggactttgcctttcaaccctttaaccttattacatgattcgggtttagtaaaaggttgttgaaaaaatgaataaattaatgacctattcatgttttctgctttcttgcctcacttaacaatgaactcagcatgcatccactaggaaatggtctctgataacttctctagtgttaatgttttatgattctttctatgatctaatcagtagttcatattccttttatagctgtgttttctaacccagggatttaactgtgagcaacataagggaaagaactaacacttgctgagtacttatgaggggataggcaccatgccaggcggtttacatgcattatatgtcatctcatcctctgtagagtgggcattatcgtatgacttctatatataggaaacagagtctgaggaacacaactagtaggcatcagggccatgactcaaattcaaatttatttatttgtttgtttctttgttcattctattatatcaaactgcattatactataggatttagcactggtaaatggtatgaaaaggctataataaaagactattcccctcaacctttttttttgagacagggtctcactctgttgctcaggctggattgccatggtacaatcatggctcactgcagccttgacctcctgggctcaagcaatcctcccacctcccacagcacccaatagctggaattataggtgtacaccaccacacccaaacaatttttaaatttgttgtggagatggggcctcactttgttgcccaggctgctcttgaacccctggactcaagtgatcctcctgccgtggccttccaaaatgctgggattacacgtgtaagccactgcgcctggccccatttattttaatgatattcagaaagttttataaattaaatgtgtgtatttattttaatagtgctaagtaacaaagcgatatattctcatttcaagaatatcaaatacctaccatacttagaatatcacaggccatgtttaataaatgccaaatctaatacagaatatatattatatataagtctatataatgtataatataaaaacaaattaaggtgtgatgtgtggaagactatcagttaaggcttaattttctcataattaactacttaggattgtggtaaagaaaaggaagtcaaacttaaagcaaaagttttaacggtctttagcaaaagttgatcataaaaaataaatattaaaaacttatctgtggccgggtgcggtggctcatgcctgtaatcccagcactgtggggggccaaggctggcagatcatgaggtcaggagttcgagaccagcctggctaatatggtaaaacccgtctctactaaaaatacaaaaattagccgggcatggtggtgcatgcctgtaatcccagctatccaggagactgaggcaggaaaatcacttgaacctgggaggcggaggttgcagtgagccaagattacaccattgcactccagcctggcaacaatgtgagactctgtctcaaaaaaaaaaaaaaaaaaaaaaaaaaaaaacacttatttgttatgatgcttcttcaaaaagttaaacttggaattatcacataatccagaaattccatttctgggtgtatatccaaaagaattgaaagcaggcatttgaacagatggtgtacatccatactcttggccacattgttcataatagccaaaagatggaaacaacccaaaatgcccattgatatataaatggataaacaaaatgtggtatatatatatacacaatggaatattactcagcctaaagagaaaggaaattgtgatacattctatagcatggacaaatcttgaagatattacgctaagtaaaataagctagacataaaaagacaaatgttgcagcattccacttctatgaggtattcagggtagtcaaatttatagagataaaaagtagcattgtaattgtacagggactggggaggaaggaatgaggagttattgtttaatgcttagagagtttcagtttgggaagatgaaacatttctagagatggatggtggtgatggctgtacaagaatgtcaatgttcttgatgccactgaactgtaaactcaaaaatggtaaaaatggccaggggcagtggctcaggtctgtaatcccagcactttgggaggccaagggaggcggatcacttgagttcaggagtttgagaccagcctgggcaacatggtgagaccccatctctactaaaaatacaaaaattagccaggcgtggtggcaggcacctgtaattccagctactcaggaggctgaggcaggagaatcacttgaacccaggaggcggaggttgtaatgagctgagcttgcgcaactgcactccagcctgggtgaaagagcgagactctgtctcaaaaaaaaaaaaaaaacaaaggtaaaaatgttcaattttatgttatatatatttatcacaataaacaattttatttgaaattataatgtgttagtttaggtgaaagaaaaaatataattgagcttacacctatattcaaatatatatctaatgtctacatggagtattcccactttgaaatatcctaccaagtcaatttaacatttatttttccattgtctgatcacatatgctgaactcagagtaagaaaagatggtcaaagacaaacataagtcttctaactctctgctgtacaatgctgtagcctctagtcatctgtgcctatttaaatttatattaattaaaattaagcatttagttccttagtcacactagccacatttcaatgtacaataactacatatggttcatggtttattagacagtgcagatagagaacatttccagcactgcagaaaattctagacagtgttcttctagattaacgcacagtaaacttccttaaacaatcattggtgtgtaagtggggacagtggtcaatccagaataaaaataaaaagccaagcacatagagtgactcatagaggaaataactagctgattgagtgtactacttgttaactagccatgacaaacagatataggccaagtgacatttttaatcatgaaaacattgcgtaacctttaatgaaaagtagagctacttatgtcatcttggacataccaagagacaagtcttttaagtaataggatcttgcattgagagaaacagtgttaagcatattttcacagcaactctatagaacattacagaatttcaaaattagaaatacggagattgcatatagtgacacaaaaaatatatactggcatagtaagtacaaccaatttatgctggtacaaaaaacaatatgctggtatattaaatacaaccaatctctttttaagaaattataaaatcagttctacagtgagaattcagttatatatcagctatgtagagatatggataattactacaggataacaggagaaaacaaaaatagctggtatatttgttgaagaattatgggcatttaacagaataaagtattacgttcaaatattgccaaaatgaacaaaaaaaagaaagtaaataggcctatgctattttatcccaacaataaaactatgcagtgttttgtaacactacctgtatgttgctctcacctcaatacctttatggaatcctatgtatattctgtgtcatacagtcaattgatgttctgatcaaataaaatacccccagaaggagtattttcaaaaaactgaacaactggaagagtctttaagagtttatgtgacccaattctctgctaccacagtttttaaaactgaaacatagcaatttaaaacttgggcaatttaatgcaagtgtacatctagtacacagtgcttttgtgtgcatgctaacttatctagcacataagccaggtgataatatgccaatttatttaaatatgtacttacataccttccgcatgatcagatcttagtagaactataaaagaatgcatcaagtgctagggaaaaatggcaaatctcacacattacaaataatgttcccttcaaagtgatatataacttgccccatgaatcaaagctcctggtttcctaaacgcagttgtgttctaaaattgtacagattaaggttgtatcattcaattctataatttttcatatgaagtatattggaattagaaggatgcataattagattagaaatactaaaaaaagtaaggtcttctacagactttttggtgagtgctgcatttgccaaaatcatgttttaagtgttttacttgagaaaataaatgacaagaataaaacaagttcaataacatctaacaacaatttgatcacataggaaagatttggacttcaacccccccattaacttctatgtggttatatatgttcttaggtattacatataaatatgtgttttatcacatttcaataaatttatgctcataatcatatctctttaatgaattattactattttcctacaaaaatcatgagtaacccccaaagttatataaaattataaataagattatttataccttaacaggttcaaatagaaaaagccgtcatcttatattgggtcaaacattttgttggaaggaacctctgggttcaagttcttgctaggtcactgataaattattctgcttaaggcactttacatctagtttcactttcttcatcactaaaatcaaaggatgggggaggtgttctctagctccttctagtttaaatatacctgactataagttgctttctcaattcagataacttacctctctcaacacaggatcagttattgaattcagattgacagctccttcataggtcaagtaatagaacacattgagggctcggacagcttctggtccttgctgtttatagccaaaaatgagatcaatccattggtgaagctggcaggaaacaaattcactctccagggcctgaaaaaaggtatacattgtattactatgctgaattcctttttaaaaatatagagagacatttagagcaatcagtaaagtttaacactaactttactgtgaacaaagatttttaaaaaacaaaacttgtggccgggcgcagtggctcacgcctataatcccagcactctgggaggccgaggtgggcagaccatgaggtcaggagtttgagaccagcttggccaacatggcgaaacccggtctctactaaaaatacaaaaattagctgggtgtggtggcctgcgcctgtaatcccagctattcaggaggctgaggcaggagaatcgcttgaacctgggaggcagaggttgcagtgaaccgagatcacgccacttcactccagcctggaaaagagcgaaactccatctcaaaaaaaaaaaaaagaaagaaacttatctgatgtcctagtttctaccagaatctgtcctccttggtttataattagaggctttccggcacttggcataattaattacaataaatgtgtaagtttcagtatttttctaccgtactgacagcactgaggaccaggactgggcctatcttggtcacatttgtaactcagggcctgacaggtactcgatttatgcttcaaagaaaggaagccatacaaggcaaagactattttgggaaactaaatgtgaaaatgttaaaaatttaccatccacttgaaatatttattatttttctagaattaaaatattttgtagtctatttcaacatgtttaaccaaattatttagttatgttgattgagttcttatgctaacaaattagattttgtgggggatacctataattactgaatttttattctaggtattaatatcaaacctgaccaaatatttgatgctattaacataatagtgtccaataaataacgaatgaacacaatcaagtatttggttgagatgctaggcacaagatccatttcctatccatcattatattcccagctacaagcgttgtgcctaaaacataatagatgccaataatgtttggtgaatttaataacgttataaatactaaagacttttaaaaactaaagatattttttaggaaactatccatctttatattatttaatattgttcaaaatcattccaacatcaaagtttagcattatggattagtttaacgataaataattatattaaaatcaaagagttttcaaacataaactctaaagcttaattaaaagtatacagtaggccgggcacggtggttcatgcctgtaatcccagcactttgggaggctgaggtgggcggatcacgaggtcaggagatcgagaccatcctggctaacacagtgaaaccctgtctctactaaaaatacaaaaaattagccgggcgtggtggcgggcgcctgtagtcccagctacccgggaggctgaggcaggagaatggcatgaacccaggaggtggagcttgcagtgagccgagatcgcgccactgcactccagcctgggtgacagagtgagactccgtctcaaaaaacaaaacaaaacaaaaaaactatacagtaatcccccctcatccacaggggtatgttcttcgaagacccccagtagatgcctgaatctgtgaatagtaccaaaccctatacctatatgtactatgttttttcctatacataaatacctatgataaagtttaatttataaattaggcacagtaagagataaacaacaataacaacaaaattgaacaatgatatactgtaaagaaaaaccataataaatgttatgtaaatatggtctctgtctctatctcaaagtatctgattgtactgtactcacacattttcagaccttggttaaacacaggtaactggaattctggaaagcaaaactgtggataaggaggagactgctgtaccaacttatatctggtaatgtatctcattgaaattgatttttatttttagagtagtaagtctatgattgtgatgtattttcagtatggcttgctgctatgttataagagatctgttggttttaaaacaaaactgaccaacttgtatagcaagtaaccaatgagacataaaccatcttgtgacaaaagacgttcctattcctttacatgtggacacttgtgtaaagatacgctttattaaaataagtgcctatgaaaaagaaatgtttatagctaaatacaaaaaaaatttcctttaatatttaacatagctttatgatatatcacaaatataaaattgaaaatataattttgtaaacaaaactctatgcaattctcacatcccaaagtatactttaaatgaaatatgccttaaaaatacttagctaggttcaattgagaaagttattgttttagacatctcttctaaaatgctttacatttacaaatttattaaacagatatgacagcacaaaactgcttcatattttacttgaaataagaagagaggagcttgtgataactttaagtaaatgcctattttaagtacataaatttgaaaaaaatctaggaactactaatgcaagttacacacagaaatgatacgttggtttcattaacttagaccttgggtagggatgggggtatggggtaggcacatttacaatgacacataaaaacagcaattgtcttaatttgtgtgcagtgcactctacacaaaagccctaaatatgttcaaattagagcaagctgcttgattgtcactgcagtctcatgtcacattaatgcatgacaaacattaaaccatacacttaaatggcaatttatatcatttaaatgtttactgccagactagctcatcactcatttaaatgtgactttctgacagctaatttcagttaattttctccaattcacttaattagaactttcaatcagggaaggacctatgcatatcttcaggcttacatcctttttggtggctgttcgaaatctgagttcataaactgccgaaaagctctactataatagattagcatataatatctctgagtttacaaaaaatatgactctatgaagagtatatactcacagtatatactcttagaaagaacttatacttatttatgtaaatagtactcttgccagtagtttaaataaaaaacgtgtagttcatatacacacactattgaaacaataaacaaaccctgcatccaagctaattaaaaattaatgatttcaaaattgtttaataagataaaacagtcaggagtctcctgagtgtccatggtgttgtgatttgagaccataaaattctagaaggctcagcaaatgacaaagtacaaatgaattttctcaatattaaagctctaaaaactagggcaattttattttatgtgtcaccaaacaaagaactgttgaattttccttacggttgactacttctttatgcacactcaaaatggtaaagttggttagatttcgatgcttaaagctttacatcttgatactgcatcagaattttaagcaaaaatgctgaaaggaaagctaccgtgtgctcatatcatgctgcaaacacacatgcagagatcaccacaatgccatggttcagacctcaccttacattgtcataggtcagtccttaaggagttgaccagtaattcgcggaactattggcaaaatcacttccagaagttgataaacacgttaccttcatgaatatactttaaataatttctcaaacactcaactaaaaattccattagtcagcttcaagcatgtcttgcaatataccaaagctttaaaaagggacctaaaagaacaaagtggtaagtataagagaattccaagaagtttcaaagtcatttcagtacaaagtcagctccgaactttaacatccttttgctatcagtgaatgacaactgcctaaccaaaagtaggtaatgcacttaagacttgaggggagagagaaggacaggcaggaagaaattaagggaaaaaatacaaacagaatgtaattcaaaatggaataccctgaggttgccttttataactcccatttttaagatttaaaaacataaatcataaaacctatattaaaatagcttttttatatattaagattttttaaaaaaattcttcatatatagaaaattctcatttagatctacatttttagttacaaaaaaatgaaaaatgccagtggaatgctgagcatttgagatttttcaaagccttcaaaaccgacagtcctcattaagcctggagttaaatacggtttgcagctaggggatagtaacattcttcccatgctgctctcaaacctaaccaatcaattgttagtactcccctagcaggctgcatacatcacttacatccaatgtgtgctctgagtaatatttgtaaaaaagaaaatccactaaaatgtccaacacaatataataatattcaactcatctgagttattataaaataaatcagtgactaatgtccaattgttaaggatcagataagactatgaaaagactatcatatgaagcctcacacgaatgttcaatccaatccagggggactcatattagtgttgacaaactgtcttggcgctgatatctgttttttttaatgagatctattaggcagagtaaaatacttcagatatgctaaaaagtacagtatacagatgtcaaatacacttattactaactttcatttgtttgttctgcatacagaatatcaacaaagttttaatattataaagataatagtaaattattcataaataggaggtttgtataaccctgtgtcagaaataattacaatatgtgtgtgtgtgtgtatatatatatgtgtgtgtctgtgtgcatgtttagcaaatctcactgaaagaacacaatctatgctttcctgaaactaactcacttaagaaatagattatttctttataaaaagtgttatataaaattattattttctatagtggagtcaaaaaatgtgataacatatagaaacagctttttccaagaaactctaagctatttgagaataaaaattctaaactaaaaggcattaactatgtatttaatctacacatgcattagtgatacactagcaatttccttttattttcaaaaaaccaaatttttgccaatgtaaaaatcaagaaaaccaatttcaatcaacaaaggaaattattagataattgtttacctcaagaccaagaaaccttatttgtttattatttatgtttctcatacttgtcattcccagcttaatgctaatatttacttattctttggctaaacattctcataccactccattaaaaaaagaaactaaataaaaactagcaatatctatgggataaatgatttttataaaaagttaaataaaaagatcaaatattctttatacactttttataaccagagagaataggcctaggcagcccagaaatacatttctgcacacctgtaccactacttccactcccaggcttctagaaggcccaaggtacaaaggttctgagatacaaaataccatagctgtaagtttcaaatgagaaaatgaaaatcactgattaaccctcctgacttgaaatacatttacttataagatgtatttaatcgtatttataatgaatgaaacatccattttgtaaaattttaattgtacttataattaagagtcttaattcatttgaacatagataacagtatgttttaaaggaactgacattgagattggcaaggcggtaatatacaaagttataaacttggaattttaagtatttttcattttaaatccatgtaatacggccttcttcctatacaaacacatatacacacagagatttaaaatgaactggtctgttatgtttgcatgtgttggatttcaaacactagtggtaatgtttccttaacattgatatatgacctttgtaatttacattgaagaaagctgtttttttcagcctaattagaactgtttcaaattttcctgctaaatatatgatataaagtcctttcaacttttttattctagagtttctttccatgtcaactttgttccaatcaaaatatgctttgaattaaatgattttgattgaatatgtggatcacatttcacttctaagatgtaaagtccaaaaaggaaaagtttagcctgttcaaacaaagcaagagcagccactttgcggaaagctattcacatttaagaagactgacaaattgtttgtgtgcaccattaggtctagtttctgcaatagttgccagatttcctgtccccctaataagatgcattaactccttaaatgctggctctgaatttgcagtgaatctgagttactttagcaaatttcaattttatctataggtaaatttccttatttgaaataaatctaaagaaaataaaagaaaatttgatgttaactatgttgtatcaaaattttctaacaaaggtcacagaaaattaacattttttcatattggttggatataaattcagaatacaaatatgttttctatatgtgacttgccagaagtgacaaattcacatcaatcctcatttaaaaaaaatgcatcaatttcactaatttaaagattacatcttcaggtaaaacacaatggaaatatttaataaactaaaatccatgaatatgagcatcaatttcctccacattgattatatataaaacacaatgcttcagagttcagctatttaccttaatatacatatatatataatgtgaaacaagctttatcctatttacaaagaaaagtttaattttgagagcttaaaaatatgtgtgaaattgtgacattaagatcaataagtcatgaagcccaagaaagtaaaaatggaggatcaaagatttagggaaaaaactgtgggatgctaagaataaaaattgtatcagacagttttaaaaaatgaaatttagtcaacaacatactgaagttcagcctgaaaagcagatagagaaatcactaaaaggggttctatacttctaaactgcccttgaactgttgggcagaagagatattttgagccagcagtacacagttcatttctacatttatatcattactaaagaaaagtgtgagttagtatcgtatcttgatataactatcaagcactcgtgcatcttttggcaggagaatcattctgtctacgattgttattgtgtagttttaaatggactagtcaaccagctgttatatattttatacactgaaggccatgtttcctttgaaattcatagttttaatctcaactgaagtctgtattgctgtgtgccaagatcaaaaggattagacaaacttgtacaattaccttcctttacagagagatgatttttaaaaaatgtttaaaatactcctatatactgacattttatccaactattttctttagaactacagaacattaaaacatttaattaacatttcaaccttaggtcacttttcatctaaaatctaggaattcacaacatacagatatgctaaactaattatagtatcacacacatagggatattgagcttttttttttttttaaaaaaaacctttagtttattaaaaatggatggggaaaaattatacctatttcttttatgtgtttgcattttgcaagcctttgctcagaaaataattcatagagcttacagtgatatatatgcagcaagatacaaaagagaagtgaggcaatgcaaaatttaaagggagatatcacataaaaactatgccatgaaatttcaaatacttgttttaacaaatctatatatgctgagccatgtatttgctgctaagctttctagcaggcaacataaagaaagaaacacgaacaattacaggagacaaaaatgaccataatgtaaaaacaaaccagatggcctggaaaaacacattatttctattcctgagataagaaattcctcccttggcaatatgatggaatccaggtatgtaactctcagagggactgagttaatcctgagatagatttaaagtatagacaaatggggagaccacatattcttcagataatcttgcacaaacattatttctcttagaaaggctttgaatggtaggttctagattgtgcttcatgacaagtacctggaattaagctattttattttgttagttaaatgcagagctaatatgctttgataacaggtaaactgagtcccaggactaataacctcctaagaatgtgaagagtataaggagaaggacacagcctgtatgaaaggcaggctcaccattacttggaaggtagactagcctgccttaaaacaggctcaaaggtaaactttctcacatagataaatatgcatcaaaaacttccaaattccaaacatgatgctgtaatatttatagacattaaaatgtttaaaacaggtatactagatgttcaactctttaaaaaattagtaaagtatccctagaaacttaatgttgaggactttatattgctgttatattttctaagataaactagttataaacatagacataagtaattaaaatattaatttaaagtggtcaattatccacctaggtatagaaaaatgaatgtttcctcttcagcagccatcacaaaatgtattaatttactgtatgaactcctgtaggttttatattatatagtcagttacaaaaggaaggaaaacaaaataaaaaaaatttaatcccttcccatttgcttatccatatagatctgataaatactagcagtctcttgcctttgaagatggccagaccagaatctctacttattgccagatgtagtttaatcccatgaggactccagacaaaaacaaggagctgtctgcatggcaccaatgattccctggactgactgccataaacttatactggcaaatcaaaatccttggcaaagtagaacatttattatgtcattactcctaagaatatccaataaagaaaaacttgaattaaaaaaaagcaaaagttgctgaatataaagcattaagttctgccagagaatcaaattacatctgcatttactttgtgtatgcgattgcatacttgtatattatataggactaaaagtattatacattctgcaactttctattaatgttagcatctctctcatctattcattcagtaaatatttattgagtggttactattggtcttgtgctagactctggggatactgaaatgagacatccctttggaagaaggaaaggggagcaaaaggtcagctctaagactactttcatagtctaagtgagaggtagtgagagccttaatcaagaaagtagcatccggagtgaagaggggacagagttcagaaagatttaagatacaagttattacttacagcaactgattaccagtgtgaggggtgaagaaaaaggaattttgggtgatcagtttgaaccttaaccatactagaggagaaattgtttacatggtagaagattagttgagttttgaacttagtattaatattttggacttccttttatagacttgaaattaaccctttgttttggatctaaggctgagaattttagtggaagtttgtacactattaaagtattaaaatatgtttgaccaggcgcagtgggttacacctgtaatcccagcactttgggaggccgaagcgggtggatcacgaggttaggagttcaagaccagcctggccaacacagtgaaaccccgtctctactaaaaatacaaaaaattagctgggcgtggtggcgcgcatctgtaatcccagctactcaggaggctgaggcaggagaatctcttgaatccgggaggtggaggttgcagtgagccaagatcacaccactgtactccagcctgggtgacagagcaagactccgtctcaaaaaaaaaagaaaaaaagaaaatatgctcatgttcaatagtggaatgcacaagccaaaaaaattctgtgtaacaaaatcaccccaaggattttataccagttttgtccaacagatatatatccatgccagatatgcaatttaaaattttctagtagccacatttttttaatttataaaaaattttttttaaaaaatgacacagggtctcgctgtgttgcccaggccagtcttgaactcctgagctcaagcaatcctcctgccttggccttccaaattgctgggattacaggcttaagtcaccatgcccagcctatagtagccacattttaaaaagtaaaaaaaaaaaaaaagtaaaactgttttaatgacatggtaatattttatcaagaatatacaaaatatcatttcaacatgtaatcaacatagaaattattttgtattaaatctcagaaatctggtatacattttacacttacaatggacagcacatgttgatcacactagccacatttcaagtgatcaacaaccacatgtgactagtggttatcaactggacggtgaggctttattcagttccaaatactgaatctgcatccagattttgatacaagacagaatgcaggagttaacaatacttaacacttttaaaatacaccttatcttactgaaaataaagataaaccttacaaagtacgaagtaactgccagactaaaatgaccttcaatgcagttttgaagaggccattacaattctcagtgccgtgaagaatggctacaccttaggaaatgacagcagaaatgtaacatcttcaagtgtgaaacagacataatgtcctacagtgtatattcttcagccatttatagatctctgaggaaatgtggcagcatctgaaagacggcattatgactatcctctaaataataaaggtaaaagggctaattctaccaactatgctgtaatctataaactttccatccttaaaggtccttagttagagttcttaaattttggctactcagctctatcagttatgtactttaagaattaccatatagccatagaccacaacttagtataggggacataatctttgctgaaagtcagatatatgacatctgtaatgtgtatgtattcacaaaactcataaaagacacttcattttagtagcagataacgagtctctgtctactcctagagattttttaacatctacaataacattctgattcccaaaattttgggtctgactctttctgcattttcgattaaataatgattagttaatagggtcagtcttttaaaattatttttaagtagccatgaatacatatgcaatatgaggtcaacaatagagacttcttgcaagagttaaatacatttcttatttatgtttccttacctccctttcacttcttaactagtttctcctctttctgttacaggcacaccactgaaaatgtttttgcaaagattactaactgtctgaatccagtgtatgctcatcttttctcatttcacctctgcattatggtgtttgtttctctttcttcttctcgcttgacactctctctccagattctctttctacatttctgattttcctattcattttcttaatatagggtctttttcctctaacatttcagcatttattctcctcaagattcagtcccaggccctctgcctctggtataacccaggctagatgagccacacttcaattacttcaaccaacaattactacctctctggagcttcaaatacaaaatgccaactgcccatcatactacttttttttttttttttgagacggagtctcactctgtcgcccaggctggagtgcagtggcgtgatctcagctcactgcaagctccgcctcccgggttcatgcccattctcctgcctcagtttcctgagtagctgggactataggcacccgccaccacgcctggctaatcttttgtattttttagtagagacggggtttcaccatgttagccaggatggtctcgatctcctgacctcatgatctgcccgcctcggcctcccaaagtgctgggattacaggcatgagccaccgcgcctcgcccatcacactactttttttggtgtgcttcacataactcaaaattaatatatcaaaaaccaaatgaatagtatttcctctgacacttgctccttttcttgtctttctggtgagggactaggtccttcatctagtcagccaattcagaaatgtggcagtcatcttgacttctcctttcccctctccctacaaaattttatcagacaataagcctcctaaatatcttcccaagtcattctttcttttcctttcactgggactacctttggtttcatgcttcatgatttctttgttcagttattctatcggtatccaaactgtttctttatctctaaaatttcccttttcaatccctcctccatatgaactgctatctaaaacctagccaagtcactgctctccttaaaacttttctcctttccctaaagcagtggatctccaactttaacacacaccaaaattagctggagaacttgttaaaacaggctccaatccacagtctctgtttcagtagatcaggggcagagtccaagaatttgcccttataacaagatctcaggtgatactgatgctgctggtccaggaactccttttggccaccacctccccaaagaaaaaagtccatactatttacgaggcattaaagatttatcgtacaatctgcctccagccatatatttccatacacaccacccacagttctctcaaacacatacttcagtctaccatctgaattaagtttagctcatgtggctgcatgcagtggctcatgcctgtattcccagcacactgggaggctgaggtaggtggatcacttgaacccagcagcttgagatcagcctggcagcctggcagcctgggcaacatgatgaatccccatctctactgaaaatacaaaaaaataaaaaataaaaaatagcaaggcatggtagagtgcttgtagtcccagctacttgggaggctcatgtgggaggatcacttgagcctgagcagttgaggctgcagtgaggtgtgattgtgccactgtatgccggcctgggtgacagagagagaccttgtctcaaaaaacaaagcaaaacaaaacaaaaaacagtttagctcatgtacagtactataaccttgatatctttgttcacagcgcttcttatatctgtaatgtccattccatcatcttactccctgcctggcaaacccctattcattctcaaagactaaggttacatatgggttccttggctaagccttcctcaaccttccccagaaacagaacaaggcatttcctcttttggtcccagaatatatatttattctctctctttctctctttgtgtctctctctacacataatgttaaatgctttcatggtaatcttgctactccttcatggtatatatacaagtatatttattatattacatgttatcacaagttatatatttgtttacttttttatttattatctatttcccttacaaaacaataaattccaaaagggcaggtactatataccatctttctcactgctgtataaccagtatgtagtaggtactcacaaaatatttgtagaatgaatgactatatcgcttaatctatttctctaattagttactgtcatgtctgtctgcttctcataatggcagccccaaagggcaggtgtcacagtcttccaattttgtgatcacagatctaattatccagtaggcccctaatacatgtctgttgaatgaatgaatggcatttaagaaattcttctgatttaccgcaattcaatgtctatgctgagggactagatcttaaagcactgtttaagaagcgtgaaattgaccatagccactttacttggttgatacagtgctggtttggcagagttatagaaaatttgaaaaatttctgtgattactagccactgcaaaatgagctgtctgcagtttgttaaccatacaatcaaatttgaggtagaatgattacatgggaaggaaaaaaaagtgaagtggatattaaagtatcatctttcaaggttttattttctcttcaatagtgtccagaagacagatgcaaatgatatccctaatacacttgacaaaagctcaagaaagtcagtatgttatgcaaagaaaatgcatctagaggtcaacttgggggaaatgcactgtccaactaaacaaccaccaccacactataacaataccagcagcatttaacatttagtgagtatttatgctgtgcccagctttatgctaaatgttttacatggactattttatttaatccttacaataatcctataagcaccacatttttaaaaactgttttacaaatgaagctaagaatgcttaagcaaattgtctgatgtcacagctagtaaatgtcagagttgtgacctgaacccagatttctctgactcctaaagccatattaaccacaacacatccttttgaaccaaagctgcaatatgaaaactctaaaaatatgaaaccactacataacatggattacttttcattggtttcacatatatcatttagaaatactagtaacaagtattgctgagtatatactaaatctggtgtgccatgttgatctggaggctttatttacaggttttactgttctttcaactggttttttgctttgacacatgcatttttaaaaccaatactttcaacttgtattacagcttatttttctcttttattaactggaatgtaagctcctagaaggtatagattatacctgtattcttggaactgagcatatagtagatgcccaataaatatttattgagctggataagaaatttatattctaggcctctttttcattaatgtaaccatatattcactataatattttatatcataataaaatatcataaaaatgtatatcataaatatatatcataatatatatacacacacagagagaaagtgtgtgtgtgtgtgagagagagagaaagagagagacagggtgtcactttgttactctggctggagtgcagtggtgtgaacacagctcactgcagcctcgacctcctgagctcaagtgatcatctggcttcagcctcccaagtagctggactacaagcatgccaccacacccggcgaatttttttatgttttgtagagacagagtttcaccatgttgcccaggctggtctcgaactcctggactcaagcaatctgcctgccttggcctcccaaagagatgggattacaggagtgagcaactgcacccggcctcattatgatattttaaaaataaacagcctttagagcaagacagagaatgataccaatatattagttgctaagtccaaagactcttaataaataaccaatccattaaacaaaaaaactattttaggaatagttaataataggagttcattctgcaaatttctaaacgtccatgacattagcaacttatgaaaatgtgattttaggctgggcacggtggctcacgcctgtaatctcaacattttgggaggtcaagatggacagatcacctgaggtcaagagttcgagaccagcctgaccaacatggagaaaccccatctctactaaaaatacaaaattagctgggcatggtggtgcatgactgtaatcccagctactcaggaggctgaggcaagagaatctcttgaaccagggagacagaggttgtggtgagctgagatcccaccattgcactccagcctgggtaacaagagtgaaactctgtctcaaaaaaaaaaaaaaaaaaaaagtgatttcatgtattttaatttctatattttgacacatgaactatttgatttccttaaatcaaactactatgcagaaataacagagaaaatttctgttatttcctacttaaacattttcatgtaactacccgattggttctacgtttctgttaatatttggaaaataccttaaatacttccacgtaataacactgctcaaactattcaaaatattgattagatttttttattttaaaaaatgtatagcacaaacattatttgtttttgtgattttaatatctcttaaatgtaccatttgacaaatgcttttaaattaaaatactataactgataagaaaaaacagtctcaaagaataaggctgttttgagattttttttaagcctttcagacaacccctatgatagctggtaagacatattagaatactataaaatatgagttagaatcactatctttattagattaggagaactgaataaaggacataactgtattcactctgaggctactattttcctcctttgttcttcaaaaatataactctttttgtagaatgtctaccactgtagttaaattcaactcataggatgcagttataggtcagaatctagcaaaatatattagaagcaatctaagcatttaaatttttcttaaatatgaggtgaaaagacaaacagcatggcaagagttaattgaaacattcctgtttgagagactgcatggaggagtgggggctggtggacagtgagaggagggagctaggccgagagatgcagagttaatcagggagcaaatccaaagccaggcatggataggcctcactaatgagcctcaagtaccctgcagtggttttcaaacttaactggcttcaaacgatgccaccccatgacagaatgcagctagccataagaggagggtgattagaataaatgactggagtaattaactctgatgtgaaaccacctgattggaaaagagaagccaagagctatttagctgatggtcctccagtagaaaaaggaagctttccctttctcttgtgtgggtgttcagttagaactcaactctttcaagtaggtatttggtagcactaatgaaaagcagctttcattcaagggcctctcaagggccttcccattcattttgaaaggggaagaaaataaaagcttcaaagtagaactaatttactttactcccctacctcttagtgaattttgcattagtgaagtctgcattagtatttatgctaacaaatttacctccaaataacgtcatcaaatactaaaaattttatttatagaataactagatattaaggctaattaaaattttttaaattttcctttctttaaaagtgttttagaaaactaaacttataatttataattaattgttgattagttacagcacttcctttactctagaatgagggagaagtaaaacataaatggggtacatctgtttttgaagagaaaccagagaataaggtggaggtaaggaaagaaagaacacatatttttgcaaaaagacagttttcttacagtgcaaattgagccaaagaatccaccacactctctggcctgctttattttataaaaagaggaattacaaagacttggggcattactgcctgctgttttacaagtaatcatcaattcattgggccaatgttgttctgtacctgctgagttaatgttcctcggcacacccctcccccaaaaacaggttcacaagctgcccagtaacaactacagcgtaagtagcacatgtaacttagcaaatgtttatgccgaaactcggatttatttgacagctttacacctttgggcatgatataattaaatgttttgacagctaaacaaaaactgtataaatttaaaagctattaggagctcagcatctagaatcaaaatgaagtaatttgcttataccctaagctacttttagtaatgcattccaataaaaagcatgaagaaagggataaatgtctatccgaatgttttagctaattcgttcatattcttctatgaagaatattctccttatactgataataaatggcatcttaaaaaggcaacataaacgcatttaagattgtcaatataatccctaaactctatctctggatattttctgtaactttagaaatggtaatattaaaaagacatagactaagaaatagtatattactgtatttttaaaaggccaccatgtgctataaaaaaggattgaaagcaacacagggacagtgaggtatccttcaaactcagccattaataactcaagggggttaatcctcattctctcaaggtgccggttccagattttcacaatatgctatgctgctgtagtcctccgagatttcagtgctcacttcataatacccccaattcacagtttaccttcggagaaaactactgttcattatctgagctccagaaaatgttcccatcagtggtactactttaacacaagatttaaaaactcagatacttccttaaaaaggaaaaaaaaatactataaagcaaaattgtccattaaactacaattttttagaaaatgaaaggttgttttatacccaccatatggcatcacattatcactctggacagcacatacagagtactggctaacagtctaacaaaagttaaatttaaacagcatctaagttagaacattactgaagcattttcaggctatgtatatacaaaaacatttaaaatttacttttcattatgtaacaatctaaggaatactgtatcttcactaaaggtaacaacgatcagttgtttatttaaaaaaacaaatcactaaaatgtttgaaaaccagtccacttttcatgtggatgtttatatttcacttaatcatccttcttggaaagacagctctaaaggaagaaaatactgagaaccaaatcctgtttaacttacacaaggtgatgtcaagtaatttaaaaaacatattctaaaaagagcttcttctgtacacatctaaagacattactgcattatctaattgttctcttcctctcactcatgttaacaggatagatgtctttttgtgtaccatatttggtttcactggcacatagcctgaaaacagattaaactgtttggagtgttcaaatatctgatggtgtatggactgtgggaataagagactggagactcagaagctgatagttcccaaacagctattttccttctttcttttttaaaaataaatgaaccttgagtcagattaattaaacactggttataagactcaatattcctagtagataaatagatgtttgaagacttagtcaatttcaggcccaaaagtaagtattactaggtgtaaaatttgtttaaaagatgtcattaaaatattacatattaaggtggtcctcttaatataatcttgatgtcttttaactatctcattctttctcttctccatggacatcatgttttgcaaaatgttatcaaataatcaaatgttataaaataatctcacaaagatgcatatatctgccagaccttctgattaggagataaccagtggtgctaacctgatataatttagctgaaagcacaagaaggttgaatttaacccaggttgcctttttataggtaaatgtactatgttcagaatgcttagaaattgctgtggtggctctaatggttcaacaacctttggctgagacccactgaacacatacaaacatatgatgcctaaaaaaatatactttttttttttagaccaaacacctttgtttcaggtactgctaagaaatataagagctgcaaaataattataacaaaatgcttacttatgcagaattttaactttagattcattgaaagaactatcaaactttttgacagattttgctaagtattgtacgtatataaaaaagaaaatataaatgaaatatttgtaaaatgtttgagagtctacctcttctgaaatgcttcctgattcaaaggtgttgatttctgtgtttctccatatagtactgtcctccatgcctttataagagcattagtgaggcagcattttttaaagagtcctccattattacatttgaacttttcttccaagtatcatactacaaattatgatgctgacatgttcttgatctttttgacagccttgtacacgtgccttagggctcccagtgctttcttcatgactgctcaatttctagcctcttctagtttaactatgatacttctatctcaacgcctccactgtgataactctatcttaaaacttaccaaaatacattaagaaataatgttttgtggagtggaagacagtttggcagtttcttacaaaactaaacattctcttaccatatgatctagcagttgcactctttggtacttacccaaatgagaggaaaatttatgctcacacaaaatccttaacataaatgcttacagaagttttattcacaattgccaaaagttggaaacaaccaagatatattttagtaggtgaatggataaacaaactatggtccatccatacaatggaatattattccaaaataaaaagaaatgagctatcaagtcacacaaagacatagaggaatcttaaatgcatgctactaaatgaaagaagccaatctgaaaaggttacatactatatgattccaactatatgatacattggaaaaggcaaaactatggggactataaaaagatcagtggttgccaggagtggaggaggaagggggaatgaataggtggagcataaggaatttttaggacagtaaaactattctgtatggtactatacatttgtcaaaacctacaggaagtctaacataaaagtgaaccctaatataaaccaaagactttagttaataataatgtattgatattggctcatcagttataacacagtaagtgtaccacactaatgcaagatgttaataatatggtgtactgagatgaggaatagtaagaggtatatatgagaactctctaaaggttctgctcaaattttctgtaagactaaaactgctccaaaaaataaaactgataattttttaaaacatgatgtttatatttttctcctcttctttgtcttccaaagaatatctcatgcctaagaaagttgctggcacatattatgggtttcaattgctactttctaaagcgaaaggagtatggaacccaaaagaaggatctcaaacccttcattcccaccaaatgtgccacggcctacagagaaagaagcattaattaacacatttaattaattaaactcacacttttcatatcacgtatatgaacatgttctagtatcaatattaatatataatctatctccttttcatagtaggttgaaaagcatgagctgcaagctactaaatttttttttttttttttttttttttttggagacagagtctcactctgtcacccagcctgcagtgcagtggcgtgatcccggctcactccaacccctgtctcctgggttcaagcgattctcctgactcagcctcctgagtagctgggattacagtcgcccgccaccacacctggctaatttttgtatttttagtaaagatggggtttcaccatgttggccaggctggtctcaaactcctgacctcaggtgatctgcctgcctcggtctccaaagtgtcagattacaggcacaagccaccgcgcctggccgcaagctactatttatctaatatttatatctcttattatgttcagggtactctggctgtgtcctgtgggataaagacaaatgaggcattctatacttgccctggaggaactccagtctaatggagacacaggaaaacaagtatgtccaaaggtacatggaaagcagagagctgagaacataaaacaagcttaagcaatattatataacttattttataaatatataatattaaataatgctattttctatatttgttaggtaaaaatgtgactcacatgaattaacactcaagataccataaagcttaaagttttaaatgctgtctatattcctatcctaaaaatatttcctcaaattatccttaaacaaattatgaactgcctttatgaagcatatttcattttcttcaattatttcagcctttggttcatagtcctattccttgtcatcattcttgatagcttcagcatttcatctaatggttcttctctggaagccttccttttctactcattttagccacttttaagcattaatgtacctttgatttaataagccatgtgattcaagtctgcatgaaccattatctcttattctatcagttaatttttctgtcagatgctcgttatgctaacttcttgtgactccttttagttcttaaattacaaagataatacaataaaaacaaccagtaagtgtttgcttactatttatttgagtactgtgataatttctataaataatatcaattaattctcaattttatgtctccaaagtaggtgcaccaaaccactacaccgtattttatttctgtataaaatattattgaaaatgttggctgggcatggtgacgcatgcctgtaatcccagcaatttgagaggctgaggtgggaggatcacttaagcccaggagttcaagaccagcctgagcaacatggcgaaacaccctctctacaaaaattagctgtatgtagtggcacacgcttgtggttccagctagtagggaggctgtgagcccagaccatgccactgcactccagcctgggtgacagagcaagatcccatctccaaaaaaaaaaaaaaaaaggaaaggaaaagaaaaaaaatccaaaagatctggagtcatagcctgggtaaaatggttttgaaatcttgggcaatacttaacttcttaaagcttcaatttattcctcatttaaatgtaaaaacaatatgttccttataaaatatccttattattaaattatatgcctggtacgcagtaagttcttactagatattagttctcctcctgtgatggccagcctccaagatggcccttgatgattttcatctcctatactaagtacagctgacctgtgtaagcaataagatagtgcagaggtgacagtgggagttcgaagactagtcataaaagatattgtggcttccctcctcctctcttttgaatcatttgatctgagaaatgctccatatggtgaggatactcaagcaatcctatggagagtgtcatgtggaactgaggcctcctgccaacatgtcaacaatgcgagacattttggaagcagatattccaccctcggtcatacattcagatgactgcagcctcagcaaacagcttgactacaatctcgtgtgtgtgtgtgtgtgtgtgtgtgtgtgtgtgtgtgtgtgtgtgtgtgagagagagagagagagagagagagagagactatgacccagagccacctagctaagccactctcaaatttcttactcaaagagactatgagaaaaaaaaaagaaatgtttattgttgttctagctgttgtatttttgagtaatttattacatagcaacaaacaaccaatacaactcctggtccatatttttctcagacctgctttacctgtttgaacccacactgaaccacatggtggttattttcaactaggtttttaagatgtaacctagactctcatcaacttgactgctctccatacctactttgttaatccctaatcttggtgaatcccatgatctaattttctggcttctacatatgggctgccataatttgttagagaaaaatcaaaacatatactaataattttactataaatccaagctatcttcagctgaccctcaaaatactcactatttttgtgtttctagttcactaacatcatatttccttcagtagctgccctcaattacacagctgccacactttccttctcagaagagtatctggctggcctttgacttcaaaatgaggacatcattaaatttttcttgatttttttcttctccattgcataatgtttatatttcaaccttacctctcctcttttccctgtgtttggagtagaaagtgttatccactttctatattaattcagtgccctcataccatctaaaaatatgctatgtactggttttcagtttctccccttctaagatattccttttctgagactattatctgctccagattctgctacctaaaaagaatttattctttaactccactaacatcccagaatcacctcttctttcatggacaccatacttctcaaaagccacgttcacccactctgtaatcttcactccttcactcaattccttgaaatctagattttaccacaaacactccatgaaaacttccaatactctcccttttatgtacggatgaaacgtttctccctctatgagagtgaactattgtggcagagactgctgttttttatctgctaaccactccttattttctttaataataaaaatttcacttagccagagacacatttccttgtctcccttataacctgataaggccatgtgctcaagttatggctaatgagatataaacagaagtaatgtgttccacttccagttgctcatctcaaaaggaatgggcatagttcctttccttcttcttactggctatgaagtagacccaccttgaacccagagatgggagtcacatgttatagctggaagattcattctcagcttcagactcctgctctctgtactattacatgagagaaaaacgagaagatataaatgatactgcaggttgggcatacctaatccaaaaattcaaaatacgaaatgctccaaagtctgaaatttttttgatcaccaacatgatgctaaaaggaaatgcttattgaagaatttcagatttcagatttttgaattagggatgctcaaccgtaagtatagtgcaaatattccaaaatgtaaaggaaatccaaaacctgaaatacttctggtcccaagcatttcaggtaagggatactcaactggtacatataacatatcaaaagtgtataattcttaagtatgtgaatgagaaatagtaagactccaaaatacagttgcttaaacatccgaaagaatagcttagcctgaaccataactaatatactcagtgtacggtcagggtcctagcaggaaacagaagacataatcagatgaaaatctgaagataatttaataaaggttctattcacaaaaagcatcaagggaaccaacaaactattttgagaaacctgcaggcttgtaacaacaagagggcatataacccataagcctgtaagagtaagggggggaattagtattactgaagctcgttgagtgctaaagctatagaagggaggctgtctggctgtagctgtagctttaactattgctgtagagggcctacagccctgaagcaggcaggaagcgggagcaagaaaaaatgtgaccccgttctcctcctgcagtcctgtctcctgtttttcatagtgatcagccctacaaggcataagggggacagaagggagttgtgggtaatgacctggggggtaatgctggaggataatcagaacacctattaataaattaaaagtgtattattacatcaggattggctacttttgaccacgctgaagcatatttttaaccatccaattcctcttgaaacagtctctctacttactttttttttgttttgagatggagtctcactatgtcacctaggctggaatgcagtggcatgatgtcggctcactgcaaactccgcctcccgagttcaagtggattctcctgcctcagcctcccgagtagctgggattacaggtgcgcaccaccacacctgtattttttttttttttgaatttttagtagagacgggatttcaccatgttggcctcaatctcctgacctcgtgatccgctttggcctcacaaagtgctgggattacaggtgtgagccaccaagcccagcctctacttactacttaacactaatgcactcttctatcactgctcctgataccattttataggttcctctttctcttcttgttttctgaaagaaaactatttcccagggctctgtttttggatttttgggctctatgtggtattgcagggtgaagtcataaaccctctatcttcgaccatcactcactatagataagcaccaaatctccatctctaacactgatctctcccctggagctagatcaaaggttgcatatttaagtatctatggaatccagataggtaaaaataattaattaggcaaacaatataacacattagagagagagaagggctgcagaaatctagaaagatatgcctacctatatctacaggggtggctattgctgagttccagttgattttactatgaagtaatgcaacccccacactgtgtctaacttttaaagaaaggctagaaatacagatttggaagaaggaaaggtgtccttattttactttttttttatggcaactccttttattaaaatattaggtagtttatctcagaaataaaattgaaatccctataactaaaaacactcagcagtgatgaataaaacaaaaatgtttttaggtcggcacaaaattgtggttttcgcctaaataaaataaaaccttttgattttgaaataagtttagacttccagaagaaatacaaaaatagtaaaagagttcaagtatatacccttcactcagcttcccctaatgttagcaacttatataatcaaagaaatattagcaaaaccagaaaatatgtactaaaccatggttgtaatgtgtaaccagcttttctccaatatcctttttctatcggaggacccaacccagaatcccacactgcatttagttgttgtgtctatcaattacaaaggaaaaaaaataacaaataagtttttaaatgaacactgtgttagaaagaaaacagcaaaagaaatccccaggagctataaacaaacaaacaattgtactacagagtggtaaagataaccccgggtgtttttgttttgttttgttttttcttttcttagtcaaagtcagctaggagtttgtttttaatgcccatatggaaaaagtagatgagaccttggctcctcttttaggttggtggaagtgaaatttccctatatataaacctgggaccctcaaagaaaccatgcccacagggaaaaggtcggggtgggagtgaggggaatctacctaccagtcaggacttaagaaaaagaggctgggtgtggtgactcatgcctgtaatcctactactttggaggccaaggtcggggataacctgagtccaggagttcaagaccagcctgagcaacatggcaagatcccatctccataaaaataatggaaaaaaaaaaaaaaaagaagctcttagtcttgacttgggcttaggataggaaaacttcccctaggaattcatatccacaggtctgtcccttatatagatttaggatttaaaagtataagcaagtagtctaaaatctacacagaaactggacctaggctttcaaacatggaagaggcaaaagcaaaaacactctggagaagcaactgtattcgtttatgcaatgctttgcacatgaaaacctggatctgtgattaagcatttaaggtaacactcataaaactatatcatttgcagtaaacatgtctaccaagtaaattaaaggacccttatactatgcagcagctaaagcaaagtaggatttgattaaaagtccttagaaatggaggactgttttaattctagaagtgggggaggagaaactcataccctttaactgactactacaagtctttctaagaactccagctttccataagacatgtacccacttaggagatcataggtcaggttttataatatactttataattaatataaaaaattaaccatgattataaatcaatgcctcatttataggagcctggagtctatcatacttgttttaaatgttttttataccaatttatttatttatttgttttgttttgtttttcttgccaacatggtgaaatcccatctctactaaaaatacaaaaaattagccaggcatggtggtaggcacctgtaatcccagctacttgggaggctgaggacctgggaaggggaggttgcagtgagcggagatcatgccactgcactccagcctgggggacagagtgagactctgtctcaaaaaaaaaaaaaaaatgccttgtccttgttggtacccatacccataccaggtaaacctatatttggtcacttgataatcacctgactttgcatgccttcttaaatgtcccatatcttgtcattctgaatagcattcaaaattatgttcatcagacgtaaatagatattttactaattagcatgatcccttacttcttatgtataagtgattgacagataatagctgactacctgccaatttggtttttgtactccattgagtataatacccctcctcaaggtaggaaatgttaagaattttttttctcatttactgctgtctgctgaactagacagctatctctaaaaggtacacaataataactgctgcttttcataaactgtttatagtcattcacagcctctatttcttctgtacgcaagtaaatcatgtttccagatgaaaatgaaaaatacttttattaatggcttttattatttttaaagtgctataatttcaaagatgttaattgtgtaaggatgtaaataaatgtaaactctccaggtcaattttcttaaaaggaagtccagatactaaaaacaacttcaggatgtaaaatgctgggaaacagcacgagcaactcatatgcatcagagacggaatcacattgtaagtaaaggtgttaggctgctctgtggacaggtaaagaagagccaaaacagctctggtaaacagaactcatagctaccatccaaaggtaagttaaacatacaggtaatgtagagaaagcctgccataaccacatgatgaaagcaagagcacaaacaaatgtcttcaaatcgaatgacaataatgttatgactatgactagtatgtaccttagcaatcactcagggaacagaaaaaaaatgatagattcagaatataaattcactaaaatgatttcttagctattttatactattatttatgtaataataatttgttatatattcttactattgtattaatttacccattaataaaagacactaacaataagccactacattaaaatagcagatcaggccaggcatggtggctcatgccgcctgtaataccagcactttgggaggccaaggcaggtggatcacctgaggtcaggagatcgagaccagcctggccaacatggtgaaaccctgcctctactaaaaatacaaaaattagctaggtgtggtggcgggcacctgtaatctcagctacttgggaggctgaggccagagaatcgtttgaacccgggaggcagaggttgtagtgagccgagatcacgccatcgcactccagcctgggcaacaagagggaaactctagctcaaaaaaaaaaaaaaaaaaaaaaagcagatcagaattcatcattaaattcctatatacaaaaattccataattagaaatatcaccagcagatacaaatttaaatatcaagtttgtattagaaaaaaaagaatgctggttggttaaaatggatagaagacagcaataatgagtcaggttataggttcaatcccatagagcccagctgggttcacattgagaaaagtacatttcatggtcaaagacaggtccctgatctcagcaaagggtcacacatctatgctattagttgaaaagggaattatactggagatggttcaaaaaacaaaaaactatcatcattacaggaaataactcatagcatacatcctgatgacaaatgaatagtgctattttctttgtgaataacatcttctgctgcactattactaactctaggaagatatgctggacttcttggctttgttttaacactatccacatatcatgaaatattatattgccgaggcagtatttatgaagccaaatagaaagcaaaccatgaactccatacataggaaaacaacaacaaagaattaatggctgggtgcaatggctcatgcctgtaatcccagcactttgggacaacgaggtgagaggatcacctgaggtcaggagttcaagaccagcctgaccaacatggagaaaccccatttctactactaaaaaaaaaaaaaaaaaaaaaaaaaattagccaggtatggtggcacacacttgtaatcccacctactcgggaggctgaggcaggagaatcacttgaacccaggaggcagaggttgcagtgagccgagatcacgccattgcactccagcctgggcaacaagagtgaaactctgtctcaaaaaaacaaaacaaaacaaaataaaaacaaaaaacaattaatgatcacaactctactcctcaatggcgcagggtcaacaccagcattagaacaacagggatcactcaactgtattctgaataatatttacaaagcacctgtgaactaattcttagcagttaagaatttttctttccccactatcattttcctcttgaaataaagcaaatttaaaatatgccaactaaggcaagagatttgaaccccacctacatcaggatcacctagggagttattccagggcttattccagaaaccaccagaaccaattttaataagtatggtgtagggccctgggatctgcattttaaacaaacactggaacactaaaagtttgagatgagaattactgactaaaaaaaaaaaaattgcagtttatgtagaatgcacacattagcaatataaaaggaaaagaagatgtctacttattattttctcttgtttatttttctaaattaagtatattttgttttaggccaggtgcagtggctcacacctgtaatcccagcactttaggaggctgaggagggtggattacctgagatcaggagttcaagaccagcctgaccaacatggtgaaaccccgtctctactaaaaatacaaaaaaaaaaattagccaggtgaggtggcgggtgcctgtaatctcaactacttgggaggctgaggcaggagaatcacttgaactggggaggcgggggttgcagtgagccaagattgcaccattgcattccagcctgggcaacaagagcgaaactccatctcaaaaaaaaaaaaaaaaaaaaaaaaaagtatattttgtttttaacttagaactatttaatattccttaggaaatagttcaacaagccgaatttaagtggtctctccataaaggcacttacatgatttacacttcaaaactactgaattttttaaaaccacttaaattccttcatacaatttttgaattaaaatgacaagtgtggcttctttttcaacatttaaatataactcacataccacagaattcatcctttaaagtgtacaattctgtggttttcagtattatcacaaagctgtgcaaacatcaccattaaattcagagccctttcatcacaccaaaaagaaactccgtacctatatggcactcactcccatttccctcaccctcacaccctgacaaccactaatctactctgtatttctatggatttgtctattctggatattttgtataagtggaatcatacaatatgtggcttttatgtctggattatttaacttagcatcatgttttcatggttcatgctgtagcatgtctcactatttcacttctgtttatggctgaataatcttcagcatatggatacaccatattgtgttaatccattattaattatttggtaggcatttgggttgtttctactttttggctactatgactaatgctgctataaacattaatgaatatgtttttgtatggatatgtttccaattatcttggatatacatataaccaagagtggaattgctgggtcacacggtaactcaatgtaaagaatgtgcaccattttacattcccaagagtaatgcctgagggttacagtttttacatatcttaaccaatacttgttattgtctgtctttttgctagtggttgtgaagtggtatctcacgtgaggtggtgtgatttgcatttctccatgactactaatgttaacatattttcacgtgccttttggccattcagatatcttcttgggaggaatgtctattcaaatcctttgcccagtttttcattagactatttatcttcttattcttgagttgtaagagtcccttatataatctgcatagtagactcttaccaaatatatgatttgcaaatattttctcccattctatggattgtcttttcactttccaagtccagtttatttatttttgtttttgaggctttggtactgtatataggaagccattgcctaatcagtgtgattcactacttttattttttacaaaatgaatattttagtaaaaattggctctagcctatcattagcaggagagtagccttgcagtcttgttttgtgtcaatagagatttgctagaaaactgaaactgagtaagaaaccattctggggctgggcacggtggctcatgcctgtaatcttagcactttgggaggttaaggtgggtggatcacttgaggctgtgagttcaagaccagcctagccaacacggtgaaaccccatcctactaaaaatacaaaaattagctgggcatggtggcacatgcctgtagtcgcagctactcaggaggccgaggcaagagaatcgcttgagcctgggaggcagaggctgcagtgagctgagactgtgccactgcactccagcctgggtgacagagtgagactctgtttcaaaaaaaaaaaaaaagaagaccaggctctgaaaagttagtttgcaaatattcacaggctttttgtgctttttcaaggcaaactaaaccaatagtttctaaggtagttatttaactaaatttaaattaacatagatcttcaaaagccaaaagtagtgaagaacttaaactggattgtaaaaaaacatagaaataaaaatgaaaaacatggtctaaactactgacaaaatattttttcaaatttctaacactcataaggacaaacaaccttctgaggacaataacaaatatagaaataaattgcaaaatttttgtgggctgctaaagtggtggtaaacaagtactgaaatatgccaagattatttgtttataacatttactacttcagctttcatcaggtttatgaatatttatttgttttaaaatatatccccaaaaagatacttaatagcccatttcagaactagcacatcttatggatgattaacattagcaaggaagagtactgcctacagaaatctgatagtagtgctcaaagtagtactaagtacactgttctttaaaaatatgcttattaacgtcaccaaaggaaaggttgcttaaaatataattatcagtttttagtcaatcttttcttttcttttttgagacagtctcgctttgtcacccaggctggagtgcagtggcgcaatcatggctcactgcagcctcaacttcccagggtcaagtgatcctcccacttcagcctcccaagtagctgggactacaggtgtgtagaaccaccatgtctggctaattttttattttaatttctgtagagatgaggtctcactatgttgcccaggctggtcttgaacttctggactcaagtgatcctcctccttggcctcccaaagtgctggggttacaggggtaaaccactgcacccccaattttgtatagataacttaaaaacaaacacactttttttgagaacataaagtgttttagatagtattggaagtctgccacgcaggtatcatatcgctcttgtgtgacaggtgtatttcagggaaatgtatatgaataagatgtatataaaagaccaagagcatcactgttgtgtccccagtgcttgtagtactgaacaagcttaacaaaatgcaagtagcaactgctaacttcctgagggcagaaatttaaaaaaagccttacgttagaacaagacactctcaaaaagaatgtctaaatgctaaaattgctaatacccatccatctgcctccaggtggtgaaaaaggggagtgtgtatagcattacagtctggcaggggtaatatatgtagctttaaaagcatattcaaattattataatattctattgtttattggctccttaatacaaacattaaggaacagtttttttatttttattttttatttatttatttatttattttgagacagagttttgttcttgttgcccaggctggagtgcaatgtgcgatctcagctcaccgcaacctccatctcccgggttcaagcgattctcctgcctcagtcttccgagtagctgggattacaggcatgcaccaccatgcccggcaaattttgtatttttagtagagatggggttcctccgtgttggttggactggtcttgaactcccgacctcaggtgatccgcccacctcagcttcccaaagtgctgggattacaggcctgagtcactgagcccggcccagtgtgtattttttacatctatataaaaggttgtgaaactgataaataaagccttcttttctaaagagatttaaattcaggacatttaagaatgtgaaaagcagatcctcttctttcctgatcctcctttcttatgctctgcaaaggagtaagagtggctgactcctagttaaggttatgaaacagcatctaacttcttatgggctaatgcttcctttaaacttagacccagcattaaacctcacaaactaaataaaaataccttcagggaattacgatgagaagggcattttgtatctttaaaatacagacctaattgtggaggtagagtaaaacaatatatattttggttaaataaggctagagaaaaagaattcacaatttgttggatttataaaatacaaactttaatttcttttttttttttcagaggaaagaattaagattagggaaatgagaggaggaaggagataagggctttaaatgattctgatctataattatcagtatgaatttttcatgtttttcttttgcagacatttggaattgtcctgtagattttgttggcagttaatgatcgaggcctgcagagcactgttactgttcttgatcccccaattcataggtataatctttatgtcctaaactattggtcataaatattagttagctaagaatgcctaaaagttgtttacaaaccattacttgaaaaatgaacagccaacatttatagcatattcagagaaagttagtttgaaaaataactcaaactgtgtattcgaatcattgtatgtaaaaaaataaataaataaaaataaaagtagcttttcttttccttgtaaaacattagctagaaaaagattttacttttttcccacatcacagatcatcttgaatgagcaggcctgcataaaaacgatcttcacaactctttatgtaaaagcacaaaaaaaacaaaaacacaaacctatacacttttaatacaaaaaatctgcattatagccataaaggggcgaatagaccagtcataaaaaataaactcgttttttagttgatccaatcttgagcaaatgtttaattttaaaatttactattgttttattttctattacaagtatctgcctaattctggggcatctgctatactaaaagcagaaaaaaatcatttgggagattaaagagagtaagagaaaaataaaaggagagtcaaggaaatggatgggtaggaaaaagaaaaaagaaagatgaacagacagaggaagaagggaagagggggcaaattggcttagtcaagctctcttgggacagtgtgctgagttaccagaccagaaatgaggggttgaaagctactactgataactggtgcaggctgaaagtgctacttaagtgcctggtgtctgtggaaaaaagagggaggagaggtttaagactaaggatgccaagtacatttccagccagcagagtaaaaaggaagcattaacagtagcctcaggggaagctaagcatgctatcccatgagccagagggcaaatgtggcaatagcagtaagtagcagctggataaagggataaagaaataaagaaaccacaggaaaattggcagctttagacccataaggctgactcggcctcgtctagatacttagaggaacaaacagcctggaaaaaacactgccatctttctactgccgatgggttactaatcaacaactgaggtgcaatcaactaaaatttacttggcaaaaattatattaagcatggatttaactttgtggaacagaagctctgctcagaagatacatgtaagatattctcagtatttggcatcataataatcaaaatcagcattctccataactctccaaatgatactccgaaatgtttaaaatgaaaaaaaaaattaaatacctttttctaatgcagtatttcattaatgttttctaaatattatttcatacctcatagtttaacaaatttaaaaaggatacacataaatatgctctatagtatatattagtgaccctttgagtattaagcccagcctccattagctattcttcctgatgttttccttcctcccaccccccaccctccaagaggccccagtgtgtgttgttcccctccccctgtccatgtgttctcatcattcagcttccacttctaggtgagagcacgtgctatttggttttctcttcctgcattagtttgctgaggataatggcctccagctccacccatgtccctgcaaaagacatgatctcattcttttttatggctgcatactattccatggagtatatgtaccacattttctttatccagtctatcagtgatgggcatttaggttgattccatgcctttgctattgtgaacagtgctgcaatgaacatccatgcagacgtatatttataatagtataacatattcctttgggtatatacccagtaatgggattgctgggtcaaatggtgtgtctgcctctaggtctttgaggaataaccatactgtcttcaacaatggttgaactaatttatactcctaccaacagtgtaagagcattcctttttctacacaacctcgccagcatctgttgctttttgactttttaataatagccattctgactggtgtgagatggtatctcattgtgggtttgatttgcatttctctaatgatcagtgatgttgagctttttttcacaagctttttggccacatgtatgtcttcttttgagaagtgtcttttcaagtcctttgcccactttttaattttttttttgtaaatttgtttaagttccttgtagatgctaaatattagacctttgtcagatggatagattgcaaaaattttcccccattccataggttgtctgttcactctgtggatagtttcttttgctgtcaaattattttcattcatattcttccattaaaaaaaggttcaaagttatgtcataaggcaatctatattacctttatatggttttagaatggaaggtaaataccacaatgagagttcttgttttaaataagtatgtgctgtaatattttagtataatatccgaaaataagatttaccaagcacaacatttttcaaatgactaggcttgatatatttgataaactgcaatttgtaattgattaaataaaccctgttggcctaagagttgctcaattctctcttttcttcatcagggttattaaggtattataagattgatgttatgaaaaaagatcctactcctaaaagaatttcaaacatttaaggaaatcaaactgaaaagtaagaaatgccaattaagttgtgcaatgtatataacaaattctataagaattcaaggggtgaggagggggtggagtcagggaaaaaagttcctaagggatgtaaaatttaagatggctcctaaaccatgcataacatttgagcaaaaattatttggaaggaaaagatataaaaagagtaagttaagaagcagatacttcaataaagcaactgtaattactaaagttacctttggaaaattaagatttgacagctattacaggtagagtatagaagggatagaaggtaaagagagtgatgatacatagaaagtcatgatactaaagtagaataaaagactcggggtgttttagtctgctctggctgccataataaaatacctcagattgtgtggcttaaacatgagaaatctagttctgaaggctgaattaatttagaatttctgaaagctgaaaagtccaagatcaaggttcccataagatttggtttatgatgagcactctcctcctactgtgccctcacatgatagagagagagtgatctctggtaacccttcctctttcataaagacaccagttctactggaacagggctccgcccttacgacctcatttaaccttaatcacttccttaaagaatctatctccaatacaatcacaggggtgtaattagggctccaacataattttcgggggacacaattcaggccatagcattctgcctctaacctcctaaaattcatgcctttatcacacgcaaaatgcattaattccatcccaaatgcctccaaagttttaacccattccaaggtcaactctaaagtctacagttcaaagtctcatctaaatatcatctaactcagacatgggtgaaacttgaggtacgaatcatctttaggcaaaattccttcccagttgtgaacctctgaagtcagacagattatttgtttccaaaatacagtggtggggcagatataggatagacattctcattctaaatagaagaagtaggaaattgtgatataattttttaaaagcctgttgggagcattaagtgagattacatacaataaagtgcttaaactagttcatgaatatcagcagagtagaagtataaactccaagaaggcagggactttatcatcaaccactgtatctcaagagttgcacagtcaatagggtagtcactagccaaatgaagctatttaaatttaaatttaagttaattaaaactaaaaattcagttcctcagtaatattactcacacttcaagtgctcaatagccacatgtggctagtgggtacaataatggaccatgcaggtttccatcaccacagaaatattagtagacaagtctgttctagagcctagaaaagtatgtgacactataattattgaatgaagaaatataaaaactattagcattcatggttcaagaagaataacaagaaaacatcaagaagaatgagtatcttcaattttggatctttgtaaaagatccaaaagaatcacaacacaagattatcttattaacttttataaaggcagtaaatttagggctaggaaaatgccaattaagaaatatttctgtagccaggtgtggtgacacgtgcctgtagtcccagctcaggaggctgaggtgggaggattgcttgagcccaggaggttggggatgcagtgagccatggttgtaccactgcactccagcctgaacaacagagtgagactcagtctctaaataaataaataaataaataaataaatactccataggagattaggttaatattgttcagagttttgctttgttatgacctgaatcaagagaggaatcaagagaggaatcaggaggctgaggtgggcagattgcttgaggccaggagttcgaggccagcctggccaacacatggcgaaaccccatctctactaaaaatacaaaaattagccaggcgtggtggcacatgcttgtaatcccaactttttgggaggctgaggctgcagtgagccaggatcacgccactgcactccagcctgggtgacagagcaagactctgtctcaaaaaaaaaaaaaaaaaaaaagaaaggaatcaaaactccagagactaaccatgaacatgtctaatagtctcactcttaggcaccagcagtcttactaaatttgttagtggcaggatcaataatgaatggattcaccaacaaattcctatggtacataatgtcagtgttgtcggcaacaaatgtgagacaatccattgtgaatacagagatctggacttccatttttgtctgggtatttttttttttttttttttttttgccagtggatgagaaggaacggagtatctgcaactaacatcaatatttattcagaaaagtgcttcttatctttttaagcacttggaaacacaccaagttctgttccattacatggcattctaatgggtaattcttcatgatgtaatactttagcttacatcattagtgtaagatcaatttatttggttatcacaccgattaaataaaggaagtttccttctccagcagttgaaatgtttctgcaactcttatataaaaaagagttacaggtctttggcctaagctgtctatcttcttgaaaagtacagaaccagagaatacacttttccagcctaagccatccattttcttgataaatccaaaccacagaatgtgctttccctggacttaacactttggctatcttttctgagaatggaaaatttttcttactaaaacatctgcctcactccccacatcacattctctgccatctgacctgcctttgctatgctctgataactgccagaagtctacagcaatctcattttaagagtgaccctaccactaactgtgaataaagttttctcacctggtttttgccagtcttactctagaacctttccttcccttgacacatatttcttattccataggtagtgggatataaaataggcaaaaatttcttcctcaaggaatttttacccaaaatttcccaaaatttacccaaaaattcctcaaggaaggaattcttcctcaaattcattctcttagtttatcctctctttccattgctgagtaatcatttcttctaccccctaatacctttattcttcttgagtgataccaggagaggaaagcaaaggatgacacagaaaattctgataaaagaaggtgacagcaataaggctaaataaactgttcagctagaacctctcaagctgaaatcagaaattttctcctgatgtattgtataatatcagtgtcctcatttgttattacagcattagctactaattgtctcccattgtctatttacctccttcttccttttagcaatagacccatcctcccttgcagttttaggaagcccagcttgataccgcacttcccaaactcccatatggctaggagtcaccaggtgatgacattttagaaagcagaatgtgagcaaaaatgatgtgcccaacttcctagtcacattcttttaaaaagcaactgtgtgtcctctacttactgttgcctctttccaaagggctaaaatgtggatatacggggtgactgcaaaagaacagcaaaccctgaatgatgatgaaaccagacagaaggaacccgggtcctttgatgacatcatggattcaatttgctctaattccttggattgcctaccagttcagacttttacttcaggaagaaactttccatgtccatttaaccactactttttggtctgtatgaaagatgtaaaccttaaaactggcttttatataaaaagatttattttgggagaaacagagtatgtgggcatagtctaaaaaaggcaatatgatcagatggaagccctaaaagatcaattacactcaaacatgagaagcatttcttagggtgagacagaaagatgactggagaacatatttgattcaacaaactgttactagattcctacttaggccagacactatgtcatatacgtgacaggaactaggtaagtaaattgtgtgtgtgtgtgtagttcccaacttcactgaattttctgtacagtgagagattaaattctagggaattagctaagatataattggtcaataattactgttcaagtgataccatgtgccaggtaatgtgctaggtgctggaaaagatggtctctcttctaccttctaaatatttttcttcctcttgagtgccacttctttggtttaggctctcagaatttatttcagctcacacccttctaactggtttcctttccttcagtttcttctccctccaacccactgtcatctgagtaacataaaaatcctaaaataagaatctgattgatactctgttactctttaaaaaaaaaaaaaaaaaaaaaaaaaactttacaaaatttttcttactgaaacatctgcctttctattgccaataggttaaatttcaaaatgtcctttctagtcttattcttcatcactttattattcaccccagctacacggaactgttcatcatttacccaacataccttcatttgctctcttcttcctttctcagttcttcatctttgagtcagtttggactgcgataacaaatatcataaactgggtaacaaacaacaggaattttatttcctcacagttcttagagtctgagataaaggtaccaacatggccagtttctagtaagagcccttttactggattgtagacagtgccttctcactagttcctctcacataggggatttgggagtccagggggaaagagagagcagagtgagtagggtgtctgcatatttgctgtttcttcttataagagcactaattccatcatgacggctccaataccctcacaatgtcatctaaacctaattatctttatttcttaaaggccccatctccaaatatcctcacattgttggtagggcttcaacatataaattttgggagattgctaggtagtttattctctttgtgagcgaatggagttcactcatgatttggctctctgcttgtctactgttggtgtataggaatgcttgtgatttttgcacatcaattttatatcctgagaatttgctgaagttgcttatcagcttaaggagttttggggctgagaatatggggttttctaaatatacaattatgtcatctgcaaacagagacaattgggatttgaacaatgagaacacatggacacagggggaggggaacatcacataccagggcctatcgaggggtggggggcaagaggagggagagcattaggacaaatacctaatgcatgcagggcttaaaacctagatgacgggttaaaaggtgcagcgaaccaccatggcacatgtatacctatgtaacaaacctgcatgttccgtacatgtatcccagaacttaaagttaaaaaaaaaaggggggagaatatgattccatccatagcagatggcaaactaatccttcaatacccagctcaactgtctcttaagtatcctcattctctgaatgaaatttagttgctctgctatctatgctctgattaacgacattctggattaattatttccattattagatggtaaatacctacagggtagagattatatatattcatctttgtattttctcagaattaagtaggatgtttggcaaacattagccccaatacatatttgctgaatgaaacactggactttcagaagcaatgaaagatatgtgctaaaatctttttttttttttaatgcttttctctacttgcaggtcaggcattataataaactctttctcccccccacctctacaattctagactctgcattcataatttctttcattctttccctccttctcctcacctcttccctccctttccctccctccctccctccttttattagagacagggtctccctctgttgccatgctatagtgcagtggtatgatcctagcacactgtaacctcaaactcctgggctcaagtgatcctcccacctcagcctccctagtagctgggactaaaggtgtgcatcactacacttggctaattgtttaaactttttgtagagatggggtcttgggatgtttcccaggcaggtcttgaactcctggcctgaagtcatcctcccaccttggcctcccaaagtgttgggattatgggcatgagccactgcccttggtccatagtttgtttctttatagcatcattgatctcaagttgtctataaccactaatttctatggagttgaaatgcagattctatcaaccaatgctagattattaatgttgactttataattgcagacacttttacataaagagtaggtcaacatgttttcacaagagtaataagtaacttcagatgcccttgtaagaaatgcagcaataggactcacctattacttttctctactgaatgcatttccacatcaacagtgttaccaatcattattttatgttaccacagcagagaagatttaatcttcttttacataacaatttctttgccttagaggccttgtgatcattcaatattattcctattctaaatctgtcatgtttaaaacctactgcctgtattaaatatctattatctatttacagccaagagaggttaagtaacacagctgtggtcaaaagttagctaatactgaagctctgggattaatctccaaatattctgagtatgaatgcatattcattcagacatgaccatgcatatgtcataaaattttataaaattacagaggcagttgatatgaaaagtgtaaaatatgtgatcaaattaattagatatgttaattatggtacttaagttagagttgtaggtctatcaataaatattcactgaaagtttactaagtttaagtcactatttacaagtaacggaggagggggcacaggaggataaagctaataggtagaaagtataataaatggcagagtaaagggttaaaagagaagtacaaagtacaactgtgatgtcatagaaagaaagaaaacctggcaggcatggctattgtctttacatatcaggactaaagtgagatttaatttgctttgtttaagccttagagctagaatgaggaccaatgggtagaatttacatggcacaggcttcacttggtataagagttatttgaaaatagaatgttgaaaacagaatatttttgtgataatatactataagcttaatctacatgtagtagaggtgtcatggtgagatggtggggagcaggtggtctgtagggaacaatcccacccaagaccagtgagtacctgaataaacactattatatgcttgtagtcatggcttaaatgcaggagcataacacaattgtactgcccatttgcaagatatatttatcagcagtgtatcaaatgtataaaaaagtgatagggagactagaaggacgttattaccatagttcatataagagataagaaaggctactgtggtaaaaatgagccagcagagttaggaaaagatgttctaattacttcaatcaattatatgctaatattatctattactaaagaagataaaaatgggattaagtgtacataatagaattatcatctatcctattatttaccttaatatatttaaattccatattaatatatttactgtaacatgtctaaaactgaatttatcttcctcaaagaacttatcttttcctctttctgtaatgcctatttcaattgttagtatgacaattcatgcagtaactttagttaaaaatctcaatattatcttcaacttcttccccttatgttctttatgactctgatatgtctctagaatctagaatgtcttctctgtcctctctgtcattgttttaactaaggtcatcatctcctgcttaatttcctttaactgttatggcctcctaattgattttcctgtctccattctttcctagcttgagtccgatactcacactgccatcttcctaatgaataaattaaatataattatatcattcccatgtctttttagcagttcctggctgtctgtaagagaaagtaccaactcctcagcaaggtataaatgcctcttcataaatgtgacctcaacttaacctcccaagcctcatccctggctattctttcccaagaaacctatgcaatggccatacaaaaaattccattatcttaatcttttcctatactataagcttattcatttcatatggcacttgtcaaatatcagtgtctgggaaaggtttgagtgaacatttttaatcaattgctatttagtaaataaaccaacaatctttcagtacaatctacagtattctactggtaattgattctctagaattgaaaaaaaaatttccctcagcatctttcccccgtagactattatgatgattaattttgtgtcaacttgagtgggctgcgggatgcccagatagctggtaagacattatttctgagaatgtctgtgagggtgtttccagaaaaggttagcatctgaatcagcacactaaacaaagaagatccactctcactaacatgggcaggtatcatccaatccaatgagtaccagaacagaataaaaaagcagaaggatgaattccctccacccactccttgagttgagacacccatcttctcttgcccttaggcattagagctcctggtctgtgagtcttcagactcagggacttacaccagtgccctactcctgggaatttaggcctttggcatcagactgggagttacaccattggttcccctggttcttaagacttcacacttgggctgaattgtaccaccagcctctgggtctctagcttgaatatggcatactgtggtgcttctcagcccccataatcacacatgccaattcccataataaatctcatctcacacacacacacacacacacacacacacgtactcccagaaataatgtttatcacttatcctggcatccctcaacccactcaagctggcatataaaattaaccataatagtagtctacagggaaaagctattgagggaaaattcttttcaatcactctagagaatcaactagtagtagaatacgaatgtattggtttatttactaattagagattgatgaaaaatgtttgctcacaagcctttcccaggtactgacacttgacaagtgccatatgaaatgaataaacttatagtctagaaaaaataggaaatgattaggacaatgaattttctatatggctgtggcataggtttcttttattatacaaacactcacacacataaacatatatagatgttattggctctgattctctgggaaatcttaatacaactacaaaactttatttgccacttgttcccactttcaaaacacaatttactatttatttccattattaaaaataataactaatcattaaaaacatttgaaaagcaacggaaagagaaaagcaaaaaaacactgacgctttaagacactggagtaggtgtatgtccttgtaatgtttttattacattgagatatcatacacataaacacatcttatatactacatttttatatcctaaatttttcttttctccgaattctaaaataaaataaattttcatattttttctgatgaaaagtgaaaaatgaaagtaattttcctctcattaagtgcatattttcatacaatgtacgatacaaaaaggtattcatttttttcttttttgaagacagggtcttgctctgttgcctggtctggagtgcagtgacacaatcagggtttgctgcagcctcagcctcccaggctcaagcatccttctgcctcaggctcccaagtagctgggactacaggcacatgacaccatgcccagctaatatttttactttttgtagagatggggtcttactatgttgtccaagctagcttcaaactcccaggctcaagcaatcctcctcccttggcctcccaaagcactgggattatagatatgtgccaccatgccaggcctaagaatgtattcttaaaataggtatggtctcatttgtacaactaaaacttattaaaacatatgcagtagtataattttatcataggaagtataatgtagagtataacaacacaggtttcttgcactggaatcccagttcaatatttatgattgctgtgacaagttacctaaactcacaagttacctaaactctctatgcctcaagtttctaatctacaggttgagagtaataatagcacttacctcataaacttattgtgagacctagatgagttaatccataaatggcttacaacaatgtctggtgcatattattaagtgttcaacgcacgacagctcttattatccttctaaaaatctaaagtttaatgaacaaaatcccattaaacaaagcgaaatataaattttgtctattgaaaatatgttgcacagtgagcattacaaaaataattacatatatattttagtatcttctctagcacagaaaaaaagtagaaagaagaaaataagggatcatgagatcctggcaagagtttttctccacagacattctgttggtggaatagaaatatgtgagatggtgaatggaacagatctaaataagcatgggactaacaaagtacaatgtatgaaagattttacttagaaaaaacaattacaaattgactatacaatcaataagactaaccgaagggaaatgcagtaaaacactttcaaagaaaaatactgtggagcccagaagaaaataagccaattgacagaggtagatttcacgagctcataaaaatgaaaaagtaaatgctgctggacaaaaagtggtccttacttttgctctcaatgtttctagtatgctatgtagaacaattattttgcttttactgaaaaataactattgcatttggtataaaacgattcataggaaaaattattttttacttctgaataattaatgtatttcttaagtaatagaggaaactattaattaagaggcattcatgaaggtggatatcttacacctaaacattttagacttgttttccaattttctttctttctttttttttttgagacaaggtcttgctctgtcacccaggctggagtgtagtagtgccatcacagctcactgcagcctctacttactgggctcaagtgatcatcccacatcagcctcccatgtagatggaactaccggcatgtgctaccacacctagataagtttttttgttttttgtagagacagagtcttgctgtgttgttcaggctggtctcaaactcctgggctcaagcaatcctctgctttagcctcccagagtgccgggatttacaggtgtgagccaccatgcccagcccttttcaatattgtttttgaaaattccatcctatactgccaaatataaatatatcccaagaaattaaaatacagaaaattaaattgcaaagaaaatatggttgcagaattcttgcaatttaattttagtaaattctttatcttttttattaacataccttaaaattgctatgcacatattttctgtctcagttatgtactcaactagaaattacctttacttaactacctgtattttattgaaatactgtgcccatcctgcatggactattttgcgtcacttattttatgaatatcactattggatatgctcttttgcaccaatagactcttattcaggtatgacacacagagacacaaaatgctaaattctcctttcctgtgaccatggcagaaactactaatcaatattcttgggcaaagttggttctcaagatgctcaagctctgctgttgtcataaagcattttggttctcttctgatactttttgaagactcatccatttttcattctttcagcaaacatgaccatgataccccatatagaccagatattgtgctacagttgcgaaaacaaagaataagagaggtcctcaagcggctcaacatctcatggtgaaaatgagatgctgagccaccactaacatgctagctgttaagtatgtccacttaaaagagaacacaggagaaacatctcaggcggactctgttggcgtggttggtggtgagggaatgttgaagagtggatagaggtataattaaaggctttctggatggcgtggtggcttatatgagtagtcccagcactttgggtgggattacagcacttgaggtcaagagctggagatgtgcctggccaatatggtgaaaccccgtctctactaaaaatacaaaaattagcagctgagtgtggtagtgtggcgcctgtaatgccagctacacgggaggctgaggcatgagaatcacttgaactcaggaggtggaagtttcagtgggcggagatcgcaccactgcactccagccagggtgatgaagtgagactctgtcaatcaaacaatcaatcaatcaatcaatcaaggcttcccaagggggaggaatctggcatttttgtaggcaaaggaaacagcttataagatgtgagagaacacagccattttagagaagtgtacattgttcagtgttactggactatagttttcaagagatgaagttggggaagtaagcaggtaaattgtgaagatcattccaagtcatgttgtaaagctgggaaagctataagtaaccactgaagaattttaagcagtatttgtgagagcctccaatttagggagtatccaatttataaatatcttcatatagtttaaaaagaaatagttattttatgtggtttcctatggcaccaactagaatgtttctgggatgatccagaaacatgtacaagtgatctgctgctgagatgcagattatatttcttcaaaaaaacctggatcaaaaattttgtcgttttacttttaaaacgaatttgagtcagaatccattatatattattctctggtgtagagcataatggaataactataatacagctcaataaaaatgaaaacaagaggatatcataaaaagacggtttcaaagaacattttgaggccaagtgcagtggctcatgcctgtaatcccagcactttgggaggacaaggagggaggatggcttgaagccaggagtttgagaccagcctgagcaaacattaggagacccccatcttcacaaaaaataaaattagctagatgtggtggcatgtgcctatagttctagctactcgagaagctcacttgactccaggagtttgagactgtagtaggctatgatcagccactgcactccagcctggtgacaatgagatgctgtcttaaaattaaaaaaataataaaaaaagaagttttctttcaaaaagacagaacaagtagttgagtgagtgttatgggttgagctgtgtcccctccaacacaactccatatgttggagtcttaaactccagtacctcaaaatgagattggagataggttatttacagaggtaaacaggttaaaatgaagtcatttggatgttccctaatccaatatgactggtgtctttatagaaaggggaaaatgtggacacagagacagatatgcacacagggagaacaccttgtgaagaccgaggttacactgctgcaattgaaggacctatcagaagctcggagagaggcctggaacagatccttctctatcgccttcagcgggagaatggccctgctgactccatgatctcagacttaaagcctccagtactgtcagacaataaacgtatgttgtttaagccatgcagtttgtgggacagtaattattcacttaacattgtcaacaggttcttggaaactgtgactttaagtaaaatgacacataaggaaagcaatttttttccgataacatcataactaaatgacattatctgagaacctattgtaattatttcacttaaagtcccagtttccaagaacttatccatgatgttaagtgaggacttactatactttgtaatggcagccctaggaaactaatacaagtagggttacaggagaagtaacttctaagaatttacatggcaactaaaagcagtaacttaccctagactggatcccatattgcagcgtaaaaattatataaatattacatgttatatatcactaacaaaagtgatatatatggagagtaaattagacgaaagtattacatcaacataagtttataaaatggataactgtgctgtagttacataagaaaatatccctattcttaggaggtacacactgaaatatttagaggtaaaagaccatgaagtatgtaacttaccttaaggaattcagtaaaaatattgtgtgtatatataattatgtgggtgtgtgagtatatatacatatactacagagagggtgaaaaaagaggagagagaggaggaagggagggagagagaaaactcacataaaaaagagggagggaaaaaggttaacaatagtgaacctgagaaaagtgtataagaattctgtgggcacggcggctcacgcctgtaatcccagcactttcagaggccgagacgggcaaatcataaggtcaggagatcgagatcatcctgactaacacggtgaaatgccatctctactaaaaaaaaaaaaaaaaaaattctgtgtgctatttttttctttgcaagtttttataagtttggaattatttggaaataaaatacaaaaaaagaacttattttagacgagatcaggcactttcagggtggtacagcagtagaccaaaaaaaaaaaagaacttattttaagaacaatgcctaagcatattgctacaaacattttatttttagtatggcataagtatatgaacaaaaaaagtgaaacgataaagtgaatgaataactgattaagaaagaaagaagcggggaagaaaagaaacaaaaactcaaaaattgatttaagctatagaaattctaagtgccacagaaaattttgagatataaatttctcaaaataaaaaccaggtactatagtcacggcatttaatacaataaaaataatacaaactaaatttgcctttgcttaaaaataagaatcagaatatctactttttctttagaaagtagcttaacatttatttagaataactgttagtggagagaaaaaatggcctatttttgtttatttatataatactcacacaactattcattgtttcctagcattgcaatactttgatatttatcctaaagtttctctatgttctaatgataattctaaaatatagaattatctatctctctctatatatataaatataaattctaaaatatagcattatcattaaaaatatagaaaggaatcaaccggaccacaaaaaactaagccgttctggataagcatgtggcaatcctcttcttcctttttctttttttttggaggtgggtgggaaggtcacagtggttaacataatcaaggaaatttgctagtatatacagaagtctttgctaagaaattttcgtttgagatacaccagttaccggcaaatcaaacagacataaataccacagtaagcagtcatttatcgggtaaccctgtgcagagttgcatgaaagcatccagaggcagaacaaaatccacagcagagccgctgcttttcagatagactgccactgcaggtgccatggcccagtgccagaaacacaggcaggggaggggttacaggcagctcctgcacagcaccactgggcagaagttgcctgtaatcagagcactactgaaagcaatggtggtggcaaggtgaacttggtgagcaagcattcctctgtgaattcaatttcttcttgtgaatttcatattgcgagcccattagcctcacttctcttctctagccattatcattagcccctcgcagaaacgatgactaccagctgtaactggcagcacactaccatgataatttacacaaagattaaaaatgaaaaattaaatactgggatttctagccatcttttaactttttttattataaaaagtatctctctctctttcttcttcttcttccccttctcctttcccttctccttccccttcttttttttaacttcaaacctatagtaactttggacaagcactaagttaccataaatgaggttttgtttatttctttttcctgaagtcagtgcaacaaggtatttcaaaaccttaaagaaagaaattatgaaattaagaaatagatgacaaaatatacacctggctgggcacggtggctcacacctgtaatcccagtactttgggaggctgaggagggcagatcatttgaggtcaggagtttaaggagtttgagaccagcctgaccaacatggtgaaacccggtctctactaaaaatacaaaaaattagccaggtgtggtggtgagtgcctgtagtcccagctacttgggaggctaaggtaggagaattgcttgaacctggaaggcagaggttgcagtgagctgagattgtgccactgtactccagcctgggcgacagagcgagattctgtctcaaaaaaaaacaccacccaaaccagaagtattttgaataaagtgtcaaatacttacaaggtgtaattactattgatatcatgagcagccactgtgccaaattcatgcaccatagaagattctgaactccaaagggcctggcatgggtctttgcaatttagttatggacatgactgaatctcacatgaagaaatgtttaataatcaataaagagaaataattgaaaaactgctctaaaatgaattagatcagccatctgcacaataccatctcaagtaataattgggaaagaatatataggggtgtttctgaaatgtttcaaagaagatgagagttctgagaagagtatttgtaagtttttagattattttgctttttgagagcatagtgataagaagggtaacgatgcacgctttagggtatcatttggctaaaaaaggagtagggtaggctcatactgcaatgataagaagaacatgtggcaggcactgtggtaagaaaagcatgaggagtaactcaagctagaagcctaactattacaggttcctgtgtcaggaagagggagaaatctggcatttccccccacactttcagctatatcactgaggctgaagtctatagggaagagtaactactattagacaatccttttcaattatatagatgagatacccacggggaagaattttccaaaatttaaaaatcattaatatattttaatgaaatactaacaatgtggtagaaaatcatagaagttacttaccccagaataaacacagaatttgaatatttttctaccatggatgtagcatatattagaaatagtatcattttattttatttggcttgtatctagcacaataacatgtcactaaacaaaatgcggtttactctcatttgtccagagttcagaatttaggtgttcagagaatctagaacacagtcaaactcaaagcaactgaaggccaagaggaaaacaagcaaaaagctcatgaactttaacggtgggaggcattgggtcattcctcaagcttttaacccagccatatatgcattaaataacataatcaatcacaacaagatggaaaccctaacagagaagtgacatctgacatagaagagaactttgaatgctgacagaaaagctaaaagaaagcaaaggaatgtgggtcattttaagtgaggaacaaaaagctctatgcatctcagaaacttcaaggcatcatggaaaatgtctggaatattcaattgttagtaatacagaaaaggctatttaagatttaatttcagaaagaattctccatttaagaggcaaagaaatgtgtaatccatttcataaagagatttctcttcaagggaaatggtgaaaaccactggtatttgaaagtgtaaaccccaattctataaaacttttactgtatgatgttttaattccattcctagatgatgctgagtacctgatgcactcttctgatgccattttgaaatgtttctattaaggtaaagtagtgaatacaattaatagatattttttctcctcttaacttctttaggagataaaagatcatataacacaacatttataacactgcatagtaggcttatatataaatgtaatatatatatataaataatagcacaaattaggggtaaggaatggagctgagttggagcaaagctgctatattttactggaattaagttggtaataacctgaagtaaattgtcataatttaaaatgcagactgggtgcagtcgctcatgcctatgagcccagcactttgagaagccaagataagaggattgcttgaggtcaggagttcaagaccagcttgggcaacatagtgagacctcatctctatgaaaaataaaaaacttagctgggtgtagtggcacacgtttgtactcccagctactcaggaggctgtggtgagaagatcgtttgagcccaggaggttgaggctgcagtgagccgtgattgtaccactacactctagcctgggtgacagagtgagattctgtctcaaaaaataaaatgtatattgtagtctctataaatacgactaagaaaagaactaaaacaaatacatagtaaaaaaaatttaatgaaaatagtagaccagaaatattatttaatacaacaaagatgataaaggaggaacagaaaaacaaaaagacccaagactaaagaaaataattaataaaatggtagacatgaatccaactattatagaactctctactagatgagatttctttacatgtgctgatctatttctggattatgctattggatgctatctggattgtgctattattatgctatcaataataacattaaatgtgaataaacacttcaaatggcagagattgtcagtctagataagtaacatgatccaactatatgctatctacaaaagacattttgaaagtgtccaaaatccaaaaaaatggattgaaaataaaataatggaaaaaggtataccatgcaaacagttaccataagagaactgacgtggctttaacagtatcaggcaaaacagactcaaaaattactaaaaacaaacagagacaatttatgactaaaaagttggttaatttatcaggaagacataacaattataaacatatatgcactgtgataggctgaaaaatgtacccctcacccccaggaagatatcaggtcctactccctggaatctgtaaaatgctacattacatgggaaaaggttctttgcaatgtcattaaattgaggaattttttttttggagacggaatctcactctgtagcccaggctggagtgcagtggcataattgcagctcactgcaacctccacctcccaggttcaagcgatcctcctgcctcagcctcccgagtagctggaactacaggcacacacctccatgcctggctaattttttgtatttttagtagagatggggttttgccatgttcgccaggctggtcttgacctcctgacctcaggtgatccgccctgccttagcctcccaaagtgctgggattacaggcatgagccatggtgcttggcctcagttgaggattttgagatgggaagattatcctgattatgagggaggaccctaaatgcaatcacatgtatctttagaaaatggagacagggacagatttggctatagacagaaaagaaggcaatgtgaagacacaggcagacatcctctggacgaagtgtgatactgatttcagatttctggactctagaactgtgaaagaataaatttctgctgtttaagccaccaagtgtttgcagtaatttgctatagcagctataggaaactaacatatacatttaataacagagcccaaatatacatgaagcaaaaactgatagaattgaaaacagcatttggagacttcaatatcccactagcaaaacaaaaacaaacaaaaacaaaaacaaaaaaaacaactagacagaaagtcagcaaagatacagaatagttaaacacaaaaaactaagtcaatcaactcacatccacagaacactcaacaatagcagaatatccattcttctaaagataacatgaagaattctcctatatagacccaatgctaggttgaaaacaagtctcaatacattttaagcaactgaaatcatacacagtatgctctccaatcacaatgaaattaaaaatagaaaatacaggagaaaatttggaaaatacacatttggaaaatacagaaggggattttggaaaatatttggaaaccaagcaatgcacttctaaacaatccataagccaagaaagaaaccacaagaatattaagagaattgcataagctgaatgaaaacaaggaaacaaaatatcaaaatttatgagatacagcaaaaaccacacataacgagaaaattgtaattggaaaacctgatattggaagagaagaactcaaataaaaaaactaggtttccaatttaataatctagttagagtaaactaaacccaaagcaagcaaaaggaaagaaagaatgaatattagagcgaaaactcaacgaaagagaacacagagacaccatagaggaaaccagtgaaacaaaaagttggctctttgaaaagacaacaaaattgacaaacccttttagcaagactgagccagaaaaaaagataacaccaattaccaaaaatcagtataaatgaggtaatatcattactaaccttagagaaattaaaatgataataagtcatactatgaacaactttataaaaataaattagttaaatggacaaattccaagaaagaaataaattactgacatagattcaagaaaaaatttaaaaaaaatcttgatagacctataaaaactaaaaaaactgatttggtaatttaaaatcttctcacaaagaaaaggccatgcctaaatagcgtcagtggtgaattccaccaaacatttaaagaagaaataatatgtagcattcacaaagtccttcaaaaatatagaggaagaaggaacactgccatgtctcattctatgagactagtattaccctgataataaagtcagatgaggatatcacaaaaaaactgcaaactaatattcctcataaatatagattcaaaaatcctcaaaagtagtaattcctcaagaaaatactaacaaaacaaaaatccaggacatatcaaaagaacttaaaacatataagtgtaatatatttgtgaatgcaaggctggtttaacaaccaaaaatcaatttatataatatatcatatttcacttttttgtttcttgcttgaaaatctttccctattccaatatcacatagaaattctcctgtattatcttgttaaagtttatagttttacctttatatataaagctttaatatactttcattttgtttgtggcataaaataaggttccaattaaaatttttttccccatatatctgctataggttgaattgtggccactccccccaaatttttatgttaaagtctcaacctaacagcacctcagaaggtggccttatatgaaaattgggtcattacagaagtctttatttaggataggccatactggagtagggtgagtccttaatctaatatgaatggtgtccttattaaaaggaaaaatttggacagacagacatgcatagagggaggatgatgtgaagagacacaaggagaagacagccacatataagccaatcagagggctagaacaggtccttcccgtacagcatttaggagaaatcaaccctgctaaactttgatttcagacctctggactccaaacctgtgagacaataaatttctgttgtttctacccagataatcatactttgttacagaagccctaggaaactaataaaataactatttatctcagaatcctaaattgaaaagtccttcctttccccacagttctgcaatactagctctataatggatgaggtttctttacatatcctggcctatttctgggttctctgttcacttttcctgtactacttctccttccctaattactatagctttataataatttttgatatctagtaaagcaagtccctctgaaatctgctcttgttccccaaaaggattttggccataatggtcctttgctctttaaaatcagtttatcatcttccaacaaaacaaagtaaacctactgaatggtttttatatttttacattgactttataaataaatgtggggagaattaacaatctatcaatatggcaaatcttttttcctcttatttaggtgtcctcgttttttaactaaaaatttcacagtaaattacatatcacggctaaaagcaaaccaaacaatagtaattttagactcttcatacctatctccctacattcccagggaatttaaatccaaccactgcactgggagtaaagaggatgaagacatgagagggagataccctcagctaacaataattatttccaactgcagccaccacggctgtttacattcttggccacatcattatcaatatgggaaatgaaaaggaaacaataacaacaaaaaaaacaatttgaaaaaagcttctggcatttcaattccaaaaatttttttttttaaatgttgtctggtcagtggtcttaagaatgtcatttccccactcttgttcagtggggggcatgacagtctgtctctatgctgtcatcacttgagaagtgtaaattttccattcagagaaaaaaattatacaagattgacctaattcattcagaggtgtaagatctataaaggtttatgttgaatagatttaaattttagcaatgatagaaacaagtttagattttatttctttatcaaccttgttttttcctgtcaggcaatactatgaaaggacagcatctcttttaacttgtccacatattctctgatgataatggaaagcagatagtatattcattttatttttctttaccttgttaagtgagtactatttgtgtcaccattatgaaatagtagaggagacaaaagctatagaacatacacaaaagtaaatgtgattttaactggtaaccttaggacaattcaacaagagaacgcttcctttgctatattaatgccacctccaggccttgagaagctttctgtttcaacaaggtatcaaagagaaggtaatctccaaatagggatattgtctcttattcatcgaatctaatagtgctggtccataagcaagcacccaataaatacatgttaaatgaatgaactattataatttgaatcaattatgtatattatgtatcttttggctaaaacaaaatgctctatttttaaaggtcaacttttagtgattctccccagagtatggttttctttgtctcttattcaacatgaaacttgaaggttataagaggcagtataatatgtaggtccaaacattgacattatatcataagagacagatgatgggcattccgaactcataaatttttctattatttgaaagtatgaaagcctttttctcatttatatttctgatgctgtatctgaaataaatttttttcctagttcaggtaatagtagataacagggaccaatctcagggatataattaagactgctttggttttaccctgattccaactgttcagaacaaaatataatttacttctctgaaaaactaatgaaatttaggtgagttttccttctaaaatatgtaggatattatcttctgttcataagcccatccacttagccagttttccaatcctacatttagatcttcattacttacagaaaactgaggataagagtcgttgggtgagacagtagttacagtcctctaacacaaacagggaatgtagcattactggttcactaccaaaatcatgctcctaaaaataccctatcctcttgaattaacaaccaaatacttaaaaaagacatgctgggtatcttaaaatgagtatgtcagttaattaattctctgatcccctgctaccaaccgagtattgtataatctgttattattcactgtcctatagatcatctgttcttggtgctggtttgttccaggaagagggacagctgcaacactatatccctgttcaacctgaggaccatctgactttaattgtaacacacagcttgatgtggctctggctatgagaagccgaagtatcgtctgtaataatctggaaaagcagaaacctgccaacagagggctgaaaacagggattgtgctgtctggctgcctgacgggctgcaggaaatatgattaatgagtaaggtataatgatatcaggaacccgattagcaccacaaaaaggtcacagatcaaagtagtatgcatttcatgagctgcaatcattgcataaaatctgtggaattgaagtggtaaaccaaaaagaggagggggatgaaactcttatgtgacaatatgctaaccaatacataagatacaatactaacaatttagtcacttgtagaaagttaaaaagaaattacaaaatgaatcaatatagactatattgtaaggaaactttgttcatcagaggtgtaaaataaatattttgaatgaatgaatgaggtattaaattctttcataaaggcacatatatgtaaaatcaagtatctttcctaattatgaattaaaatgaccagatatatactcaactctaaactatgtttgcatttgaattgcagtgattttatatacagttctgtttaggaatgtaagctaattcagagtctaaacaatgaagacatctataaaactcaagcagtaggaatcactgggaaaaatattaagtaaactcaataataatgttataacaaatgcacagttaatactgcaaaatattatttggtatataactttacaatcatgcccaagtttagagcgtgggtagccaaaatccaaatctacttgtaaagcaattacgtaaaccacaatcttcttttccttagtgcccttgtaaacctgtcccaaatagacctggctcttctgaggtgaaggcagtgagggtagagatgggaggtactgtcaagagagcggcttgccttaacttatgtaattaaattttttaattgtcaaaatgttggtgaaaaacttaatatataacttattcaaatgtttctgccttttagagctcctttaaagtgaagtaaacatactaacaaacttctttatattattaataatactaactatggtaatgattaacagaaaaccgattcccttgagacttaaaatttcaagtcatatttgagaaaaagtgtgtcaataaaaaaatgatcagaacatgattttttcttaaaagtatattcaccaataatgaggatattttgtatcttttatatattgtataaatatttaatatctaatatttagttaaaacattttttaaatcgtgattcaaaagacaccattaaaaaataaaaaaaggctagttaaaaaatattttcaaaatatatgttggataaatgacttttatggagaatacacaaagatctcttacaattcactaataaaaagacaacccaatttaaaaacaggcaaaatatttgaatggatacttcaccaaagaaaatatatatatatatgagtagcaaataagtcggtgaaaagatggttaacattttcatcattaggataatgcaaattaaaataacaatgacctacctactagaatggctaaaataaataagactgacaataccaagtcttgttaaggatagggaaaaactgaaacttcatacattgtaggaatacaaaatggtaaacatttttattatatgacccaggaattcccagaaatctacccaagagaaataaaaacagatgtccacaccaagacttatacgcaaatatttataatagcccaaactagaaaaaaaagtccattaactagtaaagagattttaaaatgtgatatatctataaaatggaatactatacagcaatacaaagaaattaactactgatatatgcacaacatggatgaatctcaaaaaacatcatgctaactgaaagaagacaggcataaaaagactacatattgtatgattccattaatataaaatttctagaaaagcaaaacagagacagaatcagtgattgcctggagccggcagtggaagcagaggctgactataaagaggcccaaggaaactttttgtactcgtgagtgttctaaagctggaatgtagtggcagttacataactgtatacacttactaaactccttgaattgcatactttaagaagttgaattttattatatatagattgtacctcaatgaatttgttttaaaagaaaaatcactgaaagaaaaaagttgtagtatgaatgtaacttctattcacttttgtgtatccctggggaaaaaaaaccacacacgaccatagacacctgccgcatttaaaggtttgacatttccttcagtatctttcagagcaagtttagtcttcatctctcaatcacagaaactttgtgagaatctttaaaaattcttggggtaaaagtaaaatgcaacatgttccataagactgtgatagaataatattatttactattttctgagtgcctactataagccagataatattctaggcatttacatacataattacaattgtttactcataatttcaaaattacaaatgaaaaaaccaaagctcagaaaggttaaactgctaaggtcccacaatcagcaatgtgattgataaaggattggaaaatctggtcagattccaaagcttacatattctttccactcccctgcattgtttccagtatatatagaatgcaaaatttcaataataatgagactgtaataggatctggaagataggattaattgttggtatgaaaagaaaggaatgccacattaaaaaaatgcaataattttccttttttacatgtgaagtaaaaacaatgcaactgagatttcacttttaatgtagagtgtggtaaacattctacttttattttttaaatttattttattttttattttttcgagacagagtttcactgtgtcacccaggctggagtacaatggcatgatatcagctcactgcaacctctgcctcccaggttcaagcgattctcctgcctcagcctcccaagtagctgggattacaggcgcctgccaccacatccggctaatttttgtatttttaatagcagtggggtttcaccatgttgggcaggctggtctcgaactcctgacctcaggtaatccacccaccttggcctcccaaagtgctgggattacaggtgcgagccaccgcacccggccaagattctacttttaaatactaagaataaagctccctgattccaaacttctgtgaaacttaaaaggcaaaaaggaaaagtcatattagtgtctcgaaaataatactgaacccagataatgaaggacactaaagaatccactaaagaggatactaaagagttgtttgtaagcacaaattcaatgtgcttttaagttttaacattttcatattctcaatattacacgaagatttccttcaaatgatagatacaggacataatttgaaaatcttgtttctattatgaaaatgtgcaatggccttctaacctggaacacaaaattatgttcctttcctggaaagagaagctcatatttggaaaaacttacaatcccaatttcacttctaactttcgcttaaaattttgaatcatcatgtatatatgaatgtaacttaacttctgcataaaagaaactattactttatatatcaattcaataacatttcataaagtatatacaaggattcttgagctattatgtcactttcagttagtcctatcacctacagctttgtccagaagagcaagggttaatgattatacaccaacacatgaaagatgctttgagcaaaagctcatgacagacagagtagatgattattatcttaccaatctgtttatgtgaacaaattcttctgaggttttggcccaaggaggaagttcgacatcagacactactgtcccatcatccatcactccaagattataattattgaagttgacaaacatctcagggagataataaaattcagggatcaactcctatataaaaataaaagacaatgtgatattataaactgtaggatactgactagatattcaaaaaaaggacctgatcattttctattgttcagaagaacaaaataaacacagggaatttttttttctttgcatatcatagccctgtcacagtttctcataagatagacagatcctatctaacccaacttaaataagatcttactggtataaataactttcataggctttccttcatgacatgtctcataacctcaaaactcttaaatacaaatattttagtaataactgaggtttgacaagatataaacataaattaccatgctataacaataatgacaacctaactagattttttatgaggtatattgaatttttgccagaaaaacccaaaatctttctaagcattaaaatgccaatgtcttggtctcttcatcaaccaggaagataatttattacagtttagccatggtttctcagtaccttttcctcacatttcaaaacggtcaagtttaaagataccaactctgatagaagatcaaaatttaaaattagtctagaaaatgacttgcatgagaaactgagtaaattcaatatgtaactttaataatgacatttaataagcagaaaaatgcagctgcttagccttttgtgtgtaataaaccccatatataactatttcagaggctctgtagatcagacttgaaatccagtcttgacatgggtcagtggttcagtggtctttcagatatcccctcagggccagcaatggcaggcccggctttccaaacagttgagtaaaatagggaggtcatcagattttggacaaggtcagtatgaacttgccagagcagagaaaaaaaatccagcaggaattaagctattatcacctccatgatccatgtgaaatgttgcctgactttgaattgtacatcctttgtttacaatcacattaattaactaagcagggtagaaacgagcttgttcttccaaatggctgacaaccacctgaccattagacttaaaaagcattttaactgaacaattaaaaaaaaaaaaagaccttatttaaagcttagctataaataaaattagattataatcacacaaaaattttaagattctcatcttcaaaaacaatgtatataattctaattgacaaaagaggaaaacacaggtgtgtgttattttatgaagcaaaaagccatatccaatttgtctgagctaacacttattgcatggtatgagtcatactctcataccataaataaataaactcttaataaaccttattacatttaatctcacaaccactttacaaggtaaagtatcaatcatttctacttaaaaaatgaactaaggctcaaaaaagtgctttgtccaacgttaccagttggacaaaatatggaagttggaccaggacttgtttaactgtaaagcctgtgtcctcagtcatcaaataagcctgggttctacctacacagtatatgcagtgctaaacattttaagtataagtttttaacttatatacaaagtgatttttaaaaaaggaaaagaaactctaaacttttagcattttcatgatgagaaaacaactggctatcctgaatacatatatctttcatatatatatatttatctctctctatacagcaattgttatataaataattgaaaaagaatttttgtaatgtgatttatcccaataaatcactatataattttctagtattaatttgcccaagtgtgtattcaattaatttccagctttgacaaattttaccaaaatatgttattttcacttcataatacttgtgctactgaagatgaatgttactattcccaggccttgtttcacaataaagagggaggaacatgctttccttgttcattgacaatcaaaagcagcatttgcttaattaaatactaattattctcatttcagtaatacccgctgcccacttccacccccaattcacactctatcatgattagaagatagtgtccttcttttgctggttatacctaccatgctcttgttttataattctcctagattcaaagcaataattataatggatgaattttaagtgctagttttcccctgagttttaaaatttgagagatgcatcatttccattgtaaattagagatgcataataaaatatacctaaatgcatagtaaaaatatacctaaaaagtactcttaccaacaccaatttgaggaagcagaatggaacaaatgacatttcatagcaattgttacaaaaatgaagttttcaatccttctaatatatagtgtcaaaatattatgattttgtatatttgtctgtatcttctacatctgttatttcattcaggttactcaacaaattgacaaaaaatttatttgctcaaaacaaatattctccacaagtttttttggttttttgttttttttttttttggttaagagacagggtcccactctgtcacccaggttggagtacagtagtggcacaatcatagttcaccgtaacctcaaactttaatcgatctttccaccttagcctcccaagtggctaggactataggaatacactaccatgcctggctaattttttaattttttgcagtgacagggtctggctatgttgcccaggctagtctcaaactcttggcttcaagcaatcctccccaaaatatattttattcctggcccaatttatttttaaatacacatttattatgaattattatgttactttaatattgacaccttaacctaaatataaattcaattagttaaactagaaattaaatggagcaaaaccacccataaaacaaacaagaatttttaaataagtgatatgaagaaagcaatttcaaacttttaagtctttcagctacataatatctatcatgctgggaagaaggtaataaccatcagtttccatttaattactatggattttgtgatttcctaaggaaacattttatgtaaattttgtacaatgggcattgtaaacatatttcaaaattaaaaatttaaacagtaaaaattaaaaattagctttcaacatttcacttgaaatttatcaagatatgtatttgtgttttactctattttttcacctctcactcccttcacctttaattttaagagagcagacaggcatttcctttctcaagaacatttgcagggtccagagcagaggcctcttgaaggcatctttcttttctgtcttgtgtgaatctctaagcaaacagagagtatatgaggtatctaggtgaaggaggagtcaaatgttagtatttttaaagagagagaagccaaacaggcataaattttttccaagagtagggaagcaagttctcaaaatctacagtcagcattttttttttccccagcctgggggaaaggagaagggattaagaggttaggcaggaacccagaggatggggaatggtgagcgggtcactatatgcccatacagtgcctctatgtgaaatagaagaaaggtaacactgctaggctaatgcagtcctaagagaattcagtttggtaaatggagtaagtacaggctggattttagcttccgttctttctctcaatcaagtgccctttcatgaagaacaatctgcctactgtacatagtggccccatgcatggtgcacatagggaagctagtcccttggcaccatggtttttggcatcagcaaatattttctaacagtaacttggtataatcatcagagctgcctgccttcgaaagaccatatgtatcttagacaataaagatatgactaatgaagaaaacgatggactaaagatgtgaaggctagttttctaggtatcacacaagcctggactctcattcaagccttgagaaaagaaggtccctgccctaccaatctaataactatgaaggaatttttcaacagcctaatatgaagaagggctaagttcaaattaggatatttcttgtacacttgagttggtggttataattttatacctatgtcaataatggtaaaaagttagcaatatattcactgataatatcttttttttttttttttttttttgagatgaagtcttactatgtcacccaggctggagtgcagtggcgcgatcttggctcactgcaacctctgcctcctgagttcaagcgattctcatgcctcagcttccttagtagctgagattataggcgcctgtaaccataccaggttaatttttgtatttttagtagagacggggtttcagcatgttggccaggctagtctcaaactcctgacctcaggtgatctgcctgcctcggcctcccaaagtgctgggattacaggaatgagccaccaagcccagccatgataatatatgtctagcccaggcaccgtggctaaggcctgtaatcccagcactttgggaggccgaggcagaaggatggcttgtttccaggagttcaagaccagcctgagcaacatggcaagacccgtctctacaaaaaaattaaaaaatttagccaggtatggtggcatgcacctgtgcctgtagtcccagctattcgagagattgatgtgggaagactgtgagcccaggaggctgcagtgagctgtgttcacactactgcactccagcctgggtgacagagtgagaccctgtctcaaaaaaaatacatatatattatacatatatggtatatatataaagtatatatataatacacattatagtataaagtatatataatgcacattatagtataaagtatatataatacacattatagtataaagtatatataatacacattatagtatatataaagtatatataatacacattatagtatatataaagtatatataatacatatataatatataaagtatatataatacacattataatatatataaagtatatataatacacattataatatatataaagtatatataatacacattataatatatataaagtatatataatacacattataatatatataaagtatatataatacacattataatatatataaagtatatataatacacattataatatatataaagtatatataatacacattataatatatataaagtatatataatacacattataatatatataaagtatatataatacacattataatatatataaagtatatataatacacattataatatatataaagtatatataatacacattataatatatataaagtatatataatacacattataatatatataaagtatatataatacacattataatatatataaagtatatataatacacattataatatatataaagtatatataatacacattataatatatataaagtatatataatatacattataatatatataaagtatatataatatacattataatatatataaagtatatataatatacattataatatatataaagtatatataatatacattataatatatataaagtatatataatatacattataatatatataaagtatatataatatacattataatatatataaagtatatataatatacattatattatatataaagtatatataatacatagataatatataaaacatatataatatataaagtatatattatacacatatataatataaatatatacatatatcatacatattttatatatataatataaatatatacttatacatatattatatatataaagtataacatataaatatatgtcattttatgtatatatttatatatacatatatacacatacacaaaatgcaggaagaattcagtatggacagaaatacaaatagaatgtaaatgttatttcttattaaaataataaaactcataagaacacctcttaattatttgatttaaaccttaggtagaaatgaagggtgatgtagcacatcattatcacaaaaaagaaaccacatttatttagttcttattctttttttgtttgtttaacagagagcttcagtttcacgtcactgtcctagcttcatctacctgttgccaacaacttgaaggagtttctccatagcccttgattcctgaattgttcaacatatcaacagcaatagtcacaaatacattgacttaaggagtaaacaagcagcttttctctacagaccactgagcaccccaggaaggtgcagctctctgctccaccccagcgtcttggtgtctgtgtccagcaggaaggacctggcaggaggctgaatccaagcactgctttcaggccactctattctcatccctggatcctccagggaaataagggggaaaaaaaatgacttttcctgctttcaaaatggagggccttaaaatcaaccaaagttccagaacaaaaacaaaacacaggagctggctgggtgcactggctcacacctgtggtcccaacattttgggaggccaaggtgggaggactgattgagtgcaggagttcaagaccagcttggccaacatggcaagaccccatctctacaaaaaaagtaaacaaaaatcagtcgggcatcatggcatatgtctgtagtcccagctactctggagggtgaggtgaggactgcttgagcctgggagggcaaggctgcagtgagccgagttcatgccactggcaccctagcctaggaaacagagttagaccttgtctcaaaacaaaaacccaaaaaaccccccatcatctgcaaagccatgttgggagcacaactgtttcccataggctttctttttccttgccccattgacttccagaaggttttccccttacccatcattgtgacttttctcatctttcacaatggtgcaattcaataggaagaattaacaactagaaaaggaagaacaacaacaacaaaaaatctaaccctatgaaaactctgccttcaacataactccagggagatgaacattataatactggcactcctgacccacactatcctctgcaccccgtccctgaccacatcctcctctctggacacttagacatcaggttccccaagggacaaggttccatgaagagcaccctgagttccttagaagaactggcactgctccggctcctctaacaactgagactggcactgtgggcaccaccaggtgagcctctggaacccacctgagggcccaaagggcttcttcatgacctggtggccagctgggcactgttctttctggtagacctgcatgtgctgcggtttgccctggaacttgccctgcagccaggctgtactgaactccaccacgtgatccaccagggcctcctaacatggaggcactcaggactgaaccaagagaaaggggatggatgccagctctgtacaagacttcattcttaatgacgttccctagccctgagaagtatttctggtccaatggtgtataagtgacaggctgagcctggcctagagcttccaaggcttgtcctcaatggaacttctcagacaggatgtcacaggtgggtgtgacctctggggaagagctccaaggcatctgacaattataaagtgccaggaagctaccaccaccaaagtacaggaccaacctcggggcagggtccctccggtcccccttcttgttggctttcttggctctggagaagtcgttcacccaaacgctgccaagcaaacaagagctgacacgcagccgcctcccagcatctcctgtaggggtgtctcccttcaaacattcctaatcatcctctccctgggggacgagctctgcggactgtgaggaggcgtcaagggtcttctgcccacttgctcccgggcctgctttgagtccacagtcccttccttctgcgcttctttttgtggaggctctggcggtgagctgttgccagcgggccccatttcttcatctggatcaaatctaaggaataatttctttccatggacctgggtgtcctggagccacagagactggaggctggtgggctatacttcttactgttgctccctgtctttaccacctgcttgcccacaaaaggagagaccgaatggtgaaatgtcctcaccaacagcccttctggcatcccagctccgggtgggcagccccttggcccgacccagcaccactgcacgccccgcacagcagctccagcaccaggcagagatttctcagcgccacggcacacgtgggctccgtccccttaggggacgcccctgtaggttagttcttactctttagagagaactgttttagggtctgggatacataaaatgagtcccccccaccgcccgagaatacagatctaaatcagtaatagagaaagaatatatttttaggagaaaatacgttgtgaaaacaactagcactccagaagttcaaataagaaaattatgactaaaagttggggtggccagagaaagctttagggaaaagattgtaatacattgtatttcgctaacacagaactcatcaatctgtattataactgcttgtttgtttctatctccctctaaatggaaggatccatgaaattgaggactttacatgtgaatttaaagtatgacaagcatttctaagaaactaatagtgaggagagagattattaagattttacatatagtatgaagaacaacatcaaattagcacaattaaataagagagcgagcatatatacagcaaatcctcacctactgtcatcgatagggtcttgaaaattgcaactttatgtaaaatggcatataacaaaaccaattttaccacaggctaattgatataaatgagttaagttcccacggcatattttggttgccacaaaaacatcaccaaacttctaaaaagagacccaaaacacttctactattaaatattgaaataaatgtgagctatatgtacatctaagaaagattaacaaaaataagataattatttacccatttattccacttcagggttgcaggtggcctaacacctactgcgccaactcagggcacaagtgaggaaaccatggtgccttggacaggacaccaggtgccatcccatagcagggagcacgtgcgcgcgtgcacacacgcacacacacacacacacacagagtcagatgggtaccaggtagacacaccagttcaccttatgtgcacatctttgggatgtgggaagaaaccagagtacctggaaaaagcccacacagacatgggaagaacatgcaaacaccacacagaaagtggccccggccatgaattgatgttttttttctcaccagcgatataacaaaacattgaatgaaatgacgttatttgaggacatgctgtacttaaactatattgcagtctcatcacaagaaaatctgcatgaataagtcggtgatgagagtgcaatactctcttaatacgaaataaacatgctgaactcaactgatatataccaatatgtaacaaaataaataagcataatacagccaaaatcttactgtggatgacaatggcatttaagttatacagtagaattccattttaatactaaaagcatctttctaagaaccatatcttgatacaataccaaatattacagttcaaaattatctcttttgacagatgaaatgtagtaacagagtcaaagattatgcctttctaatacttttaatgcacatttacaaagtgaagtatgttttatattcatcagaacagaacagtcagctctggataaaaaacacatgttcagcaattctttaaaacatcagtggaaaatgataagtaaacaacactgacagaagacagatacatttacaattcacgttttcttctggcttgctcaaaataattttaatctctatcacttaattaggtagatgggtcttagaggcaggtaacatggccaacatttagtgtatcatctcctaagataaaaatttgaaaggttcaaccagaggttacaccacagttcaggataagctcattgctttgatcacaaatcccaaggctttcatggcataatgacaaggattggttgtgaccacacatatgctttagttttctttattaaggtataatttccactgatatgaacaacctttgcagccaggctgtatgattctccttttaatagtcaccaattctatgcactgaactaaacccaccacttcaatatattggggcaaacataccaactactaatctatcaaccaaaaagaaacaagataatcaaaatagaaataaaaatgaagaagctcctttttagttaaaattaaatatttatttcatttttcctaaatatgaaatattgacaactcaaatagaagcatgataaattagaagttaactaatttaaggtgcactgcttagggacactgatggtaaaaaaatgtgaaagcaaaattttagcttttcaccactgaaaaaatgatttaaaaaattgaaaataagctttcttaattaacaaaaaagagctgattaacaatatattataaaaatataatgtgcatgttttgatacattttaattttcaagatttattttgttagcccataataaaacttttaaaaaattcactagagatcaagaacattgaattgcatttataatagttattttaaatcaactgcatatctgaaagctttcaagttgatatttaaatttagtttgtcctaatttggtagataaaatgctgttttttcctacagtaaaagaaaaacaatcattttcaaaattggaaaagaaaaaataatctataatccttccagaccaaccccataaatattatgtggtttttagatattataaaactgttatttcaaatgcattacaataaagaaaaatcatggattacaaatcaatagataaatgataatctatttcaatctgatatagtagaaaaaataattgggtttaagtcttgtctactcaacttactgtcacatgtactcaaattaatttaatttctgtgacccttactcacctcaattgccatttcaaaatcacagggtttgctgtgaggctcatatgggataatgcggaattctatatatacataagatattattatcattagtaggattcatgataaaaatcccaaattacagactcaacttgcctaaatcctaaagccaataggtcattcactgaattatgcccatttataaaagcatttaacataactctaagaatacttaacaaaacttactttcaaaaatatatatgcccacaaaaatatttgagacttaatacttcctgccaaataactatgacattcaaaacaaatatattattttttttattagcaatgacagtagggtttaacatgcttcatattatgataaatatccccaataatttatggttctttcttgctttcaacacatttttcacttccatgtttgaaatggacatctccattgggccttttgctgttctagacccttatctccaaataaattataatttggaaagaaataatgggcaataataatgcaaacaaaaagtgagctgtaactgccgtaagagaagatgcaaataaaatttctggaataagtggtagacatatatttagtatgggagaagaaccacttatctcagtatctaagaacgcattaatgaacagtctacattttctagttgaacaaaaaatatgataagatcaccagtcaaaaaacaaatcacacttgacatatgcatgcatttttataattctggaagacatgaatattttccaaatgccttaataggtttttaattttcctgtatagtatgtaaatagcatgagaagaaaaatattcagggtttcaagtaatttttatcaatgagcaaaatgtagttcattgtagacacgagtacaaacttcaatacttaattagcacaaagtttcatcatttaacctactgatacttgaagaaaagggctaaagagatgtggctaaattaacaaatcgcaagttatctataagttacgtataaaaagcaaggataaacagacatatttgagaaagcttgagctcactgatgaaaaagaagagaggctggcaaaaaacagaaggaaggagggaagataggaaggagaaaggaatgagcacttaagttgaaaatgtgcaaatgcatgaataaggataagattttaattttactttctttcagcattttttaaaactctaaattattaaaatggtgtctgagaaccggatgcagattttttttactaagaaaataaaattactaaatcatcgaagtttaagttttttaaaaaataaatacattaagaaatacattgccatcaattatgttctattaactgtagctaagcattttcttataaacgggcctaatgttgatgatatcagcatccatggaatgtattaacatggtagaagatgtgctgctagggaaagaagaaacctaatttatcttcagattgcagacctctgggatttctgaggtagtaaagggaagtcaaaggtctcatgttttacaaatctcacaagccacaaaactattctatgatcacctctactgtatattattatttaacatgcatatgtaatttaaaactttttaagggttaaatattaaattatatatgagttcatataatattactgcatagtcatttatttttaaaataatatttagtatctcttaggacttaattgcattctatttacttaactgtaaatatagaatatactttactgaccctactaacttcataacttaatacactcaccactaatgatgcacattaaattataaaataggtttttaagtgaaaaatccaagatatgaccagtgatggtatgtccatgttcgcaaagctatcacagtaataaaatgtagaaaattgaatcattaacaacttgtggtcagcatctgacatccagctaccagttctcttgtggacataaaatctcatcctaaaaaatgagatgttagtagtcccacttcatatcaggcatatatccatttgagtttggctgtgcccttctggctagaataagcatacactctccattttctcctcaaactacctcgctatttttcccaggctctttcactaactcttagaaaagctttatgcctcctgtcccttacagtcaaccaaatgctcatttgtttgcatatctttaatagctgtgacacagatcaggcagattgcaaagtcaatcatatctattatctggctattacttgctgaactggcttatataattaactcaagcatttttagactgttaccaaaggccttcatattagactcaactgcctttcagaatctctgtttctatgttttctacacacccgaaacataagaccaattaacagatcaataagcaatgtgccaaacgtcttttctgagctttgttcatgtcacttcccttgctcagaaccctcttcctcatttcatcacattattaattcaatacatatttaatttagtgcctaccatgctccaaacacctttgtagattgtagggataaaccaatgaggaaaacagtcaaaaatttaggatctcatggagctaatggtcaagtgggatatgacataataaacaaatcaataagcatgagataagtatgtcagatggtgagtgacataaagaaatatgaagtcagggagtaagtaaaagtgcatgaggtgatgggggcaattttaaatagggaggagagagaaggccttactgaaaaggtgacatttgagcaaaaacctgaaaggcatgaagaatgagttcttaaagataactaaaacaaatgcctcaggtgaaaggaaaaggaaaatcaaaggtgctgaggtcagaagtacttgaaggacaccaagcagaccctgtttagctagaacagagtgaacggggtggcaaacagaagagctcaagatgtaataggattttggaaaggagttaggtagtgtagggtcttacgttgcaaagatttcagcttatactcaaataggaaaccatttacgatagggggaagactgtaagaatagctttgaagaaatgaagatcaggaatttagttttgaacatgttaaatttaagatacagtttatatattcaaatggagatgtcgaggagggagtcagatatcaggagaaatgcacaggctagagacataaatgtgggaggtctgttagactctcctgcatcccttaagatacagcttaaaaatcacttattctgtaaagtcatttgcaatcccatctcccccagtcagaattaatttaattttgtttatatcttactatataagatatagcacttatcactatctaatttgtactaaaaattattttatatatgcctgtctttttcatctggagagatatgctaactaaagaactatgtctattttattcttttaattctaaatgctctctactatatattaaatatagcaaataaccaataaatgctagcctaactaaacgtgttttgggggattttaattgacttctcatagttttcttcttaaaggcagggagctaaatatctatgacctaacaaaacttgttctttcttctgtgctatatatatatgcccaagtcaaatttaatctttcactctctctctctcatcttacaagacaaatcaatcaccaaatcttaacagttaccttctaaatatatcttaaatgtatccacatttctctagccccactggcattactgaatataagccttcactgctccttgcctaattaacaacttactgactgcttccactctgggccatagacaagggcaatacatatgtcaacaccaatcacagcggtctcttaaaagcacaaaatctattcatgtcacttctttgcttcaaactctcccaagtctccccactgcacccaggataaagttcatcctctttcacaaagcagaaggcccctcatgattggtcctgaatctcctctttcctcttccttctcttcatttcagacgctgtatccatgagcccaaggggcatgagcctactgtactaaattgctgggacttgttttactgtaggtatctcctctagtgcaaaagcccactgaaggcaagaattgtgtcatatttggtgctatatcacaaccagagtctgacactggataaacacaattaaaatacaaaattttaaaagtaaatgatatctcagggttcctccaaactttttaatctaatttacttttgtacaggttataatttaataatatattattatattaaattcggggtttctaaaaaagtatggttctccaacaatctccgtttcagatccatttactactgtccccattccaaagtaatgaactgggatgacatttatgattccttctatgttctagtaccaagtagtaatcatttctacaggagagaaagaaaataatttaaactgcagcaagtcagattgtacttcaccattagattgaatttatcaacactaaaggaatctgaaatgagtaggcaacctcaagagaaggggaaaaaatcaatgacaataaattgcctagaaaagcttagatatttgcctaatatttagatgtagctgtctagtcaaattcatttaaacttcatgagtctaatttgttacataaaatttggtcataataattcaaggttcaggctgaagaaagtaaactattctgaaccccagtttctaaatttaagtgaattttaaagatttaaaacacagaatctactggggattttaaaatattatttatcacagtgataattctccaacccaattttaatactttgtatttcagtcttcaagattacagattgttgctactaattgtctgtttatttttagatgaagtacacatcagaaacatcattgttcaaaaagggtgaaggcattctttccataagcccaaactatcccttgatgtgattccaaaacaatgctctgaatctgcactgccccaagacagcagccactagccacaaatggctattgaacacaaaatgtgtggctagtctcaacacagatgtgccatgtaaatagagacatgttgagtataaaataccactggaagacttagtatcaaaaaatgtaaaatatctaataattttatattgattacatattgaaataatattttggatatatacggttaagataaattattaaaattaatttttttttacttttaaaaatacgactatgaaatcatttaattacataagtggcttatatttgtggtttgtattatatttccattggagagtcgctctaagtctacttagaaaactgatcaacactactgatctgcttcttcagggagaataaaaaccatcattgagaggtcagatctgaaatggaatcaccaatgatgcagagaaatacaaattatccacaaaactttaaaaacagtaaattatgctataaataaaagattgctttagtgtaaaaaaaggtctcttctttaaaataaaaagaattaacattttaaccttcatttcataggaataacctcaattttgggtaatattattctttgagtattgggaaaatttaagaaatagggattttaagatattcaagtaacagctccccctcagcaaaaaaacaattaagttaccagaaatgtgaccctattcttatttttttctttctgaaaaaatttaaatcttcttcataccttacatttcgtttttggaaaatctcacaaaaacattttacagaatgtatactatattaatcaggcaaggtatgctttaggatctactcaataaaatgattcctaccaccccaccatcatatttcaccatctcctctctactgtttaacatttctttagtatttctaggaactccagcaagacaatacaaataaagttgacaattataactaataatgactccacctgaaatatgtgatagctgaatgaaatatttacatatatttacatatattacagtaatttaagtgtgttcttttttttttttttttttttttttgagacacagtctccctgtcacccaggctggagtgcagtggcgctatctcggctcactgcaagctccgcctcctgggttcacgccattctcctgcctcagcctcccgagtagctgggactacaggtgcctgccacattttttgtatttttagtagagacggagtttcaccgtgttagtcaggatggtctcgatctcctgacctcgtgatccgcccgcctcggcttctcaaagtgttaagtgtgttcttatatatttatctctattataataatttaaatatactttctaaggtgccaaaatataacattttaaaaataaacaggatcaaaacaacaacaacagaggcatgattaaattcctcctgttttagaaagaccaaccaacaggaggttctttaaatagcctgtataaccatatattatacaattgtcaaagtatttgaaagtcactaagttttagggcccaaattagctggttatcaatataaaaatgggggtaatttatcaatgccctacttactatcctacagatattagggcatggtgatggagatggagaaggagaatatacacattggtggaaaaatatcagtaggcttcacaaagtaagttctgaaaaaaattttgtgcttccaaacataatgaaacatattccaaacataagagggagctggatttgactccttattatttgtgatgaaacaagaataataagaaaaataaggaagaagaaaggtaaagaagaccatgtgatttcttttgatgttatagttgtttagatttcttttttattttttttacaggtagggtattttaaagaatttttagagaaaatgaaaccagacacaaaccaattaaagaatcttgaaagaaaaaggctgaggttcaggaaaaaaagaaaacaaaatcactagcatctatcatatgtacctcctgcccatcaaagcaatgaacaggaatgtctagtacagatagaggcagaaagctgaagatacctactattgctattataaagcagcaaaacataatattcaaattcatgacttcatttttgtttatatttctagtagcaaacttaggtatgaggttaaaatttggtcatgagatgcttaacaaatgaaggaatttggaaagaaaaaaaaacccacacataagtcttcaatttcataacaaaatgtcaggcttatcaatattttcatttctcttattatttctcaaaagagttacataagtaattaaacagctttgagattagaggtaaaatttaacaaaattattatatctgttaactattcttacttacttttatctaaacatccaattcaaaattatttactggtgatttttaaagagtatgatatataattttcaagagtatatcagagtatattatttgtgagatcaaaaaccctgatagatgtcccaataaaagattatttttgtatacaatagaatcttctttaataaagtatctttcacataagcaatgtactctacagtaagatgtgaatacattttgtagactttaaagtatcatacctaaaagcaagatgcaattgtcattatactgaaaaaatttttaagtactctacagtaacatacacattagcagtataacttttctccttttggactccaatatttctcatctggcacttattttctcccatatggtataattatttatatatgtcatatttctctatggaactataaggaacttcaaaaccatagggatatctcattatacttaatagatctaacacagtacaccttgcagaaagagacaccatttaaaaaaaaatagactgtatttctgtaggtagaagcaaaattctagtaaggactattactagctactgtgcagtttttgatcctttgatctttcatgcatatagatagaataactcttgtttttgctttattaataatggaatgctttactaagcaaaatcaggtatgcttttagaaccagcagcaggcaaaacacaattatttcaagaacgggtacataggatatctaaatatctatgtctgagatttttctcatggtatttttcagactatagtaattttgttcactgagtttggaattccagccaggcacaatggctcacacctgtaatcccagcactttgggtggctgaggaaggaagatcgcgtaagacagttcaagaccagcctgggcaacatagggagaccccatctttacaaaaaataaaaaattagcctagcgtggtggtacatgcctgtggtcccagctactcaggaggctgaggcaggaggatcacttgagcctggaaggtcgaggttgaggctacagtgaattgtgattgtgccactgcacctctagcctgagtgacaaagcgagaccttgtttcaagaaaaaaaaaaaagagttcggaatcccattacgcatggtgccttacatgctttacattcacactacctaccatattttcccttcaacaaaaagattctaaagagaaagggaaaataaaaaaaacactctacaacaaaagacagagagagaggaaggagagattctgatagaggagagacagtcatgtagaacttacagggagaggccgggcgcggtggctcacacctgtaatatcaacactttgggaggctgaggcaggcagatcacttgaggtcaggagttccagaccagtctggccaacatggtgaaaccccatctctactaaaaaaaaatacaaaaaaactagccaggcgttgtggcagatgcctgtaatcccagctacttgggaggctgaggcagaagaatcgcttgaaccctagaggtggaggtggcagtgagccaagatcacgccattgcactccagcctgaaggacagagcaagactctgtctccaaaacaaaaacaaaaacaaaaacaaaaacaaaacaataacaacaaaaactcccagggaaagacaagagatagagacagagagagacatgctgtaattcttggccatttaattaaggacttatcttctgagatttatcttttgtaaatagggctgtatggcagtagagaaaattttcaacattcactcaacaagtaatgcactggcaataacaactataaaacaaaacatttctgtaccttaatatcagaggtatcacgctgactgtttcgccaagctctggaaattgatgaaaaagttcgatctgcatgatcaaatttgcctccttgcaaatttaggaaataagttgtaaagggttcctaaaaaatagcaattaaaaaaatccatatgttccctcaggcataaaaatgtggtttttataaattcttagaactaaatactttaatgactaataggcattcactagtaatataaactaggtatataatgagaattatatctaaattattacattaatgttctcaagttatttttccctcaaaagaaatatttctaaatatttcaaaaatttggtatttgcaacattttcttcaggtagccttcctttccaagaataatgtattaatatcatacagacataaattagatgtattttcttcatagtacagggaatagtccagtatgtagttttcctattgttatggctcaatatttaatttatgattaagaaaagaaaaatgtttggatgatttaaaagcctcctcttagttaaagaacacttaaacacatattagtggataattgcttgaaattagctaagcactataaattacttctaggatttatgtctgcctgtatccttctaacaagctttaattaatgatgtgctgctaatgcttttccgaagaaattgctttctagtagatgaatcacctttcaatttcacagaaacatttcttgtttaaccaatatattatcaatacacgacagccttagttttaccaacaaacttaccttattccatttgggacaaccttccaaaatatataagtacatgtctgtgttagtaacaacttacttagttcttattttaatagactacattttaaaagaatttatgctacaatttggaatctggtaagacagcaagcatctgaaggggcaaatttaagaaaaaaattcatacaattccagatgaaacatttttaaggcaatacaagccaaatgagatagagatatttataattagaacttcaataatttaaactgactcttttagtattcaaaaaaatatgcttatgagttctaatttttgcatatccttcacaacactgaatttatttagccatggtgtattattcaaattgaacttactattcttagcagccatgcaagaacaaaacttgcagttgagtaatgagtaccatagtgaaactttggaacttgatcatcttcccatgattcataacgctcagcgaagaatgctgctctttttgggttcagagctcctattggctgccaatagggagggaaaaaacaaagaatacatcaatgtaatcatccttcatgtcttcctctcttctgatgatatcctactggtaagtataaaagtgaattttaaaaatatatactacttaagctgcaacacagtatcatattgggagtaaaaagcaatattttttccaacaagttaaacacaacatataagtaagtgaatggatgaacccatcatttctccataagtctagttttcatggaacataggtgtttaatcatcccataacaagcatcagataaagacaattacatgaagtgaaatatcagctgtacaacactttggaaagcacctataaaaccacatttagttaattagaagcaacaaccagaaacagaatcttaaagctgaaggactgacttataatgggttcttagaagaggatgaaacaaaactgggagataggtgagatggagcacaaaggaagaaagaaattgtgggaaaacagggttaagaaactagaaatttctactagtgtgagtgaaaacaaaggataaaaatatgcctatatgtctatataggatatatagatatatacatatatatgtatatactttaaccagaggattaaaaatatgccggcatgaactctctctctctctctatatatatatattataaaattaaaaatatcacattaaaaataatgctatatatatatcgcattaaaaaaagaatagtagacagattatgaacttatactggaaaataatactttacagcagaggtcccagagcaatatagcaacatggtgaaaaccctgagctcactggaatgataataatactcattcaaaaggttgttttggaagataaaaatgagtaggtacgttaaagtccaacaaactatgcctgacaacgttcaatgaatgctaactatggtttttaagataattgtttagaatttgggttaaagagtttgaatgaaataattgcctttagcaaattgcttagcataagataaagcttaataaatgttagttggtacctgtatctttattattgctactgctgttgtcatttaggtaatacacgaactccattaaatagcaggcaaaattctgtgtgatcaagcctatgcatgtacatatccttacaaagacgtagagaatatgcttgagagtctcaaaggagtctaaggctcaaaaaatgttaagatcaactgctttaagtaacaattcattctcaaaaaacattctgatctctagaaaatctctattccgtattcaaaatgttaagtacccactcactgaaaaagacatgatatataagattacttcttttcataagatacagaggccaggtgcagtggttcacacctataatcccagtgctctgggaggtcgaggtgggagattgtttgagtccaggagttcaagaccagcctgtgcaacatagtgagaccctgtttctacaaaaaaatttaaaaatcggctgcgcatagtggcatgtccctgtaatcccagctactcgggaggctgaggtaggaggattacatgagcccaagcaccttaaagcctacagtgagctatgattgtgccactgtactccagccttggtgatggagagagtccctgtcctgtctctaaataaattaataaataaaaaattctttatttaaaaaaagatacacaacagtcttttgccttatatcatttatgaacacctattagttaatcactccttatttataacagaaagaaaatatctgattatttgtggagaaaatgttaaaataaataaatcaaaaatattggtttaaaagggatgcactgagaaatattttattgaaaatgaagcaatgttcagaccagtttttaaactgcttttcatgttacatgttaagcaacatcttaaatttatcattttggttatccttattaaattgttaattattttttcaaaactatctttggcatcatcactcaatagcttggttttaatgaatattattgtatgttaaggcattttttcctttacaagcaaaattttaaaaatctttaattaccattttaagtcagtttcacagtaaactaatttaaaatgctatcttttaaagcattagtttctgtacaaaagaatcatatctgacttactaaatatgtgccagttaagaatggagctgactccaaggattctttctttgttacagaaccaatttgaaatgcctttaaatgtattttagttgttgtccctaaagaatgagccatggaaaagaaaagagagaagaaataaaatcactagaagacaaattatatgaattaaaaatagaatcaatgctccttttgtatggtctgaagcataataagtattcactttatctgctcctatttttattactctccaaatgagtaacccccaaaatcaatagttatagaatcacgtttcttgaatataatgctaaaaccaattaggattgatttcactagcatctgaaaaaaaatggcatcttgcagagatccatattggtagaacccacagtattgattttggctgttattgttacagttggtttctgaagcctgctatacgacagctatcaagacataccacgtttatttgcaagcatataaaaaagaagtccccaaataaaagaaagttaaaaaaaaaagaccagtggagctgtgcaatgacaatgatacactatcagcttactcagagaagttacagtgggaatacacacattgaattatacattacgcgaaagcactgatttattgtggtaataacatccacctcattaaaagattctgctttgctgcagttggaaggctacatattgtttactgctataaattaatggcagtgcaaagaagactgtggaaccatcctaacaatagatctgtaatgacagtgctgtatatcacagcttcctcagcagcttcataataaaatggagacaatgtattgagctaatacattctaccatgctggcccacatttttctgacaactgctttaaaagatgatctgaattcaactatgttataatgctgcaaaacatttaactaagcaagagtcagtcatataccaaagtgcatcaaagcatttttaaaacattgtctaaatcagcatttcaggatgtttattcatctctgcaaaagaactaaaagtaaatgctgacggatcctcttacttatatagtatattaagagtcaaaattctaagtcagtttgggaagatgctagcaccatcatcctacatagagcttactgtacaatgtaacaagcttgacaaagtatttttcttaaaaagcaagattttaaaggaaagtgactcaaaatactggccattaaaaatggtcataatttcttttaaaaaatcagtaaaagtaagtattgattagaaagtataaaagtggtataattccaggtaaacacaaatagctctagaatacagaaaaataattttaaacactacaaaaagctaacaaataaatagaattatagaaggttttcttaactctacaaactaagaaaaaatctcaatcacaatacaatgaaaaataggtttaagtaaaatagaatagaataatttaaaatgtagagtattaggtctaacaacaaaatattatgttaaaaatataaataaaggacaggcacagtggctctgcctgtaatcccagcattttggcaggctgaagcaggagaataacttgagcccaggagtttgagaccagcctggacaacatgatgagatcctgtctctataaaaatcagaaatcagatgggcatggtggtgtatgcctatagtcccaactacttgggaggatcgcttgagtccaggaggttgaggatgcagtgagctgtaatcgcgccactgtactcagcctgggtgacagagtgagaccctgtctcaaacaaaacaaaaagcagaaataaaaacttagattaaagtaggaaaagacaaattaaagaaaaccaaaactcttggaaatggtatgaatagccaaaaatcactgtatttaggatattttaataatttcacaaatagcaaagctgacatctgtggtagaataataagtattctgcttatgagataataatgatatctttcaaaacaggatatgcaaaataaaacttgtaaaattggttttgtaagaagactgcaattaaaaaaacattttttgttacgttctttgagaagtaattttgctagttaacaaaatccctgcatataaagtgatcagttcagtgcctggtacataataataatgataataattattatttttttcaggttatttgatgaagaatatttaataaaaaaaggcactaagtaagcctgatgaaattaatgggatctattaggaaagaccgtgattaaacatcacaatcctctaaagacaaagcaggataagaacatatagtactgtggatgatctgtaagaagcctaagagtaaacagtagtccccatcaatgaattttactactttaagaacataatcaaaacaaaattacttttcaaaaatccaggggcctccaaattttactacgaaaagcataagaaatatcaagcaacttataatcacctcctactatattatttataaagaaacagtttgaattaacagactcctttaaaagcacataacagactttggtctaatattagtaaaagctgtaaaaaggtatctgttttttctttctttattaaaattttaggaactcttacctgaagttatctaattaagaataccacctccagcttacattttgtaatttattaaacattattatacattctcataataaataggtaatctagatattcctattttaataataaagaaatgaattgagtaacctagctcgaaatcaacataaatttagaagactcaaacctagtactcaaaagtccttctctgggccatgttatgtatttatatttaaaactattgtattacaagttggttttcctaatttcaaaaatgtgctgtaatctcaatttttcaaatatttctttacttaacaggttgatttaaaggccaatataagtaagcacttagaagagttcctggcacacacacaaaaaaatacttaacaagtgtagctgctattaatgtgcttatataccataactataattccttctttccttctgaaatttatatatgaatgattacaattaatatcaacctttcagaagtgaaattccaaactactggactatacttatagttattgaaggtaagaaagttctgggaaattggcaagaaatctcagattttttacaaagcagagatttgcttgtgttagctaacttctcttttaaaacccaaaagtctcaagggagtttttcacacctttctgtaaaggctttctttggaaaatcattaaactccaacgtttggagatgagaagcagaaaagattggggttaaagaaaaggaaaaaaaggtaactctaaaccaaaacactaataaatagggtgcttgaaaatgcttaagcatagtattttatcaagatacattctgtgggtatacagaggagtgaagaaaagttgtcaaaactgaaaagaagctcaggaaagggaggcaaaagagcaggactgctttacaaccctgcttaggatcctgatgactggctgaaagccatctgccaatgtaatcttcatttgatatgactgggaaatcagaaacatcctttaatttcgtgatgacagataaagcctgccttacagtactgaagaaggtgcatgcaattagaggttatatgttatttcattcttccctaaaagtagggtaggccacaggaaacaaaagaaaaccactgcaaagtaagaggaaaaaactagtaaggaatagaatacaagatggctgaactcaatgttcttctatgctataaaaatgtcaggttaaaggacagaatatcatcaagcatctgatatatgttaacatattaagtaaaaaatttcaaattcagagaataaaagaggatagatacactattaggaaatgttacatcataaaagatggtcattcttgattagggaataatgatttggtctgagaagactccagggaaaaactatgatatatatgtcaaaggtgccattttatctgatgacaatgctactatttgctgaatataagcaaaggttctacgagtcttacataaatcatctcattatctttacaacaactcttaatacaaagaccaattagcatccccaatttgcaggtgaaaaaaacagttcgggagaaagtaaatgactatcagtggttggttaccagccagtggcagcagcaagattaaaagccacctcctgactttttaatgatcgccattctaactgctgtgctgcagaggatgtagagaaataggaatacttttacactgtttgtgggactgtaaactagttcaaccattgtggaaggcagggtggtgattcctcagggatctacaactagaaataccatttgacccagccatcccattactgggtatatacccaaaggaatataaatcatgctgctataaagacacatgcacacatacatttactgcggcactactcacaacagcaaagacttggaaccaacccaaatgtccaacaataatagactggattaaaaaatgtggcatatatacaccatggaatactatgcagccataaaaaaggatgagttcatgtcctttgtaggaacatggatgaagctggaaaccatcattctcagcaaactattgcaaggacaaaaaaccaaacaccgcatgttctcactcataggtgggaaccgaacaatgagaacacttggacacaggaaggggaacatcacacaccggcacctgttgtggggtgggagcaggggggagggatagcattagaagatatacttaatgtaaatgatgagttaatgggtgcagcacaccaacatggcacatgtatacatatgtaataaacctgcatgttgtgcacatgtatcctagaacttaaagtataattaaaaaaatatatatatatatatatatttttttttttttttttttttaaagccacctccaaccaaactgactagcaaatcccagagtgatttgggttgtgtggactggtacgctgcctctgcaaggccattagaatcctttcatgggagctttagattaaatgctcttttgaaaaaatactattaaagtttttatccctacttacataatgtctgtggatatcaccttagaagaaggcatcaaaaccgaatttttttaaaaagcgtattttatcttggggacatcaaaaacatgcttggcaaatacagtttttttaaaaaatgtgaacaaaaaaggtaaatgttgtcaccaaagtttattgccttatcttccttttaacttttctgtttttttcttttctatcttttccatgaacccaaatgagagcccttaattttctgtgttgctgaggctttttatagaagccaatgaatttgattcccagtgtctccatcacctgccttcctcccccaccactctagtgaagaaaataaataaataaatagtgtctgtcatttcagcaacattgccactgttagggggtgcagcaactattttctttcaactgtagcgctctttcatctaaatgacaagtataacaggcagcctgatcagcattttcactcaaccttggcttttagggtatttcgttatatgctatataaggccgaaatggtttggcacttatcctcacatgctctagattttatttaatactgtcaagaaaaaaatttcatcagcacaccaccgtggcttttagagttaacaaataagcacttttgttgtcaagtaccagaacactttttaatcccttgaaaacacatcttcttacaagtggcattaaatatatactcactacaccatttcgatttaacaaacacatcttggggaaaagaaagtattccattttacttattgtgcctatgtagaatctaaatcatttcaaatgcttgcactgatagatttactagtgatgtcttcatagttctatgttattcagctacacagtaagtattaagtaatttttctacaggtgtttatctcattttgagaaaatcacataaactgttaaaaataatctattaatccaatgccactgctgagctaaatgcctataacgaccccatagacagtccaaaaaatccaaggataattactaaaaatgttttaagttattatgaaaatgataaagaatgctgatataacaagatctatcaatttgcagatatattcatctgcccacttaaaaaaccagttaaggccattaaaatcaaataaatctatatgcttttaagataggtcattagtggcatacatgtcaacattctgctagcttctataaaccagaaacaaaacaaaattgggaactacttaagaaacattcagcttttgaaattcattttctatttgctttgaaagtcatctgaatataataaaactggttttaatttcggaaaacctctctctctctctctctctctctctctctctctatatatatatatatatatatatatatatatatacatatatacacacacacatatatatatgttgttttgctcaacgctgagttgggaaactgtgtgcttattgtttagcttaagcctgggctaatggcactaaatatttcaatgatttgcatgtgaagcacaacaaaatatatgattataaaaagcaaggaggattccaaatccataaagattagtaaaaatagttattttattctgttttagactaataaattgctttttggaaaaaatattaaatcgttttaaaaatgtgtttatttatttagagacaggctcttactctgttaccctggctcacatgcagtgatacagccatagctcactgcagcctcgaactcctgggctcaaacgattcttctgcctcagcctcctgagcagctaggactacaggtgcatgctaccacactgacataattttttagttttttgtagacccaggctggccttgaactcctggcctcaaacaatactccctcctcagccttcctaagtgctgggattacagccatgagccaccacccttggctggaaaaatactaaatcttaatacaaaaattagacataaagtagcataagttaaagatatcaatatataaggcatggatggaactagaggcattatgttaagggaaataagccaagcacagaaagataaatatcacatgttctcactcatattttggagctaaaaaaaaaagtggatctcataaagattaagagttagactggtggttatctgaggccaggaagggtaaggggaaaatcgatgaagggagattgattttaaaaattatgttaaagaacacagagagagccaggcatctgagttgtaaggcattttaaaactatagtgtacttcaaatatcaaacaaggagataaaatattgtttggcaaatgtaaatgagcctatgtggtagctttcagaagaaacagggcaactggaatcaatttaacaagataatctctaatgattccataagtgcaacagaagacactctaataattctcatgacttaagaatagccatgggtcatacataagagctggtaaatgttgataacgcttttggagtagattattagcaatgtgaggactgacaggcagttacattgcagttgtattcctagaaaaagcccaatcctggcaaggaaggtcaatgatattcaacctctaaaacaatccccaaaatgaagcccttataccaaaaagcagactctgctaaaatagtccagtccctgtatattcctccccagtgctccctcaaggaaagcaaaatccactagtcgaataaaacgggagcagccagattgctgaccaaaaactttgctccattgctggcgaaatgagtcaaaaaataaaggcggatgagattcacaactgctatctaaaatttaccttatttctctgtgcaagagggtatgttgggatagtcatcaacatagagaacttacattttaccctttttaaaatgaaaattttattgtacttttccctctacaactatatatctgatctatatggtgggggagggggttaaatttagtcatttaattgtagtacagtgataatcaatacttatgagggactagaaataagccagtaaagctcggatttagaaaccactgcacctgcaatagctggacagggttttgggctgcctctacaatttaagacaaaaagaaataaaacatagcataaaacataataaaaatcctttgttcagtttataagttactaccttccctttatcaactggaaaaaaaataacctcatgtaacacaaatcatatgaaataattttatgtgtcaacttgactgggccacagggtgcagagattaagcattatttcttggtatgtctgtgaagatgtttccaggtgagattagcctttaaactggtggacacagtatatagatttctttctccaatgtgggtgggcatcatccaatctgctgaggatctgaatagaagaaaatgcagagaaaggaggaatttgccctttttttcctgtctcactgctgaagctgagacagctcatctcatcttttcctgttgtcagtctgggatttacaccatcagctcccctggttctcaggcctttagacctgcaatgaattacaccaccagctttccagggtctccagcctgcagatggcagactgtgggacttctcagcctccctaatcacatcagccgatttctcataataaatctctttttggatacagatacatagataactcctattggttctgtttctctggagaacctcaagataccacatcaagaggaaatgaaattaattcataaggtaaatatagagtatttcttcatattttgagatcaatattgagattacaatcacttataaaatagaatacaaagttttataaactacctcattctggtaatagatggcaaaactatggttccaccatccacactccttttcccaaatgaggcaccttttttaaaactttcaaatttgacattacttaagaagctcattttaaaaagtgatttaacaacacgtggaggtcaaagaatgcactagacaattcacaggaagaaaagcctaagaagtccattaaccatgtatccaaaatgggtaatttcatatttaaaaagctagctaagttgaccatttcctactaaaaggaaccagaggtccttaaacaaatcgctgattctaattctggggcaggaaatatacaaaatagcctaggacaccttgttgtgccacaaggcaaaggatttgtcaaatattaatgggattgtatctaagggacataagacccttcttaaagagacctcactagacaaagtcgtggcaatttcggtaccacaaagaataatgcagttctaccttcatataaaaatgtagaaagtatcagggaatgttgctgtcattgtaacaacaataaaaagactaaaagttgataaccatttttgtactaatcagagagctgaggtaaaagacaaccaaatgaagtaaattccaaaaagttacaggcctcttcaacgagagatggtacaaactgctataattttggcaaagcatgggaggaagaggtagtcaacataaaagtaggtaagaagaaggccgggcgtggcggctcacacctgtaatcccagcacttcgggaggccgaggcaggtggatcactggaggttaggagttagagatcagcctggccaacatgatgaaaccccatctctaataaaaatacaaaaattagccaggcatggtggcaggcacctgtaataccagctacttgggaggctgaggcaggagaattgcttgaacccagaaggcagaggttgcagtgagccaagatcatgcccttgcactccagtctgagcaataagagtgaaacagtgtttcaaaaaaaaaaaaaaaaaaaagggggggggggtgggcaggaaagaagaatctgctaaaatttataaagaatttctaaataccagtattgggtgaatagatcaatgtagaaacacacgggagtttgcatgcacttgtaagctcttttccacgggcctctcccattgctcatgagagagaatacgactgaggcaaggtagaagaccagggggtagctctctaagtaacacaggcacacaggatatgatttacagttactgggaatggcaacaaaacagaaatcaaaatccttaagctgatgggagaggaacaccaaactctcattccaggtcctaagcaaatatcaacttgcacatggggaaagagtacgagcaaaactaatctaccgcaggaaaagggatagaaaatcctgtgtaccacccctaggacccaggcaaagatccactgcttctggggtagggtaaaagcaaaagccctttcaagaagacatgtcctgcactgatgcaaagaagaggtctgctactactgggagaaggataggaaattctttcctgtggatgccatgaggggtagaggcaagaacactgagaaagtccgtacctgaggaccatttcaatgggatctacttaagaatgaggatgaatcaggagaactgaggagctaccctatccaccccacaacaagcctggcactgagttaccaacaacagcaatctacttctggaaaaaaaaaaaaaaaaccagaaaagtacataaaaaaatgcctctgtggcacaggcatagagggtcggctagagagtagagcaagaacagtgagaaaaaacatccaccacccaggccaaattcttacagaagaatttgaagtttatactgtatttaaggtaataatagcaataacaaacctaactaagcttatctattgactagattgactgaactccccacactaactacctgacataagaagaagcatatacttctttgggcataaaatcttattcatatcccagcctatactgttctcctatctcagataaaatagaatcataaaaataatctaaaagaagcacataaagggagacaaagtacaaagaactgatgtgtagaataaaaaacagcaagaaggtagatttaagccaaccatataaaaaattacattaaatgtaaatgacctcaacaccccaattaaaatgcacagattgtcagactgggcatgaaagcaaggctctattatatgttgtccataaaaaaaaagttaaatataaagccatagacaggcttcttaaaataatagaaaaaatgctgcaagtaataatcaaaataatgccctcctgggatattaacatcagaaaaagtagatttcagaacatgaaatattactaagtataaagagggacattgcataatgaaaaatgaattcttttatcaaaaaaataacaatttgaagagtgtatgcactgtattagtttcctagggctcctataactaaatatcacaaactaggtggcttaaaacaatataaacttattgcctcagagttcttgaggctagaaatctgaaatcaagttgttggcaggttcatgctctctttgaagcctctagaggaggatctttccttgcctcttccaggttctggtaggctcagctgttccttggcttgcagcaacacaactctaatatctccttccatcgtcatatagtgttctctccctgtatgtctgtctttatatgacgttttcatacaagaacaccagtcatattggatttgggcccaccctaatgaccttatcttaaattgattacatcttcaaaaaccctatttatgaataaggtcacattcataggtacctggaggttaggactttaacatatctttttggaaacaaaattcaacccataacatgtacccaaaaataaacttgaaaacacgtaaaataaaaactaacagaactttggtgaggtggggtggcttacacctataatcctagcactttgggaggccaaggcagacaaatcacttgaggccaggagtttgagaccagcctggccaacacggcaaaacctgtctctactgaaaatacaattagctgggcagggtggcacatgcctgtaatcctagctactcaagaggcgaggcatgagaattgcttgaacccaggaggcagaggttgcaatgagccaagatggcaccattgcattccagcctgagtgacagggcaagactctgtctcaaaaacaaaacaaaacaaaacagaacaaacaaatagaaaaactaacagaactgaaagaaaatatagacaaatctaacttatagttggagacttcaacactcttctttcaggattcaacaggacaagtagaaatcagtacggatacagaagacatgagcaacgacatcttcaaccaattttacttaattgatatttatagaacaatacttaacaacagaatatgcactcttttcaaatgcacatggaacattaatcaaggtagactatattctgagccatcgaacaaattctcagtaactgaaaagaactgaaatcatacagcgtatgttcctcaaccacaatggaattaaactagaaataaacacaagaaagacatctgacaaatccccaaatacatggtaactaaacaacatatttctaaataatccatgggtcaaaaagcaatttacaagagaaattagaaaacatttaaatgggatgaaaataaaaacaatatataaaaatgtgttggacccagctaaatcagtgctttgagaaaaatttgtagtgctaaatgcttatattaaaaagaaaaaagttcttaaatcaatagtttaaagtttgcaccttaagttactaaaaaggaagataaattaaatctaaatcaaatagaaaaaatatagtatggaaagcaaagatcataggaattgaaaacagaaaaagcaatagaaaaataaataaaatctctaaccagactggtccagagggagaaaaagaagtaaatgccagtatcaagaatgaatgaagggacaacttagatgaaataaacaaattttgtgaaagatgcaaactaccaaaactcattaacaaaaagataacccgaatagcactttatctgttaaggaaactgaattcaaagttttacaaaaaaaccttcccagaaacaaaactcttggcctaaatggcttcactcatgagttccaccaaacatttaagggtgaaataataattgtatatcatcttttccaggaaatagaagaggaaaaaacaacttcaaaactcattttgtcacgtaagcattaccgtgatgccacaactaaacaatattacaggccaatatcctttgggaacatatatgcaaaaagtcttaagaaaatatttgcaaatgggatccagccatttattaaaaggataatacatcacaatctggtttatcacagaaaggaaacactatacaatcagccagtgtaattcactatactaaccaactaaaaaagaaaacgcaattatcttcagaaaaagcatttgataaaagtcaatacccaattatgatgaagactctcaacaaacttcttatagaagggaacttctttgggaggccgaggcaggcggatcacaaggtcaggagatggagaccatcctggccagcatggtgaaaccccatctctactaaaaatacaaaaattagccgcgtgcggtggtgtgcacctatagtgtcagctactcgggaggctgaggcaggagaatcgcttgaacccgggaggcagaggttgcagtgagccaagatctcaccactgcactccagcctgtgcaacagagcacgactccatctcaaaggaaaaaaaaaaaaaagaagggaacttaacctaatagaagcacctacagaaaagcctatagctaacatcacacttaagggcgaaagactgaatacttttcccctaacacaaaagacaaggcactctcagtacttgttaaccttgtatagtgcagtaagtcttcatttcacaatgccatttatgtataaagtcccaaaaagtctacaaaaaggctgctagtaataataattgagtttagcaaggatgcagaatacaaggtcaatttacaaaattcagctgtatttctatatactggcaacaaacaactggaattaaacgttttataacaagattaaaaacatgaatttttaaaggataaattaacaagatatgtgtaagaattgtatgctaaaagctatggaacatttgagagaaactaaaaaaggactaaataagcggaaaagacactatactaaggaattggaacattcaatattcttagtactttatttttacccaaaatgatctacagattgaatgcaatcctaataaaaaatctagaaggctttttaaaaattagaaattaacaggaagcaaaaagcctagaacagccaaacaatttttaaaaagaaaaataaagctggaggattcacatgactttattacatgatttactataaaaccacagtactcaagactgtgatactgatataaggatatactgattaattgtgaagaacagagtctagaaatagacctacacatatatggccgattgatttccaacaaagattccaggagacctccagagaaaaagtctttctaacaaatggtgttagaagaattggacttctacacacaaaaaaatgaaccttaactcttaccatgaacttacaatacattctagacaaaaaataagtagcattagcagccacaatacagaagaatagtaataattctgtttgatccaagttgtttttagaaaacccattaacaccattgggtcaaaataagtagatagtcaattacataatctaaatcagcagctttcaacttttcctgtaagacagtctctaatatatatacacgtacactatctattcacagatctcttgcaacaaacccacagtcccctcaagtgaccagagctcacaggttgggaacaactggcacatcttcatcttcctttctaccaacaagacaccagcaagtgttatacatttaacactgactaatcttaaacctcttttcttccttttcctgtacgaaaaattcaaccctaaatgtaagaattcataatagtccttcatatttcacttgaatatttcatgtgaatgtttcgatcaaaacgatttaaaagttttttttttctttctttgagacagagtctcactgttaccgaggctggagggcagagcacgatctccactcactgcaacctccaactccctggttcaagatattctactgcctcagcctcccaagtagctgggattacaggcacgcaccaccacatctgactaatttttgtatttttagtagagacagggttttaccatgttggccaggatggtcttgatctcctgacctcatgatctgaccgccttggcctcccaaagtgctgggattacaggcgtgagccaccacaaccaacctcaaaaatttgtattttaatttgtgtaaggtaagctacatggtcaatttgttatattagtgaaactgctgaacaagtcagaaactgggacagaattctaaaaagatgccctaaagaaggcaatatctcaagtttataaagacaattaaacaataggattgtatgatgatttgaacagttattaatgttactaacgacttttaattaccttgtctgtatttcagacaggtaacactcagattttaaaataatttactgagataggtcacactagatctataactttcccaatttactggcctaatcaaaacttttatttttcttttttaaatttttaaaaatttcaatagctttagggggtacaagtagcttttggttaagtggatgagttatatagtagtgaagtctgggcttttagtatacttgtcacccaaagagtgtaccataggtgatctttcatccctcgccttccccctcagccttctcccttctaagtctccaatgtccgttatgccactctgtatgcctttgcatacccatagcttagttcccgcttacaagtaataacatgtggtatttggttttccattcctgagttacttcacttaggataatgacctccagttccatccaaaaacttttatttcttattattaatttttttggtgttcagtgttttttatttttttttattgcttactccagttttattttattttttattttttttattatagtttaagttttagggtacatgtgcacattgtgcaggttagttacatatgtatacatgtgccatgctggtgcgctgcacccactaactcgtcatctagcattaggtatatctcccaatgctatcccctcccccacccccaccccaccacagtccccagagtgtgatattccccttcctgtgtccatgtgatctcattgttcaattcccacctatgagtgagaatatgtggtgtttggttttttgttcttgcgatagaaataccatttgacccagccatcccattactgggtatatacccaaatgactataaatcatgctgctataaagacacatgcacacatatgtttattgcggcattattcacaatagcaaagacttggaaccaacccaaatgtccaacaatgataggctggattaagaaaatgtggcacatatacaccatggaatactatgcagccataaaaaatgatgagttcatgtcctttgtagggacatggatgaaattggaaatcatcattctcaatgttttttaatttttaatttttataggtacatagtttgtgtatatacttatgggatacccaagatgttttgatacaggcaagcaatgcataataataccatgtaaaatcaagtgtctaccccttcaagcatttatcccttgtgttacaatcaaattatatttttaattatttttaaatgtacaattatattagtgttgactatagtcaccctgttgtgctatcaaatattaggtcttattctatcttgataatttttttttgtactcattaatcatccctacctatactccattccctcaccacccttcccagcctctgggaaccatccatccttctactctctatctccattagttcaatggttttgatttttagatcctcacaagtaagtgagaacatgtgatgtttgtctgtctgtgcctggtttatttcacttagcataatgacctctagttctatccatgttgttgcaaataacagtatctcattcttttttatggctgaatagtactccattgtgtataagcaccatattttctttattcattcatctgttgatggatacttaggttgcttccaaatcttggttattgtgaacggtgctgccaacaaacttgggagtgcagatacctctttgatacactgatttcctttctttagggtatacacctagaagtggaattgttggatcatatggcagctcatttttagttttctgagaagcttcaaaattgttctccacagtggttgcactaatttatgttcctaccaacagtgtacaagagttctcttttcttcacatgctcaccagcatttggtattgcttgccttttggacataagccattttaattggagtgagatgatagctcattgaagctttgatttgcatttctctgatgatcaatgatgttgagtgccttttcatatgcctgcatgccatttgtatgccttcttttgagaaatgtctattcaaatcttgtgcccatttaaaaaattggattatgagatgtttttcctatagacctgcttgagctccttacatattctggttattaatcccttatcatatgagtggtttgctaatattttctcccattctgtggcttgtctcttcagttttttattgtttcctttgctgcgcagaagcctttttaacttgatgtggtcccatttgcccgtttttgctttggttgcctgtgcttatggggcactactcaagaaatctttgtgtagaccaatgtcttggagagtttccccaatgttttcttgtttcacagtttgagttcttagattcaagtctttaattcattttgatttgatttttgtatatggttagagataaggttctagtttcattcttctgcatatgaatatccagttttcccagcactatttattgaagagactgtcttctccccagtgtacgttcttggcacctttgtcaaaaatgagtccactgtaggtatgtggatttgtaaaatcttttctttttaaagtaaataagttaatgcagttcaacgggatgtgtatcccagtaaaactactgattttcttttcctctaaattaaaaaaactatttgtctattctaatttttatattgctcccacaataatatgattttgtttgcagaatttactcctttccacttccaaaaacttgcttcaaatgataaattttggattcacactttttaaaaaattccttttctgaaagtaagacaatctaaaaattaagctactgaaaaatgttgtcttattagtcttgtataaatgttttaaatataacatgcatgcaattataaaggtctttaaaagtacgaacaatttaactcacttttgtttctggaagagtcctcagaatagtgtagacaaaagatgcccagcaaatacttaacaattatttgaacaaacacattgaatagaacttggagaatagaattggacaggaatttgaacataagaataaaatatatttattacattatccactgtaaaaaagcatagtacatattcacatacaaagtaacttttaaaatcataggcaagataagaatcagaagttgatacatgcaagtatattttaaaagctacaaatgcatacatgttttttaaatgtccttctactaaattcactttctataattaaaaaaaaatagccaaatcaggaggatagttactactactaattaaacttaaaaaaaatttcctaggtgttttgaaaatagttcctatgtaaattcacagtagatattccctactctaaacctacctcagtttgtacacccagcaccaaacaaatacaaagcattatgggataaaattaataatgctatgcaaataaaacaattcatttataaataataataaatagtcactccacatcacagtaacttagcatgattagagaataaatacttaactttgagaaggattactgactggcagtgtgttgctggtatatgtcaggattattcatcaccctgacagtaatattaaccacaatccatttcagttgcttcagtttatcattttctgactaatgttaaaaaacaatgtctttggaggctgcttgaattaagtgtagaattaacgtctgttagagtcattcaaaaacttctattagaagataacttctacagaaaaccaaatctgctatacagagtactaatgcttaaaagatgtaagtttcgaaacacagccatacaaaataaatggactaattctgttttaaaagcaaaacttcaacaaatcctgtaaatgccttataacatccatatacatatatattccttaaatatatatgcttccactttcctgaacttagtattaaattctacataaagagttgcacagacacattttaaactaacatgccacattgaacacgtaataattcaatttaaaaaggtcagtgtacccatgaaaaattttcttcagggttatataaattaaatagctacacagtttgctacctaggatcctcaaaattaagtaatctgctaaaggtctctctacttataaatggtaacaggaatatacaactctatctaaatccaaagattccctgctctggtctaattttatctttccaggctgttttctccacatcatgttgatattccttttagaagatatctgcatttataactcttctattaatttttatactgctctttcttgttttatgattattcactttccatagcataattttcttgttctattaatgcaatagtttccctttatctgaaaatatttattctagtttttttttttttaaaaaaacacttctgtttcataaattgcctctgtttcttctggttttgttttgattttctatttgctttggtctttgtcatctttcacattagaggttgtctttaaatgtttgctaatacttggctgcacctccatttttaagaatgagacactgaagagctgactgagcatatagaccataagtagtgatgtgaactggtagacttcactgaagggaaatcaagtgggctcgaagtagaatccctaaatgttttatttttttaggtgttttcttttgagccagtgaatatgtccaaagagtaatacaatcttctgtcttatggggtggggatggtataagcttagctgccgcagttctaatagcatgacagcagaaggggtctaggggctttcacgacttggtacttaaagctttcagttataatcctcctgttttccatcctttaccttaaaccctccttctggtgtgcttggtgttctcatatcagaaacgtgtctggtaaaatttctccaaaaaagtcaatctcttgctttttgacaatacagagggaagagtagttggattttggaatgaagcagatataaagcaagtattgaatttaaaatgttctttcagattatacctaaagtctaccagttgactgacagacagatttgagatcaaatcctgagcttaccacttggaaaatgtgtgacctcccagaattctttaacctcactaaatcttagtttccttatctgtaaaataaagacaataacacattccttacagggttattgaaggaattaaatgaaacagcatatgtaaaatgcctgtcatagtggaaagcacctattagggcttccctcacaatcctacaaatacgttgggaactctccccatatcatttttatgcttattagactgcaaactttccaaggccagacaatgtaatttatatcataatctctaaaatcaatgtggcatacaacagcatccatgtttgatgccaagattaaactattttaacatattatgtcagccaataaaacatatccaaaacataatcaagtatggggtaatttttagtttctttctctgcatttatattttatttaaacaatttaagatctattatttactgttgtagtatcataagatgtgtttcttttggtaagcttgaattcctttagcttcactgaagcccaataaatagaaaaatgaagtaaaagccataacacctaacaagtttaaacaatattccccccacccccaagagtgttcttttccctctgtgacatctagatggtatattgattcccagtgtatctgttacagagcagactaaaaggactggcattcatcagaaacagcacttaaaacttaaagagataaagaagtgctgtctgatcaacaacagttaaatgtcggtagtcaattccaggtcaagatgcatgctgtatattaaatgtgtgtgttaaacagaaatatctcacacataaaaatatacatccaaatggtaggagatacatgaaggagagaaaaaaaaatcacttacttttcctgaaagagagagcgagaaacagaaacatatactaagcacaaacaggagcaactcagcaatgaataacaaattcactatggttctgtcactcagttctcttcggttttgtcagaatctactctttagaactatttggatccaaactagggcaatgtaaactgctaggttaacagagtgtgaatagtctagcattgtaacataggtttaaaaacaaaacgaaacaaaacaaacatgatttcttagagcttagacaaaaatttaaaattcagttttagtcaattttcctctgattcctatgttgcaagataggaatcaggagatcatggtgcaggttcattttcttctactctttattttcctgtttctgcactatggaccaaaataacagctcattttgtggttacaatctaaagatgaaaaacagatttttctttaccttgttcctcaaactctctattttccttcattttaaaaatgtgagttgtaattattaaaaagtaagtatttgctttatcttggccattcctgtttctcccaaatcttcagcttattcttttactaggatagtaatgacttcattttattctttcacatcttcagaaactagcagtccatggcatattacagtactcaattaacaaccaataaatgaatgaacaaatgaataagcagtaacactggggatcctctagttttaaccgaacattcagctttttttgtaaaataggtttaatcaaaaaaggctggagcataacctgggataaagacaacaagagtagggcaatttgaaaagaaaaaaagctttcctttttcaagcaatagcatgctgcttgtaggtactaggtacttcagcatgagaagtgaaaggcaacttcataaataacattaaaacagaaccagcaactggtgccaaaagtggaaggcactattggcatattacagagtttctcaaactttctgggccaaagctcacgttaagaaatatgttactttaaaaaacacacatgtacatacactcaaacaaattgagcagaagatttatacaatatgcacagtgatggtttcttttttatgttatgctacggtatcccattcattttttaaaaacgcaattgtgagctacaggttgaaaacttagtgttcaaattctgattctacctacgtgcaacttgacctcatggtgcattagtttctgcctctgtaaaaaacaataatgttacctacttaaagggattttgtgaaggttaaaggaattaccacacacaaaacacttagacaaatgcctggcatatagtaaatgctcaataaatattagttaacaataataataaagtggatgatcctgtcttgtgaatttcatagccaagataattgggttttcattggcaagtggaatagttatcaattgcatttcaatccaagaacatgctggtttttttaaaaggtacccagattactatacaaatacatattatatattctaaaataactacactggtcaactagaagaaacatgattgcctcagattgtcttggtttccctctctcagaaaatctgttttacacaatcactttccaaagtaaagaaaaaataataaatcacaggtacaaaggaaatcatcctaatctacaaaggaagccctggtactgaaaaactcagccatcataatttacttttatggtatgacattttgtaaatatattcctgcgctgattataaattcttataaagaaatgtcaaaaagaaaatgttgaatcttatctcttccaaggaggttgtcaaaatataaaatcaatgtatgtttataaaatatggattaatgtcactccaaattctatgcatggttagatctgtcttctcatcagtcagaatttcagactactgatgaaataactgggaaagtagagggaaaagaaatcaacctcaaaattgattcctatttttttcagctttgaaagaataaattaaaccattttatgctaaatgaggacttttgcaatacaagaaaagatttaattttcaccagtctttcagaataaaatagatttgatcttctcaatgtacttatgatactaatttggaatgattataaagagatatattgtacatggaataaaagcttatacatttaaaaagacattttttacactgctccattcagactttttttttcttaaaagaagatcagaaaaataatacagaagaaaggatgctgattacattaattcagcttcagaaagagaattcccagtgcaacatggaagagattaccaaataaaattgtagctttgtatcaaaggtactaaaagtcctctgaaaaacagctttggcaaaattaaatagatataaatatgcataaataattcaatacattttaaagccagtcaggcaatattatccacttaagaacggagataagatctgtttgtattctacattaagctatgcatacaatgttttctaagatttcacaagtttatttaaacaaacagtaatgtttacaaaatgtatactatgggacaaattttaatacaattctattataatcattatttgtacagatagagctcatttatatatgagatgtattcttgaaaatgtgtgtataaacaaatatttgaaaactgaatcacactgtaaacattttggcaagccttaatactaaaaggaatgaggtacttttactaagtaaacaatcaccgctattttatatgtgcaaagtacaattttcaaatatctgatgtgcttgattatttcactaaatgcagttgattccaaactcacttatttcatcaatatttaatgaaagcaattagtactagtagaattccattctcatgaacctgaatgacttttgtagcattcacactaccattggtttataggaaaggagatattagttgtaaggcggtagaatgttagagctcctcacttctccccagacctactaattacactactgttcattattcaactgtgtgcccttcagttcttgttgaaagcactttttataactattccttcctcagccaaaagggcaaatatttcacaaaatttctaaaaatataaaaatgaatgccattacaattgaagtcacaaaattacacaaatgacatttcttatgtctttgtttagtggatgtggacatatttggatagaggttaatgaaagcaacagttttgttttgttttgcagcccccccttttttacttttaatgtagcaaaataaaaaagcaaaattactattgatcatctactggggcataaggtaaccttatttctcatatcctgaagaaaaggcattagttaaaataatattttacccacccaacaaaagtatttcacaagttccttaggtacagctgtaatatacaaataaaatttgattttaataaaggattctgtttagctggccactaatctacaatagcatttttctgatataatttcaatgaacattcataataaaaatcatacagcctacataataaaaatgtcctggaggcttccttctggtcatttaacatttttagtagaataggtaacaaagatgaggggcagagaatggaggcagttggtaaaaaagggtggtgttaggatgaggtaaaagggttatgagaacttttggtcaggtacaaagatggaggaagagaaaaacatatcctcaaaaaaaaaaaaataacctcccacttgtcaccattaggtactgtttcatcaagactgaatcatgagtccagcccgagtccagcccacaatccatcttagtactcatcacatcttaaagagatttctaaaaactcatctaaagcacaaaaaacatctgaataagctatgtgctgaaatagagtccaaactgtggattcagccctgaaacagaaggcaaggcaatacttctaggaccctagaacacgtattcatatatatgtcattcattttgtgaagcaaattttatattctaacaaaatcaaccccccaaaaatgatatttttacttttgcaaacacaaaattcaaaccatagagagagagtagggtataatagcctgaggattaaagagctgcccagtttttattattgacctactgcatggctcattacacaagtcaaactaatacagtcctcatttattagactacagagctctacagattccataatactatggggtcttagaacaaatatgataccgaggtgtaaggccttccttttcttttcaattttttttaaaccaaccatttatcattcctcatggtcaatgggtcaattgggaaattctgctgatctgggcctggctttgttgctcttagttggactccttcatacgtttgtggtcagctggcaggtcagctgaggactagcttgttaaggatgacctaagctgtcacagctcaagtgtcctccatgtgtcagtcacaacccatcagcaggttaacttgggaatgtttagggcatattctcaaagtgatcacagagaagcaagagcagaaacacacaagcactttttcaaattgtttctagtttgctaactttttttttcttgctggtttctcttttattaatggtggcaaaatatacataacataaacgtacagttcggtagtattaaatacattcacattgttgaacaatcatcaccactatccatcttgagaacttttttcaacttgcaatcctgaaactctatacctattacatgaaacactaactcctcattctctccctcaccccaggccctggcaaccagtattctactttttgtctctataaatttcacaactctaagtacctcatatgaatggaatcatacagtatttgcctttttgggactggcttatttcacctagcataacatcctcaagggttattcatgttgtagcatatgtcagagcttccttcctttttaaggctgaataatattacattgtatgtatataccatattttgtttacccatttatctgtcgatggacatttgggttgtttctatctcttagctgttgtgtgtcacgctgctacaaatatgaacatgggtgtaaaattatctgttcttatccctactttcaattctttttaattttttgagaaactaccatactgtttgacatataagctgcactatcatactttcgcaccagcatgcacaagggttccaattttccacatccgtgccaacacttgtgattttctgggtttgttttcattaacaatcttcctaatggttgtgaagtggtatcttattgtgattttgatttacatttccctaataattagtgatgttcattttcatctcattggccacttgtatatcctctttggagaaatgtctatcaggttctttacccatttttgaatgttgttgagttttaggagtctctacaaattcttgatattaatcccttattagacatgtgatccatgaataaggctttcctctgaaaattaaaactcccttttagagttcagtaagtagatatagaaactggtacaatttcttagctctaagcactatatcaggcacaagagatacagaaattaacaaaacaaaatctttgtattcaatgattttgcttaatagggaacacagagaagaaaatgttaaaattataataaattatgaaatgtattataacaagtatatggaaagtaccctgggagttcaaatttctagataaagaaaagagccaacagcaaaagcacaagaggtgaacatgaggcatcacaggatcagatgatacagcaaagatggggacagagacagaagacgtggtaataaaacagacaatggctagatcctaaacactattgtttgtcatgaggaaaatgttaaccttcgttttgacatcctcggtaactattgtgattgtctgaactgtgtgaagatcctatcctgtggatagagagtaggaattactcctgaacatcttcctggaatgagtaaataagagaacacactcttagagtccctgagctctaagtaaaggacactggatatgttgagtgaacttgtacttctcatgctgggatctgcagacactgggcaatgatcttctgactgagactgtgaatcactgagagccttgcatttctgctatgattgggtattcagtggagctttacataaacacttacctgtggcctaagatggatttagaagagttaagggaaatgactatgtatacccttgaaaaaagttagtactaacagcaagaaatctggtgttttgagaatgtaagagtgacatacaggaataaaggaccaacactgggtcagggtacagacagggaagaagcaacaaaaagtctccaggtcaaagatgtagaagacataaacatttgttagctgttcctagaaattactaaggaaagaagctttaggaaaaagactggatattccactcacctaaaaaatgagggtagagactttgtactcagacattaaaggaaatacaattctgaatataaattggaggaatcagtttgaactcataatgtatttcatcctaatttttttcctagcaccctctaaaaaagggatagaaataatgacaaattcagtagcaataagcagaatagacaaaactgtgatctccagatattaattcccactataagaggtcccacccgggctcctcaaagaaacagatgattctgtatctgggccagaaaatgtaagggttaagactagagtgcctggtcataccagagagcatgaaagttatcaaagactacaaacagtgtcaaaaatgtcccagtaataacttcaagaagctcccccggtcaaagaaagaacaactgaacatcagtaaataactgcaatggattgaaacatcaaatacattgaaatctatgagttcataaagatacttttttaatagtcagtttgataccattggagaatgctaggaatcaactcaatattttgaaaactgttatgtaaattaacagaaaagagaaagaattaaacttctatcctgtcttttctctgcaatgtaccactggataccccagtagtagaagagaggaagtgtctctttatagaatgagtcccataaataagtgaaataaaagtgatattttaaataccacaatttggcaatgcttactaaattaatgaatccatgcactgaatatcagtgctaacatcacaaaagagaagtagtgtttatcatgcacattaaatttttccatttgaaaatctgtttaagagataattatattaaaggtacgactatatttgaaaaaaatttttaagttaagtaaaataacgaaagacaatccaatttatttttatatgcaagacaattatatttcacatcattactgagaaattaccttggacaaatctctgaagttggtgggcaaggtaagatccagttcttctgattcataattagtgatgacccaaggaaacactggatactgatttaagtcattataactccgtcctgatagggaaaaaagttactcgtaatttataattttaaaagtgaaataaacagattcagtaatataatttactaaaaataagattaaacaatttttgattgccagacatcattctcagtatccatactttctctcatttaatcctcacaacaatcctatgaaattgtatcatctccatttcacagatgaaaaaattgagtcacaaaaggttaggtaacttgccccaaatcacacaactagtaatggtcaaaccatattgaaatccagattttctggtcctaagtttgtgttcttttaaactacatttgataattttttttatcacttgaaagcctgccccaaataaaatactcttttttttatgactttaaaaagctatttgtaattctcacagtttttcaaaacaagaatcctttctctgccattaataatcaaccaactaagcaatcaagtttaaatgacttaaccctggtggacattcaccagtcatctataaaatgagggcattgcactaaataattctgaaatgtctgtggtagttttcaaatcctataatcctctgaaaataatgagcagtattatcaatgttgcttccttacatgcccaaatgtggccacatgctcttctatacatctttctaatgacattttcaatgacatatttagatttattaaaaatacaaattacagcaaaagaggaggtagtccttctacatatgtacagcagttttttggatattacctttttagggaggtagcatagtgggtgagatcattgtttctggaatcaaaatgctggtgtttgaatcccagttcctatttactagtctatacatatttttagttagatttaacatgaacagacttttacggtgaacatagagacaagtatattaatattgtttgaattcctttcttattatatattctatcatttccattcctttttctttctcaaatatatactgatgttatatcaatacgtagctgaatattaaagtagttctctgtacatactcttggtatctaagccttttttaggtctgatgtttttaactttttattttactctattcatcttaggcttgaggcctattagggtaacagagttcatttttggctgacctggaacagtcttataaaacatcataacaatgacatttttaattcatagatcattaatgtcactacatatttctatcaataattttaatttctccattaaaaaaaccaaacatagcagcagaaaaaaaaattttatgctcccccacttccttctccttctgatttaaatgttggtaaacagtaaaatcgtcttgtcccatctacttaaataatcagaaataattttttattgtacctaaaaaatgaagagtatggacctgctcagtgattagacttaattaagttaaactcaatacacagttattgaatatcaactgatggccatttgggaaatgcatcatgatatcatgtttatctatatgtggcacaaataataatgtaaaagaaatcttaagtgagacttaactccatcctctaatgcacatttaaaaaatctaaagcaaatgatagattctatatttataaaacatatacagggaatatacttaaaggacactgcaggcacaataaaagctatttgagaacacatgatttcataaatgttgctccataatcataactgtgcattcaacatgggttaattgatttactacatgcaaaatatgtccattaaacttgttatataagtttcctctcactacttaaaaattcttttagtcactagttctataatttctactaaattcaacataaccattgacattttcttcatcccttttcctcagctgactgtgagataaacttctaataaaatttagaactttcaatgtgagcccctcaacttccaattctttgcaacatcccctcactctttcccatttctctaacagggtcttttctttgctaagagtaattgcttcacctgagctctcaaacctgtctccctcataacttgaattgttacttttcttctctcctcctcttacatcatttctcctctctgccccaacccatcttctctttaataacacatttaaaataaccataattggcagggcgtggtggctcacgcctgtaatcctagcactttgggaggtagaggcgggcagataacctgaggtcaggagttcaagaccagcctggccaacatggtgaaaccccgtctctactaaaaatacaaaaattagccgggtgtggtggcaggagcctaaaatcccagctacttgggaggctgaggcaggagaatcgcttgaacctgggaggcggaggttgcagtgagccgagatcgtgccattgcactccagcctggggaagaggagagcaactccgtctcaaaaaaataaaaaagacctgtaattacatctacagttactatttcatttccaaccattcattctgaagtctccctctccactctgtaacatttgacacaggtgaaaatgccttcctccctctttcaccttgcctctcaagacatctgacttacctcagttctcctactatatctgcacattctaggatcactcattcctttttgtcctttactaactttccttctctcttctcatatgcaagagaatttccctgtcttatctcactgctttctgtattatcttccttgctgatctcacatctcttggtgatttcctctctatgcagatgaaatccaatgtcctagttctaagttccgaatatcctccttgacctatacttccaaaaactctgataccttaactagaaagtctgccggcacagtaaaatcatcatctttccctagatcaaattttctgacttctttttccattaattgcaccaccattttcccactaacgcaggccagaagcctggaagtcttttcagatactttcttctcatttaccacctacattcagtcagctgcatatcaaatggttggtgccttgtgaattcttatagaatttgttccttcttttttaattcccactgatacctaatggaagccctcattactacacacacacacacacacacacacacacacacacaccacacactaaattacttcctaactttactttctgcctagtctctagccacccaaatttatcttacacacacagcctccaagttaatttttgatgcagctctaatatcacttaggtgctcaaaaactttcaaaagtttcccaatgaactgacgctaactcttcaaactgacaagaaaatcgttcttcgcatttctaacattcttattttttcccattatatctttatgaatatatacttcatgcacacaaaaatatacagtatatacatagatatacaaactataccattcttgctctctaggtatactttatattttcccatctttgtatgtttgcttatgctttcagtcttacatggaatgacatctaacattccaaccacctcctctgctagtcaaatagtatccatccttatacaaccattgaaaccttattttctccttactcccaccaactgggtgaatataatttccctctctccctgtccttttaatcaccacagtactttgagttttttactgaatctatatccccttgctctagaatcatgtaaacattcacatttgtacttaaaatgacttctatgagagtaagcaacataccttattctctttgtatatcctttgtagtattctagtagcaataacggcaataaaacaagctagttataccactacttaaaataatctaacaattgaaattaataatttattgtctaaaataaatcaatacatggaattaggttacctgctatcgtgttgagaaacatcaagtactcaaaattagatatctctctgtgttgccatcgctgggtcatattagaagccttaaaaagctgacgtggactagctaatgaaatacgtctgcaagaaaaagaattcaatgtgatatgattaattatatcacaataataaatcatgaattatctgtgcttattcattcataatatctataattctgaaaagttctattcatgttagactaatgaatactagagaggtttcaatctacaattcatggttaaacaaatgatttagactagccacagaggtattatacatgttgtattcattcaggtaagctgtcattacagtgccattataatgtacaggttcaataaaagttgattaataacagtataattaataattcactgctttaatgatataaaaagaagaaattatagcagctgggaagtgcatataaaattctattcacatgtctttattaattgtaatagttatcttaaatgaacacatttttacattataaatttaaatatatttgcatacactttgtatcaaagagaagggagactctaaactatttgggcgtctgttcatggggtaaagagaaatttttttaatatagcttaatagaagacaaattttcctgtagcctcctaatgaaatgtaaacatcagtgaatagaactgatcaatacaaagagtagtgagaaacagatggcagaattagttattacattcaaagcctagaatctcagagaaataggctgtcacagttctttctaccacaaaaaacaaggtaattattttgtaaaaggttcactgaagtataattttcatgccataaaatttattcaatttgtacaattcagtaatttttaaaaaatatttcaaaagttgtgcaattatcacaattcactttagaacattttcttcatctcttctcggccttttggctaaaatcaagtgtagaacattttcatcactacaaaaatttgccttgtacctatttacagataatcttcattcctatccccacctacaggcaactagcaatctactctgtgtctctagtaaacccaccttttctagacatttcagatcaatggaatcatacattagtatgtagtcttttgtgtcaggtttctttcactaaacataatgtctttgaggtttatcaatatggtagcatgtatccacagttcattcctttttattgctgactagtatcccactgtatatagaatacagcacattttgtttatctagttgatggacatttaacagtttttgctattataaataatgctaccataaacattcatgtatatatctttatatgaaaatatgttttgatttcttttgggtagattcctaagagtggaattgctaggttgtatgttgagtttatctttaattttttgagaaaccgccaaattgttttccaaggtggctataccactatatgttccaatcaataatgtatacattcatctccacatccttgccaatacttgctcttgtgtgtattttgattattaccattctagttagtgtaaaataacagttttaatgtatgttgttgagcatcttttcatgtgctgattggtcatttgtatatcttcttcggtgaaatgactaatcaaatcttttactcatttattgagctgtttgcattttatcactgagttgttagaattctatatacattctgaatacaactctgtgatagttaattttatgtgtcagcttgactggattaagtgaccttagagagctggtaaaacatgatttctgggtatatctgtgatggcatttccagagagattagtacttgaaccagtgggcttagtaatgcggactgctctctccagtatggtgagcatcatccagtcaattgaggactgaatacaatgagaaggagaaagggtgaattccctcttctgctcaagctgggaatctatattctcctcctcttggatagcaggagctcttggttctctgtccttcacttcttaccccatccctctctccttaggccttcaagccttgggctcagtcatgggctcccctggccttcaaattaggattgaattacaccactggctttcctgggtctccagctgtagatggtgtattgtgggatttctcagcctccatggtcatatgagccaattcccataataaatctcctcttacatatctatacatatcctattggttttgtttctctgaagaatgcagactaataaaaagtgctttatcagacacatgatatacaaatgttgtatcagtctgtggcttatttcttcatttacttagtggtcaattttgaaacacaaaagttttacatgttggttgagtccaatttctcaattttttcttctgtggattatgcttttagtgtcacatctgagaactgtttgcctttcccaacatcagaaagtttttctcctatgttttctttctgacattttatagttttacttctcacatataggcctataatatattttgagttaatttttttgactggtatgtggtaagcatcaaaattttcttgtatgtaaacatccaattttgtccaccaattgtttaaagcctatcttttcctcactgaattgtgttggcacctttgctgcaaaacaattgaccgcaaactcaaggatttatttctgtattgtcaattctcttcctttaatttatatgccgatctttgtacaattaccacaattgaagactgagtacaatgaaaatgaggaagggtgaattccctcagtattttgataactgtggctctacaataagttttgaaatcaaggtacatcttccaattttgttcttatatttcaaaattgtttcagctactctaggtccattgcatttcaacttcccaatttctccaaaaacgtctatcaggaattgatagggattatacagaatttacagatctagggaaaactaccctattaattatattgaatcttctgatccatgaacatggaatgtctccatttattaaggtctatttttaatttctcttaaaaatgttttatacttttcattgtacaaatcttacacttctgtgatctgtaaagagggctactttctttcttcattcccagtgcagatatctttaatttctcccttccttcctctctttcttccttattgcacaaactaacatctccagtgtaacgctgaatagaagtggtaaaaatgggaggacatttttaccctcctaaacttagggggaaagtattcagtctttcaacattaagtatgatgtacgtattgggagttttttggtagatgatttttgtcactttgtggaaatttctttagttgaaagttacttgagagtttttaatcatgaatgtgtgttgaatttggtcaaatgcttttttctgaaatgatagtaagctttttctcctttataaatactggtgcatgacataaattgattttcatatttaaattaactggcattccagtgataaaacccacatgaacattttataaatcctttttatatactgctgaatttgtttcctaaattttgttttaaaaaaatgtgtctgtgttcaggacggaaattggcctatagcatttttcttgttagttttcctgtaatgtctttgtctggcagtggtattgaggtgactgaccttatagaatgagttgcaagtgtttcctccctcctatcttctggatgagtatgtgaaagatttatatcatttctagtttaaatattttattgcattagccaggaaagacaactgggtctgggcttttctttatggaaagatttttaaattaatagctcattttatttatgtgttataggtctattcaaatttccaatttctttttgagccagttttggcaattctgtttttctaagaatttgtccgtatcatttaagtatctaatttgttggtaggaagttgttcatgatattcctttctactccttttaatttctgtaggctcaggctgggcttggtggttcacacctgtaatcccagcactttagaaggctaaggagggaggatcacttgagcccaagttcgaggccagcctgagcaacataggaagaccctatctctataaaaaaaaaaaaaaatcaaaatattagccagacatggtggcatgtgcctgtagtctcagctactcaggaggctgagatgggagggtggcttgagcccaggagtttgaagctgcagtgagctataactgtgccaagtgcactccagccagggcaacagagcaagatcgtgtctctacaaaaaaaaaaaagaaaaataaacaggaaaaaagattctatatgctcaatagtcatgtctctactttcacttctaatttaagtaatttgtgtcatctttcatggttaggttaaagtctgtcaattttactgatctttgcaaagaatcaacttttgtttcattgatcttcttcagtgtttttgctttatgtttcattgatttttgttataatcttcattactctatttttctacttgctttgcatttagtttgctctcctctactgtctaacagtagaagcataggttattgatttgaggaatttatttcagatatgggtgtttaaagctgtaaattttcacttaatactactttagctgcatctcatatattttgatatgttatacctctgttggatataagcatccaaattagtatgcttctcagtcccatgggaggaagagttgctggccacagaagtaaccaaagcactaatagctacatggcagagacatggcagaatgtgtgaggacaaaaagaaagatgcccccaaacccaggcactctctaggttctgggaggtatacagaggaggaagtggtgcagaccaaggagcatggaatcaaaaaaaatgaagccccctacaccaccaccactctagccacacagcctaagctcactcccttctctgtacctctctaagcttctaactgcaaaataacatatctcctggtagctgttataacccctgatatgcatgtattaaactccttggttagtgctcctatagaaaaaaggaaatgcctgaaaacaagtgatagggttaggcaaaacttgcagtgaaacagaaaaactaaaatgaaaactattgttggtggcatctttgggctgactcaatatatttttgttacggcttaaaactggtatctgtgtgtatatgcttgtactgtaagagctcctgggtgtcagaaagaatattccagatcaagaaccaccacaggtagaaaactgataacaggactaattctcttgctgattgccatcagtggtgagtcaggatttagcacaatagtccctaccctctcacgtcctactggctgacaagtcagaacatttggtcttaatggccctgacttgtagtgttctcacaactaaaccaaaaggagtagctcataaatgccaacaaaattcagggtcctgcttgccaagtaaagcttcttgatattgtgtgggcaaattcacaacattcaatcctctggaggtcaaaagctaaatgtgatggacagttttcagtctatgtcttactgatttctcatcagatattttcatgtttaaaaactaccatcccttggtgatatggtttggatttgtgtccccacccaaatatcatgtcaaattgtgtattagtccactctcacactgctataaagaacagcctaagacggggtaatttactaagaaaagaagtttaattgacttatagttccacatggctggagaggcctcaggaaactacaatcatggtggaaggcaaagaaggaagcaccttcttcacaaggcagcagtgggggtgggagaaccaagaaaaaattaaaccatcagatctcatgagaactcactcactatcatgagaacaacatgggggaaactgcctccatgatccaatcaggtcctctgttgacatgtggggattataatttgagatgagatttgggtggggacacagagaaaaaccatatcaaattgtaacccccagtgttggaggtggggcctggtgggaggtgattatatcatggggtaaatttcccccttgctgttctcatgacagtgagtgagttttcacaagatctggttgttgaagagtgtgtgacaacccccctccccgcttcttcctcatgctcctgccatataagatatgtctgcttccccttcaccttctaccatgattgtaagtttcctgaagcctctccagccatgcttccttatagcctgaggaaacatgagccaatgaaaccccctttctttataaattaccccgtttcaggtatttctttatagaggtaccagaaaagactaatacacttggcatcatattttcctggatttcctgtcttttgagccactcctgtttttgctcttagtgttgttgtttttgggagggcagggatgtcctgtttcccttacctaacctttacatgttgaggttttctggatgtagctctagttcctcttggcattttacaatctctccccagatgaactcattccctctcatggcttcaaatttcatctacttggtagtcattctcaattactaggcctttcttttgagctctcaacatacctccttatatctagcttcctattcaacatttcaatctggatgtctctcaggggttctaatttcaaggacctaaaattaaactcattttctgtccctccacctcctccacacaaccccagccatggggatggaaggatgtttatacaaatactgttcgtccattattcctaatcccagtaaatgccactgagcagctcaagctgagacttgagtattgactaaagatattgaatatctccccttgtcatcaccccccaaatctctgagtcttataaattatatttcttaaaaatctctaaacaagaatgtctctcttcagctacattatcaacatcacatatcatccagatgtcttcaataggctccggtcttatataaataacaccctcttcctaatatcactaagttccagtgatacttgctttccaacatttcttagaacactagaagctccctgccttgcttcagggcctttgcatatactgtgccttcgttcaaagaatagctggttatatttcttcaaatcaaaacttaaaagtcacataggaagatattcctggttatcttatccaaagcaacccatctctactctactaatcactactacaacactctaattatatccttcctgtcacttatcacagctatttagtttacatatttgttttaaaaatgtatgggtaaaatggtttctatcttgtacatggctgagtgcttgacacattgtaagtgaaaatctatttaagaaactgattaataaattaagacttataggctgggcacagtggctcatgcctataatcccagcactttaggaggctgaggtggcaggatcacttcagcccaggactttgagatcagcctggacaatggagcaagacagcatctcttaaaaaaaaaaattagccaggcgtggtatcatgtgcctacagtcccagctaccgggaagctgaggtgagtgattcgcttgagcccagcagattgagctgccgtgattgtaccactgcactccagcactccagcctgggtgacatagcaagaccctgcctttaaaaaaaaaggacatctagctttaactgtgggagaacattacagaacattcccaggtatgaaaacatatactaggtgtgataaacaaaacttttctaaaataaagagataatttgtagaaaaagacttcttaactaatataaggaaatccactatgctcctctgggctgcttcttcctgaactctgaaatcctcattaaattataaaaattatctaatcaaaagcattaccggtattgtaaggcaacatagcttataatccagaaggaccactttatttgccccatttacataaaagttgtgacctgtggtagttctggaatacatcctcgagaggtggagcttaattcccctcccctggactttgggctgtatttagtgacccacttgtaaatgaatacaatgtagcagaaatgatggtgtataactatcaagagaaagtaatttttaaaaattggggtttctgcttcattctctcttggatcacttgctctgcaggaagccagctcccatgtcatgtaacactccagtaacagatggaaaaactgactcggtaaggaactgaggcctactgctaaggagcacatgagagattcctttgacagccatccagccacaggctggctgtagctactactaacatcctagctgatgtttgtgcattctatcgcaattgcatttgtaataggatacttaaaatttaaaaataaacactgatcaaaagtagctcaattcaataccaaattaggtatgctaaaagtaaactgtacgtttccaccacgaatatgtttcaatcaatagaaaaatcccagtgttcgctctttccagttcttaaattagttaactaaattgtattgatgatgaatcaatacctactatgaaaggaaataatcagtaattatgctacttcaatgtagtcccagcatacaggagaaagatgcatacacctacactctcccaataccctataccatgagagatattttgccattttaacatttctctcagagacttattaggttactttcaactatataaatacttgttattaagtccatacattcaaatacaaaactaatatgtgaattctgatttaccagaggctacacatacaggttttaattaaatatagttacaaaatccttaatctatagatttaatatttatattaaataaaaaattgtatgatgtaatagagcaaaatccaatcatttttatcaaaacgatgaaaagtttcagatttatcatgtgtatattaaataatgctatagcacatactaaaatgattgtaataaacacttttttaaaacagcatcacatgtacagatgtaataagcacttttggcttagatatttttaaatatgcttagaaagcttatctttcaataattgtgattggaatataattaattttttatatttatttaaacagttttacatagatgtaataattgtacatatttatggtgtacgcagtgatgtgatatacataagacatagtgatcagatcaggtaattaggacacccattatctaaaacatttatcatttacttgtgttagcaacagtcaaaatcctcctcctagctatttgaaactgtattactgctaactctagtcatcctacagtgttatatagaactttagaatttattcctcagtccagctcttattttgtatactttaacaaatctctccctatcatctctccctccccactacccttttgatcctcgagtatccactgttctactttttactcatatggagattaaccttttggtagcttccacatatgagtgagaacacgcagtgtttaactttctgtgcctggcttatttcacttaatataatgtcctgcagttccatccatgctgccaccaatgacaagattccatgtttttttatggctgaatagtattccattgtgtatatatggcaccttttccttatccacttatctgttgctgaacaccactgattccatctctttgctagtgtgaacagtcctgcaataaacatggtgggtgcagatgtctcttcaatgtactgatatcctttcgtgtggatagatgcccagtagtgggaactctggatcacatgggagcactatttgtggtttcttgaggaagagatataatttaatacattatattaaatgtataatatttatcaaacttaagtgtacaatttgatgagatttgaatatatatatatgtttctgtaaccaccaccacaaccaagatacactctaaaaggtccctcataaccctctgcagctaattcccttgccccaactcttggcccctggtaaccaataatctgctttctgtcattgtgtagttttgctttttcagtaatttcatataaataaaaccatggcctatggctatgatgtatggagcccgtaatgtttaatttctttcatttagcataacacttttgaaattcatccatgttgttgcatgtaccagtagtcatttcccttttatttctgagtggtatttcatttattccagtgaatacaggtattgcaatctgtttagccactcacagttgatggacatcagaaatgtttacaatttgagactggaataaaactgctattaatatttgcttaaaagtaaatgtgaatatgtatgttttcattactcttgataaatgcctaagagtggaattagtatgatatacattaagttcctaacctatacatcctcattaactttacacattctttgttgttgtttttgaaaatcaagtttgttgaagaataatttacatagagaaaaattcattatttttaggtgtacaatataatgagttttctaaacatagaggcttatgtaagaacaattatgacatggaatatttccatgatccccaaaagttccttttattctcccttgtatgcaattcttcctcttttcccatagctcctagcaatcattgctctgttttctgtccctaacagctatgctttttccagaatgtcatataaatggaatcatacaacatgcagccttttgttttggctttgtacacctagtataatattttcaaattcatctgtgttgttgcatgtattagtgcttcactcctttttattactaagtactatatagattccattgtatggatttatcacagtttgtccatttaccagttgataaccatcttggttatttccaatttttgtgatgaatatggctgctataaatattcatgaagcagtcattgcatgaacatatattttcattcctctagggtaagagacctagagtgagactcctaggatgtatgggaaagtgtatggttaattctatatgaaagtgccaaattgtttacaaagaagtcgtaccactttacttccccatcaacaacatgtgaggttccagttgccttgtatactgctcttggtattgttagatttttaaaaagttattcgaataggtatgtcatgggatcacactgttgttttaatcagcatttctcagatgactaatgatgtttggcatcttttcatgtgtttattcggtatctatatctattctttgttgaagtatctgttcaaaacttacattttttttttgtagcaagcttatcttgttatatagtatgtttcctacatatcctggatgtaagtgctttatcacacataagttgaacaaatactttaatccagtctggcgtatattttcattttcttaagagttggcatttcaaagcaaatgttttttattttaatgaaatcaattaaagatctaaagaaatatttacctaattcaaggtcacaaagatttttctcctatgtgttctttcaagaagttctacttttagcacttacgtttgtctacactacgtttttttctgttacattttgagttaatttatatgtaaaattaaggggtgaggttctttttctttttggatatggataaccaattgttcatcatcatttgttaaaaagatcattttcccccctgggcataccttgacatctttgtcaaaaatcaaattgatcatatatgtttgagtctatttctggactctgttacagtccattggtttatatgagtctatccttaaataacaagctatcctaatgaatgtaattttatattaagtcttttgtttttttttctcaaaattgtttaaactattctggatatttacaatttcacttaaattttagaatcagcttgtctatttctcttttttcctttttttaagttaaaaaaatagagatggggtctccctatgttgcccagactggtcttgaactcctaggctcaagtgattctcccacatggactttccaaagtgctgagattacaggtgtgagccaccatgcctggccatcttgccaatttctttaaaaaagaaagaaagaaagaaaaagcctgctcagattttggatagagctgctttggacctcagatcaattctggagaaaactgacatcttaataatattgagtcttccaatccatgagcgtagtatagtacaattctccatttttaagttttaattctccaaaacagttttatagctttcagtgagtaggtcttataaatacattttcaaatttatctatatgtatttattttttgatagtatttaaacactagttttaatttcaatttctgattgttcattgctagcatacagggataaaattgagttttatatactgacccagtatgctatgaacagctaaactcatttattagttctaacagttgttgttgttgctgtttttttcctcatagattccctgggactttccacataaacattcaagaaggtatgctaaaatgactattttatttcttcctttccaatcaggatgtctgcagttcctatttcttgaaaggcctttgtatgcatttggtgttcaggtaatgctggtctcatataatgtttttggcaatttaacctccttttctattttttgcaagagtttgtgtagaaatggtattatttcttcattaaacatttgatagaattcatctgaactacaagttttctctgaggtaaggtcttttactacaattcaatttcctttgtagaactattaagattaaccatttcttcattagtgatatttgatagcttgtgcctttcaagaaatctatttcatctaagttgtctaatttagtagcataaatttgttcataatatttctttatttttcttttaatatctgtagtgatgttccctcccttattcttaatatttttaatttgtgtcttctctttctgcatctttgctagatatttactattaatacatttattaatcttgtcaagagacagcttttcattacactgatttttttctctatcatttatttttattatttttttctttcttcagcttactttgactacatgtgcttctcttttttcccacattcttcagattgaagctaagatcattgattttaggcaatgatcctctcctcctcccctcccccttaccctctcccttcttaaataaaatcatttaatgctataattctacattaggcacttctttatcttcatgttaaacatttctataggttgtgctgttattttcaattagtagaatatttctaatatctcttctaatttcatctttggcccatgttttatgtagaagcgcattaatttccaaatctcaagagattttccaaaaacctttctgtaactgatttctggtttgtaattaaccagagatccaagatctcaatctttctaaacattttgagacttattttagggctgaatatggtcaacgtgataaatgttctacgtgtatttaaaatgaatgtattttgtgcaattgactaaaatgttttatacatgtgacacagatcaaggtggttaataatgttccagtcttcagtatgcttactgattttttgtctacctgttctctaaattactgacataacagggagaggctgtctatatttcattccacttctatccacttttgtcttatgaattttgaagctctatttttagatgtatgtaaatttaagatcatcaccttgatgaactggctcttttatcattatgatatgtcactttttcctctgataatataatgctttgtgtggtaatttgataattgttatgggttgacttatgactccttaaaagctatatattgaagagctacctcccagtacctcagaatgtaacaatttgcagagagaatattttcaagttaaaatgaagtcatcagggtgggcccaagtccaatatggctggtgtctttgtaaaagagggaaacctggacacagagacatacacagggggaaaacaatgtgaagagacagagggagaagagaggcatctaaaaaccaaggagaccggcctggaacagatccttccctcatagccctcagaaggaaccaacactgatgaaaacttgattttgaacttcttgcctccaaaactgtgagacaacacatttctgttgtttaagccacccaatttgtggtactttgttatgacagccctagaaaactaatatagtaatgatatgactagctggctgtttttattaaggtagtgtttgcatggtatacctttttctgtccatttacctttaacgtataaatgtatttatatttaaatggggcttcttggttgccagaggcagaggagtgggggaaatggggagatgtggccaaagtgtacaaacttttcattgtaagacaagtaagttctgggaatctaatgtttaatatgaagattatagttcataatattaaattgcatatttaaattgctaagagagtagatcttaagtattctcaccacagacacacacacaaaggtaactgtgagggatggatatgttaattaacttgaatgcagtaatcatttaacaatgtatatatgtatcaaatcatcatgaggtagaccttaaatatgtgtaatttatatttgtgaattacaactcaataaagctggaaaaaaatacctactgcaaaagaaaaaaaagggtgggtttcctctaggtagcacataaatgagtattgcttttttatgcaatttggttttttcttcctttaaattatatagtttaggcaaatagtacttcaaggtagcatattttttattatattattttataaataagacattggtcataaaacttgaaagaaaaaatacataaataattttaccacagcattttttataataatgaaaacatggaaataaagcaaatcttcagcaatgagggaattactcaattttgatatattcatatttcagactattagcaaccaataaaaattatcatttttttgtcttgtatacatcacgaaatagctaatttgagcaaattaatatatccattacctcatatattcatcattttttgtaatctagtctccacaatttttaagaaaacaatatgctgttactaactatagtcactatgctgtaagatagatctcttcaactattcctcctaactaaaattttgtatcctttgaccaacatctccccagtcaccccacccctaacctctacccttggtaaccacgattctactctctacttctatgagtctaacttttttagatttcacatatttagatcatacagtatttgcctttctgcgtctttcttatttcacttaacagaatgtcctccagttcatccatgttattgtagataacaagatttccttctttttaaagactgagtagcattccattgcatatatatacaaccaaaatttctttattcatcagctgatgtacacttacgttgatttctgtatcttggctattgggagtaatgctgcaatgcaaacaggagtgcagatatctctttgacatactgttttcatttcagttagatatatacccagtagtgggattgcaggatcatgtggtatttctggttatacgtgtgtgtaccattatgatatatatcgtgtgtgtgtatatttatacacacatataccattatgatatatattatatatatatgtatctttgaaaagaatagtaattatatcgatatatatactataaatatctttcctaaaaggttagtatttaaactttccataaaagagataaaaagtaaatcttacaatatacacttttcttggggtaaggttaggcaatcttttatttaatgattatttgctaagtatatactctgctagacaccataccctatgctagggaaaacagtatattataatgcagtttagtcaaaagaaaacttaataacttaaaacagtacattataatgcagtttagtcaaaagaaaatactaataatcattatttactatgaaacataaaacagaaagttataaatttcaaaataagtgagaacattaatacagattaatgttaataagaatattaatactggttaattattataactattaagacactttactttccctaagtttctcatataaaacagtacctggtttgaggcaatccaaaacttgttccaacgccaacacgaggtagatagttaaccactttctttactgttgcagggtctgggaagttgaacatcacagcaactacaacagatgatttttaaaaattagaacacagtataacttcctttctggaaaactgactccttggtccaataaaatatttacttttaattcaggtatctattaaatacaattcttactatattccttttatatagtatatatcaagttttagtattaatatgccagtgataatattcatttcacttataaattcttttaccatagacagtgctttcctaaatactattaggtgttataacagttgatgttgcattgatatgacatgaagttgagattatgagacatgataataataatgataatgatagctgagataatgtgacatgaagctgcaactttaaatttacaaaaatgaattttggcaagtcaaaggtatttctaggagtttccagaaacaaatattaaaaatttaagtttatgtagttaaacaactaacactaaaaaacaaccaatatagctatgaaataatcagttacatttatttccaatcattaagttttaaaacagtctttttacaatgtctatatgtttatctttcatatgttcaaatgagcaaatgttcatataatccaaaacaatgtgtgatctgaaggaacatttttcctctgcagttaaaaatcaaatttaaatgctttctcatcctatttcaataatttcacatacatgagaataccaagaagtacatgtcaatatgtaaacatatttagcaataaatgttaatttatgagagtaatctataaatttttacccatttaaagaacatgaaagtaaaatcatacaatcttgagagagtttagaagatattcatttggtcagtcatggaattttaacttcaatgtcagaatcatatgtaagctacaagcgatcatctagaagatggtccttcttctctaccaacccttaaaaaaatatttaaagccaaaaaaaaaatataccaatgttcctatagtttttaaaacactggcattgccaacatgtttcaggtattcaggtaaataagtaatcgatcattcactaagcacctataacatatttagtaatgtcataatatatacacacacataagaatatatacacacacataagaatatatacacacacgagaatatatataacatataatatattatatataagaatatataacatataatatatataagaatatataatatattatatataagaatatatattatatataatatattatatataagaatatataatatattatatataatattatataagaatatacaatatattatatatcatatataatatataagaatatataatatataatatatcagaatatataatatattatatataagtatataatatattatatataagtatatattatatatacgaatatataatatattatatatacgaatatataatatattatatataagaatatataatatattatatataagaatatataatatattatatataagaatatataaaatatattacatataagaatataaaatatattacatataagaatataaaatatattacatataagaatataaaatatattatatataagaatataaaatatattacatataagaatatataatatattatatataagaatataaaatatattatatataagaatatataatatattatatataagaatatataatatataagaatacataatatatattatatataagaatacataatatatattatatataagaatatataatatattatataagaatatataatatataatatataagaatatataatatataagaatatataatatataatattatatataagaatatatattatatataagaatatattatatattatatattatatataagaatatataatatataataattatacataggaatatattatacatatatattcttatctgtgtgtgtgtatgtatcctttagataagcctcctttacatatccactattatactgaattcagggggaaaaaataaacagaagaaaaaaatcatcataggttatggcagatggtcaaggccacgaggcaaaggcaacagaaaaacacacatataaaaacaagcatgcataagaaatttcaaagaaagaaaatgaatgaggatgagcaagtaataaatattctaagattgaagctcctttgggacagcaaggatgcggactgaaataaagtgtgaaacattctcttgattatttgcctagaagaataatgtttagattagaagaagaggtatgtgccaggaggagatcaaacaggaagggaaaaatcttttcctaaagaaatttgtattccctaaagacagataatttcataaaggaaaaacaagatgtgtgtgtggaatataggcagttatgtgtacctttaaaaataagaaaccatcaacccatgtatatataatacaaggaatatgtacaataaatcagtaggttttacatatattccattgtacacctccacccataccaaatgatgcttttccttcaagttcaacttgtctccccttcttttcttaatggatttcaccaagttccatcgtaaaactgcaaattaaattttagttcaactttcaagaatgatgaaatacagagcaaacaggacagttcagtatcattttctcatggttcctttataaaagcaatatatcacatatatcacacaaaagattaaatagacatatgaatcgttattgtcctctcctctccccaaatgcagccaccttccagaaggaattaagtatcaaagcaatgctcaggacatcaaaactcctcttcaagctgattaaatggttatgtattccttatgtttataaagccttatatcaatttgtgatatggcaaaaaaaagaaaagaattacaaatgattctattaataatcaaggtgggaaaaaaccatgaagaagcatttggtacaaaaaaagaggtcactagaacagaaggtgggctacaaataactatctaaattgaagcaatatggtatgttcaaaaatgaaatcttaaagagatggaagttagctctgtaacaacgtatttctgtaacacattacctctgtttgccataaagatctccagggctgtattttgcaaaagataacgacgagaaaagattgatcgtatctctgtgaacagccattttccatgcagcccttctgtatatgccaagatctaatgaggaaaaaaataatcccaggtaagtaacaatacttgttttttgttgttgtttctttccccaattaaaatagaaaagaccctattaagaaaaataatttttaagaaaaaggatttaatagttacagacataatttggagatgaagaaaataaattgtaatttatagaaaagaagcttaaattaaaaagcaaagtaaaattataaaacatttaagtatatattcgggcttttaaaaacaatgatataatctactgcttctgaagaaatacatattgcatcatttactgattgatttttaaaccacattatgaaaagtaaaacttcagataaaatcttaaaaacaaaaagccctcaaaagaatgtcatatatgcttataaatcacatacacaattcagtttcacatgattataatttgcccaataatgcttttacatacattataatacaaatatattaagttcataactttaaaaaatgacacttttaaggtcactgttaaggcaacagtcactcattcagaaagcacaaacactgactatataagaggttaagtatcattttgtcagctaaagctaaacacaaacctgcaaatgaacttagcataatctccctatggggtaggtggttgtcagagtaacttgttacaattcttgtcatcccaggtgacagacagagttgcttaaaatgctttgccaattcaaagtaatcctgtctttagtcctaacccactttgttgctttgattcaagttttgtttttcaaaacgttcatttcaaaagcttaattgtgaaagcgttaagggaaaaccagactcagcatttctctacaccagtactatacataatacataagaaaatgagatgcacttgctatcaaaacctgatattctatgacagcaaattaagtttaaaaaattaagaaatatatctcaaaagtaaccactattaaaaattacaaatgaaacatttgattatgatactacattgtaggaataaagatgggatgagcaaagaggtaaaataacgagtagtaaaaatttatccttctcaaactgttttgtctttactcatttttattttcaaaatcctaatggcaaataaatctacattctccagtgcagaatgtagtttttttgaaaaaaaaaaaaaagagtaacaaaccttatttaagtcagtaagtatgtatttcagtctttctacaaaaatgattctatttctgacaccacagaatctagaaatagaatgggtataactctaagggagagtgtttcttgaaaatacaaaacaaaaagttcaaaagacaagataatcatgcgtgcagttttgaaatggatgagagagaaatcctactaattcagtaatataatcaacgcctatgtaaaataaaggtaaatgaacaggaaacgagaggacaaaaatatgaacattactctcagagattgcatgtatccctttctctcactttgaccagagataccaccagttggtctatggccccaaggtcttcagaggcatctatttgttctctcttttattcttacctctgaagtctaccatgaccagaggacccttcacctcaaaattttaaaatacaaatcagatcacatcattcctatatttaatagtatccagtgacttcccatgacatgtataataaactcttaagctctttatgactgcataaagcctcatatctgggactgtcagatgagttcaactcattcttcctcagggctttgttttgcccttgttttccactctgcctggaatgttctcccacatctccacatggttcactcattctcacatttagacttctcctcttatgtcacctctgcagggaagccacaggatctaaaccccagttactccattaacaactcatcccaccccaaacttaccagattttcttcataatacttatcactacctgaaattttaaatattaatttaattttcaagacagggtcttactctgtcacccaggctggagtgaagtggtgtgatcacagctcactgcagcctcaaccccctaggctcacatgatcctcccatctcggcctcttgagtagctgggactacaagcacgtgccaccacatctagctaacttttaacaatttttttgtagagatgaggtctcactatgttccccagggtggtcttgaactcctgggctcaagtgatcctcctgcctcagcctcccaaagtgctgggattataggcatgggccactacacctggccactaactcaaactataatatttgcttgctagcctattgcctcttcagcactagaatactagaatctaagttctgttggagcaaaggctttgaatataccctacttccaatgcctagaaaaatacctggcacaaagtagcaattttcagaatgactaaatgaatcaatgtatggcaaccttcagtccatatttgatccgcatgatattttaacaaaatttcacatggttgaaaatagttgagaaaacagatattcgcaaaaatattcggatttctgtcttctcaagaaaaactagggtatccagcaaacctggatctgtatgccacatggtaacaattggcatgcactctccattttggtaccattttcacttcatttattattattcactaatgtgatgtgagcattcactcatttactattatccacctagtttccattggtacttgagtttgctaccctggatttaccaaatattagagaatccaatatatgttctgcaacatttatagtccaatgtatccataagaaaaacaagagccagggccagtagcttacactggtaattgctgagctttgggaggccaagatgggaggactgcttgatgccaggcaacatagcaagacctcatctctacaaaaaattaaataattagttgggcgtggtagcatgcacctatagccctagctactcatgaagctgagatgggaacatcactcaagcccaggaatttgatggcacagtaagctatgattgcgccactgcactccagcctgggcaacaatacaacatcctgtctctaaaaaaagaaaaaaaagaaaaatgaggcctagacatgttaaatatttgatacaaaattccttggcaagttagtggcagaaaatggcctatacccaggttttctaacccaaaaatacagagcttccattgtatataccacattgccacatttttaagaaagggttaaatatctgttaaactagaacccaactaactgcttaaaattttcctgcacttgggttaaagaggaaagaggaaaatcaaaagaaaacaaacaaaaaatattttaagctctttgatatgttaggaatatcacacactggtctgaaaattctaccttttgtatctatagagctatataataagacctgttgcccataatagtgaatccactcattgcaaagtcatgatcatacaactaaagatttaatcatattctagactactccatttattaggagaaatgagtatactacagcattgttacaagatttttcatgtactgaaatagttttctgattaaataaaatataccatttatattccattcccttaaacagtatggttattcaaagatctacttgaaacactgcaagtgtcatagtcctttaaaatctgttttattccaatgtcaaaaatattcagtagtaggcggggcacggtggctcacgcctgtaatcccaacattttgggaggccaaggcaggcggatcacgaggtcaggagatggggaccatcctagctaacaaggtaaaaccccgtctcaataaaaaaataaataaataaaattagccaggcgtggttgcgggcgcctgtagtcccagctacttgggagtctgacgcaggtgaatggcatgaacctgggaggcggagcttgcagtgagcctagatcatgccactgcactccagcctgggtgacacagcgagactctgtctcaaaaaaaaaaaaaggaaatgaggtaagctccatgtacctactactcagtaaccttataaaatcataacactttgccatattattctatacatctataagaaagtgataaatgcattacagacagtgttaaaattcacacgcataacgcttcctgatcccattttcctcctctgtcacagccaatcactatcactatccttgtttttaggattatcatctatatgtaagtttttatattattagtacacatatatccataaataacataccacatcactttgtatgttttcaaacctgatataaatggtatcatactgaatgtataatgatatgcttttcaagttaaacatgacaaagtctaatgaagttttaaaacttagagaagaaaaaacagcatgagagaaaattatttaaaattgtcaaaggtgtcaaaaattaaaatcttaccaaaaaactagcctaatcttttaaaaaattaaataaaattccacaattagggtcaaaaaatttgagatttaaaacagaaactagcaatctcttaactaaggaattactagctgaaatttatataataatatttctttaagtgttcattaggaaaaggtgtcagtactgaaaagcagctgaggcctagctaagcaaggggttcatttcttattggaatagtataggcctggtctgaggcttcacttcaaagtctctagagttcaattaaaactggattaggtagaaacagacccttctttgggactttctgttcactgaaactctacatacactgacagcaccttagacagaggtctagccctccaatgaatcagttgccatagaaaccatatcattaccattgctctgcagttatgacctcaactcctgaattgcttgaaatctttactctctttgaatgtttaccaccttgttttattattgttagtattattattagtaaattaagctttcaattgttttaaataatttgtttcaaagctggtttattaaatgttgagacagtgtgttagagaggagagaaaggatttagtattgaatacatagattatatacacacataaatattctatttatttactgtaaaacatcaaacctatcttttttaaaagttttatttaaaaactgtgccttatgaaaaggatatattatttttcccaaataatgcatgtatttcttccttctgtcctacaaatagtatactattaacacataagaaaattgcttcactttgttgcacttattcttagtaaaagtaaggcattttttactttccctttaccagtccatttgtaaaagcttataagtttatccaaataaaactcttttttgttttcttgtcctcatgaaagaacaaaaatagaaaccaacactcactgcccaactatatactcttatttattgaatactagggatttttaaaaagtagatttaaaatagttaaagccaatcctttaagtgaatagaaagggaggttttatttttttaaaaaaaactatccttgatacattttaaatgttttaaaattcctcctgaagggtaaatattaaaaagtgataaaatgttttacctcaaaaaaaagaaatacttacatgagagcctgcacatgtaacatcaataaaaggtattttaaaaattactattcctaaggtttaaaactagcatagcatatccctatgccaaatatttcccaaattctatagtaattttattttttcagacaattccagatttctgaagattttggtgttaagaataaaatcaggtaatatatatcaataacaatatttaaaaattcacaacagaaccatctccaaaccctatcaatacatttaacatcaggaaaaatgttgttagccaaatatacaaaatgtaaactaatcataccattcattaagcaataacacaatggctaagaaagtctagaaaatattcactatatcccattttaatggaacataattacatagtcacaggttaacactttaatatggaaaaactaattatttgaaccacctttaaaataaagacattgaaaaatactttcatatcaattcaccaataaatatatgtgcaaatgttttatgttacaataattgtaatttgaacaaatagcttaaagaattttaatcaagtattttaaagttgcatcactgttattaacatagtttttacattttgctatagttttctctgaaggtagatatcaaagcatagcacgtaatttactcaaataatattgaatcctagttggttcaaggatttacttcatcaccaaccatatgacttttggttttaaaattcaaggatatattctttaagtaaaatttagaggtcttttttgaatttgacaatgacaatgacacacagtcgactctggtggaaaatttaagttgataattttcttactaaatgtatatccatgaacacttagaatgtccccaaacttcaacaaacaacaaaaatgaaagtcatacataaaaaataaaattacctcttaaattaatcatgtgttgttatttaatttttttcatctatacagtatatttcccttctggtttcaagtactatgatgtagtatagtattcatagcatttcatgggtgacaaattcaattaaacatattcattactctaatgttctacttggcagttttagtcagtatgaaaaattaaaaatatataaataaaatgctatgtgacctttgtattgattggactaaaatggctttagcctgggtgtggacgatggggcagttgggaggggcaagaggggagcctacaaacacacacactcttatgttttctcttccaattactgagggagatgataaaaccacagcaaatgatgtatcagctcattttatcttatcgctttggggctaggtgacaatgaagttcatatttcacgggctcccattgaagactgtgaaaattacttgcccttatgacctgaaatttcactagaagacagaaatttctcttctgcaaagtaatgcaatttttcagatgtcaacctttagcccagctttaaaaattaatttcatttatattaaccaatgatattgatattttcacagaacactctttgatacatgaagcactgactggcaaattgatgttgctttagatgggtaaaactattttattttaagctgctgtggcacacagatttatggcaaactgaaattcccatttcataatttaatatttgtgctggagttgatgcacctttaagcccttggcctgtaaataattcagactctttacttggttgttttattttcaatattcctcagcttaaaaataatttgcattctaaatgatgcatcttaaaagccatctcttattcaactagcattaaatatcaatcttaatgagtcaaaagccaaacgtagtaatgaaggagaagaacaaagaaggtatttatttatcttccagctcatttttaattcagtttttaaaatttaaactataccataagtctaaatttttttttgaaagaaggcaagaaaccaaaatgaacccgcaaaaggatattaaggaaccatagcaaggaacatgaatatattttatatctttttcatagcagcacataaggtgaagagctgggtgataaatttgtagagaaggaacaaaatgaacttagatatttatctaaattaaaatagatatttagctttgaaggtaccttttaaaatacaaacaaaaacaaagccacaatgtcaatatcattgtgaacgaggcataaaagggtctcatctgattttagtaaaggagatactgaaattaccttgtatctgtacaaaagaaacatttcaatatacaatttcaatattttagagtaataaaaatgctactaaaagatgtatgatctggtgtctttacaagttacaactttattatctttatccagtaaagagttttgtctaattcaaataatgccttgagaagataatcattaaacaaatacccttctattttataaggaaagtcaagcataaatatgcatataacttatacattcatttatgatcttaaaattagaaaaaggctaagaaagccatttatctaatttaggtagtttctccccaaatggtttaacactgctttggctaaatttctatactcaaaataatttttgcacctttatgccaacaatattcaaattgttttttcttcaaaatatttatatttagttcttccttacatgtacggtatagaaaaaaatcataatataaattttccctttataattttttcatttagattgaaaatattcccaattacttctcaaaaagttgtgacaataacatgctattgttgctgaattaagctataaagtatttctgtcagggccaggcaaagtggattatgcctgtaatcctagcaatttgggaggctgaggcaggaggatcacttgaggccaggaattccagaccagactgggaaatacagcaagatcccatctctacaaaaaataaaattagatgactgaggtggcatgtgcctgtagttccggctactccagaggctgaggtgggaggactgctcgagcccagaaattgtttgaggctgcagtgagctatgactgcaccactgtacttcaggttgggcaacagagacttttttttttttttaagtatttttgtctaatgttccccatattgattctctatagtcataagctttctattccttactagagagttaaaatttaagtcaccactaataaaaaactaactttaaatatattggaatatttcacaataagtactttaaaacaaccaatgggcagaaactctctttcttctcaatgccaattcttccttcatgaactccatctttgatgggtatcaaaagccctccctaaaaaagtgttttacttctcatagaagtaaaaagtaaaacagaggatactagaggttggaaagtgaggtgggaagcaaggaaagtgaggtgggaagcaaggaacatggaaagatttgttaaaagatacaaaattacagttagacagtaataagttctagtgttctataccactgtagaatgactccagtgaacaataacatatagtttcaaacagctagaagtaggatagtgaatgttcccaacatgaagaaaggatgtttgacatgattaatatgctaattaccctgatctgattactatacattatgtgtatacaacatctttatgtaccccatgaatacgtacaactgttgcttaaaattttttaaaaataaaatgaccaaaggtaaagttaaaaaaaaaaaaatccccccttgggctgggcgccggggcttatgtctgtaatcccagcactttgggaggctgaggcgggcaaatattcctgaggtcagtagttcaagaccagcctggccaacatggtgaaaccctgtctctactaaaaatacaaaaaattagctgagtctggtggcgggcgcctgtaatcccagcttactcaggaggctgagacaggagaattccttgaacctgggaggcggaggttgcagtgagctgagatcggactactgcactccagcctgggcagcaagagcgagactctgtctctaaataaataaataaataaataatcccccctctcccagatgtatgaactaaatcttcaagttagagtaatatcagtttactgatagactattctgtgtagcagatacaatatgatttagccactggaagtttctctgttacctaagctacttaaacaaattaaagggaaaacctttgtttatcttgaagaaatttgcttttgttctttgaacacagcaagcaagagaaatgaaaagcaaaatggaaaggaaaaattaggaacatagaacttgatgctaagagcctaaaatccccaggatacatttttcctaatcagagggaaatacttttctacttttttaaaattagtacctgcctcctactaaatattaagcttgtttagttggagtcagttataaatgaatagtacagatttgtattcacttccataatagagcatggaactaaatgctatgctcacatttgccttcagacgtaatcttccaaaaagccattttcttaaaggacctatatgtaatagaacattatgaataaaacttaaataagacttttggggttaacctcatttcattgcgtaactccatattgttgcacaatcctcactagattggagttcatactttaactggagttcttatgacactacatcactagtcttagtcatctttctattcacagtatctagcacaatactgaagagactgactgatggatggagggccaactcagcttcactaagtgtctacaatcaggccagatgtggtggctcacgtctgtaataccagcactttggtaggccaaggtgggagaatcacttgagctcaggagttcaagatcagctgggcaacacagcaaaaccccgtctctgctaaaaaatgcaaaaattagctggaggtggtggtgtgtgcctgtggtcccagatactagggcggctgaggcaggagaatcacttgggcctgggatgcagaaggtgtagtgagccaaggtcgtgccactgtactgggcaatagagcaagaccccatctcaaaaaaaaaaggtatctacaatctaagattctgggaacacatgaacataaacacagcaaaaaacaaaagggggaagaagagtaaaatggaaaactacaacataaaaatttttaaaaatcaaattcaagggtcagaatacttccacttttgatgaagatggagtaacagggcctggatttatcctacctaaacaatatgcaaaatgaacataatatactgaaaagttgttttcaaaatattaaatattaagcaataaaaaacagtgattcctgaaaaacaggaaacaaaattgtgacacctattaatgcccaagcacaccatctggaaagactttgcagggcccagaggaaaatagagaaacgtagttagaacgtaatggtctcctgcagtagagaaaacagagcttgaagtacagggagatcaaggcatcaaaagcttgcagggcagagtagcagatcagagagagctgcaaagcaacagagctccagagatctgcagccttcagctgagtactgaccaagctatgaaagaaaacaatgtgagaccagtgaaagaatcatcctaagaaattacaatgaacagtactcagagctcacacagaatgtaaaaatctcatgattcatggagcactgtagagactactcaaaagggttttgccacagaagtgggggaaagttagctctagacttaatgctgctctagttctccctaaaaatcttaaaaccaagctccagatggatcaaactatttctaagtaacttaactgtatcccagaacaatgtattataaggaatgcaaaaatatccaccacacaactaggcaaaaatcactacaactggcattcaattcataattactgggcctgtaaaagaagcaaaacaacatgacccacatgaggagagaacttaattaaacaaaactctcctagaaatgaccatcaacagaatttttagaaaaagacatcaaggggagccaagatggccaaataggaacagctccagtctacagctcccagtgtgagcaacacagaagacgggtgatttctgcatttccaactgaggtaccgggttcatctcactggggtgtgccagacagtgggtgcaggacagtgggtgcagcgcaccgtgcgtgaggcgaagcagggcaaggcattgccttacccgagaagcgcaaggggtcagggaattccctttcctagtcaaagaaaggggtgacagacggcacctggaaaattgggtcactcccaccctaatactgcgctttcccaacgggcttaaaaaatggcacacaaggagattatatcccgcacctgactcagagggtcctacacccacggagtctcgctcattgctagcacagcagtctgagatcaaactgcaaggtggcagcgaggctgggggaggggtgcccaacattgcccaggcttgattaggtaaacaaagcagccaggaagctcgaactgggtggaggccaccatagctcaaggaggcctgcctgcctctggaggctccacctctgggggcatggcacagacaaacaaaatgacagcagtaacctctgcagacttaaatgtccctgtctgacagctttgaagagagtagtggttctcccagcatgcagattgagatctgagaacaggcagaccgcctcctcaagtgggtccctgacccccgagtagcctaactgggaggcaccccccagtaggggcggactgacacctcacacggccgggtactcccctgagacaaaacttccagaggaacgatcaggcagcagcattggcagttcaccaatatccgctgttctgcagccaccgctgctgacacccacgcaaacagggtctggagtggacttctaccaaaccccaacagtttggtagaactgggtctggagtggactctaccaaactctctgcagctgagagtcctgtctgttagaaggaaaactaacaaacaggaaggacatccacacaaaaaacccatcaggacattaccatcatcaaagaccaaaggtagataaaaccacaaagatggggaaaaaacagagcagaaaaactggaaactctaaaaaatcagagcacctctcctcctccataggaacgcagctcctcacgagcaacggaacaaagctggacggagaatgactttgacgagttgagagaagaaggcttcagatgatcaaactacgctgagctacaggaggaaattcgaaccaatggcaaagaagttaaaaactttgaaaaaaaattagacgaatggataactagaataaccaatgcagagaagtccttaaaggacctgatggagctgaaaaccaaggcacgagaactaggtgatgaatgcacaagcctcagtagccgatgcgatcaactggaagaaagggtatcagtgatggaagacaaaacgaatgacacgaagcaagaagagaagtttagagaaaaaagaataaaaagaaatgaacaaagcctccaagaaatatgggactatgtgaaaagaccaaatctacatctgactggtgtacctgaaagtgatgggcagaatggaaccaagttggaaaacactctgcaggatattatccaggagaacttccccaatctagcaaggcaggccaacattcaaattcaggaaatacagagaacgccacaaagatactcctcgagaagagcaactccaagacccataattttcagattcaccaaagttgaaatgaaggaaaaaaatgttaaatgcagccagagagaaaggtcgggttacccacaaagggaagcccatcagcctaaaggctgatctttcagcagaaactctacaagccagaagagagtgggggccaatattcaacattcttaaagaaaagaattttcaacccagaatttcatatccagccaaactaagcttcataagtgaacaagaaataaaatactttacagacaagcaaatgctgagagattttgtcaccaccaggcctgccctaaaggagctcctgaaggaagcattaaacatggaaaggaacaactggtaccagccactgcaaaaacatgccaaattgtaaagaccatcaaggctaggaagaaactgcatcaactaacgagcaaaatagccagctgacatcataatgacaggatcaaattcacacataacgacattaactttgaatgtaaatgggctacacagactggcaaattggataaagagtcaagacccatcagtgtgctgtattcaggagacccatctcacatgcagagacacacataggctcaaaataaagggatggaggaagatctaccaagcaaatggaaaacaaaaaaaggcaggggttgcaatcctagtctctgagaaaacagactttaaaccaacaaagatcaaaggagacaaagaaggccattacataatggtaaagggatcaattcaacaagaagagctaactatcctaaatatatatgcaaccaatacaggagcacctagattcataaagcaagtccttagtgacctacaaagagacttagactcccacacaacaataataatgggagactttaacaccccactgtcaacattagacagatcaatgagacagaaagttaacaaggatacccaggaactgaactcagctctgcaccaagcagacctaatagacatctacagaactctccaccccaaatcaacagaatatacattttttttcagcaccacaccacacctattccaaaattgaccacatagttggaagtaaagcactcctcagcaaatgtaaaagaacagaaattataacaaactgtctctcagaccacagtgcaatcaaactagaactcaggattaagaaactcaatcaaaaccgctcaactacatggaaactgaacaacctgctcctgaatgactactgggtacataacgaaatgaaggcagaaataaagatgttctttgacaccaatgagaacaaagacacgacataccagaatctctaggacacattcaaagcagtgtgtagagggaaatttatagcactaaatgcccacaagagaaagcaggaaagatctaaaattcacaccctaacatcacaattaaaagaactagaaaagcaagagcaaacacattcaaaagctagcagaaggcaagaaataactaagatcagagcagaactgaaggaaatagagacacaaaaaacccttcaaaaaattaatgaatccaggagttggttttttgaaaagatcaacaaaattattagaccactagcaagaataacaagaaaagagagaagaatcaaacagacgtaataaaaaatgagaaaggggatatcaccaccgatcccacagaaatacaaactaccatcagagaatactataaacagctctatgcaaataaactagaaaatctagaagacatggataaattcctcgacacatacatcctcccaagattaaaccaggaagaagttgaatctctgaatagaccaataacaggctctgaaattgaggcaataattaatagcttaccaaccaaaaaaagtccaggaccagatggattcacagctgaattctaccagaggtgcaaggaggagctggtatcattccttctgaaactattccaatcaatagaaaaagagggaatcctccctaactcattttatgaggccagcatcatcctgataccaaagcctggcagagacacaaccaaaaaagagaattttagaccaatatccttgatgaacattgatgcaaaaatcctcagtaaaatactggcaaaccaaatccagcagcacatcaaaaagcttatccaccatgatcaagtgggcttcatccctgagatgcaaggctggttcaacatatgcaaatcaataaatgtaatccagaacataaacagaaccaaagacaaaaaccacatgattatctcaatagatgcagaaaaggcctttgacaaaattcaacaacccttcatgctaaaaactctcaataaattaggtattaatgggacatatctcaaaataataagagctatctataacaaacccacagccaatatcatactgaatggacaaaaactggaggcattccctttgaaaactggcacaagacagggatgccctctctcaccactcttattcaacatagtgttggaagttctggccagggcaatccgtcaggagaaagaaagaaagggtattcgattaggaaaagaggaagtcaaactgcccctgtttgcagatgacatgattgtatatctagaaaaccccattgtctcaggccaaaatctccttaagctgataagcaacttcagcaaagtctcaggatataaaatcaatggcaaaaatcacaagcattcttatacacgaataacagacaaacagagagccaaatcatgagtgaactcccattcacaattgcttcaaagagaataaaatacctaggaatccaacttacaagggatgtgaaggacctcttcaaggagaactacaaaccactgctcaatgaaataaaagaggatacaaacaaatggaagaacattccatgctcatgggtgggaagaatcaatatcatgaaaatggccatactgcccaaggtaatttatagattcaatgccatccccatcaagctaccaatgactttcttcacagaattggaaaaaactactttaaagttcatatggaatcaaaaaagagcccgcattgccaagtcaatcctaagccaaaagaacaaagctggaggcatcactcttcttgacttcaaactatactacaaggctacagtaaccaaaacagcatggtactggtatcaaaacagagatatagaccaatggaacagaacagagccctcagaaataatgccgcatatctacaactatctgatctttgacaaacctgagaaaaacaagaaatgaggaaaggattccttatataataaatggtgctgggaaaactggctagccatatgtaggaagctgaaactggatcccttccttacaccttatacaaaaattaattcaagatggattaaagacttacatgttagacctaaaaccataaaaaccctagaagaaaacctaggcaataccattcaggacacaggcatgggcaaggacttcatgtctaaaacaccaaaagcaatgttaacaaaagccaaaattgacaaatgggatctaattaaactgaagagcttctgcagagcaaaagaaactaccatcagagtgaacaggcaacctacagaatgggagaaaatttttgcaaccaacccaaatgtccaacaacgacagactgggttaagaaaacgtggcacatacacaccatggaatactatgcagccataaaaaatgatgagttcatgtcctttgtagggacatggatgcaactggaaaccatcattctcagcaaactattgccaaggacaaaaaaccaaacaccgcatgttctcactcataggtgggaattgaaaaataagaacacatggacacaggaaggggaacatcacaaaccggggactgttgtggggtggggggaggggagggatagcattaggagatatacctaatgctaaatgacgagttaatgggtacagcacaccaacatggcacatgtatacatatgtaacaaacctgcaaattgtgcacatgtaccctaaaacttaaaataataaaatttaaaaaaaaagggggggggggggagaaaaagacatcacatgagaccaagcagttttgttttgttttttttgagacagacccttgctctgtcacccaggctggagtgcagtggcgtgatctctgctcactgcaacctctgcctcctgggttcagacgattctcctgcctcagcctcctgagtagctgggactaggactacaggtgcccaccaccatgcctggctaatttttgtatttttagtagaggcggggtttcaccatgttggctaggctggtctcgaactcctgacctcaaatgatccacccaccttggcctcccaaagtgtgggattataggcaggagccaccacgtccagccccaagtagattttagagcaaaacatttaattagggataaagagggtcattttataataatatcatttcatcaagaggctttatttaactatcctaattgtttatgatctgaataacagagcttcaaaacacaagaagcaaaaactgagagaactgaaagaagaaacacatgaacccacaatataaacatttcaacattcctctgtaattaataaaacaagaagattgaaaaatcaataaagatacaaaggagttgaacaagaccatcaaccaacagaacctaactgacatttatagaacagtccaaccccagagcaaggttacgaaaagcatattttgggctaaaattcaagttgcaataaatttaagactcaaatcagataaagtatattctctgactacaatagaagtaaattaaaaatcagtaacaatagattgtttgcacagcatggtgactatagttaatggtaatgtactgtttatttcaaaattgctaaaagagattttaaacattcttaccacaagatataagtatgtgagttaatgaatatattaattagccagattttatcattccacaaaatatacatattattaaaacatcacacagtaccctatatataccattattatttttcaattaataagaaaatttaaaaaaagctatctggaaaaggccccaaatttgaaaattaaatagtacacatctaaataacctatgagtaagagaaaaaaacgaaaaggaaattagcaagtatttaaaattggatgaaaatgaaaacacaattttaaaaaattctagaatacagctaaagcagtacttagagggaaatttacagcactaaatgcatatattaatgtgaaagaaagatctcttttcagtgattttgacatcccctttaggaaaaaagaaaaataagagcaagttaaacccagattaagcagagaaaggaaataataaaaatcaaaagaatagaaaaccaaaaaaaaaaaagagagaaatatcactaaaacctaaagctgtttttgtgttttgttttgtttttttaaaaaaagatcaataaaattgataaacctctgaccagagattagggaaaaaaaatagatgtaaatcacgaatatcaggaattataacaggaattaccaatattaggagagaagagacatcaaaacagatttttagacattaaaaggataaggggatatcataaacaaatagtttggactactttgatgcgatgaacagatctcttgaaagacacaaacttggccaggtcctgtggctcacgcctgtaatcccagaactttgggagacagaagcaggcagattacttgaagtctggagttcgagaccagcctggccaacatggtgaaaccgcatctctactaaaaatacaaaaacagccaagtgtggtggcacatgcctgtaatcccagggacttgggaggctgaggcaggagaattgcttgaaaccaggagggaggtggaggttgcagtgagccgagatcacgccactgccctccagcctgggcggcagagtgagactccatctcaaaaaaaaagagaaagatacaaactaccaaacccctttcaagaagaaatagattgcataaataatacaatatctaataaagaagttaaatttgtagtttaaatcttcccaaaaagtaaactccaggctcagcagactacactggtaaattctaccaaatatttaaggaagaaactctatacaaacttgtccagaatattaaagaggaaagaatacgtgccaactcgttctatgaggtcagcattatccagatgtcaaaaccagacaaacacagtataagtaaaaaggcagtctgcacttaaatatttgtaaaatttctctgtcttgagacttactgtggataccctacaaaataaatatattaaatgtcttctcatactaccttcccactcttgtaccttcacaaattgtcactcaatgcacccatctttctctcggatttctcaaaaacatctacgcagtttccttttgtagtacattccaacttgacttcctttggatttcaacagagtggaattcttagccttcttagtttacactgagtgatttcatcccgaatcactgcttctattgttgccaaagcacgctggggtgtgagatgtagagctaagatattagaggtcagttttagacccctatatccaatcacctataaatagctccaccatatgccctctaaactctcaaattcttttattttttattattttatttatttacttttcattattttttgagacagagtctcactctgtcgcccaagctggagtgcagtggcgtgatcttggctcactgcaacctccgcctcccgggttcaagcgattctcctgcctcagcctcctgaatagctgggactacaggcacgtgccaccatgcctggctaatttttttgtatttttagtagagacagggtttcaccatgttggctaggctggtctcaaattcctgacctcaggtcatcctccggccttggcctcccaaagttctgggattacaggcgtgagcctccatgcctggcctaacctctcaaattcaacacatccaaaaacgaactcactaccacccctcaacagctgtcattagtccaattgagactatttcagttagcagagccataaacaccatgtaagccaaacaaaaacttagttatgctaaatactacatctcactccttttgaccctcactcacctctcaatgaactacttcacttgactctatctcccttctgcttttagtcatatagggtaaaacctactttagaagaggttcttatcatcttttaccattttcatagacatatcttatattctaaacatgtcatacaacataacactccttcaatcacgccatgctgcttcatgcttaagcatctcccagtgtgatggtcttcctaactgcaatgcagcttctttcaacgtgcaccaccaaggaggtggtggcagtggttgtattaaagtagtaccagacagtaatagcggtagcagcaacaaacacaacttacttagatctcattgtatcccaggatctatgctaagtgattcaattcagttatttcagctaactctcaaaatggcactgtgaaatcgatgtcattttcaccattttataaattaacaaacagtctttgagaggttagatgacgcagtcaaaatcacataactagtaagtagtgtagccaagtctatcagacttctgacattatgctctgagccactatataatactcccaccacagagaacttctcatccttaaaggccaagccaagattttgcaaaagctctgacttctcaaacagatgtgctaccacaggcctcttacaaattgtaaatgtctccctcactagacaattactgaaggcagatactaaacagtacttattttagtaattccagtgctactggtacatcacagaactcaataaatgtatacccaatgaattaatgatgagattaacaatttcagttgaaacagattcctcatcttccactccatgtttctataattagtttcaaaactgaacagaaaagagagatctttaggctttttaaaatagcgaactgtgtatttcagcccctggtaagggcattggggaggccataatcaaggttagccaaatttgttgtatctggagaaagtggttcaaatgacctttcataactactaaggaactggaaacttatgatttagatcatttaaaaggaacttattataagaattaaaaagtgagtgttatgaactgaatgtgtctttccaaaatatgttgaaatcctaacttccaacgtgatggcaacaggaggtgatttggactttgggaggtgaacaagtacttagaggagagccctcatgaatgggattataataagagactccagaaagctctctagccctctttccaccaggtaaggatagaatcaggagtcagcagtctagggctccacaccagaatctaccatgctggcatcctaatctcagactttcagcctccagaactgtgagaaataaatttctgttgtttataagccacccagtctatggtactttgttatagcagcccaaacaaagacagtgctttttgagaaaaaaaaaaaaaaaaaaaaaagatgaagagtccttgttctgcagtgaattattagaacctaaaagaaacatgtttctgaacaccttcacctccccccaaaaaagggaacaggtaataaaaatatgcaatgtagatttgctatattatgtaagaatattcaattctgctttagaagacaagaaaacaaatgtgatagatgaacacaaaagaaacattaaacattaatagtaacataatagcttccaagatgtaggcaaaaagtcataggctatgttaagtataggtaaggaagtaagtggcttatgagagacagacaaaattcaaatgatgttaaatacgtacagtcaatttaaagtttgaaatcagcaagacctgtcaaagacagaatacattgaatgtatgatggcacacaaaaaaagtgctatttacagatggatggaaagaccacctcaaggtataatcatactacctctgtgctgggtctctcatatttctgcagatcttagaggaaagtagtaattgccatcttatatgacacactgttttcaaggatgtttgcataattaatagccttggaagagacagtatctcagtttacagcaatgggcaggtttgtttactgtccagtataagaaaggtaatgatgctttataaggcagaggccagatcttactgcccattgtaaaaattttaggttctctacagttgaggttgcttaactgggatgtaaactcactgggaacacagcatccacctgggtcccacctgggtcctcattgggaacacagcacccacctgggtctgttcatgatgccctaataaaatactgcagactaggtggcttaaacaacaggtgtgatttcttggagttctggaggctgggaagtccaagatcaagttgccagccagtttggttcctgctgagggctctcctcctggcttgcagatgacttcctgctccctgtcccctcacatagtggagacagagaatttctctttcatcgtcttcttataaggccaaagtcctatcagattggggccgcatccttatgacctcatttactcttcattacctcctaaagagtctatctccagattcagtcacactgggggttacagcttcaacatataaattttggggaaatacacatcagtccatagcatctccaacaagtcactccatgaaacttggggatgcgagggaaatagacactaacaagatgcttactctgcttgtgctgtaagtctttgtccctaacctttgtcctatgtcttctgccaacatctaagaaactgtggcaagataaattgttagcttgcatttcagacctttcatagtttttttgttgttgttttgttttgtttgtttttgagatggagtttcactcttgtcacccaggctggagtgcaatggcatgatcctggctcactgcaacctccgcctcccgagttcaagtgattctcctgcctcagcctcccaagtagctgggattacaggcatgtgccaccacgcccagctaattttgtatttttagtagagacggggtttcaccatgttggccaggctggtcatgaactcctgacctcaggtgatccacccgccttggcctccttaagtgttgggattacaggtgtgagccaccacatgccgggcccctttcatagttcctgacaacctggatgatatctatgccggctttaaattgcccacccattgataatacccagtatagccccactctggcccctgtggttttatctgcacaagaaatgcagaaaaaaacttgtaaaactattcagcaggttaattggttggctccagctatgaccagggatagctgctgctgtgtgtctctaatagagctggtgtgtttcattggaccggaacactttccttctgtggtctcccttgtactcaaacctcaattctggcacttgtaacatcaaagaaaggcatacgaggcagaaaaagagacaggacatataaatgttacatgaaccaggactcaagaactctgatctttctacctgcttgcattcgatccgaagtatattaacttatcccaactctcttccatttcttcttattgcgtatgttaaattgatttaatgaatcatctgctttgagaagcttatttgatctgtgagcccttctgttctgtgaaatctgggacgacttgcctggtagtgtactaggaggcaacattgcattaggtaatttcccacagaacaggttcatagctaacctttatctcgccttaaactaccgttgaaaaaaattattctaggccactggggaaaaaataggaagctccataattcatttattaagccagcataatgttaatgctgaaaacttaaaaagagataaagagactatcaaaaaggaaaataatagagcatttttatcactgaataaagatacaacactcttaagtaatctgtaagcaaacagaatccagcaatgtctaatgagaacaatataacattaccaaggagggtattttcttggattgcaagagtggttcaataccaggaaatccacaacaggagatctactccttatatcaacaaattaaaaggaaaacattgcatcatcatttactagatgctgaaaagcatttgatcaaattcaggaaccaccactaaagaaaaaaagttagtaaaacaggagtggaaaatattacgtaaaataaagactttttaccagaaaccaacaacaaatattagctatgtgatctggggtcagtcatgtaggcttctcacctcagatgcttgtcttaaattaattagtgtaggtacagctagtaaaacagggcctggcacatcataagcactatgcatgggttagcaattattattacaataataattatcaccagtcaaattgcaaaagttgtaataaatgaaataataaaatgtaaaacctggtataaacattgaaaagaaagatgaaaatgcatttgaaatatccaaagtactccaaatgattaacggaaatatatataagataaacatgggaactattaatatttgttctccattttagcatttgacacaaatattgaaattagaaaaaaatttcattcataattgcaagaaaaacattacacacttaggaataattttaacaagaaaggcagagagggaccatgggacaaaaaatataaaacaattattagaggaacacaaagtacaatctgaacacccaaaaaacttttataatagtaagaaaataccattaaaatgtaaatttaccaaaaaccaatatgtatatgagttttataaattataattaaagtgacaataggacttttttaaaggcttcataaaattatttaatgtttacaaactatataccagaaaatagtcaataaaaggatgaaaacaaagactagtaaggagtattctaccttaaacaatatgcaaatggcataaaaacaaatatatatttttttaaaacattagactgtaattcagtctgacattttctattctcttttttttttttttttttttttttttgctaagtacctgttgtgatgcacaaagctgatagcacagcttaatgtggaatgatcaacacatatgcaaagcacctagactgtacagtggcttgcacacagttacctttctattgttcttcccatgtgactacatatataatctaaaggccaagagaatttttaaaccataattggaactcagaaagtactaaaaaatatttatacctataactttgtaaaattgtaaaattaatggcaaaaatatgactgataaagtcaaatagtgaaagatctgaaaaagctatttcatgataaagggttactataatatacaatacttataaaataaaaaatgaatagaaaatggataaagaatataaaaggaatttcacagaattcaaatgtccagcattttaaaaatgctgaagtttattagtagtactaaaaaagacattaaaataatttataccccagaaacaataaaaaaattaagagttataatacattttgctgacaagagtgcagacaaaagtgtatattgttggtagaagcatgaaatgtaaaatccctttggaaagtaatccaaaattatttatcaaaaataaaaatatgtatggcctttgacccaacaagcttttggataacaaatagaaataatagttttattacatcaacatgtagggatggttattcccacatttttcatagtgacaaaaaaatgaaaataagactttgaaatccaatgcaaatcactgggaaaatggtggtatatttatgatgtatcttcttcagtcatttaaaagaatgaattaaagtcacagagttgacttggctggatatccacaatcaatatattatggagtgagataaacaaacataccaagttgtatatattatatgactttatttttgtaaatcaatgacactcactccctacaacatacataagtttatatgaaaatgaagaaaaacatgagaagattacgtactaggttgcaaatatatgttaaggtgttgccaggcacagcggctcacacttgcaatcccaacactttaggaggccaagacaggaagactgcttgagcccaggagttcgagaccagcctaggcaacacagggactctgtctctacaaaaaaatacaaaaattagccaggcatggtggcatgcagccatagtcccagctactcaggaggctaaggcaggaggatcaactgagcctgggaagtcgaagctgcagtaagccatgatcatgccatcacactccagcctgggcaacagaacaaaaccctgtatcaaaaaaataaataaatagaaggtgttctgggggatagatgatgggggcaagaggagaaagccaagacaaagaaaaacaggatgcataaaagtaaaatgcacatgctaacaaaaaacaagcaatgagtagattatatttataataagctgcgggtatattcacaaacatataaaatctgaatgatagcaggtatgacattatttctaaatttttttctatgtcatattaatagtatttgtataaagtagaattcccttatccactcagaggtatgtttcaagaccccttaggggacatctgacaccacagacagtaccaaactcaattgtcatcagttggaacatggttttcttcagactttccgcccacaaatgcaatgctttttccaccttaactaagcacttattatgcactgtgctggtaacttttgcagtttgaagtatgacagcaaaactagcacaaatttcttattccctcttcacaattttatagataaagatgcattcttactatggatcttagcaacctcaacatacgctatttcttctttcagttcgagaactttcaccatttcacttcgaggaatcattttacagcttctctttagcatatctcaattgccaacatcactacttttgaactttgggacgattagtaagtaaaataagggttacttgaacacaagaactgtgttaccacattagtggatctgataacctaagcaactaacagcaggtagtgtagacagtgtggatatgctagacaaaggaaagatccatgtcccaggcaggaaggtgcaagatttcatcatgctactcagaatggtgcacaatataaaacataaattgtttattttgggaattttttatttacaattttcagtctacgattcaccactgtaactaaaactatggaaagcaaaaccatggataaggggaggctactgtatggtcatgtaggatgaaagtcaacttatctttctttcctttcttttagtttccagagctcaacctgcttacctttttttccctactttaacgtttgcaaaattctttctataggtttttgagaattcttcgcctacaaccagcctcccttccttctcattgtccttaaaaataagaatacaaaccctttgaattttaaatgttttactcttgttttctatcaggcaccaaatattcaggtgactgatagaatgattcacagacctttgtgagtcattaagtgtgaaacatgattcagaagtagcaactggaaacaaacacagtcctctgttaacatctcagagttcaccaaacttttttcttacccatctctgatctccataggcctaatgtaacaacaagagtagaatactaattttctggggtactgtgggtttgtttgcttttttttcctgaggaccggtatccttaaatgcctatctctgtgacctctgccacaaacattaatagtcccacatttgttaatgcatttttatgttgatacaaatatagtcctttcctagataattttttttcctttggtttattttacttcattcataattcatatcaaaatagcaatatttaaatgagacaagtcaattccttataatacattcttccattttcaaagccttgcacatttaagaattaaaataagagaaaacctttagaagtttaaatccattattctttttttttacttaaaattttattaaggtatagaaaatacttggtaaaatacaaagataacaggtgtggaacttgatgacttctaataaattcagacacctatgtaatcaccatcctattataatataatatttccatcatcccagaaaggttgctcacatctcttcactgtcaacatctcctgtaaacattcactgttctcatttctttcatctctgattagttttgcctaatctacgcatgatacacatggaatcgtacatcatgtatccttttgtttatggcttctttcactcaccgtaaagtttttgaggttgttccaagttgttctgtgtattgataattcatttctttttattactgagtagtattgcattgtataaatgtaacatgattggtgtatctacccttcatttaacattcaagtagtttactaagaataaagttgatgtaaacatttgtgtactagtctttttgtgaaccttgtgttttcagtcctcttggacaaatatttaggagtgacactgctgtttcataggataggtggtatgtttaagttttgagaaactgccagaacagttttcaaaacagttgcactattttacactcccatctgcaattgataggagttccagttcctacacatcctagctaacatttggtgttgtcagtcttactaattttagctatcctaacgtgtagtagtgtctcctggtggtttttcaagacaacaaattgtgctgaacattttttcaggtgcttattggccactcacctgccttcctttatcaagtccctaatcaaatcttttgtccatttgttttattgagttatctttttattattgatttgctaatatttagtagacacaagttttgttagataaatacatggaagatattttctcccagtttgaggcttgcctaatcattttgttaataatctaatatcattgaggagatataattttctagaagtctcttgttcttcaatggtaaatgggtcttgaaaagacatcttttgcaaatatattttttaaaggcagcttgtcaatttcttgaaatgacctactgggaatctgaatgggattgagttgaattgatagataaatttggggagaaatgacatctttataatactgagtcttatcatcaaagaacttgtcatatctttcaatttatttaggttttatttttttttccttaggaatattttgtagttttcagtgggcttacagatatttcaacaaattattcctaagtattttatgtttattgaatattattgtaaatgatattaaattcatatttttgaattgttcatagaaaaaacaatttttatgcccatcaatggtagatcagataaagaaaatgtggtacatatacaccatggaatactatgcagccataagaagaatgagatcatattctttgcagcaacatggatacagctagaggtcattgtcctaagcaaactaacgcagaaacagaaagccaaataccacacattctcacttatttgtgacagccaaccattgagtactcatggacacaaagaagggaacaagagacactggggcctacttgaggttgaagggtaggcgagggtacctatgtacctattgggtaactatgctatataatagtataatagtatacctattgtatactatcttgtacttgggtgacataataatatgtacaccaacctatattgtgttttagctatgtattcattttcttaaaaacaatagagacctaattaggttatttatttttaattaaataagctttagaagtttctgtcttcccagtaatttgttcatttaatctaaattgtccaatttattattttcatggctataacatgtataatgttcttttattccaatattggtagttcataccttctctgttttttattaatctgattagatgtttatcaatcttatcaaactttttaaaaaacagcttttggtttcactggatttctagttttttaaagttgatttttttccttttacctttattatatccttccttatgtttgagtttaatttgctcttcttctgacttcttaatgatgagcctcagatatttgattttaaacttttctgttgttctctatattgttatttataaagatataaatttcacagttataggttttcctctaggtactattttgtccatatcccactaattttgatatattatcttttcttttcacttttattgtggagattgggtttcactgtgttgcctggtctggtcttgaactcctggcctcaactcatcttcacacctcagcctcccacagtgctgggattacaagcatgagccagggtacccagcctctattttcattatgactgttaaatacttcctaatgtccctaatggttgcctaaccctatttaagaatatgttgcataatttgaaatatttgggatttcccagatatcttcattactttgatttctagttcaactgaattatgaataaagaatacaatctctgttatttaaattctattaaattagtgcactccttttataaccaaacaaatggtcttcacagtaaatattgcacttgcatttataaggatgaggaattctggagttaaaggtgatgtatcaatctcaattaggttaaatttgttgatagtgttcatgaattctacataattactgacaatacctattgttctatcagttactgatagaaaaattttgaaatctcaaatataaccatgaatttaaatattttcccttcagtttgcttcacatttaaaatctctattatttgatggtatattaattattactgctgtaacaaattaccacaaacttagtggcttacataacacaaaattattatcctataattctggaggacagaaataaaaaatgttccttaatgggctaaaaccaaacctgagttcttttcggggccccaaggatggtgtcatctataagaaacaggcttccaccagacacaaaacctgccagtgcctcaatcttggtcttttcaggctccagaacagtaagaaaataaatttctattgtttacaaattacccagacttaggtattaatattttgttagaggagcacaaattcactaaaagagaaattgttgtcaagagtagaatattgctacaacatatatctaaaaatttaaagcagttttggaactgggtaatgtgacaatattagtatgaatagaaggaagtcagatgctattcatcaaagcaatgcaagaataactccccaaagcatttcagagatctttgagtctgccacacctattacatgcccagagtgccagggcctgagggtagatctttttcaaaggaggggcccacaacaccagaggggctcaaggcacccgtggtaacttggggctcaccaaccagcacagctcaagtctccgcttcccgcattccagtacagtgctctttggccaccccagctatagctgaggaagggccaggtgcagttcaggccacctctctggaggacataagtgataagcctcagtagcatccatgtggtgctaattctgcaggcccacagagtgcaatagctgtggaggcatgacttctccacctagattttaaagaatccttccaagagtcccatggccaaggcagaaaactgctacagaagtggggccactgaatagagcccccactagggcaatgcctagtagagccatggggttgggaccaccaaagacagcacccactagagcaatgtctagtggagttgtgggacctgtcccacagttgtattttgaaggcggtaacttgtttgatttcacaggttcacaactgaaaggcaacttgctaaggctaaaacacaactttcagtctcactcagtctgacttggatggcatctacatgatattctggacgttaaacttttgagctagaaggagttaagacttttggtgctattgtggtagaataaatgtgttttgcatgtgaggttgacatgtattttgcggtgggaatgctatagtctgaatttcccccaaaattcatgtggtgaaacttaatctctattgtattgggcagtgtggtctttggaggtgatcaagtcatgagggctctgcccttatgaatgggatggataactttataaaagggctgaaggttgaaggggccactatcttaccctttctccatgggaggacacagcagcaaggtgccacgatggaagcagagagcagccctcaccagacacaaatggtactgacttcaccgtggaattcccagacaccagaactataataaatttctgttcttcataagttacccaatctcaggtattttgctataccagcacaaacagactaaggcaggtgagaaatgctctagttgacatatcctatgaggaattatatgagatccagatgatatcactagtgatggtaacttcatcacttgattaaggtagaattagccagattttaccaccgtcaagttaccataattcacttcgcatactcttttctatggaaatgtgtcactgaatctagactatcctcagagggaggtgggaagagtaggaattaagttccagctcctagaatgggaagaatctatctatctacccatccatccatccatctatacacaaatacatactagattttaaagttgtacaatctctgtcacttctgggactccactatttaatgatgtttctcctggattagaaccatattttcctgcttctttgcatgtctagtcattttgtgtgttagacattatggactaacaattattttatctacatgttgttgtcttactttagagaataatgaagttttgctctggcagatgggtaatttaattgtgaatcagatggttccttttcaaggttgttttaagctttgttaagacaagtacagagtactatatattatctaaggatacaggagagtacttatagtctcctacaagcacttcttatacatggtcataaaatagaataattggggcaggatgggaacagcagaaattaattttttcttatagttacatcactaacaatccatactaccttcctgacagtacttttcacctaggcaaatgattgtactccataatttctcacacaaaaattaatctacaggcttcttgcaatgtttatttcaccataattttaccttaataaatgtgaacagaagagtggagacagggtaatatagccaggctaatttgaatcctggactttccaagggataaaccaaaaccaatgggcacaaaccctgatttcactgtgttctacccaatagaaaataaaccagcccaagcataaagcagcccaagcatcattcaggaattttatacagttatctatcatgggatctttgcttcttaaactttattatatttactaatggctttcacagtctgtaggcatatttttcactgataatgaaatacagtagaaaatatcctgaggaaaaaatatttaagctttaaactcaggctacaggtagattgtcccttcaacttacaaatattgtgtattgtgaaatactgcctgtaaactagcaattagtcccactgaaatttaaaaatattaattagatgccaaggttttctcataaattactatttgattcaaaaagtgactgaatcatttaataattctgaattctaatctcgcaaaggccaaacatcctcttagcttcttcccatctcaactccaaagcctgacagaagtaatcatttttatagaggttaacaataattcaaaatttctaagtaaagagtgacctatatatatcttgatatttgtttggaaagtttgggaactctttaatcaattgtccaattacaaaggtctaattctactaagagcaaatgttaaaatagatttcaattctatatgtactgaaaacagacttacagacaataatatttttctatttatgtcttatatgaagtattatcagctatggagtgagcatcagaaggcattgtgtatagtctgcatatttaaaaaaaactgaagaaaatattattttatgctgttcctatgcagtcaatgacatgctctggcttttttttttctactaagagaacacattttgatttcagtgtttttccattatgttcttttttttcatagcccaaaagattcattactttgataaccatttatcagggactcaagttcaatctataatacctattgaaatagcaaataattcagcctcagtgtctgtgtgtgggaaaatgggctgtgtgctagataaacggcctacctgcctctgacacagattaggtcatcattcaaactaaccacagatctctagaacaaatacaaggaactacaggttcactttagctgatgtttctgttttagaaacagtcttccttttagagagttacaatatcatcaaagtatcatggcacaggcttgaaaaaccagcatccaggaacgtaaggatagaaatatttcacaatttttacaaaacaccaattatgcaacacatacttatatctgatttctcttttacactagggaatcttataaaacccctgctatttccatctgaatgaaattatataactatattatgctaggttgtaggcaaggaaagccgttacagacatacatctctttccatatacaaataagctctattttattcctctcaaatttctaatctcttcaatcttgctattagaagaaagaagtaaacattatttaaagaaggaaaccagttggctaccgagaccaatcctcacagggtgtaattaccttggtaaattcagcaaaatccagtttacattaattttacagattcagaaataaagtgttattacaaaggaagattcatttgtgaggaatatatttcttttaaccaattatacaaaatagaataaatgacttttaagatctacagaaagcaacattgccaatgaggagactagacacagagtacattccttttgtacagagaaaaaagaaaggaagaaaagaaggccaactaaattcagaatgacagcttactgatttaaaatgagaaattataatggctgttttctggttaaccatgggagagtaaccttacatttttatctactcccttgccctatggcagactttgaaggttacatcccttaacctccatttccaaacctatgtttccttgcattcttctgtaacagatgtttcacctcctctataatatgctcatttgcagttacagattgtaaaaacagtcttacttaatgagatatacagaaaaatttgataagggggattgtgggacaagcatcagtttctcaataaaaagatggataaatatgttatagccattctctcttcactttctccctcctatttaaactttttattacgaaaattttcagaccttcacaaaaatagactagtataatgaaacctttatattaatctatgaaacaatttcaataattatgccagatttgtatcatctatttcccttgcgacttctttccttttggaatattttaaagtaaatcacaggcatcataacatttcatccataatttcttcagtatggattcctaacagatgaagacttctatttttaattaacataaacatgatgccattatcatgtataacaaaataaacaatttattaaaattatctatgtgtaaaaatcctgattgtctcaaaaacatatttttatatttaactgtttccaaacaataatcacagaagatctatatatcacaattcgttgatacgcttttcaagtttttaatcaatgagagaatctctctcttcttcttttcttctactttttttttttttaaagaaactgggttatttaatctatagaatttaccatattctgtgcctcgctgattatttcttcatggtatcatttaatttgtttttgtatccactattcttggaatcagcaatttctccaaaatgagatgcaagcgtctcatgaaatctgctcagtgatttccaagaacggttttgctttctcaatatagaaacttttcaaccatacttttctttctagattatttaaacatcgaatccgagatacctacatctctgccagagggctctgtacctgagggaagtactggctgaaccaaggacataattttaaaattctgaaggaagtgatggtcaacctgaagttctatacctaatcaaactatcaaccaaacttgagggcagactaaagattatttcagatattaggcatttattaaaggatatgtacttcttaggcatttattaaaggatgagcattaccaaacaagggaccaataagacaaagaaaaggaagaatgagatctaagaaataaagaatccaatttacaacataaatcctaaaatgacagctatgggctatgtatattaggcaaacaatctgagaggttggagcagaagaatggatgataactaaaatatactggaaactgcttatttttttctcagcactatcctgctcttctaagctctatcttgaataatgagaactgaaaacttataaactatgtttcctacacttcttgccaggaggtttttcacttagagcccacaatgaaagaatttgtacaatatttagatggcagaagaaaatgagaagccttgttctccagggacaactgagggcagatgcagtggattccaggtgccaaagacaactgacataagtagctgtggttcacctgcaattcctgtactatcacatttcttgaaatccagcaatgatttcccattggttctgttagtctgtaattttaggcattaattcctttctttttaaactatgtaatgtagtttctattttccttacctaacctcaagtgattcaggaattctttaggtaaaaatatagaagtaatggatcatctgatgcttgaatgatgaccattatttatatactcactgtactataaatatcaacttctgattttatttagattgtggtatacctatatttggaagatagggatagggaaaaatgcgtgtgagaaatatgatgataaagaatgatacgttgtaatcccagcactttggcaggctgaggcaggtggatcacgaggtcaggagatcgagaccatcctggcaaacacagtggaaccctgtctctactaaaaatacaaaaaaaattagccaggcgtggtggtgggcgcctgtagtcttagctactcgggatgctgaggcaggagaatggcgtgaacccgggaggtggagcttgcagtgagccgagatcacgccactgcactccagcctgggggacagagcaagacttcatctcaaaaaaaaaaaaaaagtgatactttcttaatttccataaaagaaagtctatatacagtttaaaggtcttaagtttttttaaatagcagcataagcccaccccctctccctttttttattttaggcagtaaggttgtcttaggagagtgagtcaaggaacgaggtagaggattgattttaggtaataaagagcttttcagcatcatcgattttttaggtagataatatcttactttgttaaaaaggaatttttaaaaggggttagcaaagaaaaacaaaataagaaacagacaaagttttaaaacaaacataaaagatgcttgtgaaataactgggaaaatggctgcaaatacagttgcaaaataatgacctgagtcctctgtgacattactccttctatatatatttatatgagatgctaaattacaataaaatgtgtgcttgtttttcatttggtatgcatagaaccaaatgaaggaagttgagcaaaataatttaaatttgtaatatacttagctatgatagcctaaaacatttttctctacatgagatcatacatgtcaccaggacttatgggtttaaaagatttcctcttcctcagaaagaacatatattttcatacagcaaaatcattagcagtgactctgtttatggatcctagaatcgaccagtttcccaaataactggtttattcgcatatgcaggtctgtgtgtctatcaaaacaggttatagattaaatctaactcatctggaagccactctttacctttacggtgagtatgcatgttcctctcaaatccattttgtgaggatctattaattaaatttccaggtatccaagtattttgttaattaggagtggtaacaggagtggggatgtcactgggttcccatgtaaaacaaacaatattagcttatattaaaagcaataatctggccaggtgtggtggctcacatctgtaatcccatcactttgggaggccaaggcgggtggatcacgaggtcaggagttcaagatcagcctgaccaacatggtgaaactccatttctactaagaatacaaaaattagctaggcatggtggtgcgtgcctgtaattccagctacttgggaggctgaggcaggagaattgcttgaaccaggacccaggtagcggaggttgcagtgagccgagatcatgccactgcactccagcctgggctacagagcgagactccatctcaaaaaaaaaaagaaaaaaaaaataataaccagcttaagacaaagtagactgtaacaatcagtacactcttttctctactttttcttatggaaaattcgaaacatacaaataaagtagagagaatataataaattcccatgtagccatcacctagactcaataatttttttattctgttgatcttcttctatctatttcgcattatacttttctttctagagtatttaaaaactagtctcagatatcatgttatctcataatccttgcattccaaaatgtagactaagccatccttgactattttggcaggaattaatatttgaatagatatttaaatcttttgaaatttaatatgtgaatcaattgctctggcataagaagaaatacatattaggtgttgtcatatatactcttcatggttcatacaaattcagaaaaccatttaagaaaagaactgtccaacctcaggtgtgaaccataaagctctttcagggcatctattctctaagaagatacaaaagtgctaaggaagcagaaaagtatagagaaaaaaaaagtgatctaggaaaagaatcatcaagggagtatagaaaatctgaacttagagataaacactcagatactctggatgcctaaaaataagactatcatagtagacattgttagggctctcctcatatcccttggcaatttcaacaatctcctgtagacttccatctggcagtatctacacatccatgtgcctgagggagtactggttagacttggaataattttctgaagttggtgtataaataccacagctccctcaactctctcagttgggataattatgtgttatattttgcactgtttccaaaagttatcctgtaggattaaattcatctggcagctggcttataaggagcccatcattgtttcccctttccctgttccattttcccacctccctactagtgtcaccagctagtgtcaactacttgcactggaattcctgtttcagcatctcaacctggggaaacctgacacaattactaaacaagattcctttcttgttcttttagatgagcaaaaaaggaaaagaaagaccttgtattaggtactttacaaaaattaccttagtaaacccttataatgataatgtgaagtaagaattatacacatagggaagctcagaagttgtgtctgtgatctcaccactgggatctgaattcagaaataaagactaggaaaagcaccagcgacacgaattcagtaaacctgaatttccatatgccccaactcccaagccaattttacccagtgttatttcctcaaagcactgtagtatttgaaattatcttgtatatccatttgtttacttattgtctctctctcccacccactttagaatggaaggtacataagatcaaggacttttgtcctcattggcatatctccagagccatgggtacatttagacacaaattaatattttctaaatgaataattcagaatgattcttaaaatcaaaatattttggcttatattttgtaactcatctttcccagattttttgcaactcaatcccactttgctgattttccagaaacaccatgtttccttgccattccagtcacattcctccctccaggcctttccatttactgttccctctgcctagaatgttcttttcattagacagtcctcatggcttcttccctcacttcattcagatctcttttattgaagagacattattgctttcctttgtccttagtaattatcaccatatgacatacgtgtttatttccatgtctatccccactagactataagctcaacaagaggagaagattgtccacatttcttcactggtatattctcaacacttagaataaattttctagcatgtaacaggcactcaacaaattttgatgaatgagtggataggcacaatataaatttaaaatgtcatgatatcaacaacctccataaaattattttggttttctgaaataatcttcaaaagtaccaatacaaaatatgaaactgaaaagacccagttaaagttaagtggcactccatgcttaactgtaactgatgtccaaacagttggattctcctaattaaaataagacacaggacatggaatcaaaagacactttccagatctcaaatgtaagaaatcccagctactgtgctagacctctaccatgcgtatcatttaaatataaatgaaaacttcacacacatttgattaaatgtcctcttgttagttttagctcagttttgcagctgcaactgttaattttcaacagtttagtgaaaactgaagaataaagcccacttttcaaatggcatgttcttacagatcgtatagaggactgtcattctcatctcccaattggagcttgattgattactccttttccttatgttcattaatctcgtcaccttatcttttataccacttcattttagcagaaaggtaataataaaaccctcatccattatccttgtactcatctagtcaagcggaaatggttaataacatgctacaaattgaacttcaatcacttcattttctcctttgttgaatacacattaaaatatattccaaaagtgcaatctgttttacaggagaatttgtgttatattgctacagacaactaaaattaagtgtttctcagtttggttattaaatatatccaagtgctcttttaccaataatactaaaacattaactcattttattagggtataataatacaagagccttatctcttagaacacaaagacatctagactacctaatagtatgtgttatatgatagggtcatttatctttaaaaaaaaataccagtgataatttatgaattggtatattattacaaatgaaattgctatttttaaaagttaatttgtttacatgcaaccttatcttgaaatgcaagccctattagtgaaaaagtctataactgtcatataaaacagaaagagaagaatgggcatatacataaaatagactcaatgatttaagattttaaaagtataatcactgaaagaaattaaatttaatatgtaattagactagagttttcaaaagaaaaaagaaaaaatgacttctgaaattacaaaagatttttatgtacatcacaacaattgttgaactgatttctaatagtcttaaaaatactgagaggaaaaaaactatccttttgggaaaaaagaattttctactaatgtgggtaagtgtcttctatctatttataaatggacatgctcaccaactaactaaaaactagacctacagcaaatgttgaaaaacttaaccagataatcaaggcttattgtctattatctttctaccatcctgaaaaaaatgttcttctgaatctagataacaatgttagcaactgacaatatcaatatttgagcacccgaactctactacttaataaacccatctttttttgtttgtttgttttttaatttttttgagacagggtctcagtcacccaggctgcagggcagtggcaagatcactgctcatcacagcctcaacttcctgggctcaagcaatcctcccatcttagcctctcaggtaactagtcacatgtcaccacatctggctaattttttaattttttttaagagacagggtttcaccatattgcccaggctgttctctaactcctgagctcaagcaatctgtctccttgggctcccaaaggctgggattacagatgtgagccatcatgcccagccaaaacccatttttttttaattattgggaaagatacatatatatatctatttgcttacactgctgctgttgttgtttgaagggcatgtgtgtcagctatcaatttatcacctcttagttccatatttacccttcattatctgctctgaagtaatgaacctggatactttaagtatttctcctttgtagtagcatgacgttgttgagctttttcaacagacagccctggagggacgctgcaggatgaaagcagcttctttccccccattccagtgtgctcaactcatcgggcttccttccactcagacattagctaatgagtattaatactgagtgcctgaaatgatattttggcaagtttgcctgacctaagagtcatagagatcacagtggctgataagtcaatctccattccaccaccttctgttttatggcagaatgtgccataaaacaaccctacggccatcccatttggctcagtcatgaagatgctggattctatgatccacagacccacatcaagtatctctaccccagtccttgtcttttcctgttgttcaggatgaataccatatgtatttgccctgcctttctcagaagcaacaaaggatgaatgattaaaatgctgcttttaaaaagtgcattcctttttatccattaaattgtttcactataaaatatacacatagataatatataataattacaatgttatattttataagatcatttagtcaaggccttggtttttccagaatatagaacagtagtataccaaatgtatacattattgttcacatttaagactttttagttgtatacatatgtaactaacctgcacattgtgcacatgtaccctaaaacttgaagtataataataataataataataataataataataataattttttttaaaaaaacactttttagtacatcatccagtattcctaatatacaaagctaccctcctttttgcatgatttacacgttttgctttagtggaaagtttttaagatacttgtcatgttaggcatgaattacctgtcatagttacattatgttctccacaaataatccttcttttctgtaaactgtacaaaacaaaacaatattacaaaaacaatagcctaaacgtttttagatacttttttcctacaaaaagctgtaagaacatgctactaagtttatattacatatattacatagttccttttaaggagacaggaagaattaacatttaatattatttagcatgtgaaaattggaaaggaatcaatcaataagcctatgtatgcaacaatttttgtttcaccctctaaacattcttaaactatatcagatgccattgtctataaaaaatgaatttatcaatttaatgaggatttaggcagattagttgcttaatgagaactccagctaatgtgacagaggttttgtttcagtgctgacaaaatcagtgtgataaaactgtgattaaactgatgagagtacatttctttttaaaatcattatttcacataattaatgttaaacagcaatatataatcatttaaaaatattgtttataccttttatattttaatgtttttatatttagacataatagtttcaatattttacaatcctgagccttctcctcttacctttatctattgtgtattattttgttttgttttttagagatagtgtctttctctgctgcccaggctagaggggagtggtgcaagccttgctcactgaagcctcgaactctggggctcaagtgatactcccacctcagactcctaagtagccagaactacaggcccatgccactatgcttggctaatttttttctttattttttgtaaagatggggtctcactatgttgcctaggctggtccctaattcctggactcaagtggttctcccactttggcctcccaaagcactgggattacaggcacaagccatggcagtcaacctactattctgtttaattgtttcactcatttttcttgattttctctccttctttgttctctttctatatttacacaaatacataatatcaccatttaaataaatgcaaattacaattcacgcaagaacagtaattcccaatatattggctaaaagaaaactctattatcaaaagctttctccttagctgggtaatgctttggttcatagattagagaactatctaccttaaaacaaagactttttaaaattgaagatagaaaacatctgtaaacattctacattttcctatgttgtttcctaaataacctaaaaggtcaataagaaagagatattttgtactataaaatactttcgttcttaagacaagggtgctgtggcccatacatttgctagtattcctcttactgactctcagaggtggtgtagttaagaacagaacttcgacatgactaatgggggtcagcagatattacgtgtctcctcatatgttccaatatgaggcatacatcatcaactatagttcacctaaaaatatttaccttaatataaccaagcctttacatttaacttccagcttaaaggattacaaagtatcttttacaatataaataactactataagcaagtaaatagataagtgcagaggtaggacactctacagaacaaatgcactggtctcctcaacaagccagtgttatgagtaaagaattgctctgaaatgaaaaaaagacttaacagacagaacaaccagatacaatgaggattcccagattaaattccactttgggcaaaaaagttacaagggatatttttggagaaagaggacacatttaaatattgattaggtatgagataatattaaggactattattaataatttcattagataatattgttactttggtctttgtaggaaaacatattgttttaaagacatagaaaagtatttaggaatggactgttgggtaccaatttattttaaaacccttcagcatttcacttgtggtagtgactgaatttcaattgcggtcgattttggggcacaaaggtggcttctggtgctggtaacattctgtttcctattctagttgctggttttatcattctgtccactctgcaaaaagttagtgtgttgtacaattatgtgcagttttcagtatatgatgtatttccatgaacagtataaaacaaactaatcagcgttaaaaaatgtttacatgaattaattttaaaatgcaacagctctggattaaattgtttggttttcaattttggctctaagcctaatcaagaacacaatcccatttataatagacacacacacacataaacaaatgaggtgaaaggtctccacaaagagaacaacataacattgtgaaaagaaatcagagatcacacaaacaaatggaacaacattccgttctcatgaattggaggaattaatatcattaaaatggccatactacccaaagcaatttacacattcaacactatttctctcaaactaccaatgtcatttttcacagaattagaaataactattctaaaatcatatggaagcaaaaaagaggctgaatagccaaaacaatcctaagcaaaaagaacaaagctggaggtttcacattacctgacttcaaactatactataagactacaataaccaaaacagcatgatactggtacaaaaacagacacatagaccaatggaacagaatagacaattcagaaataaagctgcacacctacaacaaaagttttaaaaagttgacaaagataagcaatggcgaaaggactgcctatttaataaatagtgccggtataactgggtatccatacacaaaaaatgaaactggaccactgcctttcaaaatatacaaaaattaactcaagatagatgaaagatttcaaggtaagacctcaagctataaaaatcctaaaagaaaacctaggaagtaccattctggacattggccttggcaaagaacttacaaccaagtcctcaaaagcaattgcaacagcaatgtcaacaaaaaatgacaattgagatctaattaaaataaagagcttctgcacaccaaaagaaactatcaaccaagtaaacagacaacccatggaatgggagaaaatatttgcgaactatgcatctgacaaaggcctaatatccagaatctataggaaacttcattcaacaagcaaaacccaaagaaccccattaaaaagtgaacaaaggaccgggcacagtggcttacacctgtaatcccagcactttgggaggctaaggcaggtggatcacttgaggtcagcagttgctcaggaccagcctgaacaacatggtgagaccaccatctctactaaaaatacaaaaattagccaggcatggtggtgcacgcccgtagtcccagctatttgggaggctgaggcatgaaaattgcttgaacccaggagggggaggttgcagtgagccaagatcacaccactgcactgcagcctgggtgacagagcgagactctgtctcaaaaaaaaaagcgaacaaaagacattgaacagaagcttctcaaatgtgtccaatgtgcaaccaacaaatatattaaaaagtgctcaacatcactaatcatcagagaaattcaattcaaaaccacaatgagataccatctcacactagtcagaatggctattattaaaaaggcaaacaaataacaggtgctggtgaggctgcagacaaaagagaacttttatacactgttggtggaaatgtaaattcgttcagccactgtggaaagcagtttggagatttctcaaagaactgaaaacagaactaccatttgacccagcaatcccattgctggatatatactctaaagaaaataaatcattctaccaaaaagacacatgcactggtatgtttattgcagtactattcacaatagcaaagacaaggaatcaacctagatgcccagcaacagtggggttgataaaggaaatatggtacatatagatcatggaaaactgcacagccataacaaagaataaaatcatgtcctttgcagcaacgtgcatgcagctggaagccatcatcctgagtgaattaatgcaggaacagaaaaccaaataccacatgttctcattcataaatgggagttaaacactgggtacatatggacatacagatgggaacaagagagattagagactactaaaggggggagatggggaggggtaaaaggggtgaaaaactatctactggccaggcgcacacctgtaatccaatcccaacactttgggaggctgaggcagaatgattgcttgagcccaggctcagtgagccaagatcatgtcactgcactctagccggattacagagtgaggccctgtctcaaaaaaaaaaaaaaaacaaaaaactacctattgggtattatgctcactacctaggtgacaggatcattcctaccccaaacctcagtgttattcaatattcccatgtaacaaacctgcacatgtagcctctgaatctaaaagttaagggttttaaaaacctttaactttttttttttgttagacagagtctcattcttgtcacccaggctggagtgcagtggcatgatctcagttcactgcaacctctgcctcctgggttcaagcaattctcctgcttcaggctcccgagtagctgggactatgggcacgcaccaccatgcccggctaatttttgtatttttagtaaagatggggtttcatcatgttgttcaggatggtctcaatctcttgacgtcgtgatccgcccgctgcggcctcccaaagtgctgggattacaggcataagccacagtgcccagcagtttgtttaaattgaggctgtaccatgaactgggtaagttattaacagccctgcacctcaatttcttcatctgaaaaatgttagccataaaaaattttttaccccaatttctaaactaggctattctaaggtattttcttctttcacttgccattttttgtgtgtttatattactttccttattcagtccaaaatagatttccaatgccctatctctaaaagttggaaacattctgaaataaatctaaacaagagttttcaattgaaattaataccagtagtcttataaagtcgaaaggagattcacagtatcaacatagtcttaagcgcatcttaaacaatatatctgctctgaatagttacctggaagtggcagtgattgtatggcctcactagaatccaacgtaacatataccagaatattatacattaattgacctgaacactactcagtgtgctaagtgatctggagaacagtaactgagatacatatacatctagaagttcacaaagggaagtagaaaaggtgttgccgagaagactattcaagattactttgtcagtactgaaactgtatattttatcagaaataaaattctaggaatatcttttagagtatcagttcgttaaacatcagtaaaggaataaaaacatttatgtactcacaaatatcgtattaatatttgaaagttttttaatgtttagtattttattttttaatttttatgtatttatgtcatttgaagtatactgaatagcttttaaattaaatcatagctaacttactttccgttatatgtcttgctacttaataaagaatatcacaaaatacctaggttttacggacattttaataatataaactgaccattatttttgcattctcgaaaacagaccataatactcttaggtagtatgctgaacatttgggatgggtttttatgggtgttgttgttgttgttgggagacggagtctcactctgtcacccaggctgaagtgcagtggcgcgatctcggctcactgcagcctcctaggttcaagcgattcaagtagctggctacagatgtgcgtcaccacacccggctaatttttgtatttttagcagagacggggtttcaccatgttggccaggctggtcttgaactcctgacctcatgtgatccgcctgcctcagcctctcaaagtgctgggtatacaggcatgagccaccagcgcccagccaacattttgaaaaacaataaaaatgaagattttaaggcatgctattgttttacaaaatagcctggcttaattttgtagttgtaaagtaactcaacaaaaagcaattgtaagaatgtttataatacattccttaataacaatagcaacttatactttcttaaaagtgtttttcctttataactttcaaaatgttactattacacaactcagtgatatacatgtgtcatataagttggtgcaattatctagcagaaatacagccacagaagctaagaagggccctgtgtcagcaaaatcaactttaaagaacatcttgcttagaaactagagagcataaactcaaaatttaaagctatttttgttgctgtaaatttttaaccatatagatgcaccattaaacagcaaaacttttctgattttcaggatgaattttataatgctaatatagagcagcggaaatcataaccattactgtcctcaaaaaatggtggctttatcagttctaggaaaatttacatatgagtaacagaaaacctaactaaaaaatgttgtaggcagcttagattcctttcttctcaaataacaaaggtaaacgaaagttagccagttactggatttagtcagttcaatggctcaaatagtataaaggctcggggttctattattttcttggcttgttccacgtattatgtttaagttccagggaggaagaagggaaaggagaaggataaagaccaaagagcatgactgagctgagtcagctccacctataaaaaggtttcccagaactccaacccagcttctacttatctcttgctggcaaaaaatatacctaatgatcagtcctagcttcaaggaaagctggaaaaactgggacaggagaaggaggttaagctggaacattggttcctttcaaaattcacagtcctatcagttttcttaaaatatatttctgaaactactgccatccaaactacttcatatataacagttcttaagaacatgccaaatatagacatttctcctctttgaaaaaacacctaaggaaggaaaatattaaaaaatagaataaatgattttttaaaaggtatcaatttcagaagtttaaatacatttttatagtgtctagtaccgttttatgctattttaatgattcaactatatactatctacagaagactcactttataattcatttatttttagagacagggtcttgctctgtcattcaggctggagtgcagtggatgcttccttgaacctcatagctcgctgcagccttgaactcctgggctcaagtgatcatcctgcctcaggcagcaataggtgcacactatcacacctggctaatttaaaaaaaatttttttttgtagaggcagtgtctcggtatgttgcccaacctggtcttgagctggtctcaagcaatccacctgcctcgggagactccatttagatttaaagacagaaataccttgaaagtaaataaatggaaaaatacttacaatatttactgcatatattgcatactaatatgtaaaattaagcaataaagcatatgttatgtctgaatcatgcattgcattttagaatagtattttaaaatttatagtacttattaaccagctttttacttttgaaatcaatctcaaacaaaaatgggttcattgcctcacaagtgtctctaaaccttgctcctcccctatcctctggtttcctgcaggcaggcagtataaccaatgggtaagagcatgaattctggaattggactacctgggttcaaaactagctctagcaatgctgggcaaactaattaatttctcttagctcattcagctataaaacagaaataataattgtaagaattaaatgagttaatgtatataaaacttacagcatatcacacattaaaagtgtcatttcttgttattgttatgaccttttccttcatttgtgatacatgtattaagcacttaccatataccagacattgtgctaaatattagaaatttgggtatttgggttatgaccaaatcagacataaactctgtcttgcacatatcaaaaatattaaacatgattttaccacctttttattactataaaaagtgaatactgaatttgttttctgcagctaacgagaagaaatcaataaaggaaagttaatataaacacaaagcaatgaaaatatttataaggcattgatgatgctagccagttcctgcttcctgtaacacctagctatgaatgttcttaaaagacaaatccagaatcgaaaaacaaactcaatgatttaaaatcacccaatcttcagaatttctattccatataattatgaatctgataatgacacatccataatcatacaaaaaaattttaaggtttcatagcaaacttcaagaaaattttagatagtctggtggtactaaaaaattagaccaaaataattttataatgaggcttaacattaaaatacaaaaatgcaaataaattgccatctttattaccaaaaacataagtgtcccaaaattcaccagtcccccacaaaaaactagaacacatatttattaactcaaggggctttgctaattatgtaaatgtctatcttttctacatgtaatttcattcaaacttcctctctttcccccaattaacgatcctgccaaatgttgggacttgaaaaggccacagctttatacacaattaacagtcaaattctaacacaaattacatgtcattcttatctctgtatacacattgaactcctatatcttgttgccaagagggagcttgcactagggaatacatcctgaatttgtttaatgtccaggaataacatttcacacttagaaaggagatactatccactgccagctatgtgaactgaaatttgccatgtcctatccttttcattttgttcaaataggtagtttagaaaatgagtaactatccacttatctgttttaaccaaatattttcttgacgcagaagaggcaatcatgatctttggttttctttagacactttttaggatgattacagaaacttttatgaatggtaaacttattttctgaatagaaattggggaactatcatttgacacataatctcactaccagaaaaaatatttgcaattggatcaatcccagaaaattagatttacatatatggtcattatatttatgattgcttcccgagaaaaggtttcaacagcagcaacactagaaataaccaatttcttattcagtaagtatatgagacaatcatcacatcaaaatagtcagacatgtcccaatcttttgaagtatagcattttattaccaaagtacctcaacaaataccagtcatttacatactaaaagggcaactaaaatatattttatatatattaatatgtacatgttatgacctaaagttatgaaagcttgtaaaacacagcacttttagaatacaaacatccccaaattaaacttttaaagaaacaaatctgattgggtttagttactagcttactgctcttcagtagtctccactgtccttagaatagtatcaactggcatttgtctacctgtccagctttgcctcctacaatctgcttactaaaccctcagctccaaacataattcttcctttctttttttttttttctttcaagacagagtctcaatctgttgcccagactggagtgcagtggtacgatctcggctcactgcaacctcctcctcctgggttccagtgattctcatgcctcagtctcctgagtagctgagattacaggtgcatgccaccatgcccagctaatttttgtatttttagtagtgacggagttttgccatgttggccaggctggtctcaaacccctgacctccagtgatacacccaccttggcctcccataccataattctttctattcctccatctcaacaaactatctctttaaactgacatttaccctaagcctggaatacaataaccgctcatctttcagttcacacttcaaatgtcgtttcctcaatgaagccttcctttaattcccttctcctatccctgacccccaaatagattcagtgcccagatatacatttccatgctactccacacttccttgccacagcaatttctacagtatattgaagcttgttgttcaccccctgttggcatgtaagctctgtaacattaagaaaaaccatgtttgtcttgctcactattgaattcccaaggtctaaacatatgggcctgaccctcacaccctcatttgatttctaaaattgggcttacatatatcaaattaaggcagggctcatatgcattgcaacattcagttaaaatactctcttccatcgttataaattccttcatatgaatataaaatgttctgataaccaaaacaaacaagaaaaagtgaaaaaattgcaatttgtttctacactgccttcagtttcatgtggtgaatctggagtcagaaccctagatttgacttcagattgtatcgcctgttacctatatgatgatgtgaagtgcttaacatcacaaagcctcatattcctcttctgtaaaatagaaaatattaatgcttgtcccacaaaccttaaagagctgggatctattaataaaattatgctcatgaaagcctttaaaaacgatgaagcatttcataataaaatgaattaacatctttgttattaataccataatcaaggtaatctcagttaaaaataatgcatacaaattatttcagaaaaactttggcatatatatgagctagaatgtactagttaaaataaatacaaaagtttaacctcaaaagaagattacaaatcaattgtaaaatacattccaatattctaagatattgttgctacaatctcagaaaattttactcctgaaatttcatatccttcgtgatatctgaaacctatcagttaaattcattattaattcttttattttacttattgcactttagaatcccatccagggaatctgttattattctgagaccacaatcataattctttttaaaataaaaatgtgaacattaagcttaaaaaaaataattcgcaacttaactctgtggtaaacaggtgaacaaaacaacaattatataatatctaaaaccattttatgctttaaaaataggtttatatgtactgaatactggctaagataggaaatatttgatttcaaatttgttaagaatttaaagacataaaaagttagattagaagttatcttaaaacaacaataaggtagtcattaaaaacatgatcaaacaagaaaacaatttcttttaactcatgctaggaaagttattcaatattctattacttattagagtaaaaataatcttggtctttgatttttgagtgttaaaaaaccaaacttttccaaaattcaacttctgatgcaacagctaattcagaaaagaaaaagtttttttttttctttttcctatccatttgggctacatgattctaaaattacaggtatagtcacaaagagcatatgcttcccccaaagctctgaaggcatgtaagaaactactgtagttaaagcttgaacaagcaagtcttttttaatccacatttttcatatagaagaaagatttgtgtattttgcaaaagtaatgctattgcgatattacgactttgaactaaagctctaaaatcatactattcaactaaaggtttctttagcaatattaacatggccacgctgcacatgttacttttagcttctttgtgtacaacaaactgcattcaattggtgaacaaatacaatgtttagtatcatatttaaaaccactattcaaaccttttcttaatgctgttatcagttttccttttgcaacaattttgtgtataaaaataaaagcactggatttttattagcgctgccccttctttgttttgctccactctgcaaagcccttttgggacactaagcctgcatttaccataatacggattaaactttctttgtcccattgcacaaggtttgttagcaggttagtctttttacacttttcacaggctgcctgcagcttaccctttaggcctcactcaaaatacttctgtggatttacaaaaataccagagtggtcttggggttaattggaagataagtgcagtctttaacatagagactcattaaacatttagccttaccacaatccactatccttgaaagagaaaagttctagagacactttaggaataataacacagtaaaattgttttaaaaaatgacgattagttgtttcacagacttggaaaaacttcatttaactaccccaaaggtgatatagtagaacaaagcaatgtccctggtcagctctctacattggttttaatatgcattgatcatagaggaaaattgaacagattttctaaggaactaaaaggcaaaatcttccaaccttctgttgggaaatttaaagtaaaaactcaactgatgggttatgacagataatatttatttgtaaacaaaacatatttaattctaacagtttaactttgttgatttaaattttacccaagtaaatcacatcaaacatgtctattagagccaaatgaaaaatttataaaattcacccaaaaaacttagaaagtatttaaaaatttaagttccttctttaatttctaaaatacatacatatacacaaatatacacacttaaaatgaaatctgaaacctactcattggtattaggttattttttagaattatgcaagcagattgttaaacagattaacttttccatccccttacctccttccaacactattactcccacacaaaaaggaaaaaagaaaaagaaaaatgcgacaaaacacacagacacttgaagtaaaggattagacatatttgcccaagatgcagataacaaaagcaaaagtgaagaaaattgaagagacagccaaacttcagcaacaaaatggttaaagaatctgaagtattgttcccgttattcttaaagtctgctatattgtagacagcgcaaacatcagacaagttaagattactgaccattatctccttaattttctccgctttccctcacattccctcttgctatctgggcaccatttttctaaagctttatttctggtaagaagtaaactttccctaatccatctattatggaacctttaattggattgggagcagggtggtgtataaaatagcccctattcactcaaaaggactgtagttttagagacttaaaggagaaaggtattgtgaaacaaaatcctcagggaatcaaggattaaaatgtggctctcctaaattcatcaactccaggacacaaatgaattgcttccttaaacaggtaactttccaaatacatggcatagcaaaactgaaattaaaattataattttactttaaggaaaataatgcatttacactaataatttttcgctttataaatgacttttacttgctgtttcttcaactcagaattacaatgccagggaacaaatggaatgccttaaacatatttatttatattttctctacatacatattttccctgtaaagtaaggagaaaagcaaaagaatatgctttaatcaattaagtcctgtacgttatatttgtgcagccttaaagcagcaagcactgccataatacaaacatttttttcaaagtaaaaatacatttcgttcttatcagatagtgtcagatacataataatcagcagtcactcttcttccctcaatcagttatcctctctgttttcttcataaacatccccaaaccactctttgttaggctgtagtacttttgtcttctgtcccgccacagtgcacacccaactatttgggatgtcttcaacagtaagatgaggatacagctcatactcagttattctcttactgaattaaatatatttaaagtgccaaacctgctatctaaagtaaaatgaaatccagaatgtatctaccaactctaaattaatctcgcaaatgtctacatactctaccaaaacaataggaaactgaggaagagaaatgttaggagagttcaagattctaatgtaacacttaactctgcatagtttactagtctatattaaaatataaaaatacatcaatattagttatttacctaatggtgctgttaaaaacagatttaaaaaaaaatttaagaaatgcaattaattttaagaaaaccctcaaagtatcccctctgttttggaacctgtatcacaactcaataagtgctacttattattgattgaacccttactaattgtctgacattgtgctaactgctattacatgaattatctcattttattctctcaacaattgtatgaggtagttgctattacctgtttttccacaaatgaggaagctaagtttttaaaatttcaattaaattgtccaaggttacatagctgcaaagaaaataagctctgtgaaagcttttcattactatattataaatgtttagtataagaaagcaggctcatttgccaaagtcaatctgccaaaaaataaatgtgcctaaattatcaaaatcacctatgttccaaccgtaaatatttaaagaatattcttcttgaatgtattaaatctataactatattcttctaatgaatatattctaagatatatttaatactttttaagcaacattttaagaaccactgtttttcaaaactaaagtcatcatagggtagctctgtcctattaccaatataactaaaattttaatgtttcatatgacattttttagttcgtactgatttctatttgtatattttttctatttttctaacattctgtcatgtagaataattgttgctttattttattttattttattttatttttttatttttttttagatggagtctcgctctgttgcctatgctgcagtgcagtggcactatctcggctcactgcaagctccgcctcccgggttcacaccattctcctgcctcagcctcccgagtagctgggactacaggtgcccgtcaccacgcccggctaattttttgtatttttagtagagacagggtttcaccgtgttagccaggatggtctcgaactcctgacctcatgatctgcccgcctcggcctcccaaaatgctgggattacaggcatgagccactgcacccagcctcatttgtcacttttacctatttataaagtattatatcagttgagaattattttaatacttttcaaagtgtatgaagtcttatttgaacagttttcatcttgttttcataacaaccttggagggaacctccatttgtctgtcccaaatcactacagttgaagctgaagaaagcttttttagaggaaagatggaaaagaaagcaaatattccagggagagattctgattcctgaaagtattaggaatgagtatcagggttgagtactaaatggcactatcagagaaagaagatgagggaactacgaatcctggccataggtttcatagtctcttaggccacacctcttaggctcttttaacccatacaacacatagtgtgtaaataaaaaaatacaaactagtttagggtaattttaatatagcagagaattcattttctgtaaatttagctcattagttttagcaaattcctagcacaatggcatgcatatttagtagggcattaaaaatatgtgtggaatggatatattaaaattttatgtaaagtaaaactttaaacactgtattttgatttcaaaaataatctttaattggtcagttaaagtattttaaataaatatatttttaaagataacatgaacatgcatgctccactttaggggtagctaaaacaacaccccaaaacaacctcatactaaaggattattgaattttacatttaaaaaagagcaactatagggaaagaaccaaaaatggatctaggaaaattacaaaatacagcaagtatcttaaaaatgatttaattattaaagcatatttagaatacaaatgagtatttactattttgagagcccattaaaattaagatacccaactattctttttctctgatgccattttactaatagctaagtgtgtatataaatatctcagtcactggtatgtaaatgtcataataaagtgtaatgtatttcatcacattctatctgcacttatgcttccttatgacttcagctaagtttctacacacagtggtttagttttaaatggttgtccccaaaatatgatgagttagaaattatcttgcatttgtgtgctcattcataataaatcactgtttttaggcctcaaataacatcaggtctctatttgctgcttagtaagaggcaactaacatttcacggaaaatagttctttaactaaaagattatatcagggcttcctcatataagattactcaaattttgtataacattggatctctgttgtgttataaaatatttggtacaaaacaaactgctatggtttgaccatatcccccaaagttcatgtgttggaaactgaatccccattttaacagtgttgagaggtggggcctttgggagtgactgggttatgagggctctgccttcataaatggattaatgtgattattgctagggagtgttaattatcacaagagtgagttcctcataaaagaatggagcttagacccctcttgctctctctgtctcacatgctcacttggtcttctgccctgggatgactctcaccaggtactggcaccatgctcttagatttcctgcctccaaaagcatgagccaaataaattctattctttataaattactagtctctggtattctgtaatagcagcagagaatggattaaaaaactaatgaaatgaatatgtaaattagcatataaatatatcaacttgtgtatggataaacatattcaacgacagctacataaaaaagactaaaaagcaggagtggtggctcacacctgtaatcttagcattttgggaggctgaggtaggtagatcacttgagcccaagagtctgagaccagcctgggcaacatagtgaaatcctgtctctacaaaaaacacaaaaattagccaggagtggtggaacatgcctgtagtcccagctactcaggggaggatcactaaaaccagagaggtcaaggctgcagtaagccatgatcatgtcactgcactccagcctgggtgacagagcaagaccctgtctcaaaaaataaaaaaaaaagcaaaaagcttaggaatacaccctgattgaaatatatgatactcataagttatacatgagagagccattttaaaccactaatgaaaatgactgttaagtcccatagaaaagtctattaaaatatatgtatgtgtatatatattttttacacacacacggatatacatataatttcttacatcatacttaccctttagaatagcagtcctcaatcattttggcaccagaaactgatttcgtggaagacaatttttccacagaccaaagtggggtggggggtaggaggtatgattttaggatgaaactcttccgactcagatcgtctgacattagagtctcataaggagcacgcaacctagttccctcatatgcacagtacacaataaggttcgcacccctatgaaaatctaatgccacagctgatctgacaggaggcagagctcaggtggtaatactccctcacctggcactcctctcctgctatgtggcccagttcctgacagggaaactgggtagggaacccctgccttagaagacagaatacaaaaatacagtttatgccaagatccaaaaaatagtcaagtcagaaagttaagaatattatacttttcataccaataaccatatcctgtacaattctcctgtacaggagtgtatcttgtacaatttctcaaaagaagacatttatgcagccaaaagacacatgaaaaaatgctcaccatcactggccatcagggaaatgcaaatcaaaaccacaatgagataccatctcacaccagttagaatggcaatcattaaaaagtcaggaaacaacaggtgttggagaggatgtggagaaacaggaacacttttacactgttggtgggagtgtgaactagttcaaccactgtggaagacagggtggtgattcctcaaggatctagaactagaaataccatttgacccagccatcccattactgggtatataaccaaaggattataaatcatgctgatataaagacacatgcacacgtatgtttactgcggcactactcacaatagtaaagacttggaaccaacccaaatgtccatcaatgatagactggattaaaaaaatgtggcagctgggcatggtggctcaagcctgtaatcccagcactttgggaggctgaggcgggcagatcacgaggtcaggagatcgagaccatcctggatagcacggtgaaaccccgtctctactaaaaatacaaaaaaatagcctggcatggtggcaggcgcctgtagtctcagctacttgggaggctgaggcaggagaatggcatgaacccgggaaacggagcttgcagtgagccgagatcatgccactgcactccagcctgggcgacagagcgaggctctgtctcaaaaaaaaaaagaaaaaaagaaaaaaaagaaaatgtggcacatatacactatggaatattatgcagtcataaaaaaggatgagttcatgtcatttgtagggacatggatgaagctggaaaccatcattctcagcaaactatcgcaaggacagaaaaccaaacactgcatgttctcactcataggtgggaattgaacaatgagaacacttggacacagggaggggaacatcacacaccagggcctgtcgtggggtggggggaagggagagggatagcattaggagatatacctaatgtaaatgacgagttactgggtgcagcacaccaacatggcacatgtgtacatatgtaacaaacctgcatgttgtgcacatgtaccctagaacttaaagtacaaaaagaaaaaaaaaataacactccctcacctggcactcctctcctgctgtgcagcccagttcctaacagggaaactgggttgggaacccttgccttagaagacagaatacaaaaatacaatttatgccaagatccaaaaaattgtcaagtcagaaagttaagaatatcatacttttcataccaataaccatatcctgtacaattacacacagacagatggggggtagaaggagtcaaatcccacttctgacaccagattgtgtcaacctaaaaatagacactagagaaatttgtctccaaatatgttgagtttgtttgggaatgacaaatgaggattatgacatagaatggcaagccaccggtgcatctggtgagagaagggtaaagggaagcttttattagcccaaagagattcaagtaaactacttagaaacagagttcactggttccagaggcttaaagtcagagttatcatcagttcattggtgaagctgctattactggtcaagggttcatttaagagcatcttctctgaattgctatagttctaaaggatgtctagtgataaaccttgccaaaactagtgagaaaccttgctaaagcaggagatacatgcaggacatgaaggagtttcttgtgggatttctagaaagtccttggaaatcattcttatctcagatatataagcaagagcctcctctcctttctgccttcctgtaccaattttgccagggtctgacaaaattgatttcatccccatatctgtaactttcacaggggaaagaggggtaagatagttaaattaaacagagtccctcaaaaatcacccttcctttcttccccttaatttcaaagagccaatttactttacatgttggatactgcgctggagcaagaaggtaaaaccaggaagtaggatcagagagacaagagttactaagccaggacagaaatcagaaaccaaaatgtaataatctgctagagaattaggccataaggaatatctgttattttgcttattatctgtaagaagaaataaaattatagcacagtgatgaaagcacagtgaagagaaaccctaaaatgtttttagtaaaagaatgataaatgaaaattgacaataaagaatcaatcacaactaaagtatagaaagatgctaatatttctttattttacaagcttcatcaatatatattagtaaatataataataatcaaaagggcttttatagactcctttctgacctcatttctgcttactttttccaaaataatcttaaattcttcaacaaaacattctattaccaaggaggcttttcaggaatgttatctttagtataaggtattactaatccttcttaatgatgttctatgccacttataaaaaactcattaggatggcaaacaaaacagccttttgttacattaaactcagtgtttaaggaaaatagttacatattcattcattcaaaaaataagtattttttggaaagcctagagatacagaaatcaacaacaaaaagctgggggaaggaaggatacgatagttgtaagggttagataactactataaatctgtttcaatatgtacctttagcagtaatatttatagaaaataagattcaaaggcccttaaaatatctagggttactctttaaacaaggggaggaaggaatctgaaaacaggtgactccaatatcaattctttccatcaactctaggtcttgtggtgaacacttcagttgtttaattgtataaagaaatgctatcacccacacacatataatactacaatgctactacctatcctcaaattgtatattctactatttacttaaaacacagtagaccttaagactattctgttcaacccataacaattcaaatctacaatcaagttttagtaaagacagcatacttgcagctaatctatattcataaacgacactactatgctagctcatcaagtataaagaattaaaaacaattatatcttacaatacaaacagaattggctgggtgcacgcctgtaatcccagcactttgggaggccaaggtgggcggatcacaaggtcaagagatcgagaccatcctggccaacatggtgaaacgccatctctactaaaaatacaaaaaaattagctgggcatggtggcgcacgcctgtagtctcagctacttgggaggctaaggcaggagaatcacttgaacccagcaggcagagcttgcagtgagccaagatcgcaccactgcactccagcctgggtaacagagtgagactctgtcttataaaaacacacacacacacacacacacacacacacaaacaaatagaatctaaaaatattctctttttttgagacagggtcttcctttgtcacccaggctggtgtgcagtggtgcaatcgcggctcactgcagccttaatctcctgggtccagccaatcctcccaagtcagtagcccaagtagctacacagcaggagcacaccactatgcctggttaattctgttcattttttatagagatgagatactgttatgttgtctgggatggtcactaattcttgggttcaagagatcctcatgcctcaatctcccaaagtgctgggactacaggtatgagccactgtgctcagcctagaatctaaaaatattctagcaaaatatataaaaaataaataaaataaaaattttatgggacctgaaaaatgaatatggagaagccaaataaacatgctctccaatagcttttaatacagttaacacttatttttatacatttgttctaaatattcaaaaaactaaatttaaaaactatctgatggatggtaatcaaaaacatttttgtttgaaaacaaatcatattttaaacagcaactatgtttgaagtttaatatattcaaacatttgattatatggttaatgtctaaagctctacgaggaaccaaatcagagctattcttacttattgctgtaatctcagcatcctacatagttggcatactggcagataatcaaaagtgtttgtgaaatgaataattatatacatagttacacagaatgtgaataccttattagcctatttacttatttattttagtgccataactccaatctctttacttaaaagctcattgattgcttctgcattaaatgtgaaccttctaacattacaattttccctatgaaataagcataatattacttataaattatacaaatactgtgaaaatgcagattgacatattatatagtttggattttgaaaagacatctttatgcatgcacaaatgcaatttgtcattaaatttacaaatgttgtggtgtataaattggatacttcttcctaaatgtcttgcaatgttttaatatcaatgtgacagcaaaatctgcaatcaaaacaaggcctacaaggaaaatgcaacctttttaaaaatatgtagctgaataacaagatgtcgcaaaaatagggctgccacaattaccaaagaaagataattaaaaggacgtttgttatgtgctgtgtttcacccggtacccacatcttggtttctaatagcattcttcactgaaaagaattaaggctctccaaagtaatagctgattctagagctgcagaagggaagctacaagatgagccttgagcctcttgccatgtcagaaagtcagaaagtgctcaagaaaatgaaggggtaagtaaaaaaaacataagaacaagcttgaaaggcttcccactggcccaatctggaagaatttgagcattaaagtaattatgaccaccagtgaattattaaccattgaaaataagaaaaattcatgagtccatagcaataatagatggataaatacatggggaatgcagaagtgtataaagttaaggcataatgtcaactgataaagatggaagaagacgcgatatgggaaaataatcattttataaccatcatcactgtagagattaatacagggaagaactgttaagcggactccatatttcattcagatttcatcagtttttctctcaagcttttttttttttttcttgtcccaagatcccatccaagacaccacattatatttagtcttgatgtctccttaggcttctctggattttaatggtttttaagacttttcgtggttttgatgacctttgacagctttaaagagtactgaccagggcatttgtagaattcccctcaatttggatttgtctgatgttctcatggttagaatggggttacaggttttaggaaggaagtccacagaggtatagtgccatccgcatcacatcatatcatatcatagctacatgctatcaacgtgttttgtcactgatattagccttaattacctggttgaagtagcatttctcaggggtttccactgtatagttattttagttatttcctgctgctctgttccatactgtaccctttgtttttttgtttgttttgagacagtctcactctgtcacccaggctggagtgtagtggcgcaatcttggctcactgcaacctccacctcccaggttcaagtgattctcatgtctcagcaccctgagtagctggaattacaggcacataccaccataaccagctaatttttgttatttttagtagagatgggtttttgccacattggccaggctggtctccaactcctaacctcaaatgatccacctgccttggcctcccaaagtgctagaattacagacatgagccacagcgcccggccccatattgcactctttggaagcaagccactaagcagagcccacacttagcaggtggggagtaatggtccatttcttttggggggagtatctacataaattatttagactccttctataagggagatttaactcttctctcccctactaatttatttagctatttatttcagtatggactcctatttacttcatactttaggttataaaccaaaactaagttatttattttgttgttcaaattattttgactttgactattgagagctctttcatttggctcttgtgtccctttgacctaatcccattattctattcttcggacacttatgtatgttctggcactataatatgctccaggctcatcttgtgtagtgttggcctcagcaacagattcaaccatttctctggggagtcctgggttccttttattggagcatggtattagaaactaagacctgggcattgagtattctcattgctactggagtgtcattacttctagacaccctggtgaacaaagctaataaatgtatgcatatataccaatccatgtatacacacctattctttatttttctatgtatccatttgtatttatattaagctaaatatgatttaagactctgactctaatctagtaccacatgatttattctagccttcagggaggcaattttgatgagaagcaggatattcgcatggtatcattaaaggctgcttaataattacaaaggaaaaaataatacatagactagcaatatcagacaacatactgactggctgatcaaaatatcaccattgaagggcaggtagacatcctgtgcctctgtaagtgaaactctcagacagacatatcacttacatagtataacaactagacgtataacctgaatccaatcataaggaaacatcgcacaaatccaaatgaagactattctgttaaaaaaaggagagaactacattcttcaaaattggcaatgtcaagaaagacaaagatagcctgaagaattgtttcagatttagtcagactaaagaaatatctaattctaaactagattatctactagaagttaaaaatattggcagggcatggtggctcatgcctgtaatcccagcacgttgggaggccaaggcgggtggatcatgaggtcaagagattgagaccatcctggccaacatggtgaaaccccgtctctactaaaaatacaaaaattagctgggtgtggtggtgcatgctggtagtcccagctactcaggaggttgaggcaggagaatcgcttgaacccgggaggtggaggttgcagtgagactccatctcaaaaaaatatatatacattatatataagataaatatatatatttatataaatatataaatatataaatatttataatatataatgtatatttatatattgtattattttataatatatatttatataatataatatataattataatatatatattatataatatattatattatatattatatattatataatattatagattatataatatataatataatatataatatatataacattatagattatatatattatattatattatatataattataatatgttatatataataatatataataatataaaatataatatatataataatatataattatatataatatataattatatataattatatataattatatataattatatataatatataaatataaatatatatatatctatataaatatatatataaatatatatatttatataaaataagggacattatttcgtccatcgatgaaactcaagtatggatggcaggttaaagtattatctcaaagcaaatttcataaatttgattactattatagttatataaataagataacattcttattcttaggaaatacacactgaagtattcagggggaaaggagtataatgtgtacaaatggctcagaaaaaaagtggtgtgtgtattatatacacttgtatgtatgtgtgggtgtatttactaataacatacattatgtatgtatagagagagacaatgtcagagagagcacgaatgataaatgaggctaaatattaatggcaggtaaatctgtttttaaaaaacatgtgatccttgtttcttatataataaatgtgataagcatgtgatgagactgagccaacattagtgaaatatgggctttaaaatgttttccagaagcagttattctatcctgtgatgtcctctgtgaccaaaaactaaatgaaggatgtctttggaagactctaaagctaactggacaatttggaaactgacctctaactatactttgattaataccactggcgaatcattcatagggtatatacaaatacaaatttggcctcttgtttaaagggtttctgtagttcaatcattatgaactcctaactgatacttagtagaacagcatataggtccatatttataattcaaatcattggcaattaaaagcgttactatcggccgggcacagtggctcatgcctgtaatctcagcactttgagaggccgaggcgggcagatcacctgaagttgggagttcaagaccaggctgaccaacatggagaaaccccgtctctactaaaaatacaaaattagtcgggcatggtggcacatgtctgtaatcccagccactcggcaggctgaggcaggagaatcacttgaacccagaagtggaggttgcggtgagccaagatcacaccattgcactccagcctgggcaacaagagcgaaactccatctcaaaaaaaagaaaaaggttactatcagtaaatgctagctgaaactacagtaacaatttataaacagtaattctctactaaaatttaccaaaacataattctttctgagaacattattgtcacaagttttattacatgcttatattataaacctaccaataatatatttattaatatgataaatactaatttaaatctgttcttaatatgacaaaactgtgttattctaaaatccatgaagatgagctattccaaatgagaactttttctaaataactgaagggctagtaacactgtattccttctaaaccacaaaggtatagtgtggtatgcagaatgatgctccctcccaaagatgtccacattctattccctggaattcatgaatatgttattaataccataaaaggcaaagaggaattacagttgcaaatggaataaggttgctaatcagctaacattataacagagagattaacctggattatctgggtgagtccagtgtaattacaagagtaccttaaagtacaagagggtggcagattaagtcagagtgatgcaatataagcactcaatctgtccttactgactttgctgaattaaggaaggaagccacaagccaaggaccatggaaaacatctagaagttggaaaaggtaaggaaacgaattctcccctagacgctctagaagagaatgcagtcctgccaacaccttgattttacttctgtgaggcctgcataaagccattacttttgtggaaatttgttatagcagcaacagaaaattaatatatattctattttcttttctcttacaaaaagtgtaataaatataatttgatcttaaaacttcctgtagcaaatcattgcaggaatcaattcctgtactaaacaacaccctaccaatccctacctccaagcatatatagattcccacatctatgctttagaatataatatagttttcatgtaatcttttgataacagagatgttctatctattatctattactacccttcatctactgtgaatggctgtgctctctctaccctcagcaccactgactaccctagatgtccactattctctttcccccttagcctctccttcaattattttatatttgctcacacagtatctcctgagcttcttggctctagcagaagactgtccttaaatacatgaggctattcaatgccttttacccttgtctacaaatctaccaatcaacatataatattctgtgcacctcagctctttccattgttgctgagtattcaccggttgctttccagggatatttctccctctatttgcaataagcattaaatttttctttagaaggatatacatacatacatatatattcagcctatctgcaaaatgtaatgggacagcagcaggaataatgatagcgtagttacaagtatactctcattgctatgggcaactatgataatggcaatgtaagtacatattcattttctctatacataggcatcctcccacaccctgctatgtatgtatgttctcagtaaatgtttagaggacagaggagaaagtaaggtcttaacctcctggtatgcaaattataggaagaagagagaactaagcaaacaaacttaagttacataaagtaacagaagaaataatacatatttaatccataatatattttctaaaaatttatctgcattcaagacattaaaggccttcaaatatttaaatagtagaaacattacactgagagttattagacgacaaaattatgtcttactcattttcatttctctcatgcccacaattaagtttgctttgaaataattttttttttaataggggtcttgctctgttgaccaggctggaatgcagtgggatgatcatagctcactgcagccttgaactcctgggctccagcaatcctcttatctcagcctctcaagtagctgggactacaggcacacactaccacacccagctaatttttaaaatattttgtagaaatggagtcttactgcattacccagactgggttactcagggctcaagtgattataccaactcagcctctaaaagtgctgggattacagaaataagccaccacacctggttgaaataattttttttaaccttatgacaaatttgtatatgagcctaggtacacagacccttgcaatctaacaataagacttactagtattagcatcacataatcacaaggctgaaatattatagtgttagactctctttaaaatctatgtttttacacaaatcaataaatgtaatctatcacataaaaagaaccaatgacaaaaactatatgattatctcaatagatgaagaaaaggccttcgataaaattcaaacatcccttcatgttaaaaactctcaataaactaggtattgatggaacatctcaaaataataaaagctattcatgacaaacccatagccaatatcatactgaatggacaaaagctggaagcattccctttgagtggccctctctcaccacttctattcgacatagtattcaaagttctggccagggcaatcaggcaagagaaagaaataaagcgtattcgaataggaagagagaaagtcaaattgtctctgtttgcagacgacatgattgtatatgtagaaaaccccatcatatcagcccaaaaactccttaagctgataaccaacttcagcaaagtctcaggatacgaaatcaatgtgcaaaaatcacaagaattcctatataccaataacagacaaacagagagccaaatcatgagagaactcccattcacaattgcaacaaagagaataaaatacctaggaagccaactcacaagggatgtgaagaacctcctcaaggagaagtacaaatcactgttcagtgaaataaaggaggacacaaacaaatggaagaacattccatgctcatggataggaagaatcaatatcgtgaaaatggtcatactgcccaaggtagtttatagattcaatgccatccccatcaagctaccaatgactttcttcacagagttagaaaaaaagtactttaaagttcatatggaaccaaaaaagagcccatatagccaagacaatcctaagcaaaaagaacaaagctggaggcatcatgctacctgacttcaaactatactaaaaggctaccgtaaccaaaacagcatggtactggtaccaaaacagatatataagaccaatggaacagaacagaggcctcagaaataacaccgcacatctacaaccatctcatctttgacaaacctgacaaaaacaagaaatggggaaaggattccctatttaataaatggtgctgggaaaactggctagccataagtagaaagctgaaactggatcccttccttatccctcatacaaaaattaattcaagatggattaaagatgtaaatgttagacctaaaaccataaaaaccctagaagaaaacctaggcaataccattcaggacacaggcatgggcaaggacttcatgactaaaacaccaaaagcaatgacaacaaagccaaaatagacaaatgggatctaattaaactaaagagcttctgcacagcaaaagaaactaccatcagagtgaacaggcaacctacagaatgggggaaaatgtttgcaatctacccatctaacaaagggctaatatccagaatctacaaagaacttaaacaaatttacgagaaaaaaacaaccccatcaaaaagtgggcaaaggatatgaacagacacttctcaaaagaagatatgtatgtggctaacaaacatatgaaaagaagttcatcactgatcactagagaaatgcaaatcaaaaccacaatgagatactatctcatgccagtcagaatggcgatcattaaaaagtcaggaaacaacagatgctggcgaagctatggagaaaaaaagaatgcttttacatcgttggtgggaatgtaaattagttcaaccactggggaagacagtgtggtgattcctcaaggatctagaactaggaatttgacccagcaatcccgttactggataaatcattctactataaagacacatgcacatgtatgtttattgtagctatgtacaatagcaaagacatggaaccaacccaaatgcccatcaatgacagactagatgaagaaatgtggtacatatacaccatggaatattatgcagccacaaaaaagaatgagttcatgtcttttgccaggacatggatgaaactggaagccatcatcctcagcaaacacaggaaccaacaccacatgttctcactaataagtgggaattgaactatgagaacacatggacacagggaagggaacaacacacaccggggcctgttgggccatggggggaaggggaggaagagtatgaggacaaatacctaatgcatgtggggcttaaaacctaggtgatgggttgatgggtgctgcaaaccaccatggcacatgtaaacccatgtaacaaacctgcacattctgcatatgtatcctagaactaaaaataaaataaaaaatgtaaaaaaaataaaatctatgttttatattgatcatacacaacattgtagaatagattttacatatataattagtatacattttaaatatagagatttaacataacaactctcctggcaatttcagctgacaatttccatggcaaagtacaagctgcacacaatggaatcctgacttacttctttaacacataaaacacttaataaaatgtggaaaagctataccacctaagagttattctaaaatattttatagtgtgaaatacatttatatgtatgtatgtttaaatttactgaataaagacaccaattaagaaaattaaacccctaaaagctaactactattcacatactttaatttagtttgcttattcatttcaagtctttcttcattaatataagtttaacatatgtaaaatcatagcatagaggccaagcccagtggctcacacctgtaatcccagcatctggggaagcgaagataagaggatcacttaaacccaggagttcaagaccagcctgggcaacacggcaagatcctgtctctacaaaaaaaaaaaaaatgtagtcaggcatggtggtacatgcctgtagttctagctacttgagaggctgaagcagaaagattgcttcaaccctggagttcaaggttactatagcttgctactgggctccagcctgagagacagagtaagatcatgtctctaaaaaaataaaaataaaagtttaaaaatcatagcatggaaataaccttgtgcttttatcttttgaaatactttaagtataactaattttattactacataaatctaccatttcaattctcctttaagaaatctacaaagaaaaactcacatgatactttcatgacctctgaagattaaattatatctggattgtatctgaatcaaggatataagataattcatgaatgaataaaataggatttaataaagtaaaatataaaataaagactgatttcaaaataacaacttgttttaggactgtagcagactttcttttaattatagatttccaattaaactatttaggaaaagctatactttaattttaatcttaaaagttaaaagaagatcaagtaactgatactaacttcacattaaaatgtatttcactaatacaaatagtaataatgaccatcacaaaaattttagctaaatattaattgacctttatctgtatactttgactgtatttagttatttaaatactcacaatcaaaatatacagatacaacttttaaaaatacacagaaagtacttcagcacttatgaaatagaatgccatcatcttccgtataaaagctgaaatcaaatcagaaattgaaattgatgtcagtttatttctgagagcttaatatatttggtaaactgcttcctctttgataacagtggtttcagttttgtataaagactcattataagccacaatatttcctaagtataaaatatgcagcattttattaacttcatttccatcttttatgaacagcatggatataactaccaatcactttaaaacaaaatttaagtttcaagtatttttcatgtgatttgctacaaattattttggaaatttcctgactatataacattgtttagactgcaatcattttattaaaacttacctaaaatgataataacaactgctacttggccctccatgtatttaaaaaataaaaaacgtgagccagagatttccagatctctatatattatctgatcatgtcgcaacatttcagagtaggataacaagatgctcttttgaaaattaatgggaaaaaggaaagctttggagcttcttgtgaaaacaagaaaaagtgtaaagaaaaaggtaggtgatataacggacactatttaagttgtgggaaggcaaaacttacttaagaaactgtcatggacaactgcagacagggcattaaaaaaaggacaatggcactgatgggataccagtaaaaatctgatggctttaaaataaactgccaacatcttcacaaattatgctttactgcttctgagctctagcaaggtttctatacagatagggataataatagaatataagtcattatagatttgttgagaggattatgacaattaaagtgcttagcatagtggttggcacagaataagagttcaataaagtggtgtgttattcttatcatctcatttcaattgagttttgcaagactttcacatctctagaaatgtcatactgtaaatttgaacttgctgatagaaatctgttggaaaaagaagggtatcaaatttatcactctataaggatttatttagcatgtactatttacctaggcatgtggtgctaccaagtaaataacttgatatctgccttccaataacttttcacattggtaggttaacaaagggagaggaatacatggataataagaggaaagaacaaaaacaacgatatattagagtgtttaagatcaacggtaactgaagcatcagttcaaagagagcacttgcccgggcactgtggctcacgcctgtaatcccagacctttggaaggctgaggcaggaggactgcttgagtccaggatttcaagaccagtctagtcaacatagtgagaccccgtctctacaataaataaataaacaataatattaaatttaaaaaacaaacaaaaaaaataaatcagagagagctctctgtgtggcatccaatgatagatgtaagaaagctagcctggaaagacaaagacttcagattgggggccaatgtgaaacaaagttgaataggtaggactttaaggattttaaagcactatggcatgatgacagtgttttattctattcctctaagtaaaaacctgccaagggaactagaataaagcatgtatttaatgaaatcatttaattattaaaccactgacaattttcccttcttttattccctccttctttctataaatatttattgaatctccactgtctagcaggcagcacgtaagtggtggtaataaggaaacattaagatgaggactatacctggtttgaagagaaaaactttagtgtaaataatcccaaagaaaactaaccaagattattttatcagcactgcacctgcacttcattttcttttaagtaggtagactgttttcttattacaacttaaagattttagagtttcaagattatatcaaattaacacatttattacattttagatatatattcatatcaaaagcattctaaaactccatcctcaaagctctactcacttaaactagtattctggaactgcacatgagcattcggttttaaaatgccttacaattttgtcagatgccagaaaacaacaatgaaaaattaaccctggttgaaaaaagggataacttataagtagatttggttcagaagactataaaactataactaacttttaccaggcaatccaagatttataaaagcatgtaaccttgagcaagagacccaaccttcccatgcctcagtttcttcatcagcaaaatggtgacaatacctacctcaagggcttgctgtaaaaatgtaagagttaatacaggtaaaacacttaaaacattgtttgccacacagtaaatgtttcatatgtgctattatcattgtagatgcatctttccaacatctgcttggagaaaaaaataccgtgacaaaagaaaatggctctaaagagccttcagatgtaacacaatagaaggacaaacaggtagtcgcagaattgtgttagattagtgacctaagtgtgtttaaggaacaagaggtaaagcagaggtcacaatgtgtgtttaactttaaataaatatatgaaacaaggaaaattatattctagattttaaaaatgtaaataactttctattgctttacattgtccaaacaaaagctgtgttaataataaagagtatacttctgaatctggagtcccatcaatgatttgttcagcttgcgtaagtcacaactgattggacacagtccctgtgggcttgccatttcatccagactggacggttcattagtcataactactataactgtacagcagagactgcagttttatctcatcgtacatctttgatcaagctgcctcaattctgcttcatcagcatatgaagttacattattggagctttttattttccagtcggtaattaacagagattatgctttttatcaaaacatgtatttggtcttcacatttaatagtgagggcccagatctgaccaccatttgacctctgaaatttctaccacctaaataccatgaatcataaactgaaatccagaataccacagagaaaattaaacaaagaaaagaactgacctgtgttaaaaagcataagatgattgcacttatctaaattgagactaaccatatttgctgcagcttctcattaaacattaaatcgcacaccagaagaaaacatcatacatatttattgttttgcactgtcactttcaaaagactcataccacaattagtgtttctctcaaactataagctacataaagaaatttcccatgaagcctgaagacaaagtaatgtaaaagatggttcaagaaggttaaagaacagatggataatagatttcactgaacactaaagcataatacacttacttcagaaaagaaaatgttgccaaaacttagttcaaatataaaatactgaatgaaattgatgtgtcgggaatttttttttccttccaagttcttttggagaacaatagggggctaaaaggcctgtctcactatttttgcatctcactattttcgtgtgtaaagtgtccccactgtaggctgcatgaacaatcataatcgacagttacatgcaggcactgaggctgcaaaaatcccagagtaattagtgttgtctgaatgcaatgacatctgtgttctcatggttctcgagacatgtcaggccaataagatgtatatgaaaaaatatgacaagcattgcaaatgcccttctgaaaggtcttacactttaggggaaagctgaagaaataacacatgtcatcttctctttgtaagcaatatatttaagattacaagatctagaaagatcttttgagtcattcattctctttttgtaactataaagcatttgttcagaatacatcactagggtatgaaaaaaatctgttgtaagttggcttctttttaaaactttctcagcacatgtgattctgtgcagtgcaatgtaggtgcccattcctgtaagtgacaaaacagagagcatatcttattaacattccttggtttcgttaccttttaattaaaaaatattacctcttagtactgaacataaaatagttcaaaatttgtggttaaatgccttagaattatgtttgtatttttctaataatacagagtgtcaaattgactgtattaaaaagtctttgttttaagacaactaatgcttttgcttactgatgcctattactgaggcctctccctctatatgctgtagcagtatgtttgagcatgcacttgctccaagaaagacattagtcatcattaacagaagcactgacaccaaatctaagtgcctctccacaatgaccaagtggcaatcatctttctcttacactgtcactgctgattaggattttctttcatgaaaatttaatttgtacccctttctgcagcttcttttttttttcattcctgaaaaagcaacgtgttcaggagagattacagataaagcaaagaagctctacctataatatagctaatgatatagagattgcaagattctcaggtaaatcttttctctaatccaacagaaaaacacagattaaatcaatgattaataaacagaagaaaaacaatgattttaaaaggaatattgctttattgctttaagaatccataagcctcaaaaggtaactaattcaaggaatccaaataaaacttccctaaatattaacataatcccaagcttctttaaaactaagataacactttgatagttgccatctttcactaggtttcaaatttgtattctccattttgtaaacaaaaagacaggggcattcacacagaaatatcactataaactgaagaaaatacttaagcattcatacctttagtatgcattaacctactggttagttgtttttttttttttttttttttttttgagaaattttcagttgcactggacaaatgaaagtgattcatttggccaagcagggtactctacagctagatgatactacagacaaactctggttctgtacaatatcacaatgttaaacaagatatcatagcaataagttatttaaggaagtttttaaaaacatttacttttctgttttatttcaatctgtttaaagtttttttttttaatgtaagcatgtgatagtttgcaagggtcctggtacgacccaaactcccacttctagttataaatattatcatctcttcgtattacttaggtattataacaaaatagagattggtttaaatttaaattatcttgaaattattttatatcccttttagaacatatgtacttttagtcaaaacatgtaacacttttgtgtttacatgagcataaattgtatctttttaaaatgtaaataaccacatgaaatgctctgaaagcaaaaatcaacattatttctttgtaaatcagaagcaagtacaattcatcaaactttagtcattaaacgatccttctactcctattttattctgaaaaataatacagaaagtcaaacagcaactgcttagtgccatttacaaatggtttgttttttctttttttctatttaaaattggtctgcaattagaacatgtaagaggagattaggaattaaaatggattctgagaggcaatttctaactactgaacttttataacaggagtatctttgattaaataaggagctagtctaaactaaaagcaaaactgtaccataataacccaacttaattatctttgcagaatacatttataaatgattggctcatttctacctttacttgactaagtaaatatgcctcttaaattctcaaacattgaaaattctgattctcacagttgcacagacttatctaaatcaaaacttcaaaaagttacaatataattactgactccattgctagatccagtacaagttcaagtaaggaagtttagctctgtaacttccactcctcaacctaaacctccaagtcacttgtcagttaaaggttgggcgatttattgaccgcctctggatgcatactgtcagtgctgaaggaaatatgagggagggttgttgctactgttctggagctcattgataatgacatacctgcctctgtcacccattacccatactacaaactacttagacctaactgaaaaatcaatagcctacttgcactggttcctgtggctgcctcctttgattgtcagctcctgtctagggtcagcacttacatgaaaggggctgtgactgcctgatgctttcaggacaacctaacgatatgaaactagccaacagaacagtaaattctgcctccctgccctcctcatcaattaggctttgactaggcttgcctgtagaaacctgaccttttaagtttaggtgaatatggactagctgaacacaccattgccctcagcactgagccaggaaatctactgacaggttaaacaaaacagaaggttgtaactgtcataatttgcattgcactttcacgccaacaagggtgttatcagtaggggcaagccctggaacacacaactccagcacccttaagccacgctactcataaattttcaagtgaagtgagataaaacataaattcacaaatagcaatgcatttctcatctctcagtcttttaggtttgcactttgcaaacccacagagtgcccatcaacaactccttttggtcacctggcactcccattgcactaattagggactttcaatgaccataacacagaagtaaaaataacaatgcccatttaagacctattttagagagactatataatatagcagatagactgactggtatatatgtcaaaatgagaacaattagatctcaatatgctatcttttcttgcctcaattcactctctccaaaagtatccacaagcttagacaaacaataagttatcacgtaagtgaaaggaggtgttgaaattatttcctaccaagctactctgatatagcatcttttacagtttgagggaaaactaagaacatctgtaaaataaaagatgttaacacttttatgcttgtcagatcttctgatgaaaacaagtgaaaagcatgagaaagcagtataaaactttcctttgtttagtgactcatgttttgaaaaccacttccctgcttagatctatcttttaacacagtaggaacttggtaatatcatagttgcttagcacaatgtcatttctctaaggagaagaccaataatttatttttttaagttaattgtgaatgggaacttactttggcttcaagaactaatatttacacaatacccaatgttcattaaaatgtccaaaacattgacagtccattaaatatttaagggaaaaaaacatattgtttatataaacatatattatttttctatatacaggaacacatactgcattttgttttataattttatgattcaacccctatcaagcaataattagtatactcaggatttttcccaagttgctacttcattgtccctcacagttgtctccaaactatattttgtaaattttttccataaatctaaaatatctataagcttattcttgtctgagtttaaaaactttcatatacctacgttagagcagcactgaaagcctaaacatctgcagaaagatttctgatagaaataaacaaagatgtcaacaaatttagtcatgtaatggtggaaaattttagacttttttaactagaagagatagaaaagattacctagtccaacccactcatttagcaattgagaaaataatggataaagatagtgacttgatcaaagtcacccaggtaaccaagccaggacaaaaatttgggactttttgtttcctagattgatgctttgctgatacgttcacactgtctccttttatctatccaggtattctggatagcaaccaccttacatttaaaatacatatctatagatttgtatcattcatttttaatttataaagtttatagaaagctttgattagcagaaaagattagattattcgtagagcatttaaccaaaaagttacccaacaaatattagaaatagaaggcccaattaagtatggttggaatcctttactgaccaaatatgatgattaactaagcatctggtcatctttctgctcctttgtgtgtacatagctgatagcaaagtgaaagggtatggatagtgtctgatcccagcaagcaaatcatttgaaaacagtcatagctacaggtcaaagattttctactcagtctagatggatctaaacgtactaacctcgattttaaacctaattacctatataccaaatcagtcagaaaataagagaatgactctttatgatccaaagataataagggaagataggaaggaaaaattcaggaaagagactggcagaaccttgatatccataggccaagacagctgttttatatcctagctttatatcagatggttaaaggaaaagtttccattccttagatcattaaatattatttcatttatattacacagatgtcttccatacatagattacaaccaatgaagcattttgttgttgttgtttaaccactacaagcaatcagagaaacctctctgcacatcacttttactctaattcataacatttaaaggatgaggcaggctagatttttaacatttccattaaaaataacacaaagtccattaagtatttcttgtaatcttagcagatgatcaatgccaaattactactattcataataatatagagtgctacagaaccaatacatttttaaataaaatgtttaaaatggctagtgctcctaaagtataacaaaaacctacccatacgatatgcttaactaataattttaaacatagacccacaaaatgtctcatatgacctgaaagaaatagcacataatgccaaatattatattttgaaccaagtacagctcaacactagcataatctacgtctctaatttcactcatctgttttgttaatgtctggcactgatcacaagagaaagtagaaagggagtggggatggatttaatatcctaagaaacatattctacacaatttttgtttcacacacattgttttggctcacaatgtgagtcaataatattatcttcataaacaaaagatatcacaccttgaaaccataaggtcagctttcaattttctttaacacttaaattcattattatctgatcctggtttttctgtctaccttctggaagtgatgttaaaggccagcaaaatttggttctccaggtagaaaagtcacaaagaataatccacaaattatacaatcatttcttaaagttaacagttggctctaccaaatataccctttcatgtgaagataatagtgacttatgaaagtcaaagttatttggcaggtaaaatttaatatttatctaatagtacattaataagttcaaactggtttttaaaaaaaaaaaaaggaggaggggagaggaaaagaaggaaggaacaaggaagaataggaaaagaaaatttttaaaaattttgcttcaacttttcagaactgcttaactatgtatgtaaataaaagaatgtagtgttacaactcaaaaatgtatacatttaaaatgagaaaaagatacacgatttcttggtaaggtcaaaagacatatgccaatataagtgtgaatatagcaagttcaaagaaactttctaaaaaatacttgctgaattaacttggatgttaacattgcacattctagcgcaataatataatggcatttacttcttagtcaggctaaaagctgcttactttaattttcctgagcacaagtcccttactctatcattgtatatttttggtgacatcaaattatgtatagtttaataaagtactcatttatgcagttgctattcaacttgggggaaaaccctgatatacagcatactctcaattttctcattccactatataatacaagaattatatttgtaaagtctaataggtaacaaacatctctaatcatatatattatctaaggcaatccaaacaaatttaaaaggcccacaaacaatactcatcaaaagtacataaaagcattttatttttcagtacagtttgataggcttactgtacaaaattaaagctactgcttttacctgacataaaattatctgaagttcaacctgttcaaatgagaacaatacccttgggttactaatcaaagagagtaaaaaaaaattttttttattaaggctattttgtgaggggggaagaataacttgtttcaacagcatgcttgaccatataaaattattaacaggcactatggtgaactgttcaaggcaaacattcaattactggttattttagattgattccagaataataattacaagtagcttagaaacaatctccttaacactttggaattttagaaaattaaatcctttgacagagaataaaagagaatgtagttttactgtgacttataatgtggacagtataatcttgatgactgtcattaacacatcttacatatatttaaatataattacttcaataaaatttcatcaactagaatacactaacaaatcatatctgggttatttacttttctttctgtttttagtgaaataatttttaaattcagagaacttaatagtgttttatttcctcatttacaatttgaccaaaaataaaaatcaatgttcatttttttaaaaaaaaaaagcattttcataagtatgtagaatgattaagtatataagaactaaaaatgtagcacccacatagatgtttcaaagttagaatttagaggataagactatataccagtaaacacgtggtcctttgttttccaaaaagtataaatcctccagaaatgctttcttttcttaagtcaataatctgattattttttgaaagcttctaaaatatttcctggaaaataagatcatgtattctaaaatttgtttactctttagtaaagattattgagatacaatatattatttttacagataataaaataatagataccttttaagtctcgttaacatgataaagtaacaaatgcactgacgttaactcagtaaatacatttttaagtaaagatcagcaaaaaataaaacagtttaagaattttgtattctctggaaacataaacaggattataactgtcagattacagaagcactgacttcagccattagtttggtttggctcctgagaaacacaacatgaactactgcatcatttcttttcaaatccatacattccctgcagccgttcaagcttcatcagcagtgcaggaatgtataaaaatgacaggcaaagggcattaggtttttttacttccatactgttttcctataaatggaagacaggattctttctcaaagcacttaagctcaagctcagtcaatgctgaaggaaaaatacaactgaattctctatgcaagaaagtatcacaattggattatttactacttttcaaggacatgttgataaatctaatactgtattattatcttagaataaaacattgtaaggttagcattctagcttaattacccattattcttcaattagaaatattttcactttttaaagtactctgtcaactcatcaccttattttaacaccaagtattcagttttgcttctaattttaattataaaaatttccttaaaatatgccaattttttttgaaaatatatttgtataaatagttaattttttatttccaagtttctgtactcataaaggtttcggtgaaataggaaattccattaataattaaaagtttatttaaccatgataagtaaaaataggatgtaatgagtaatctggttatttgactggaccttaaacattcacattgctataaaactagtaccgtaattactacaacctgactcaattttttgaagaaactgggaaattttcagactaaagttttaaacatcctcatattttagtttatagtaactaaaaacatgcccacttcagtactatcacctacattctttatgttcctaatgtaatgatgcaagaggtaaagcctagagaagtctgaaggttacggactacctgatatccaaaacaaaaaattcagatcacaccctgaatgtcctccttccctttttaggaatgtcctgcagctagcccagcaccacagctctgggctgaagcatgccaatgttggcactgcctaagccaaacaaacaagatgtttaacagtcaaataaaatgtcctgcagcctccctaatgaatttgtcaaggaccatcagatttcgcaccccctcctttgcctcattaactcaagtatgatgagacggattataacaagagaatacagatgaatcggtctgaagacttgaagtggcttttagcctctagagtttctttctctcacttggtctcctttaatagaatatagtatctcctgcagaaggagctgccagttcgttttaatacaccatcaaggagctgctgatggacttctatactaacatacataaaagcagaggtgacaggggctcttcaattacagcctcctcggataccgtttcccccttcaattattcaaccagaggaagagaggaccgcaaaggcgcagctgaagctgctcttagagcagaggcagccagagtgagttggggtgggggaggggggagaaagagaaccagcaagagggagcattatttgctggaagtgtttaagtttattgctcgaatgatgtttctaattagtaccacggccataaattaaagtcgcctttgtttaactgatttattatttactagagcatctacctaagacagggtaaattggtaatgaattgtttttaaatcaaaacatttgtaacgttttatcatccttccctctgtatgtaaaagtggagaagcgtaggggcaaggatgcgagaaaacttagccgagcttgacagagccgccagtggaggtgcagcggagtgtccggcgagtggtggcgcgaaggtccgctcggcctgggacgccccacccgagagaagaggagaaggcgcaggacttgcggcgcggcggcggagccatgcgaaccaactccgccacccctgaggctgtttgcaaacactcactctcgggagcgtcgcgggccgggccattcgcgaaccagacgcaacgacgaagcgaccacctcgagagtggggcgggaaagctccgcaccctctatccccgccaccagtctccgcccagtaactgcccccggagaagcaaccacggagcccctcccggccagtcgcgctctcccggcagcgcagtgccctccggcccaggcagttcccagagcgccggcaaggcctcccgggttagagccgggctcccacaggcgcgaactccgagggcgcgaggtcccctagatccttaggcggcgaggcgttccgggacgcacgcggcctccccggagaaggctggaggtcaagcagcccaagtctctgccactccagagaagttaactaaagctctggagtccaagagtcgcgcggacacttaattctgactcttcttcctaatcgcgggaagacaaaccctaagcaacaaatccgagatagtttttttttaagcaaatattccttagaaagggacttatggcaacgagagaggaagggtgacaaactgcctgtggtccgcaccaggtatgtaagaaagaaccaagaggcccaattgtctgataccaagtagatagaaagaaattaacttccctatgcaattcaattcaggttcacccggccggactttaagagggtaagtcaagccctcccaaggggttttgaaaaagccgaactaccaggtttctaaaacgaagtcttcacccaaatggacgcatagatttttatttttatcgcataacccagggctggaatataacctcccaaatcaaactaaaaataatcacatctacctgaaatacgttaaaaagattcagaatccagacatcttaggttcatacataaaccctcagtatcaagcaaatcagaaacaatgttctagctttttttttcacccaaaagtatggaaaggctacagtgggtacaactcgtttaggataatacatatactaaaagcacatgcatgcctttcattgaaatgcctagggaggagtgaagccatctgtgtaatcaataacaggatagttatagatttttgtggcagtgaagtcttttaaaagcaagagtcaattatgaaaataaaatcattttacaaatgaaactctgtacctgtaccccctaagaatacattcacaattagatttacaacagtaagattttaagaaaactttaggtttacatttacttgccttgtttttcattaagtttgaagcaattttagtagcttattttaaaagtatatcctactaagttctacgacatgtaagtttgcaccatttctcacaacttagatattttctctctcgtaactagttaattcttgtaacgataaaataatggtattaaatacatgtgaatcttaattatgaaataattatcaaacaaggtgcttggactagtttttgccctgccctgtttttaaacagcatatcgaaattactaaaaagagatttataaaccctcaccttatatccactccaaccctcactggtgcacatatacagcaactgctctgattcttggcaacaatgggaggggaggggaagagaaaggaggatgactttaaaggaggaaaaaacctggaaaaattaggtcctttcccagattcccctttcgcttcccatttgccttcaagccaaagtaattttgttacagtttgcaccttctactacacaatgttgatagaatcatttaaaaaaaaaaaaagtgaacctttctgaaccattgctactctccctcgcgttattccagccatctccaggagagtcccttctatataaactctttttcttctttgctactgataagagaggaggataaagaggaacggctgtaaaatgtgtgcaagcatttgactcccattatctcctcctattttcttacttctctctttaccctgtttctttatcaagtgcagtggtggctgctaccgttcgccaagcgtgcctgtcttctctctcggattggctaaagcactgacagctcggatagcgattgtaggaactgaagctccaccccctcatgatggccctgggaccattcataaactaaataactccaggaaacagcgagggagagagagaaagaaagagagagggagagagagagacagagagagttagaggaaagaagagagagcgagcacgaggaaggggggcgggggagagaagcagggggagagcggggcgagaaagaggtcggaggggagaggagggggagagacgactcagaaagtggaatctgtaaaagcaagctagaggagaagaaggaaaaccctgaatcgttataactacaccccagatgcaacgcaagcaacgacttcgtcacactaaaacggattttgtgagggccaaaagtataaattacgaagcagaaatgattatcaaacaacttccagcggtttgcacctaaagaaacacaaggagaacccactacaaacaaacaaacccagtccaaacaacgcctccagtaggaaaagaggaaaactgcgataacacgaccccccgagaagagacgagaccaacacgctgagactgtggggcgtcagcaaacctccaagtgcacggcggactgagttgtacttcgcagctctctggacattaattacctcctgcaccttccatttgggggagggtgaggaagaaggcactcacctacactgagcgaagaagtcctatcagcgtggaagagaagtttaagaatgaaccactgaatgtttcgcttttatttttaaatttactttggcacttaaaaaacctcatttccagatttctggacaatctcggctgcagacatctaagcctaaccttttggtatcctgagttttttccctctccttctccttcctcacgcccaccccgcttctctcgcacacggtcatctttacatatcaagagaaagcaaaaaggttccaagaggtacttttctttttagaaaatcaccttttctcccctaattcttctgcagaagaaaagaggtttcgaaagagggaaaaggaaaaaacaagccggctacggtatcagccggtcagcccaggtggaaaacgagagtgaaagtagggcttaacggggagcgcaccgcctctttcgaaagccgctgggccaccaccagtgcgtgagccttggatccctcaacgtattgcgagacgccggtgtatagcccggacctgtgccccaacatgatcgccgctcaggccaagctggtttaccagctcaataagtactacactgagcgctgtcaggcgcgcaaggcggccatcgccaaaaccatccgagaggtctgtaaggtggtctcggacgtgctcaaggaagtggaggtgcaggagcctcgcttcatcagctccttgagcgagatcgatgcccgctacgaggggctcgaggtcatttcgcccaccgaatttgaggtggtgctctacctaaaccagatgggcgtcttcaacttcgtggacgacggctcgctgcccggctgcgcagtgctcaaactgagcgatgggcggaagcggagcatgtctctctgggtcgagttcatcacggcgtcgggctatctctcagcgcgtaagatccgctcgcgtttccagacgctggtggcccaggcggtggacaagtgcagctatcgggatgtggtcaagatgatcgcggacaccagcgaggtcaagttgcgcatcagggagcgctatgtggtgcaaatcactccggcgttcaagtgcaccgggatctggcctcgcagcgcggcacagtggcctatgccccacatcccttggcccggccccaatcgggtggccgaggtcaaggccgaagggttcaacttgctctcgaaggagtgctactcgctgaccggcaagcagagctcggcagagagcgacgcctgggtgctacagttcggggaggcggagaaccgcctgctgatgggcggctgccgaaacaagtgcctctcagtgctgaagactctgcgggaccgccacctggagctacccggccagccgctcaacaactaccacatgaagacgctgctgctgtacgagtgcgagaaacacccacgagaaacggactgggacgagtcgtgcctgggcgaccggctcaacggcatcctgctgcagctcatctcctgcctgcagtgccgccgctgccctcactactttctgcccaacctcgacctctttcagggcaagccccattcggccctggagagcgctgccaagcagacctggaggttggccagggaaattctcaccaatcccaaaagcctggacaaactatagggtgctggggactgcttgaaaagcgacacaaacgggcgtgctctctcagacacacaactctgctataaacagcagaaactctggacacaaacttttatgtaagtcacctgaaataggaatccggcagaagaccttcattaattaagaagcaaacaaaaagagagcaacccaaccaaaacaaatcacattcttgcacaaaagtgatcgttttcttccaaacaatgtgaatttaaaaggtcacacaaaagaagcaatcgggctccgccaccacaaaatgaaacccaaggtacattttcaaatcaatgtatagtagttccccccccttttccttctttccccctatcctttttctctccaccccatccccccccccatttcgttttgcttttggttgcctgaatgttgtcaccaagtgaaaaaattatttaactatatgtaaaatttctcttttaaaaaaaagttttactgatgttaaacgttctcagtgccaatgtcagactgtgctcctccctctcctgaacctctaccctcaccctgagctgtcttgttgaaaacagtaataaaaacattactttacattgtaattgactgtttgtggattgttcttaagtgaaggcaggtgagatcacagtttataatttccaatgtaaagatgtgacgaggaatcaaatgcaagaagcttccacttgaactgatttgcaaaattttaaatacagtacattttgtagaattgactgtataagttccgacccaaatccttagaaaatagaaaacactaattttactcaactataatatatatttgttctgtagatgttaagattaaaagtaacatctacttcacgcttgggaaaaaagtatgaaagaaaatattttgatcctaatttttaaaatagaaaaaactttttcacattaaaaattaagagatgtgctttcttatgccataatttcaaaaaatccaatctgaatccgatatacaaaggaaatatttatggatttttctgaatagttaacaaagtcagttgatacttttccttcaaccgtttgtcctcttcaagctttgagtgataaaaatttaacaattaaataaaccacaacaaaaaatacaatggttatagcaataatcctctccccaagcatatggtgatatgaaccattcagatttataaattacttccattttaaaatggcttagttgtaaattccataagtatgattattttaatcaaatttcaagaattattctgaaactgcttatatgcaattcaaacaaaaaaggttttcataccatttttataaccaaagaaaaattattattccaggatttagaaataggaaaagtaccttcctcctctttctgtttttctaaggtaacaaaccaatatactcatttcaatgtttcagctttaacaaaggtttctttttaatgcaagggaataactgattagaaaataatataattagtcaaacagaaagtatcccaaaggaattggtttgtcttgcttatgttgaaggtaactatatactccattcgctatgctaatgatgagacacaggtacagaatatatgtcagatgttaccctttaatatctaacatttattctttgtattagcccaggttttaatttattgagaaaatgcacaaatgagaggtgtagagaaaaatgtttttaaaggcaattttaaagatcagaggaagaagtttgagagggggaagggctgtatggagggatgagcagcaggatagcagaatagatgaaaaacaagaaagccactcaggggtctgaagcctagttcacttgacaaacaggcttaagttgtgtaagattccttggtaaaaacagtcctgtgttaaaaatataaactttgatcctatcagttctgaaatcatctccactctttcaactcaacctctattatatctatttttctagttgctcttcctgtattcttcacagtaatattaagtggctcaaacaaacaaattcttttaaattataaaaaccaatttattctctggggaaaatgttctgaattttaaaaacattttcaaacaaacagtaggtgcttacatttgcacaaaatgatttaaaggaatagtgtttggtttcaaagataaaaagaatatctataagtgaccatttttctcactcacaaaagtatttacagcagtagacatacatctccctccaactattccagaaaaaaagtttttaagtcttgacaaaaagaaacaaaaatatccccaattcagcatattttcttcttccttatttaatttaatgcaggtatcagttaaaaaggaaaaacactgcaggaacataaatgtcctcatttacagaacaccttaaagcattaacatctatacaaaattaaaacttctcccagtagctgactgaaaaattgtttttaatataaattggcaggagttttaacttctggaatataaggaaggttgcagtgatacagaccatttcttcattgagccaaaagatctccatatttcacaagcaacaagaaaaaaataatttaatgatgctgtacagaatcagatcagagagagacaaaacttgtaacttctctaaaaggagcaaataacttcaaagaacctaatctcacacattggcagagattctaattttcagaacaattaattagacacttttaaattaaatcaaattttaggctttgctctatatgtgtttaaaagcatgatagaatatcttgaattaaatcccagtctttcttaaattcagaagttaccagaaatcagagagtttaattttggtaaccttcctttcctaaagaaactaatgcattttcagacatttcagtcatgggacaaagtagaaaaaatttttaattgatagaatttcagaattagcaagttttctctacattggattagttaacttatcaagctcaaaacaatcagtttcatacaatctaccaagtcctgtcttaataaaggcagcaatattgaaacaaagtgctagaaatatgtgtgagacatgatttgtttgtatagttttaaacaaaattataatattttcatcaagagctactactttgaaatacttctaaatcattcagatttaaaaattcacatgattacaaaatcaaagaacctaccaaaaaactcaaaatatgtgtatgtatatacatgtacataacatatgctatcagcctgcaaaataaattattccactttttaagccacctttttctacagattgcttattttgctcatttttaaaagaaactgtttcctctcagagcaaattataccattctttttcttgaaataaacctaattttggtttttatgactgtgctacaaatgtttcttagtaaaaacaaagttgccagggtctgaaaagtaatgagaaatatattttaaaggggaaattacattttcatttaagaatagaaaattatgcagtgccttgtaaaatctactataggtaatgggaaacagaggtatctcacacacaaaacatgcttgcatgcacgacagagtagtaagtcatggggacaaagcaaggagagtgatatattggcatcatatccagaaaacataaaggctaaacaaaataattccactctcaatctcactgaattttgtatcttaattcacccttgaccctttgaggcaaaatatatttatagacaatgttctcggaggttccttcccctcctcacaaagagctaatgataaatgtcattaagtagaatttgtttttgaatctaaatgaacttcaataatctaactaactggtagggaatcataaactaaagaagataatgacattgcatataagccaaggcaacttagaagaaattcaaactaagcctgtcagatttaccaatcccaatcctatccaacagcacccaccatcccatcataagaaaaaatgaaaccccttcatcttctcaccttggggtcgatttttttgaagttaggatcctcttcatccacctcaaaatagagttcggaggaggtgacagaaagagtgccctttactacaacagagggggccacaagctgagctggtgtgctcaggctaacaggacctgccaaaaggaaaagacaagccacacaagttggaatgacatttttcaaaaaatcaaattcgaccagaaattgtatttaatcttttcattctcacgtctagtactgaactgcctgccaactacttctacagttaaatattctgtccaccccaaatcttcctctgaaaatgcaaagtcaggattctcatactacaagatctataacaggcggttaatgataacagtaaactaggatgcaattattttacagggagtctgcaaagctttggtctaatctctaggtaagaagtggctctgcctaaataagtccatccacattccatttagaaaacaggcctcaggctatctaacaacatgaacaacaaccaggagcaaagaagcctcaataggcttccaaggccagcagttagcttacagtatggtagaggcatggctacaaaaagatcactagcttattaatgaagtgggaaatgttaaaccatattttctgatagagattttatgccagcttgacacaaaacctcttccataacaactttaccccatcaatgactggtaaaaatacttcttttctaagccttcctttccactgttaagtattgttcaatgcttccaaatctaatattagtgtagttcagggactctgggagtaaacagctggagggtgggtttccaagtgaatgaatttttattggaataatcaaatctccacagggcttatcaaagagacaaatcagactgctactgaaaacaatagattcactacagacagaacagcataatgtgtattagagctaaatataaaatatgaactaaaaatgttacatatatatgtctgttatgtctgtgtgtgtatacacacacacacacacacacacacacacacacagagagagagagatcgacgtagaaagaatttgaaattccattatcaattcctcatggtataaatcctataggggaagaaaacagcataagagaagattggcacttatagttctgaattaatatagtgcctataaacaagctgtgcctattcaggtaatcaatgggtgaataagtgtttcaaaattcagatgaattgacatttccatcgattgttagaagggtgatagtgcttaatctcacatcaatcttaatgtgtgccagtaggacaatagaagggatgctctgcggagatcagagcaggttttgccctctattcccaatgtacaaatacattgtgtttgcagatgggcagcagatagctgcagaacagccatgatttcccaaagctcatccttataaatggatgaaataagaagctatgtgttcttttgctgtctccttttgccctctgtacattagcatgtaatactgagaagaaataacattttttcaatcactctcagacattcaattacagggtaagcagacagctgcaagagctagggcagcctaggtcctacagaagacccctgacaatttccacttcatttctaacccacaccactttattagtgtggattacttcttaatcctattgccattgtcaagattatataattaaactcccctttcacctctattactgtatgaatgtattactagtagcaagaatagaagcaaaataaaggaagaaatgggtaaatggatgtgaaggaaaagactacagaatagcagtatctaccttactctccactcccaccaattaattttattttactttatagagaggtttacagttatcagagaagataccatcttctctttttgcttttcattaccaagtggcatagtagcacaggttgcagatatgtcaccaaaagcaaggtttttaatgtcttttctcttaaaattatcaaaatggaatactatgtaattttcacctattgaaattatagaacctttcagactttcttccttgagggacagagccacaggtattaaagtaaaaaagccatttaatgaatgactaaaatttccggctaaacaagagaatttttcccataagggatgtaaaactgagaatctgcagagtgcaaatcaaaattcctacatcaggcaaaatacgtgaatgttgtgaaaagccatggcattctcggaattgatttgagagagttacatgcatatacagcatgttcactaagacctgtatatcaaagcaaatagcttctctccttccaagctttatttacaaaaaaaaaaaaaaaaaactggcagaattttacttatagtcttactttacagagatttggtaactcctatgggatgggtgaagtaattttgttcttttgttgctgcttttaaactttttctttttcagtgaaaattattcacaaaagaaaaaaatgaggagagtaagaagactgaatagaatagaaaaataaaggagaaactgtagaagggggggaagtatttgaaataaccaattaatgtaattgtgggtataaacttggtagtcctagtggtcacagctgaaaaagtaagtaattatatgcttattgtcccagaggtagctgaaatatctgcacaaccaccaaatttaccggcaagattctctaaatctttctcatccacggatgacagagtatcatcatcgccttccaggaggatctcgttttctgagttctgatttcctaaagcctgactcctgatggactgttttcctttagcaaggatatcttcatctgtggctgaaatgaaaaggaaacaaagctgtccatcagttctgggaagagcacttcggcagaggggtaggggcttaggtaagggtaggtggccaaagatggtcaatcttttatacacagtgtcagctacagtggagaaagtgattgggatggcacacatgcctgatctgacaaactcgatcccccaacctagtctaatgttaccctaaacaagcaccctaatcccattaaatttgacccctgcactgctcaccaaaccatttatttacttatagttagggtaggagtggttcaaaagcagtacttttattgaaaattcattaataggaacaatcaaatcccagttttggaaacaatatttaacagcaaaaaataaggactgattcattcctccaaacaatgttatactgacaaacattttggaatggttgaggagtggctgtggagaagaatccagaattaaaaagggttaaagctaagagacattcacaagccagtgaggatttaggcccagatactgaagccatatctgacactaataagactacagcagctcctcaaagctgcaatctcttctttatccaccctccctccttccttccttcacattaccctcgtccacatgttcacacatacactcactcctccgcccttttgtcctttatacaaatatccaggagcaaggcggtgtggaaactaagtggaagctcaaacactacctcctctgcatgtttaaactaaagggctaaggcaccccgggggcaaacataacagaaagcctgggatgagaggcatgtgggcaaggggcctcatgcggcctgaactggagcagcttgtggagagcagcagtaccagactcaggcactatgacaaggcagcaactgcaggcagatggaggaaaagagaacacatctagggagggaagaagcagccctgcagagcacctacactcaacaatgggatccgaaaggagagcaaagacgcaaatgaaagtggaaaaccctgaaattcaaaactctgattcaaaacccacatccttccagggctcctcctgttgttttgagcagctttctccttacgacaagcaggaaggcagatgctaacttctaaattgtgatttgtaaaacttcatatgtgtatcttttcctaatctttttttgaatggtgtcatataagggaaagttaagaatcttcacctgaccctcctggcttccagctagataaatcccagaggtaaagcacctgatctacccaggctgcggcttttgatatggaaatcggatggctagggttttttttttttttttttttttttttgctccactgcagcttctgcctaggcataaggcccaaaccccagaaagaataaagcagtcaatttgcagtaacacgactaatatatatatatctatataatttattctacatagttaacctgcacatgtgttacctgatttggcagatcaaaggttcttagggtttgataagtacgtttacggatgatgttaaaggtaaaaggttttttttttctcatatttattgcgaattcaccatgtataccatttatatacaatacttatagtgctactgaaacataggagttttctatttaataagaagtcatgggaagaagctttctatatttacctttaaatacactctatgggtaaataaaatctttcatactcacaggctgcattgtaagctacacacatatgatggtctggacatatgtttgaaaagattactttagtgtatctaattaaagtggctttatttattttttatttaatttttttgagacaggatcctgctctgtcacccaggctggagtgcaaaggcacaataacagcttactgcagcctctaggctcaagcaatcctcccagctcagcctcccaagtggctgggaccacaggtgcttgccaccatgcccagctaattttttaatttaactttttgtagagatgaggtcttcccatgttgcccaggctgatctctaactactgggctcaagcaatcctaccacctcagcctctcaaagttgctgggattacaggcgtaagtcatctcacctggcctattttttttttaaaggctaaaaagaaatatacttacaattaaccaataatttttagaaaaacagaactatgttctaaaatcacttatatttcaagtatttatagttccttactctaaaatcagaaacactgccctgaggctaaacaagatcttttgcagtttgctatcaacattattaaaaatatattggccactgagaaatgcaaatgaagcaccatcttctaaatgtttttataaagtaaattataataaattattattttccagttagattttagtacagaataagtataccacattctttttatttcttggatttataattccttcttcaaagcagaaataataataaggctaatattacatatcattttgcataagtcagggagtagtgttaaaaatactttacatagttaattcatttaattctcataaaccttctgcttagttctaattttaagataagaaagcaggctcaaagaggttacataaattgaccaagttaacatgcgtttgacaattagagtcaggatttaaaaacaggcagcacggtgccagaagctgggctcttaaccacgatgccatattagctcttagatgtaagaaacagaaagaaaacaaaacaaccactgttcaaatatgaatgtgtatataattaatttgtttactaattcttgtttttcatagtgcattttaaaaggttaaatgagaataataatcaagaacaaaaaatattcatttccaaatctaaaattgatgaacatgccaaacacatcagaaacaactaaacaccctgctcattacttcctctgattattgccatacatgtcctaaagtacaccaagcttatgtgaaaggaaaaaagaagaaacctctttaatctgcaaacatttacaaaaaaatgagagtccccagtggcaatatgtaatggtttaaaatagctcaaaaaataaattcacattcatttataaatgaccacgagaaatataattatcccttccaattgcaattaaaaaatttttaaatatgttctaatcatgctgcctatattaaaacacagtaaggtaacttctgaattaaagtttcattaaaaattttacatactataggtgtactgtatgcatacacacacccactttaatttatttatttacttatttttacaagctcagattctggaattgttcaagctccactgaaaaacctcttgtcatggaaaatatgcagcttactgatatttagaatggttttcctgtaattaactcccccttgaggattttaagttagcagcagtaaaattaccaacagtactctaatatacaccacatgcgctggtgttcaattctcagtggtctaatagctttctgctaaagaaccttaaaaaaaaattagaacaaaacttttccaagcataaaataaaggattattatcatgtttatatgtactggggaaaagtatatttttaactttcatttgccttattctcaatcaaccattataaacaagtattttgatatcttctgtgagcatattctacacacgtctaaaagttaattggatgaagtcagaatatactttgggttccattttaaagctcaattcagatatttctggctaataaaattgttactaacatgattgctgtttaaatttttcatatcattattaagaaatgccttttattctggtttaatttcaccttttattctagtttaatatttatcctaacttaatacttaaactgcaattgttacataaaattggagaaatctgtcagaaatgtcatctttaaaaatgatttgattcactgaggctaagaacaatgaaaggcctaagagagagaggctggtccccaaaatgtaaaattcaagttcttcagagctaactctggacatgagttgatttatctatccaccacaaaacaggtaagtagaattaaaatataaaaacagcaaaaacacacacaacaaaaactgttccacctttgatataaatcctttttaacatctactgagcaagtgaactggaatcatcaatagtctgtattaaagtaaaagaagtttatactttaagaattagcatttttaaaaaagactactattagaataacagagtgccttcaaacatacataaaataaaaatgggtatctacttatgtgatctgaagcacacaccataacagcattctgaacaggacacataaagaatatcttataatcaactattgttctaattgattcccctctatagtttatgccatgtccatagcattccaagtcaagaaaactgactctgtaaaaattaatgaaactacaaaggataattaggagaataagccaggtgcatctcgtaataatcatgggctaaccaaaattttagatagagaacctagtatatgttgatcctaaaaaggaagcaacagtatctggcattattgaagttatgagacaatggcacgatttaagatctttacatgatctgtcatccctagaaaaccaaatgagttacttgtatcattccatatgcttacaagatacttttaaaactatgttaaattctccttatatatttctattagcaagcacgttctctaccaaataaaaatgtcttgaattcaataggattctctgctaaactgttttagcacctgaattaaaaccaatctttctaccgtttaaaacattttttacatgtctttaatttaaatataaaattcccgttatatttaataatgaattttagaggacagcacagcacactgatatgaaaatctgggtttcagtcagttaacctgggctttagtcctttatctaccaaaaattatactggccctttgtttcctcagtttccttatctgtaaagaataaagttagactagatgttagccttaggttccttctacatctaaaatgctctgatagtaagtaacagctaaccagggctctggcattaggaaaatgttacaaatcattgctaccaatttctaataaattttaaaactataaaatggaagaaaatgccctcaagaataaaatgcccagctttgcttgagctgctaatttccataaagaatacttaatcataagaggaagtattaattttaattttaaaatatgactcagtttctgcaaagttaaagaaatctcccattacagcatgacttttataaataaccactttggagggtctctgcttgaaaaattacctaaagcttttttccccaagcaagttaatgtgaacttgggaagggcaattaaattgtcagaattaaaaaatttgtttttaactagaaggtagccagaagtagagtcatggggctggtattgatcgcccaaacagagaacatcactcttcaggtatttactctgccacctttacactagaggctttccttcaaatcaaatcaatctataaaaaagatggctcttactactaaaatacgtaactgatctccaatggcacttctatttagatgtcttcctttgataatgataatatagttcatggtgttctaagattctgcatttttaaaatgtcctatctccttagttaaataaattataaataaaagtgagaagtcataaaaatataagaatgacatactatcctcattaatatatattttaaacatttaaattcaacattgaagcacggtatttatccatgttaaaatctgtaatttcaactgctttttgatcacattaacaattttgttttgcatacttaattcttaataagtttattttgattagcttctttaatgctccaaaatttttaaacaccaaattaaaattgaatgtcaccataaaatatttaatacaccagtaaaaaattaagctctttgtttacagaatatattagcataaattttctaacatcgaacaataccataatacaatctatgtgctgaatttattccctttttatttaaaataaaataaatatgaggtaggattagaatttgtgtttttttaaaaaatgttatagtaaatattaaatatgatatatctctgaaattgtaagacaactgaagaatctcctacacatttagatttttaaacatatatttcaaacgcaagttttgtttttaacattttggagtatgacaataatcataaaattactataaaatattactcaatgcttacctttgctgttctctctcaatttaaaaatgcacactaaaacatagataattaacattggattaacctttcaattactatcgagagtaatcagagtgaaatctacttctatacaagtcaagagtcttaggatgatagtaaaaacatgttaataaattcttttttgtcaaactttaatgcagatgcttagcattaaaaaagctgacaaaacaatatgattttaagagctcaacaattaaaatttattcattaaaaatcctgtaactcttcaaaatggttaaatgtactatttttgataagaatattttaataaattctatattaaatctataccacaaattttaaattgaattattgatatctaaggataaaagattaacagcctatctatgtgcaattttagaaaacaaatcctccccttccagatataaaaggaaaatgtttttacgaaaacatattgccatgtatagatctcagaactcacaaattactgtaaatgatggtttagaagacagaaaaataattaaatttcaaattttaagtggacatggtaatacattttgttaaaaattgcaaaaaaagttcaccttctccatgtaagcatcattaaccaaaacaaaccagaaaatccaaaaaaacacacaaaaaaagaaaaaaaaaccctctgaaatctgttatcaccacctaaaaactatatgtactctaaaagcaaaagtggcctaattaattctacattttatttctctttctccacctcctgtagttgaagatgtagggccatgagactattattgcttttagatcactttgttattgactattctctgtatgatcatttattttaaaggactgatgtaacatgtggtgttatatctgatgacatattgtggacattttcttccagaaatggctctttaaggctgagtgcaagaggttaagctgcctgactgaggccaaacctaagattacagatttttaatctaaattcttaatatccttattgaatataaattaacatttattttgtatgctacatatttccatttaatcacaagctcctgcatgttaaaacaataccctgaaaaaggaaaattaaaagtacttctgactttattaaaaaccaatttatattttataaagtcaggataattttaatgtggggaggagcatttcccccttaaccaatatatcttaattgactttcaaaaatcataaaataagtgaaattttataaaaatttatagtatcaaatccaaaggaaattttcagtttttccaatttacttataagacttttacctaaactgaatcatagtcatatgcattgtatcaaaaaagcaaaaatgttttgttaagctctgataacaaaataatatagaataggaacgtatgaaaataatgtttattctctttttccatgagccatctatcataaccatcttcaaatcaaggctcagaaagtatctaggcaattggacatttattattatctttcccagttcatgatctcatgctaaaataccaggattgggcgaaaaccatgtatacacaacagaacctagaaacttatctggtttgtaaatgctgtcttcctgatattcatggatttaaggcatgcctcctggattcatttactcaaagctgaatgtgtcgcttaaaaggagacatatttaatctttgtactctgaaacaaagggtctatgttaagtaagttttgtatgtgtaacataattaataaatatacttgacaccataatttaataggactctatagtaactataaaaaaatttaacttctctttctggtatgaacaaccataaaatgtggtgttggaccattttacagtgccttgtaataatgaagttatgctcttcattaccaagtcctgtacctgctgctattggcaaggaatggtttatacactgaccatgttccacggctgtttttagtgtcgcttcaggatgtgtcgatcctagagggttacgcacaaatcgtcgccggcgccgcaagtcatcttcccagtagtcaaggcgccagaactcaagaggacgactacaatgaaacagagaagccacatatgttagcaattatcaaacagcgtggtagcactgaatttctgcataaagctctccttgtttgctctgcctttttttccctctccttccacttaattctccctccatctcacactcccctttctgcaatctttaacttaggtatgtccttgaaaataacaatatcaccttctagtctaaggaactccttttccttttcttggaaggtgaaatgagcactaaatacatcattttgaaatgaattgctgacagtgtgatcagtttccccacactctagtggcatgtgctctgatttcagcctcatttcagcctcagcagggcacctttctctgtagctgcatttataaaccagaatagggaaaaggctattataaatatggtatagcattacctatattaatcaaagtccgtcccccttcatttttcttcctaatttgtgcctttttgcacaaggtcagtaaatcataccatgaattcttggtccagaaagtgttaactttaatgaatatctcagttacatggttatgtatgtgataataaaatattactctgtttagatgtgcaggaatttaattaaaataatctcttaaaatattcattacatttagcccctgaggcttagaacaacacaagaaaatgcatttcttttccatttactgtttttaaataaaccattcctgtagagtgaaatagcaatctattttcaagcaaatcagattggatttctgttttatgtactctgtttttatatttaattaaaaactacatgctatatgatgtgcaataattgctatatcaaaagcatacttttggaaatgtattttttaaaaaaaggtttgctcatttcaaattctatatttcccctattacatacacattttatatggcaatatataaatgtcagctttctctcttgttaactaatcatgatctagcatgctggaaaaatattttataaggaaaatactaaagtgttttcagttatagtaagaaaaaagtctctgtagaatacattaattcaataaagatatacagcaggaacacctgtaagtttcaataatgaaattaaaaaattattcataatcaaaacttcttcaggaatgactaatacaaaatacaatcttacttatatttcgggagctaataaaattgtatctgtcagctttgacaaattagtagtcttcaacaactgacagtcccaaactacccaagtaaaagttacctttattttgatgttttaaagatgttctctttaaaaattcaaaataggtttataaataagtacttttatcaattaaaaactatcttgtattaataaaaagcataaacagtacgttatttaaagaaaatctttttaaaacagtagagactgatctctgaaaatgctgaagggataagaacatcaaatatttccttgggtgattttggtcaggagaaggagatataatgtaatcaaaatgtaatacaaaaaaagtataagaattgcagttctcaaaaagaaaaatttaaaaagctattattatatatttcttcattattctgtctaaatttgaataaaaacatgatgatattatttaaaaataaataaatacccacagaatatacatacaatcaaaagacaacagttgttttaactcaattaataaaatgaaattctccttaggtgagaaggaaaaaggcagtacacagatggctgtgtgtatggctttgatagtcatggagcttggataggcacttcatcattctgcctacctacatttatctgttaaaattattatcaaatatcagccaggatgcagtcgtgaatcacaggctgctcctcgccttcaggggaatgatacaatgagggtctattcatcagtgcggcaatcggcacaagtaattagttccctagactgagatctcctacaaagcctatttcagtcagcaccacaaacatatgacgatgtaaagctaatgaaagctgctcaaatttgttaaccttttctgccatctatccttctaatactctatgcttcagtattatgcaaaggtagtaaattattaatttgtcattcatccatccttctacattttgagtcaaattaaatgatgtcattcttcttgataacaattaaaattataagagatgttaagctgctatgataaaattatgactaaattaggtaacaatagattctactataatgcaccacagtgaagtcaaattcaatggctattaagcatatgcacaataacttttatcacacagcagaaaaaccagaggaattataaaattattcacaaattatcaagtaactcaaagataatatctatagcaaaaataaccaaaattaggaggaaataaaacgataatatttatttttataccttgacactaaaaaaaatggtcaaaatggtgacatttggctaaaacaaaaacaccaatgcatcagggaactgagaatttgttcacataatagaaatgaaagttgtttcatttctgctaactatatatatatatgcagacatacatactgtcttcaaatatattctatcaatttttttttctttttgagttggagtctcgctctgtcacccaggctggagtgcagtggcactatctctgctcactgcaagctccttttcctgggttcacaccattctcctgcctcagcctcccgagtacctgggactacaggcgcctgccaccatgcccggctaattttttgtgtttttagtagagacagggtttcaccatattagccaggatggtcttgatctcctgacctcatgatccgcccgcctcggcctcccaaagtgctgggattacaagtgtgagccaccgcacccggcctattctatcaataatttttttaaatacttaaacatggtccaaatagaataaacgacctgtaataccacagcatgataatatttacaatctcctgaagctatgtcacttaaggactatttttccaacacaatccagttacaacacaattaaaaacaatctgaagacaaagcaaatatcacttagttcagatcacatatctagaaagaattataaaaatcatttcaaaagaccaacaatttcaatatattttttgagagtctcttcatataaagcactgctccaggtgctacagtgtacaaagttctcatgtaatagacttataatcaaacagttagctattagtctcatttgagaaaatagcatttatcacccaatttcagattgtgtaggtaatacatgtttttggagaaaaagccacacacccacttatttgagatatatttaaagtcatttaaatatatttaataactagcatatttaaagtcatttacacagtaacaaacctgggcctaaagtacaatgttttgtttccctaagtctgctccctccaacaacacatactctcagtataacgctctaccacacacacacacaaaaatgaggccggctttgtcattttaaaacagtattataaaggagaatgtgtaggttttggtcttcaacttactttcttcactctcatttaagaaatactgttccctaccccgtcccttcctcaaaagcctcttccaggcaaaagaggatacaaaattggcaaatttattaataacatagtgatccaaccctcttcccaaaaggttataaagtaattaaaagattatacatttttgtagttatcaccatggtacgatcagcaaaatttaaaagacttcatgtgttcagaaacagactgttgaccaaatataagcatggataagatcagaaatcacttattctggcaccttataagtacatatctagatcacattatatacctatacctttatatatctgtatctatccccaaaagttatattaatactacacaacaccctttcacaaacttcactcatatccatttccactaagatcctcaaaatcttcaaagtaaagaggttagcctaagttttagatctggaaatactatttccttcagaagacataagcccttctctacaaagatgccctacttagggctcctcttaggacacaatctccaggtactaaagtctttgactggtggaacatatgtctttaaaaagttatggatggcactgaagttaaatattataatctttctaattattttttaatttagttttttcgttctttggtctaacttcagagtctgaagttaaaattaccatgtaagtctattggacttttctacatatacgtcatctaattatgtttctactttttaaaaaactttcacgttatgtgtttgtatacacacacctttaatacatcactataatctacataaaataacataaagcaatgtcatggcttttttgtggttgttgttgttttttaagatggtagagtgtcacccaggctggaatgcagtggcaacatgagggaacagaacaaagctcactgcagcctctaacttttgggctcaaaagattctcctgcctcatcctccccagtaactgagacatcctccccagtacaaaaattagtaatctggctaattttttttattttcttagagatgggatcttgctacattgcccaggctggtttcgaactcttggcctcaaatgatcctcctccttgagcctcctgagtagctgggattacagacacaagccactgagcttggctggcaatgccattttaatacatagaatatatgttttatgttctacaagaacagaatttgatagattattaaatttttagaaagaaatataactcaaacatcaatagataggctatttattctatttcctaggccctttatggttactgatttgatcaggtagaacaaatgaataagaattaaacaaatgagaatcatttggaagaggcagaagtattaaaacaaaatcaacaactaaggtacgattcacatttttcctctaatagttaaatgatacaactatacaaatttgactattatttttctcatgttaattgtaagaatttttaggctgggcactgtggctaatgcctgtaatcctagaactcagggaggctaaggaaggaaaactgcttgaggtcaggagttcaagaccagcctgggcaacatagcaagaccctggttcaaaaaaaaaaaattagacaggtgaggtggtgcatgtctgtagttctagcttcttgggaggctaaggtgggaaggtttcttgagcccataagttggaggttgctgtgagctctgatgatggcaatgaactctagcctggctgacagagggagagactatctccaaaaaaaaaaaggaattataaagtttagattttttgaaacccaattagccagttaacatggtatgaatggccaaatattctaataaaataccaatatattttctaataacaattatttattatttacctgagtcagctgtggcaatacaaggattattacaatgttgtccctgatgtcatggaaaaggcagatgcaaaaacaaataataagaattcaaaaaagtatgtgtaacagaacagagctttactacatggctattaaggtgcacaactccagggggcacttttcacatcaaaatttttgtaaataacatgccctggagttatgcaatgctcactgtacattactatatgccacagcccaagtgctaggagaatactacctttacccacacatcccccagttcccctgccccacaattcaatgctcaggctcctttctttctctggaatccaaaagttaaatctaaacttgggaacaggaaacagaacaaagcccttcagacactatcagtggcagttgcacagtcagtatttccctgctgtaggaaaaagtggacatattaggaagatgcttggttgtcaaaacacaagcaaaattcaataaaaagaatgaaataattaagtacataagagaaatattaacatttatttaaccaaaaaccattaagttcgcattgctatattaaagtagataactttctggatattgctgtattaaagcagagtagtttccagaacaatgttaattactgaaatcagtggtagctatgtaagtatcccagttattctacaacctagatgaattggcacctattatcaaatgagtcaaatgtattcatgtctatcatctcactggttttagtgtcattttaatgtaacttaaatatgtcaataaaagtatatgagttttaaaaagaaaacctgtcaaaacacaatcatattagaaaattttcccattttccatctcgcccactttgctttggcaatacctgataaatcttgataaccttaacagaagtcagtaagaaattctcctagctaaagttccaaatcctagaacattttagcacttcatattttgttcttaaattttcacattgcctgttttttaaactcctatatctgactagcttctatttccatatttttagattaaaaattcatagtagacattagttacaactgaaataaatggtaacccctaaaaagcagtaaacattttcagagcactgtcagcttgaagataaaaagcacttaagttctagaaaggtttcacattctgtataaatcttggtgaaataatgttcaggtactataggtatcatacaatataagagaatgctttacctcacaaactgaaatctatggtgccttcatgcaaataaaaagaaaattaactaaaacctctgtttaccaagtaccaactataaatcaagggcagctgatctatgcattatgctgtcttaatgaaaaggacaaacaaaaacaaaaacaaacccttcaattgtgtggattccagcagagaagacacatactaaagcagaattctttctttattgaggcctgacattgagacactggagtatcatatattttatttaattatgtaaaatcaaattttatgtaattaggaatttctgcatgtcactattcaatgtatgtctgtatttgttttttaaagccatctagatatccatcttcaattaattattagtttggacatttggcaaccaagttaattattcaagaaatgatcccaagcttttcctgtctgttgttagccagttgaccatttctttcttcacttagaatttttaccagggattgagtaaagttatgagactatcaaaatctggtgttatactaccagttaaagctctaacaaaagacatctaggaaaaaaaaccattaaaatgatgttattaagaaccagaagccttaaagctcacctcagcctcactatttagacaaatctattatactgtccccaaatatctaatttaaaaaaattcaccaaacacttgttgagtgccaactatgtaccagattgtggtacatacaaatgaatgatgctgggctcaacctacacaggacaatggggacaaggaaattattaaatataaaaaaaataagttaaaatagactatattactttaggctactctgtgctacacactgttctctgttatatacagtaccgccaagcctcaacaaccctgccatgattaaatactgctattctcattttaaaggtgacgaaagtaagttttacccattggtagtaaataataagtctgatgacgtctaagccaatgagcttttcactacatagcatttcctcttgaacatcttattcgttactattatagctatgatcaaagtactaattaaccctgcctgggaggactcaggatttcattaagatttcaatgaggatctattttgtaagttacatgaagagaagggtttatgcgtaattcactgaccaagcacagtaactgttacaaaactgccacttaataaataattgatcaaagagtaaaccgatgacttttaaacagaaacttaaatgataaacaggagtctgctgaacaaaatggaaaaggcactataagccaagaaatagcatggataaaggcatggaaatgtaaaagggctctgtaatttaaggaagttttggtaagaaatcacagctagacagccttaggatgggaaaagctaaggtaaaaaacataggtttagaaccagatttcaaaagaccttgtagagttaactaaagtaactacctgtacatcctagagtctacagagacagcatcaggctttcacaagaggtttaatatgatcaggcttgtatgctacacggcagcaacatacagaatgtctggattaaggcagtgaggatggagcctagaagtgaagggtttaaagacatatctgaggtagaatagataagacttcacatgatattcaaatatgggaggtgaggaaaaagataatgagaataaaatcaagggctgtaacaagagggaagttagaagataaagatgctatttaattaaaataaatacaggttaaacaggcctgactgggaaaaataatcgcatcctagatgcctaataacatccaggcaggtatttctaataggtaagtaatataacactggaattgaaagagaagaggcctgtgctagagatttaaaatagggagattgaccaggcatggtggttcaggcctgtaatcctagcactttgggaggctgagacaggtggatcacttgagccgtggagttcaagaccagcctggccaacatggcgaaaccctctctctacaaaagatacaaaaattaggcagacacggtggctcacacctgtaatcccagcactttgggaggctgaggcgggcggatcacgaggtcaggagtttgagaccagcctggccaacgtggtgaaaccccgtctctactaaaaatacaaaaattatccaggcatggtggcatgtgcctgtaatctcagctacttgggaggctgaggcaggagaattgcttgaacctgggaggcagaagttgcagtgagccaagatcgcgccactgcactccagcctgggtgacagagaaagactccgtctcaggaagaaaaaagaaaagatacaaaaattagccaggtgtggtggtgcacgcctgtagtcccagctacttgggaagcagaggtgggagcgtcacctgagcccaagaggttgaggttgcagtgagctgaaattgtgccactgcactccagcccaggtaacagagtgagatcctgtctcaaaaaatatataagaaaatagggagactggttagtcttgggagtcagtagatttagcattcatttaacaaaaatgtactgagtgtttattgtaagcctgggtattttgctagacccagagaagagtctattgaaagggcaggagaaagatggggatgaatattgcagaacagaaaaggatcagtaaaagaaacagggaagtaacagtgccttacagtcaataagataatgggagaaccaaaatagaacggtgccaaaaaagacaaatgagcaaaaatgtttcaaagcagtcagcgggcaccattatttaattctgcttaaacatgctcaaaaggatgaaaaatgaagagaagtctttgttcatgttttgtgtttttaacagctttatgatatataatgtatacaccataatgctcacccgtttaaaatgtacaattcaacgttttttagtatatttacagagttgtacaatcatcaccatgatctaatttaaaaacatttttatcaccccaaaatgaaactccatacccattacccgtcattccacatcttcccttcctcccagcccctggcaatgatgagcctaccttctttctcaacatatttacctattctggacattttatataaatggaatccatacaatatgtagaattgtgtgactggcttctttcactcagcataatgtttttgaggttcatctatgttgtagcacatattggtagctcattctttttattactgaatgatatttcattgtgtagatacgctgcattttgattatccattcatgtactgatgaacacttgagttgtttccattttgtggggatctttgggttttacgatgagaaaactgaagtacttggttagctatctagcattcacttctctcctctttcctaataactgaattacaattttgttcagatatctatcactttttaaatgtttctctgactcatggaaagctgaccaaattatgataaatccggtcattctcagcagcgattggttcaggaatccagctttaagaggatcactgcataaattctgcctagcaaccacttttcaccaatatgaaatggaaaccttctattcagtggttgagacaagagttctttctttttcctgatggtctgacacaatgaaacatgtagatccagttgctggcagtcataaggcatccatgagagaagccagattggaaatagtttatacatccggggacagagaactgaaagagttacaggaaaatggagccagaagcctgccccaaagcctatacatatctgtacttcttataagagatattatacttcttcataatctagtgaagtcaggaagttcacttggtgcaagatttcttattacttgcctttgaaaccacctaacagatacatggattactggtgatgctgtgagcaatttgattacagtggctggaaggaaaagtagagagtaaaacacttatgctttggtggcaatggttaatattgatctcctcttcaaaaattttgacgatgaaaggaattagagagctaggatggcggtttaaagaaggtaaagaacagacttaagcatgtttgcagaaggaaaagacaaagtccaaagaattcaaagaagctgaagatggcattgggggtaggaggtgggtagcaggagcagggtttgataaagacagaagaggtatgatcccataaaaagataacatgatgaacttggaagtaactaaggtcatctctttctttgtggcaaaatccaaggatgtaagactctgtactttaataaattcagggctgaagagaagaaaaactaaagaccagattttcacctgattgtttgttttttttctattacgtagcatatttttgactaaagaaaagaatagaggaggtaaaattagaagaggtgccttggggaatacagaagaaagctgacaaaggaaaagtttaaggatgattaaatagcttatgaaggtccagctgagtttggaaaccattgaggtagcatcgatctgcagaactgtgtgatttttcctataccctgaccctgaccatacatagtaacctgggagaaagagtaaaaagagcagctgaggccaggtgtggtggctcacgcctataatcccagcactttgggaggccgaggtgggtgaatcacgaggtcaggagttcgagaccatcctggccaacatggcgaaaactcgtctctactaaagacataaaaaattatctgggcgtggtggtgtgtgcctgtaatcccagctacacgggagactgaggcaggagaatcgcttgaacctgggaggcagaggttgcagtgagctgagattacaccactgcactccagcctgggcgacagggtgagactcccatcacaaaaaaacaaacaaacaaacaaacaaacaaaaaacaaagcagttgaccagactcattcaagatttaggactgatttggttggcagaccaaaataaggaaggttaaggaaaatgagtaggctagtaagaacgcctgggatgactatgggtgataaatccatgatctttctggactttaataaaataaataacataggctttatagacattgactcattgggaaatcaaatttatcctgcatcccaagctacttatattgatgataattaatcaatataactggcttatgatgcagtataaatttgattttccaatgaaacaatcagtaattctatttaatcaatatatccagtccccttatttactgctgctatgttttcaacttgtactaaaacacatatagaataaaagaatggaagattatactgtacttgaagactttcttcagtcttcaaaatgataggatcactagccaggagatgaggatagggaggagaaggttgttgtaaataatcatgggactgaacaatctatacgcagagaccatctgaaggcttagggaggcaggacctcactcttttaagaagtatattacattatgctcctggaaagaggatgggaactaaaatttactgactgccaataatgtattaggcatgctagtacgtattttacatgtgatctcatttaattctcaaaacaaccatataaattagagatataacacctatttaacagttgaagaattgaggcccagaaggtgagtgattcagttactaagaaatagcgctagaccctcccaactagaactacccattaccaaaaattttccaggctactttggctaagacattcatatgaggttcattaatatacttcttatgacagttcattatattggtatgagtttaaatatctctttcataaagtgacagatataactataaacaaaaaattttataaattatatgaaaacctatcaacacacatttcaataaagaataactagaaaattcataatttttccagcattagcatcactcaaaattcaaatagcaaggctattagactaagggtaaggagttacaaggctctatcgcttttcaatgtataagtataactaagtactgtgtagtgcagggtcagtatttgtaagtaagtagcctgaaagctattaatattcagaaatatgtttagtaaccacatcacttgccccaaatttggaagaactacataagcatctacatgaagcaatctcatatccaagaaccactgctttggcatacagaacctttatttctacgcgctctctctctctctttctctctctctaagacaaggcctcactctgttgctcaggctggagtgcagtggcacaatcacggttcactgcaacttcaacatcgcaggctcaggtgatcctcccacctcagcctcctgagtagctgggactacaggcacaagccaccatgccaggggaatttttgcattttttgtagagatggggtttcgcccctttgcccaggctgtatttctctcaaagtcaagtcctataccacatttgttgctgttcttcttaagatactttgtaagtaacaggaagacaagaaaagaacaaaaaaaaagtcaccctccatagcataacatttttatctttaaataattttttaaagtttacatgaagaaaaaccctgcataatccatcacttcctctttttaaaccaaaactctcaggaaaatactgagagtaaataactgattttaactaacataaaagaaaaatatatatactgtactttgcaacctggataaattaaagcgttagcaaaaggtatgtgctttttatccactggggaaaacaaggcttattatgttacacttccaggtttttaagacagttggaagccggttctctgaatagttgctgtcatctcctagatactttctagtactttcaattttgaagcaattatttacattctaaagtgatttattttcctctctttctttgctacatttcatttcttctggttctcaatgaccatctctactttggcttaattatattcatttacaaatattttctgagtacctgctaccgtgtggaaagaactggttgaggtgccttaagaaatactcatatgaagaaaacacaagtctctaatctcaaggcacttaaaatctaataaatgggataaaataagcaaacaaaaaattatatgacataaaatccacaccataagaaaagtaaaaacccagagtgatagaaaggcaaagagtaatcacatttgttttaaagggaccaagaagctttaaagagcaagagatttttgagaaatacccttaagaagaggccaattttcaattgatacacaaagaagacgatgacattttaggcttttaggagatcttaagtaaaagtatagaggtctgaaaattggaagcagtctcatttagccggtccaatagaaaatgagatatgaaagataagttagagccataacataaaaaatcaggaatgaaaaactaataagcttatatttcactcatttactcacttgttcatttaatcaaaaacacatactgaataccaacaatgagtaaagacaggagattcggtcatttggtgatagaaagtcattattctcaaggtcctcaaaatccaataagagaaacagatatatgaagagataattacaatatatgcaaaaggtaccttagggacacagttgaagggcattatccaaagtaatagaagccttcttagaagtgagtaatccacaaattgagtcaaagagttaacagatgttaaccagaataagaaaaggaaaatcattctttctgagggaacagcattagcaaagccaaacaagtaagaaacaattgggtataagctaaagttaaatgtttccagaatttttggagcggcataaagcaagaagtgcccaaacaagaggctatagagggcaggggccagatcatgaagaatcattttaggagtctggctcctggtttaaaacctatgtgtgatttttttcaggccttaccatgggtagttacaaaacctttacctggcaggcctcacagagaaaagctgtactccccacatcagacttgatgtacagcgaatgctttgcatctctggcgggagttgcagctaaggtcttaggcctctctggccagttatgctctttgcacatttacattcctagccctgatgaattgattcttgggtctgtatctgaaaccttggcctaagatcctctccaggcatctcttcctagaactccttacttggagaggaagggaaaactctgaagacagtattccctactctgattcagcctgttccaagaccaccccgctagcccttcctctgacctcgtgtccataaaactaccagagtctttagtttcaagtttcttcaacaataagatgactctcacatctgcgcagatccacactaacccttgaaaagcatgccattctatggcgggaaatggaatggggagtcaaccccttccttcggatttagactcttgctaataccatcatagttaatgattaaaggcttaccctttcatttttggcttgttactttaattggctactcctacacctgacagttcaactctcccagctcagcttaggccatggccatgtcatgttaaggagcttgggttttaccctatagcaatggggagatattgaagagttttaagtaggtattataactgcagataaatagaaaattagactatagggaagaaatatcttaaatatcactttcacaagaaagtggaaaaaaaagtaagaaagttattggaataaacaacatgtaatgagagccttcaatactaatttttaaatttctatttttcagatttatcctatcaaggttttattgaaacttgcctaaaattgtctatgatacaaggtaggcaataaatataaatgaataagggtatgaaagaaaagctcaagcatacagccattttgttcacaacaaaatagtttccaaaccatgtgatgtacaaagttaattaaatgttacatggaaaaagtagacctataattgaagtagagatcaaagtcctaaagctaagtgtagagatgaaaaaagaacataggaaaggtccaataggtgatatatcacctcagcccagaaaggacatacatgtaatctactcacattccactcatctccctaagtcatgtaacactgcaaaagcaatgtgttccctggctgggtagccatttcccagcaaaactttaaactatacaaagaggcatgaaactatggttatcagctggccatatctgtgacagatgacaataagtaccaaagacaaaacagaaaaaagggacagaaaatacaagggaggtaatagggaacatgttaacatctcaagtaagatgcttagaaataattttctgaaagcaacctttgagcaaagacttgaaggaggtgaaggtgtcagttatgcagatatcttaaagcaaaaggatttccggcagggaaaacagtaatgcaaaggccctgaggcagacacacttggtgaaatgatggaatgtaggaggccattttggatacataaagaataacagagttaagtagaaatcaaatagtttctaagagggccaaatcatttaagtcttcataggttataacaagaatttgacttttattctctgtggaatgagacattagaagattataagcaaagaattgatgagacctgacatgttttaacgtgatcactccagctcctgcaagagcctggctgtgagtggaaagagtgtccagtttataggcttttgcaataatccaggagagagagacgatgtctgggaacaaatagcagcagtggaagtagtaaaaagtcattgaattatggatatatattgaaggttgagtcaaaagaatatgctaacagatcatatatgggatgtgagagaagaggaggcactgatattacaagtactttgatctgagaaaataaaagaactgaccctgagaaaaaagagaatgtgagaggaataggttttaataaagaaagtctaaaatttggttttaaacatgttttattcagggtgcctattagaaatctggggcagaaaagggctaactatttgccaaatcccttttcatcttcttcttaggcacacaactagaccatatttcccaatctcctttgcaattaagtatggcaatatgactgagttgtagccagtgacatgcaagcagaagtgattgaggcacacttccaaacccggccaataaaactttccacatacaactggccatgctctaccaccttccactgttttgatgcagatgaatggggcactcttggaagccaagaactaaggataatggagctataagatgaaggaaattatccaccagaaacatgttataaaatttatatgaaacagaaattatgttctattatgatcggacactgactgagatttggaatctatccactaaagcagttaccactgcccaaactaacacagatatccaagctgagatattcagtaaacaactgaatataagagtgtggagttcaaaggaaagaacctgacaggatatataattcgagagacattgatgactagtgtttacataatacaggtgtggactggctcagactttcaagcaagtgaccaaagctggagaagaaaatggaaaagtaaaagtacaaagagtaaggcctgtaccagctcaacaataaagagattgaaaagacgaggaagaaccagcaaggaattttgaagagaggccagtagtaagaggaacacctgtttactcatctcatattggcagtaagaagaaaacaagaaaaatacagtgtcccagaaaccaaatgaaaaaaatgtgtcaaggagaaggtagtaatcaaccatatcaaagggtatcaaaaagtcaagtaagaagaaaactgagacttgactattggatttatttatttatttatttaaagactagtcaatgactattggatttaacaatattgatgtctctggtgaccttgaaaagaacagcttcagtatatggtgggaaaagagcttgagtgaagcaagttcaagagagaataggagaagagaaactcagcaagtagaaataaatctttcagttattcaactgtagtacagaagtcacttaaattatatactggatttagtacattataaacatttgggggggaaagcatgaatgcaaataatccaccaaatggtactttacaaatgccatagaattttacaacataaagagattctagtagaccctgacacatcgtaagaatacactagatatagagaaatataatttgaaaagataaaaagtcaaaatcacaaagcctgcaaacttctaagggcttattcatgttcagttcattaacctgcaaaggcaagtttagtacattttgtcagcaagcttgtcaactagggtttatacttcaaatactgacactcaagtatcaatattcaactttgaggagaatcaaaaagttaagagaaagattaagaaaaaatggttcctgaaaaaaaattcattgatgggagctgaaatagctctaacaagcagcaatactatctatgttaatttcaagaactaaaatatgaactatctcaaaaaacctcataaagaaacaaatatgatttaacgataaaacacttaatctagacatttaaaatgaataatctggacatttaatctagacatttaaaatctagacttttaaaatgaataacaagtagcgctggctggacactggcctcacgcctgtaatcccagcactttgggaggccaaggtgggcagatcacctgaggtcaggagtttgggaccaggctggccaacatggtgaaaccctgtctctactaaaaattcaaaaattagctgggcatggtggcaggcgcctgtaatcccagctactccagaggctgaggcaggagaatcgcttgaacccgagaggcggaggttgcagtgagcagagattgcaccattgtactccagcctgggcaacaagaatgagacttcgtctcaaaaaaaaaaaatggctctatcaattcaaacaacttaatgtctatgtgagagctttcctatattccgcctgaggtacacagaagccatataggctacgcatcaattttcttttaccagttcattgctatagccactaaacctcgtctattaatcacaaagacacattaaaatgcactgttcggctaagcacagtggctcatgactgaaatcccagcactttgggaggccaaggtgggccagactgcttgagcccaggagttcaacaccaacctgggcaacatggtgaaaccccatctctacaaaaaatacaaaaagctgagtgagatggtgcgagcctgtagtcccagccactcaggaggctgaggtgggaggatcgattgagcctggggaggttgaggctgcagtgaggcatgatcatcctactgcacatccagcctgggtgacagagcagagcaagatcctgtctcaaacaaaaaaaaaagaactcttagattctgatagtttctcttcttgcctttataatcacacagtataatcagcttctgcaaattactattgttgaaagtttacttttcattattctgcttcattcatttagttatatgtgctcggctagggatatagcatggggaaaacaaatgaagaccctgctctcatatcacttatactcttgtctatctgaaagactctctgtcccaaaaaggatcttgcatggaaaaaaagtcatcttttagtaaatgaggattatgcaggctaacaaaagcataaatgaaatgtaaaaatattccaaagggttcatgagattccctcaactttgtttatattaggaaacagaaaaattaagttatttgagttgtagctcttctctttcaactcctaatctttggaaacctggaatagttttttattttttaaagttaaaaaagtataaagccctaagtttagaaataatttatataaaaaattagttgcaccctctcaagaacaagccaatattttcagtgctaatctcttcaaacagcaataaactatattatgtcctagtcagttcattagttttactgcaaatatatgacaagtaagctttctggtctgctatagcattttctttagctacagaagtgttaaaaatgctgtttattttaattatgtagtaaattcacaataaacattatgtatacatatattatgtatatgtgtgtatgtatatatatatatatatatatatacacacatacacacacatatatatatcctaattcagcagttttaatcaaaagacaaatatgcacttaagtctactaaaagaaataatcatgttagagagagagaacaccaagaataacctctacattttaatttgctggagaaataaatgcagccatacctggaaaaaatgcattaaattttaaaagcaaagtcattatttctaagttttataagtttattatcaatgcaagtttaaaaagaaaataaaatcacagagaggtacatgtttaaataccttatggtttcattttacacttctcatatcaggatgaagtcttaaaagtaattcaaaaggaaaatgaaagtatttgcccagacgatagagtccatatgttcttcaatctggaaatccattgggaaaaaggcttgagtttttaaaaactgaattttgacaattggaagctgatgtggctttttttccctctccaggaagatttgagtcattctcagagggaatgaaatagacctttatcaagtattgcaaagcttaacacctgtttaactccaaattacttagaaaacatttagttagtcttcagaatctcaaaataagggttgttataaacacttttcctaacagtaagatgttttttaagtttagcaagaaggcgtatctacatattcaagtctgtttatatttcatattctacagatatcaaccatcttgtaacagtctatttgttattactatacagattcctatataattttgttattcctaagattataagtaggctgtaattaaataactagttgaacatccatcataccattaggctccacaactgagggcagtctggttcttccccactgtttgtatgaatcccaagcttctagcacaagaagaagcaactagtatgcacttaaataaagcccatcaaaatgataaatatgtaccctactctgatcattctttcatagatctaaaatgaagctaacatattcaaagttaaaatgagtttgctctcaaaatcaaggtagaaaatagactggagttcttacaggagcctcagttttacacaacatagcacaaattggataacttgtgctccactactaatgtataaaattcctaaatgaatgtaatttaactacaaaaaatttattgtattcctattatgtaaaaagaaatttgctaaactatactgacatattaaatacctagattaaaaacgttaatgtttcgttaatggatcaaaaattacatcagagttaaagtaactacaatagtgtatttttaaaaaaaacatttctcaaaacatatacaaatggccaacaaacatatgaaaaaatgctcaacatcactaatcatcacagaaatgcaaattaaaaccacaatgagataccaccctactcctgcaagaatggccattattaaaaagtcaaaaaacagtagatgttggcatggatgtggtgaaaagggaatgcatatactctgctggtgggaatgtaaattaatacaacctctatggaaaactgtttggaaatttcttaaagaattaaaagtaggtctaccattcaatcaagcaatcacactactgggtatctatctgaagggaaatcagtcattacatcaaaaagacatctgcaagcatatgtttattgcagcacaattcacagctgcaaagatacggaatcaacctaagtgcccatcgaacaatgaatggataaagaaaatgtggtatgtatacaccatggaatactactcagccataaaaaagaatgaaataatgtcttttgcaacaacttggatggaggtgtaggccattattctaagagaagtaactgaggaatggaaaaccaaataccacatattctcacttataagtgggagctaagctacgagtacacaagggcacacagagtgatataatggactatggggactcagaaggggtaggaccagtggagaggcaaggaataacaacctccatattgggtacaatgtacactacttgggtgactagtgcactaaaatctcagacttcacctctatacaattcatccatgtaaccacttgtactccaaaagttgttgaaatgaaaaaaaaacttagagccacatattagttttgaaatttttttggagaaatttaattgtactctgctgtttgataaaaagtgctcaccagcaatcttatgttctggctcctttgcctccaacttctttcccttcttcggaaaaaaaaaaatgcaataaaataaaggataaagagtgcaaaagattttttaataagaactctcagtaaaagcaattgcatgaaaatggaaattactggcagtaagtggtctccaaacatctgctttgaaagatattttttataatgattcaaatgctctttttatacatgatctcccttatcatttaagctaatttttttaacttttaggagttgtatttttaaaaactgtgggcttcctatttttctttattcctcaacaaatgtttgtatattgtaagttgtgctctcatacatacttgttaaaaagcttaattatgtcactacataatagtactataaaagcaacacagtgtgaaaaacagcactagagtactagttagagcactagttagaacagcactagttctgattttataattaaatacctgttggatctttagcaaactcatataacctacttgggtctcagtctccttttcaataaaataaatgagctgaattaaataatctttacctccctaacaccttaaaagtgctaccattttgatatactacttaaaaaatatatttcatttttagttatactccatacacttgcctgtatgttcaaaatcattacttccagttcctcagaaatctcaaaaaatactgctgaaggaaatggaattaatttttactttcctattatgtatttctcttgggagtaaggaggacagaatgcaataaaatacaactatttgtgcagttgtgcgatgtcttagcttgtactgagggcaatgctgtatgcacccttttgatcaatgtaaagaaggtctagcatagataaacttccctacatggaaaccaaaacagttgggttgactttttctttctccttgccacctaaaactgtgggacatactagagatgaagaagtaagggtaaattaaacttttgtaagcatacaggaaagcaagcagcagcatgtttatttttctttaccctgttgaatgtcatgggctagaaagacactgaagttgtgaaggaagggaggcaacatgtttaaaaactcaataccaagttttataatgcaatggcctgtttagaatatttaaagatatggacatgagatgtactgagcacatgaaaataagtagaccatcaaaagagcagaaattatgaggaatttctaaaagacagatcatgtgtaactccagcactttgggaggctgaggcagaaggatcacttgagcctagaaggtcaagaccagtctaggcaatatatcaagatcccatctctacaaaagttataaaaagtagccacaatggtggcacattcttgtagtcccagttacttgagaggctaaagcaggaggatcattgtgcccaagagtttcatgctgcagtgagctacaattgtgccactgcacaccagcctgagcaacagaggaagaccctgtctataaaaaagaaaagaaatctagtaggatcaactggaaggtaaaatcccagacacatggaagataagtactcttccgggggaaaatgcgggagcttcagcctaaaggcaacagatggaaacggtgggtgaagacaacagtcacctaaatcaatcttttttttttttttttttttttttttttgagacggagtcttgctctttcaccaggccggagtgcagtggcactatctcggctcactgcaagctccgcctcctgggttcaggccattctcctgcctcagcctcctgagtagctgggactacaggcgcccgccaccgcgcccagctaatttgttgtatttttagtagagatggggtttcaccgtgttagccaggatggtctcgatctcctgacctcgtgatccacccgcctcggcctcccaaagtgttgggattacaggcgtgagccaccgcgcccggccaacaatcttaaggctgatttcctctctccccttcccttacttctgctgggctgcaagcaagattgcccacccttggctaaaggcatatgtactcttggattagaagaagggcagattcctagctagctactgatgaccaaaaagaataggaagcactgctggtagaagaccattactgacaaatctttcctggcggtacattcaaaccttgccccacaagggcattctgacagtatttaacaaaatttgtattgcaaataactccttttgacttagtgacttcacttctaggtatgtatcctaatagaaatgctcacacatattcattcagaaagatgaatctgacaagattgcagcacctctaaataaagaaaaattagaagccagctaaatgtccaccagtagaaaagctaaaataaactatatattttcatactattaaatagtatatgcctgttaaaaaataatgaggtagatatacataaaatagcattgaatataagaaaaaagttagtagctaatatactatacacagcatagccacatttatatttttaaaatagtgtgtttataaatgcaaaagaggaaaccagaagactatacatcaaactatttacctcctcaccactaggagactttctgggtagggataagtactaaagagaattttcacataataattgaatattttacaatgagaatgcatttctatataccccttatacttgaaaaagaaaaaaaaatcttgccaatttgaatcgtgaactgagaagaatgttccccacctagataagaaaattttatacaatttatctaacaaaaattttaaaataatatccacagcactctattttttattttatgttattattattatactttaagttttagggtacatgtgcacaatgtgcaggttagttacatatgtatacatgtgccatgctggtgtgccacagcactctattaactttagtatgttatagataactgaactaccctctaccacaacatacacataccaaaaaggtacaaactatatgaacagattacattattgttttcatttcgtaaacatattcaagtaaaatgtttttaaaatctatttctttttaaaatttaaatgtcattcatgcaaatacttgttttgtgacaactatgaactaactgcattctcatggtttcctagcacaataacaagaaatatacatgtttgaaaccctgactgttgctcaaacaatttgaattcagaatatgaaaatgcagtcattcactgcctttcctctgtataacaatgccaaaccctacctccctatcaaaaaaaaaaaaaaaattgaaacccaggctgggcaatggagtgagagactctgtctcaaaataaaaataaaaataaaaataaaatccccacaaacacaaacactattcccttttcactcatacaagggcttatgtgtttcccttctctaagttctgctttctcctgtcagaattctattctctcccttgtcactatatgaacaggaaaaacatatcaaacctaaagttatccaaagagaagaaaaatttctaccataatcttgaacaacaaatgtgtttaaatattgtttagtagaattttatactaatgtttatacatgtttataaactacacatatttatacaactaatgcgtatataaaaataaattttaattaaaactagataaaggaattaaaaatgtcagatccacaaaaaaagcatgtgatgtaaagcatatctttactcaattttgccactccacattgtatatatatttcaaaacattatattgtacataaatatgtacaacttttgtcaattaaaagtaattaaggtttttaaaatgtcaaacacattttttaacttacaagtttttagataacaaagaatacaataataattcaaacagatgatcctgaagtgattttcagaaagaaacactcattttatattggattgtttggctttttctatctatttataagagctctttgtagtcaaggaaaataactagaaaataggtttttggaagacacaaattgaaaaatgtatgttaatactttagaacaattaccaggagtaggaaatagtgggtgagaagtgctattactttagaacaattaccaggagtaggaaatagtgggtgagaagtgctatgtcaagtatggaatgtgtcgaaatctccagaagaggttttctaactataaaggccacttgatcccccacaatcaccttttgaaatctactacaagcaaatttaccaagagatatacatcatacaagtgaccagagtggaggcagtgtggatgccaactactgcttttagactacaggtgactgataaaataaagccgtatcttcaaagctttttcaaggagcaggcagaattatattttatctcaaatgagcaaaaagtaacatttttagaatagcagaaaatctccaagttatctaaaattatttgtaaaatattatatgcagctatgctcaatatcttaatctaacttgaaaacctgctccactgttcacaaacaatcttgggtttcacagaaagagatattataatttaacacagtgcctctcaatcttgcatgagcattagatttacctgggaagctttataaaaatattcatgcccaatcagcatctcttgtggtggaatcctggtaccgagattatatatatatatatatataattattattattttttttttgagacagtttcgctctttgttgcccaggctggagtgcagtggcgcaagctcagctcactgcaacctccacctcccgggttagagtgattctcctgtctcagcctgccgagtagctgggattacaggcacccaccaccacacccggctaatttttgtatttttagtagagacagggtttcgccatgttggccaggctggtcttgaactcctgacctcagccccccaaagtgctgagattacaggtgtgagccacagtccttggccggatatattttttttttttggaagctttccatgggattctaatgtctagccaggatgaaaaaacaattggattaatcaaacgaactggcctggatgctatatattcgtctttgatttttctatgctactgagcagctgtggaaacttgggtatttaacacaatattctgcatcttaattctctcactctgtagtatgaactgacctggcttaacatgatgcccagggatccttttggctttaaagttgtttgattagacccttcaaaactggcacctacatttaacatctaaaaagtgcttcaaataaaagttaaacctcataacatatatactaaaattttacagttaaggttttccacatttgcaaatcccatgtgcagaactgtatttatcaaaataagttttaatagcttgttattaagatgttgttactatgtgtttatcaatacaacattaattcctatgaaatcctatccttcactgaaaaatatgaagtcatcttcatactctaggggtacattttcagtatcacataccattaagagttattctttgtggtaacatatatcaagaaaaaaacaaaaaagaagagactgtagtttttatgtaaagggttttcatcaaaaccaataactaatttatagaaaaaaatggcactagactttagaaattaaatacatatgtaaagaagtattcatttaaaaagccatttttaacaaattaagatttcactgccacatattagataagatttaaattgcttctgtttaaacacttggaaatgggattaccattagaagagcaagaaaaccttaattccgtatcaaaaactttaattaaagctatataacttgtgattaattacttatatttgattcaaattgaaagacaatacattcttttttaaaagataatattctttttttaaaacagtaactcacttcttctaaaatcatacatacatcaagatggcaacacttatgttaatgtaaaataatcacctttcatttatcagaacatattggcaagggcaaatttttcagtcatatagttttgtaaaacaaaatgtaagtttatgctcaacatctcatattagccttaggaaaacaaatctgaaaaaaaactaaagcacattttaaagctacatacaagtcattttgggctgctcagtattcctggtcctatttcaacaaaacacaaaatgagagcctgactgtgtgctgaaaattaataagtatgcaaataataaaacttcaatataatattctaaggtactcctgactgtgtgctgaaaattaataagtatgcaaataacaaaacttcaatataatattctaaggtactttgacaaaaaaattctacaataaatgacatataacaaggcttaacttagttctatttttatggtataaatgttaaatcattattagtataaacacaagggtagttaatcttgaaaatattttctatagaacatcacttgaattttgaattattttcaaacatgactttaaaattaaggtcaaaattagcaatctaaaatactgtaattaaaagaaagcaaattcccaaaactaaatagaaagtatattcagccctcataagacatatgaaatatttacataataatatgtaagatatatttcttgttgcaacaaattatgcaaggttggaattagtcttgatgcaaaatgatattaccaattcttttcaaatattacagttcttacattccttttacatttccaaatcataagactacttaatagatgtaaaaatataaagtactggaatgtcttttttgccctaatatttaggaagaaaagagaattctaaggaataaaacattcagttaaaaatatgtttccccttctactttgaccctctttgaagtcaacttttcaaggtccattatcagatggaatgcagtagtaaagattttatgacactatactaaatttttattatttcattgagaaaaattgtaataataaaaaggattaagatctatttcctttttcgccatgttaagcttttaagctttttttgctttcatcaattccaatataccataaatcaaaagtattcttcttttaatcccaacagttgacaaaataatgcattttacacttgaatatgctcaaggaaaaaaattaacattctttatcatttcccaacagagacagttaatactctaaggccacattaatagaatctttctgccattgtagaaagtttgatagcactcctatttcaatgtctgaatttttctcctttttttgacaaagacaaatgattgccatcaatcaagatccaatcgggtatagagagagtcaggcaaatgcatcactctttactggttttcttgttatttgagcaggctttgctccatattattttatagaatgatcaaaaaacagccataagatagatcattcacacccactgtaaaattaactttcacgaataatgagttttaaacctcagataatgtatatgttataccaacgatattactgagttcattcctggctagagattatgtaaatgataccatatgacctttatcattacaacaggacatgcaaaacacatattatttcatacatcattttaaagcaagtcagtttctaaaggaaaaatcatcatttataatctgcatggtgaagtgttaaagttttgaaagaaagaagtatctctgaaccatgagtccttcttttaacctgttacttccattgaacataaggcaataaaacctactagttcaaaaagatgtacttgatttctgtatttctttgttgagctactgttaatgtcatttcaaaaactcatatcatgttggctaatcaacactaagttttaaatggataacaagtattaatatacacttctaagtcattcctctcaaaatttttgctgttgtttttgagaaagggtctctgtcacccaagcttgactgtagtggcttgatgatagctcagtgtagcctcaaactcttgggctcaaatgatcctcctgcctcatcccccaggcaactgggactacagctcaatgtcaccacagctgttttgtttttgtttttgttcttttgtagagaccagatctcactatattgcccaggctggtctcaaacttctggtctcaagcaatcctcctgcctcagcctcactacgtgctgagattacagttgtggtccactgcatccagcctcaaaatgtcaatgtaatgggttaaggaagtaaaggaaaacattccaatactgtttctttagaactatattctgccaatcttaaaatactaaaaatgtaagtataaactacaacggcccaccaattataaaatagctcctttttttaaaggtataggccaggaacagtggctcatgcctgtaatcccagcactctgggaggccaaagcaggtggatcacttgaggtcaggagttcgagaccagcctggccaacatggtgaaaccccacctctactaaaaatacaaaaattagcagggcatggtggcacatgcctgtagtcccagctacttgggaggctgaggcaggaagatcacttgaacccaggaggcgaaggttgcagtgagccaaggtcacactactgtactacagcctgggtggtgacagagcaagaccctgtgtaaacaaaataaaacaataaaaaggtatataaagaaatacatattgcaagccaggcatggtggctcacgcctgtaatcccagcactttgggaggccgagctgcatggattgcctgaagtcaggagttccagaccagcctggccaacatgatgaaactccatctctactaaaaatacaaaaaattagctacgcatggtggtgggcacctgtaatcccagctacttgtgaggctgaggcaagagaatcacttgaaccctggaggcggaggttgcagtagccaaggccacgacattgcactccagccagggcaacaagagcaaaactcagtatcaaaaaacaacaacaacaacaaaaacatattgcaaacccagctcccttctgttgtaattccacccccatcatgttgacacagttatccacagaatcacccaagcacaaagcctgtatatcatctttgaaccctccctctccttaagcttcttacaatgaactttcaattgttttttcctaaataattttcaatccatgcccactaccacagttctgccatatctcatgcctagtctactgttattataacacctatgatttcactattggcagtgtttttcttcttcaaatctataatcaaaaagaactaccagaatgatctatcctaaaaagatgtgttgacatcaatagtttactccacaaatttcaatagcactacatcccttacagcagcgatgcccaaaggggatacataacataattcatctggatgttggaagataattgcagagaaaaaagtcagaaattgagctttattaatatttaatatatagtttaattctggcatccttattcagtctgaatatcagtaatcatgtcatatgtgatatgcaattttctcatattaacacatactgtagtttatgtctacttaaacaggtttacagattacactgttttaaacaaatacagtatttagaatactttgcaataagataaaaagtgaccagaaattacctaataatggttgaatagtatgataatactcaattatcttaaaaagccaattattccaaatttgctaaacttttctgtggcagtgcactgcaacaagctctgaaacagctatttgaaaataaacacataaaatatatacctttaacataaaggtagcattttaactctaaggtaactaccttagaaaaacatactatggaaagagatgtttagaaatatttccatcattatgtgatttttgttgcctaaaactatcttaaccacctataaaaactcttaaatttgtattttaattaaaacaaattagaaacagtgtcataacctagtgtgtcaatgggttttgtacaaacataatgtctgtaaaaacattaaaatattaatacaaatatttgaagagaaccaagagttttgtaaagttagatagtccttaaaatattttctttggctttattttatcctttaatttctcctagaaatagtggcaatattcaacacttgctttaaagatttcagagtttagactattcttgatctttaaaaaaaaaaaagtaaatgcagagaggataatattatctatcttataaggtaatttaacaagatatatggacttagtaaagggatctctaactagtaacattaagttgctgctgctactactaccattcctaacatttttattagtatgtagtacaccaaaaaagggacttgtttctcggaatgagagtataaaacattaggagtaatttatgagaaaattggagtggaaggcatccaatttaggaacatgttaagttatataggaaaaattgatttatcattttgaagcaaaccacaagaccctctgcatgaatggcatatatgaaaatgttttaagatgagaataaattgtcttaaatttcgatatgtattacataatcaccttccaaaaatgtaccagcaatatactcttccatatgagaatgtgtatatcccaaatgtcattaacactgagttaatactggccttattaatctttaccaaacttacaggtgagggatatgaaagagaggagactgttgaatatgaatccaaggttttaagttagattccaatactgatgccattaataaaaacagaaaacaccggaaggaggagagacttgcaaacagagatgaatttagttgggacatgttgagtttgaggggccagaagtacatccacatggaaaaatcaaaaaggttctgaaaacagagatgtggaactaagaagagaggtaaagatcagagtgttgatttgagattcctgtatagaagtgatggttgggctgggcgtggtggctcaagcctataatcccagcactttgggaggccaaggcgggtagatcatttgaggtcgggagtgtgaaaccagcctggccaacatgttgaaaccccttctctactaaaaatacaaaaattagccaggcatggtggcaggcacctgtaatcccagctacttgggaggctgaggcaggagaattgcttgagcccaggaggcagaggttgcagtgagcagagatcatgccattgcactccagcctgggagacagagtgagactctgtctcaaggaaaaaaaaaaaaaaaagtgatggctgaggtgctagcagagattaggatcacaaaagaactaatttagaaaaagaaaaataccagcaacagaatttttctgggacaactctaaatagcagaattaggcaaaagcaagctccaaggacacaatgctcatcttgctaatccctgttacagtgatgcctggcaaagagccttgctcagagtaggtattcaataaaaacttgttgcatgcactatttaataattaataagagacagagtcatcagaacaaaagagaactagaagcaaacaagtcaaataagatttttttaaaaattagacaccattaggcttggtgctcccaaaaacattattcaaccacaatgaactactttccatcccatgggcttatcctagctctcctcctatctctctctcatgtgtactctctcatgttgcccctgtcctgtggcatcttccccaccaaccatgtttcaccctatctgcctgctaccaattatcatccaacaactaagtctcagcttagatgtcagctcctacaggtaattttgatctcagcaatttatacttgctgcatcatagcagttattcaactactttatcattgcctgtttatatttttccccctccaagtctataagctctgtagtttttatacctaatcatcttagccactaagttagagtttctttctaggccattccttttctcaccctatattctctcatcctatgatctcatccaaacttttggctataattacccacatgtatgtgaactccaaaatttatatacccagcgaaaatctccttttgagttctagagccatatatctaaatgtttacttgctatatagtttagcagttaagaacatgaaatcaaacacagtatttttaaattctgggtttgccagttattagctatgttattagctgtgtgaacaagacatttaacatctctgtacttcaactgccttacctataaaatgagaataacaataaaaagagaacctaattcataaggttgttgggcagattatataaaacaatatttaaagtgcttacaatagtgctttgcatataagaaatacttcttgagtgctaaatattgtaataatgttaattcagtgaaggcagtgattttcatttcttttgttcactgtctaatccccaaatctttagacaatggctgacacactactgaatagttgttgaataaatgaatgaataaatccatctcaatttcaacacagtcaaaaccaaattaatgaccttccccacaattagtccccttcaatgtgaaaggcatcgtagttcatccagttgtgcaagtctacacaatctttgttctacacactgcagtcagggggttctcagagcataacactaatcatgttccccatcctttccatcataaaatctttatggctccttattcctctttagaaaagcacccaatatggccataaggcctcgtgtaatctggctactatcaatatctccacagtacacacatccactcactatccacgttccagctatataacctttcttctggtccttgtactcaggcttcttgtttaaatacctctgctggtcggatgcggtggctcacacctgtaatcccagcactttgggaggccgaggtgggtggatcacctgaggtcaggagttcgagactagcctggccaacatagtgaaaccccatctctactaaaaatacaaaaattagttgggcgtggtggcgggtgcctgtaattccagttactcggatggctgagccaggaaaatcacctgaaaccaggaggcagaggttgcagtgaaccaagatcgcaccattgcactccagcctgggtgacaagagcaaaactccatctctgaatggagttttcccgtcttcatctagctacctcctactaactcttcaaattccaattgaattgttacttcaaagataacttaccagagctctttaactagatatcaattgaaggcattcatcattcagttttgtcattcttcatagcattttcacaacagtaaatttgtatctgttttataatattaatagctgtctctccttctggataatgaaatctatgtaaactgggaacatgtccacttctgtttattatgggagctctgaggcatagcatagtgactggcacataacaggtgaatattcactgactattcaatcaataagataaaagccaattaaatttttttatcttattcaatgaacaagataaaattcaagtaaccataggatttaaggaagcagtatgaatagggatgaagaaggtaactataaattcaattcatgacgtccatttgaacagtaataagctatcccacacaatactattgtgaaggatctgacactacctgttcatatatttcttctttgcattcttttttcagattccagaatatagtctcacctgtttttctccctcattttcctttctgaatcttggcttctgttctgcagtggacaggcatttgcaaacatacccctaaaggtggaggaagctaactgaccaaacaaagaggctgataaatacagtttctcagaaagaaacatttaatagggacttaaaacagaagccgtagtcttaagcagtcataagactctagagggtggatccctgcaccactgccccctagacccagggcgtatataccatagagaaagaatgtgtaggacaattgaagttgacctctcagggaaaggcaagcatgctatgtgaatctgcctaagcgggggatttatgatcaaggttgtttggacctggggcaggatttatggtaacaatagataaaagtagaaatcttagaggcatttccagaacagaggttaatcagaagtcaacatggcagattagcatccgagacggagtttctttagcctccacagcttctctacttttcctttcaaattctgctcctagattctaccataaggctgtttttcttacaaaccaggaatatcagcatgactcctgcaactaaaaccatcacctatgtgacaatggtaccaaatctcaactctttactccagatttttctcataagactgcgttttcaaactgtttaataacatttccattttgcttacccaaatatatgttaatgtgtcccaatattaaaaacagtatcctatttctaacttgttccttcttctatatttccataccactatcattattctctccaccattttccctctctgcctctaacacataacacccccaaccatctctcttcttcctaccagggtttgtctttcatctccacaggttttaaggcttgttgtatatgaacttgttaaattcttatggagagggcaaaccttatttctttttttattttgaaaatgtttcaaatttgtagaaaagtggaaaatggtaacatgatgccccattgacaacagatactttctataaacaaggactttgttctacataataataatataactgaaagtcaggaaactaaaactgatacattattaccttccgattttaagcaccactcaaattttactaattaccccagtaatccttatagcaagatgacacagctgagaatcatgtctggcattgagttattatgtctctttattctctaacaatctggcagaatagttctatagtctttcctgaaattttaagacactgacatttagatgattacaggtcaattattttgtagaatgtccctcaatttgggtttaactcatatttcttctacatttcttctacatgattagactcagactaggcactctgggcatatcacagagtgatactatgatcttcttaatagatatagcctaaaaggaagcacatggtttcagtttctctaattactaatgatgtccattttgatcacttgatgacatggtacctaccaagcttttttttttttttttttttacgtgaattactctttctccctttgtaattaatgaatattttttgaggaggtactttggaactatgcaaattttctgatcttcatcaaactttccatttgttcatttatttatattagtatgatcttctattttattcaacggattataatttattgctatctattagataatattatctattttgacgtttgactgttcactgatttggccagtgggattcttttcaagctgattctttttccttcttacatgtctccatcattctttgagcacttctttacattctagcacaaaaaggtgctatgagctcatcttatagtttccctgccacagtcctggaagtagccattgctccacagagccctggtttcaatggagaagatcaaggctttaggtgcattcattgctaccaggatgtcactattcccaggccccctcagtggacaaagctaggaaatatatccagctgggcacgatggctcatgcccgtaatcccagtactttattgcccagctggagtgcagtgacacaatcacgattcactgcagcctcagcctcctaggctcaagcgatccttctgcctcagcctcccaagtaattggcaccacagacatgcactactacacctggctaatttttaaattttgtataaagatgaagtattacttttgttgctcaggctggtctcaaacttctgaattcaagcaatcctccacctctgcctcccaaaatgctgggattacaggcgtgaactatcacacctggcttaagtttattttttgatgccaataatatgtctagaagggactagactaaaacattaacagtggcttggaaaggatggtgtgattaaaggtaattttttgttcttcttttcatcttacgtgtatttatattttctacagtaaaaatatattattctcataattatataataaatacctgtaggaagcatatggatctctgacattagtaatgaagttgaattattccttctaaaaaaaaaatctaagctttccacatcgtgttacagtggtacattggcaagtatcagtttgccacaaaaaactggggtttattttgggattatctgttctgttccattgatctatacagctatcctatactaatagcatggtgtcttaattactgtatctttaagttttggaattaggtagtgtatatactgaattttgttgtgctttttcaacattgtttcggctgttgtgacagacagctccaacatagcccgtaaatgctccctgcctcctagtgttcatggtcttgacaatccctccttgagtaatttgcttctaaccaatgaaatatggcaacatcaaggggatgtcactccaaaaattaggttacaaatgactgtgatgtccattttgctagatgactcctctctcttgatggctttgatgaagcaagtaagccaccatactggagaagtccctgtggcaaagaactcagggccttagtccaagagccctcaaaggattaaattctgacaacttcataagtgaacttgaaagtggatacttcccagttgagccttcagatgagaacccagcctgcggacaccttgactaaagccatatcagagatggtgggccagaggaaacagctaaatagtgcctggattcttgacccattgcactatgaaataataagtgcatgacgtgttaagctgttaagctttagagtgatttgtaacaaagcaacagattactaatgcagctcttctgggacctttgtatttccatttatcttttgggttccgactaccaatttctattaaaaaaattctgaaacttacataggggattatattgaatctatagatcagtttggggcatactagcatcctacattatactgcataatattctatttgtttacaatttctttaattattttttttttttgcaacctctgcctcctgggttcaagcaattctcctgcctcagcctcccgaaaagctgggattacaggcaagcaccgctatgcctggctaatgttatctttagtagagacaggttttcaccatgttggccaggctggtcttgaactcctgacctcgtgatccacccgcctcagcctaccaaagcgctgggattacaggcgtaagccaccacgcccggccaacttctttaattattatcaatttctctttaatttctctcagtaaagctttatagttttcagtgtaccaacattatacttcctggtattttattctttttgttggcttaaagatttctcacctatatttatgagggacctcatttacttttaacaataaaatgctattttcaagaacacaaaactggggttcagagaatacttaagaacacataaggacatgaacagacacttctcaaaagaagacatttatgcagccaaaaaacacatgaaaaaatgctcatcatcactggccatcagagaaatgcaaatcaaaaccacaatgagataccatctcacaccagttagaatggtgatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgcggcattattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaactatcgcaagaacaaaaaaccaaacactgcatattctcactcataggtgggaattgaacgatgagatcacacggacacaggaaggggaatatcacactctggggactgtggtggggtaggggaaggggggaggggggagggatagcattgggagataaacctaatgctagatgacgagttagtgggtgcagtgcaccagcatggcacatgtatacatatgtaactaacctgcacaatgtgcacatgtaccctaaaacttaaagtataataaaaaaaaaaaagaaaaaaaaaaacaaagaaaaaaaagaacacataagcaaaacgtgggaataatgagatctaaattaatctatctaaaaataatgcactttctaccccacccgtggtactcaacagattcagaactgttccctagagtgaataatagaaatctgcaaggaaagttttggttgtcacaaatgactgagtgctacaatgatttagtgggcagaaggagcaaaaaaaaaaaaaaaaaaaattctagacattccacaagaagaatagttcaataataataatggtcctagatcctacattactttagaatgttctactgtatatcagtgaaagtgacaaactagaagataatctgagcctatgccccaaatatatatatatatatatatatatatatatatatatatatatatatgtgtgtgtgtatatatatatatatgtgtgtgtgtgtgtatatatatatatatatatatatatatatatatatatatatatatatatatatttagatggagtttcgctcttgctgcccaggctggagtgtaatggtatgatctctgctcactgcaacctccccctcccgggttcaagcgattcttttgcctcagcctcccaagtagctgggattacaggtgcctgccaccatgcccaactaattttttgtatttttagtagagatgggatttcactatgttagccaggctggtcttgaactcctgacctaggcaatcgacccgccttggcctcccaaaatgctgggaatacaggcatgagccaccacgcccggccccaatttatttttaatttcaaaaaatgcaatcattgtgtaaagtaaggtaaaaatgaatgttgtctgcttagtactacaccagtatctattcaccacttagaaaaatcacattatagacaatcacacatcccttgtagcaggacaaatcatacatcatacctctatcagtctgatttgtacctgtcacattcacagtgacctatatataaatacaagcatccaattatgtcttttagcatagttatgttcgtacttatggaacaatgaaatgcatactacatatatttttaaatattttatttctcttgttatggtatagagcactgttgattaatattatttatctagaaaaggtctatttactattcaaaaataaaactcatagataaggaataattgcaaactacctgtgatataaagagcatgttaaatttcagagggtgaagaactatagcattacattatgctacctcctaaatatatctcctgctcaccataatttctggcactgccatagttaatactccttttatctctggtctagtgtcttttgacagcctcctatctagtctccatcacttgaacttcccatccaatataatttacttattgtcgaaatgttactgcttttcctttaaaaaaaattattatccaggatataaaataggatcaagatacttaagttcctactatcctacagaaaaattccaaattctccaccatggcatttaggatcgcttatgacctgcttttatctgtttctagatttgtctacaaccactctctatcacatattatatgtctaaaccatgctttctggactttctcaaaattttcatattttctcatggcaatgccttgcatcacctactccctattctaccatgacttcccatcatcattcctgtccccatcttttgtccgtctggaattcacatactgtgtgacatcctactctagaccctcctcaaatctatgtcctatttcacagagatccaaaagcttacattcagactttttaccatacacatttcgcagtaatataattaattatatgcttaacattcccatgaatcctcaatatcctcaaaatgtaataagaaatttttatattccctaacaatttttatcattggtttttcatatttgttgattcaatgaatatttaactaattttccactctcttcatattctaactttcttttctgaaattctagacattaattacatatatctaaatacataatggcatcaaattctaatttactccacaaaaacacaggaatcacaactcttctaaatatgtcatgatggaaataatgtagtcagtcttgacattcatttctttattaagcagaatctcagcatctttcacacagttaaaataggagaataaatttgcaaataaggtttcatttgcctattttcttttttttctttgcagcaaaaagattaaaaacattttagcccttcaatgtttaagttcaagtggaactatctaaacatcacatcaatcaatacctttatatgttcttctttatatgcacaagggcaagaattagtttaggggtataggagttggttacagtcattatgctctaatgtggcaaacattagtgtcaatttaagtaaactctaaagggttatgaggtcaaaatgcaagactgcataatttatcagatcaagcaaatcactttgaaagtacagaaataagtgaagcatgaggctattactgcctctcatgaataaaggttaataccaatgtttatttattacacactggatggtatttgctatctaaactttatttattaaaataagtattttgctacactgtcatattttaaactactgagtcaaatttaatttacagcactgtcttatactaatacaattaatacagtattctaagttttaaacaaaaaattgaaattgctttggacattttgattagtaaaatatgttacctgtaaaatatgaaatctcacttttgcatcaagacacaccaatgagcaattcaaaagcacaagaatacattcatatgtaaattctgcatgtatttcaaagttgtggtttattatttgttcttgttgtttggtatttctacatagtattttcttatgcacaaaaaatagaaagttgcgggagaatggtataacatactaggccatcaaaaaaagaaagataaagataagcttttaaaattagttgttactctttcttttatgaaagaaaagaatggtattttggttttccataaattaatactaaaatattcatattccattttctaaggtaaacagtaacatgtgaaatgatgtaatagacataatagctgtgaagagtacaggaaaatatattaataggaaagaaatgttacttttccagaacaaatcttaaatgaaatggtgtaattagatgaagggttatgtgaaacatggcaatatacacaagcaaaatcacaatgcagatcaattctgttacttttacattttactctgcatataatatattgaaaaatattatttaatctaaattcaataagatatcaagatttcctcaaaatcaatgttttgtagtcaaatcaactcaaataaaacttcacagttataagacagataattaaactgtattgaagtagatgttttatatagcaaatgttgtttattatggttacaaacacacacataaggaggcaaaagaattactctcaaagaaaaaatgttcaaattctaaagcattggaatagaaaaatgtaatgttatattcgcatcattattgaaatgtagctttaacatgacacttaaaaaaattaatattctagtgatttgtgcaggacctgtatctttcatttaacccacataaaaattttgtacatagactctcttgaagggaaatttaaagttccccctattttatccatttcaaccaacataaagatttcaaataacaacttcaacgcacaagtagtccaattccaggctgggcatatctaaatgaagaaaaaaattgatctgtcatgaataaccattccattttaggaaaatgcagaccattagagttcatttatttattccacaaatatgtactgaatatctaccatatgccaagcactaaggagacaccagtaaacagaagaaattagcaatcaaagaaaaaattaatttataataaaatgtcataaaaagtattatgaaaaaataactttaccatgttaatgcaggctaagagatagtgatggaggcacatagatgataagaaaaggctgacataggaaagtaggtggaagaagaatgggcaaagatgacatgtgagtaaataacctgtatgaagaggatatgtaagctatattgacatttggacaaaaatgctgcatgcatgaagaacatgtgcagaagttctaatacaggagcatggtatgtttactcaagtaatagcaagcagtccagtgttgtcagagcaaaatgatctagtgctcatctaagatcagatcatccagggctttgtacatttcaaaaagatagtttagctgtaatataggataaagagataaaagtggcattaggaaagtaagaatcagcaaactgttgctgcatagcctatgagctaagaatggattgtaaattcataaataattggaaaaaaagatatttcatgatgtgaaaattatataaaattcatatctaagcttccatgaataaatttttattggaacagagccatactcatttgtctaggtactatctgctggttttgcactacaaaagcagagtacgtggtgctctcatcacttagcactgatgctcagcacatttcagatcatactaatgtagctatagatgaccgtgtttcaaatgtcacacatatagccataccacattttatttttattttcttattaccagtgtgtacccatggtattaaaacataaaaaagagaaacgtagactttaaataacatgtttttaaaggcatagtggagtctgaattattttgttttagaattaaatgttaaagcatttttgtttagtatgcagtaacacgatagctagtgattttaaaatataatacacatcaatattaccaaacaaagcactcattataatattgctaatgcataggaatgcagcagtgaaaaacttagaaaatttaaaacaaattatctcatcaaaacagaatctcttcagaaaaattaaaaatgaaaataaggctgcaattaaagcaagcttctgagtgattcttttgttagtcaagcaaaaaaagtcatttacagatggtaagttaattaaactgagtttcatttgacagccaaagaactgtatccagagaaaacaaaattgtttaagaatattatagcctttcagtgaaaacagttgcttaaggagttgaggacattgaagcaaaatcaatagacaattaaaaataaataaataaagcaaatgattccaaatggttttccttggctcttgatgagatcacagatgttacctacataatgttccattgttgtttattcaaggagtaaatgactattttgaagtgattgaaaaacgagcctctgaataatctgcatggaataactatacggatgattttttcaaagttgagaaaacaaaaatttagtaccatctgaagtggaatctgctaggatgtcttataacaaatggtgttaaaagtatgtatgggggagaaaattgaacaacttacaaagtttgtgaaaatatacggtatttaaagcataagcttagtcactgtatcactcagtactctgtattactcaggtaccctgcaaaaaatattggaatttatcatgttttatcgaaccaggagtgtcatggtgaacttcattcacttttttttcatggtcttaaccaatgtcatttccatgcatttttctcagaaatacaagtggaatatactaacttgctcttccacacagcaattcaaaaaaaagtttttttttcttgagatcctgtctcaagaaaaaaaaaaatcttaacagtggtaaggttttattatgattttccgctaagggcatagactgatttttttttttttctgagaaaaaaataactactattatcacacactaaatggttttagaaattagcttttactgaagacataataatgtttcttaataaattccatctaaattacaaggcaaaacagcccatatatgggaaatttacactgcagtaaagtcatttagatgacaacactgtttgaatcacaagtaatatgaagttactttatatacttttctgtgctattaaaagttaaaaagaagtgagattgtcattgtcatacaaatttgcagctaatacattttccagctcaaacttcaatcccagaagtatttttcagatactgatgcaagggcaaaggaaattcccatatttcaaaatccatttaaatgtggtactgcggagcttctactcaaatatcaattgcaactaattaacctataatgtaacggtatgctaaaaggcaaaatcaagagaaaaatctaacaattatataaatgccttccaagagataaacatgctcaattaacatcccatgtccatagatggacattaataattgacaatatttatctgtgtgaaaacatattttaaaagatgaaatccataaaatattatagatcatattaacaggtgaatatttgccatctattttgatgacaggcaacagtaactatgaaccccaattaagtaaaatgttacccgcccccctcccaagaaaaagaaattcttctcattagaaaacccattacagaaaattgtactcaatagatatattttaaattttatcaataaaaatatattaaaatttgctttctgtcttgttacacaggtatttatataatatcctttatcttgccttttgacccaaaaatctaaaatatttactatctggcccattatagaaaaagttttacaatctctgatataagaaaataatgatttttctctagaccaggcaaagcagatgatgggaaatgtccagattctggctatatttttatggtagaaccaataaaatttcctgacatattgtggggtatataagaaagagtgaagacaaagatgacttcagggttttagcatgagcaacgagaaggataaataacagttattgccatgaactgaaactggaaaggctatggatgaataggctggagagtggttcagtattgacatgttaagtttaataaatctaccaaacagaagtggtttaggccaattagatacagaaatctggaattcaggagaggttatcttagcataagatacaaatttgggagtcactggccaataggcggtttttgaaacgttggaaatgaatgagatcacaagggatacttggtaaataaataaatgtcctgagaactgagtatcagggcactaaaacattcaccatttgggaaggtaaggttgatcaggcgaagtcaacagggtgtggaacaatgtctaatcaggtaggacattatgctatcttgaagcaagataaccaaagtgttagcagaaggagaaaatgatcaactgtgtcatatgtcaatagataagcatactcactataggttgcacataccaaattcaaaaatctggaatttgaaatgctaaaaaatccaaaatttttgagcacagacataacatgcaaaagaaatgctcattggagcatttcggacttttggattaggaatgtttgagcggtaagtataatacaaatattccaaaatatgaaaaaaatatgaaatctgaaacacttctggttccaagcatttcagaaaagagatattcagtgtgtatgtgtttatataaagcatagacagtagtgattaacagaacgaagaacatggtcctgaagcaccagaaatgtttctcctttaatctactaatcagtaaaactaatattttagtaaaaatcaggattttagtagtggtgctcctgttcatatttttccatcacatataataaggacagttctggaaaccttgtcaaatgccttgcagaatatgtcaatatgtgtatatcaagaattaaatgttcatattttttaacttagtcattctatttctgggactatagcctgaaaaaaaaataagctaaagtaggaaaatgctttatgactaaagataaaaacctttttccagattatatctgtaaaaagtaaaatgattactttttctttttttttttttttttttttttgagacagggtctcatgctgttgcctagactagagtgtgcaaggcataattattgctcactgtaacctcaacctcctgggctcaaataatcctcctacctcagcctctgtagtagcagggaccacaggtgcataccaacacacctagtagcagggaccacaggtgcataccaacatacccagctaatttttttaaattatgtgttgtagagacagggtctccctatgttgcccaggctggtcttgaactcctgggctcaagcaattttcccacctccttaaatgctgggattacaggcatgagccaccacactcagctcttactttatgctttacactgaacaactcaaagttccttaaagatgtgatgctgaattgttttcctggcaccacactctcagcctaactaaaaagttagtcattactttcaaagacccctccataatcgagatatttatctacatctattattgtggtttatcatattatatcagacatattattaatacgtctttctcatctattgtaagtatccttcctgagagcagggccctgtgcctagcagagtgtgaggttcaataaatgtttactatattcaattatccagtgagtaacttgtaattcaatgttctgagaatagcaggtatttttgctttgtttaggacataaggcaaatgtagagaagtaatagaaaataaagagatacccaagcagcatcaacatttatgagctaggagaaagaaggaggcagtgaggacatcagaagagaaaggaacacaagtagcaaaaaaaaaaaaaaaaaaactagaaaagagcgagatgtgccagaaaccagtggaacaaaataacttgacaaggaagtggtctacacaaacaaatatcataaataaacaaaaattgtaatacagtggttttgacaaagaagagctcacaagacctctgccagagcagtttctggcagacagcaagaggctgacggatgaacaggttgaggccgcagaaagttcaagatctaagaaacctgactgaaggagaaaaaaagagagactatgcagcagactactgttatttagtggttgtacaggaactctacttaaatatcacaggatatttaactacctggattccaacaataaaagtctgcaagctttccagtcattgtgacaatcaaaaacatgcccccccaccccacatttctaaattaccccagaaaggatagagtactgcctctgattgagaacccttaaatgccaactcatgctaaaacaggagtctctttcccatgagattgtttttatggtttaagatgaagcttattagcattttagaaaacgttggcaatacagttacaggggacagtaagtttggggacaatgccaagtagttgagggagctgaaacagagccacgaggcctctattttttcagagatgagttctgctgagagtatccatcacactatagtttcaagtacaacttcctactttcctccacataatcaaatttcttaaaagagatcttctctcttactcctctttagtaatcactcactcattccctaaacctttataatctggcccccactttctccatgctaccaaaacagttctatgataaccagtaccttcttggttccaaatctaaggcccttttcttagacaattttgcttctgatcaccttatagcattggtcactgctccttcttaagaccacttcttctcccaccactgtcctagtttgggcacttgttatctcttaaactataaaatacctctggcctctgccttcccttcagtttctcctaacatttacccattttacaaatgacaagatcttcctgaaacatagttcttaaactgttcctggctcagtaattttaaaatggttgagagaacagaccaaatatcttggccccaatatttaagatccttgacaatcaggtccctgcctatccttctcattttatttctcaccaatctggtttacataccactcgttctagatgagcaattagaactgctgagtgttctctgtacatgctcttctatctgctttctacgctttcacttatcttccttcaacctgaagtaacgcttttgcatcgcatggtcatatatccagttcttcttcacactttgatctataactcctatgtcaaggattccctgacctcatagctacaagcaatagccctacccttcctaaacttccaaagtactttatttgtaccttttttatgtcacctttaaacctgcattatacatttcatataaacatcctgcctctccaataaagttcactaggaactattacttactaagcattaatatcaggtacttacatatatcacactgtatcctctcaatataattgagttaccccaatttaataaatataaaaaacagaggaataggaaatctgtataaactagcaaatactcaatacatattttttaatgaataaattattattccaagatgaagtatcattcaaaatgtttacaaatatgcgggtgtgtttcactttaagtgaaccaaaggtagagctccaagaataaaaaatatttaagaaaagagccaataatagataagaggttgcgttcaaatctaatattaacagttactacttaacttgagcatatatgatttttcaggcacacactttctatatgctaatttattttattctcataacaatcctttagaatagatattgttttcactggccaatacttggtgaggttaagtgactcgttcaaagttgcaaagccaggatacacataaagccagcctttctggctttaaattctttgctctagagtagttagtgagaaggcccaaacagcttaagcttgaaagaaatacaaatttgggcaagtgcttctttttgctttattaatattaacatgtggacatctacaaaacgtaataaggcatttaaaaactgagaaaattttctacttttcccaatttctataaaatgtaatatgttatttaataaccaagaaaacattctattttttcctaatatctctaagcagacattaaaacttgttatttggaatgaatatttgtttccaaatgaacaatgaaagtagtatataataagtaacaaagcaccaaatagagtaaggaatctcaaaactcaaaactgaaaagcattgtaaacatcttcttattttaaaaaacactcacagagtcagcaaaaggatacaacaaaatgtataaattgtaccaacccactcatgctaggactttcctataaaagtttctggtcagatagtaaactgttaatatttgaattgaagtttatgttaaaatgctataaaaaataaaatttatgttggtaaaactgaaattaactgccatgaatgtcagtactacttaccatgatgttttacttcattagacaaaaagaccaaaaaaaaaagtctacttctatttacaataaataaaactaatccatattataatccttccacatgaatcattagaacttggggagagaactaaagaggagaaaccatcatgtctattattactgtgactaaatgggattaactaatcctcatgaggtaaagttatgaattaagtggtgctcagaacactaagaaaatttgtggggagagaatgcaaatagctccctaattatctacagcctattaacaagcaaaccttattacttgcaattaaaatcctcttaaattttatggcaaaagttcattgaaacgttgaaaattatatgctaattattatactgtaaagcacatgtttagtgtatacttttactatgggctcaataaataataaaatatcaaattcaaggtgatacagtaactaaatattttactagatggaaaacaccttggtatgaagccagtatgggctcctgttacaatttcacagcactatagcaccagaatatccccaataacaactaagttctatgtgcacggtgacacggctatcctgttaaccactgaatggaaccccaacaccatcacagtacctggcatagataagtacttaagtattaattgaagaaataatgttgacggatgaaaatatatatttggtgataatatcatctactttcaggttctgaatctttaagcgctaccacagagttcattcattcattggtttctgtaccaattcccacacaataaatctataatatttatgaaattatttatgtctaaaagctcccatggcaacctagaccaagtttgtcttgttcctaactgtatcagagcacccagcacaaataaagccatcaataaatatttgtgaaataaatgaatgaataaatacaagaaaaaaaaaggatgttactacagtttgcaactgcctgggacacaatattcttcagtaggcaatgtattatgttctaagaacaataagcccatgctacaaatggtgtgagtcatgaaacagtgcccacagatgggtcttttaactgaggactcccccagctcccacctgattgatgattgattgattgatttagagacagggtttgctctgttgcccaagctagagtgcactggtgccttgatctcctgggctcaagtgattctcccacttcagcctccgaagtagctggaaccacaggtgcatactaccacactcagataatttttgtattttttgtagagatggggttttgccatgttgcccaagctggtcgcaaactcaagcaatccagctgactcggcctcccaaagtgctgagattacaggtgtgagccactacgcggggcaccaatatcattttcacacctatacaagttaggggaaaataccttaatacataaaggaaacaaccaatattcagtttccctcaatgtttctctctctccctctcctcttcccctttcccccacctcttaacagctagtttgttcaaatcaggatccaaggtccataaaatgtgcctgttgaggtatttcataagccttatcatatacattcctcttttatttttatatttttgacatctatttgttgcagaaactaagctgtttctgcatgcatccagcttttttgcattctgaatttttctaattatgctcttgttcttgtaacatgttccccctttccttttgtttcccataaactggttattagatttaaaacagcaatttctattagaaatacaatgcaaatcacatatacattttaaagttttctaacagtcacataaaaaaggaaagaaacagataaaattaattctaataatatatttttaacaatatattcaaaatatcatttcagcacacaatcaatataaaaataaaatatttagattctttcatcatttgaatattaatccaaatccagtgagcattttacaacttatggcacatctcagttgagactaaccacatttgaagtgctcaacagccacatgtggcaaccatactagactgcacagtaatcgagacttgatcaaattgaggttagacacctaacgcctgcttgtttcctttttggtgatgttaatattggtctgtgaatctaggtactgtcagctttgtctattcattaggaaaatccatatcagcttctttcctaatgattttagtagctattaatgattatgcccagatatcaatttttttttgctattctaattctattattccttctgcatttattagctgcaattcttcaattaaaaagaactggccaggcatggtggctcacagctgtaattccagcactttgggaggacaaggcaggaggatcgcttgaggccaggaattcaagaccagcctcggcaacatagcgagaacctgtctctacaaaaaataaactttctctcatcaatgtggttatataagttacagtacatatagaaaaatgagataaacatatgattctcaaaatattaggtttttgacattaaaacctgcctccccagaatactctgaaggtaatccataaagattttgtaatgagtatcattatgaacacatggatttaaacataatttgccatgctttaatctattatactttcattcttttacttttagactgtctcatcttctggatagtaaaagctacttcattttacctcctgcaaccctttttacctcaccccaggaccctctggcctctgacatagcaggttggtccaggctgaccttgcccaatcaagccaattattttcactggcaaatgatatttagagacaacaatctaggtgtgagagggcccgctgctaccagattgtttgtcatttctaggccattccagtaggcaaagcaagaaaaaatactgtttaactttaaaaaatgagttttacagatatttccaacagaaatttaagataaaaggggttttcgcttctcgatttttaatacatgttcccattttctcttgctctgaaaaatcttagtttccaataccattaacataattacttatttgctttacactatagggtcataactgtatttcagcatgtatcaggaattcattccgtattttttcataaatacattgaaagactgtcattttgggaaaattattagaattaagttcagagtaacaatagcaatactactactaagaataatcaataatactccttctctggagagaaagaaggccccactgggaatcttcagattactgagttctaaagttacctgaaataatttgcctctatgtagtatataatagcaaattaatttatttcctttggcttccaattcagccattgatttaaaaatttttaattctattttataattatatattaaaagtaaaatctagaaaacaaggtttattgagaaaagtctgttgtcattgttttttgttgttgagacagagtcttactctgtcacccagaatggagtgcagtggtgcaatcttggctcattgcaacctctgcctcccgggttcaagcaattctcctgcctcaacctcccaagtagctgggattacaagtgcctgccaccatgcctggctaatttttatatttttttagtagagatggggcttcaccacattggccaggcttgtctcgaactcatgacctcacgcgatccacccatcttggcctcccaaagtgctgggattgcaggcacgaggcactgtgcccagtcaagaagtctattttcaattcctatctctctaccttgtctcttctatcgccttaaagtcattttttttattatactttaagttttagggtacatgggcacaacgtgcaggtttgttacatatgtatacatgtgccatgttggtgtgctgcacctattaactcgtcatttaacattaggtatatctcctaatgctatccctaccccctccccctacccaacaacaggccccagtgcgtgatgttccccttcctgtgtccatgtgttctcattgttcgattcccacctatgagtgagaacatgcggtgtttggttttttgtccttgcgatagtttgctgagaatgatggtttccagcttcatccatgtccctacaaaggacattaactcatccttttttatggctgcatagtattccatggtgtaaatgtgccacattttcttaatccagtctatcattgttggacatttgggttggttccaagtctttgctattgtgaatagtgccgcaataaacatacgtgtgcatgtgtctttatagcagcatgatttataatcctttgggtatatacccaatactgggatggctgagtcaaatggtatttctagtcctagatccctgaggaattgccacactgacttccacaatggttgagtcagttaaactagtaaagtcatttttattagttttaggttaaactttccattttaaaaatataagcaaatataattacatttgcccctccccattccttaaaggattatatattattacatatatccttttctaccttgttttgttcatttatcctggtgatcacttccaaagcagtgtatattcttcattgtgtaaatgtaaaacagattattcagcttccaacactggatggacatttttatcctttttagacttttgctattatagatagtgctgtgataaatagccttatcatttttgccaccaaatctttaagacagattcctagaactggggttgctgggtgaaggaataaataagtgcatatgtaattttggtagatactgctaaattgctttcactacaagcttgtgttttctccagcaatgtacacctttttagcaagagcaatccactcaatgggcattgactgaaaaactgacacttggcaaaccaaaagtttgctgtcaagatatacaaatggccagtgctgtttctgtcttttcacaccactgacaagagcaatgcttatcaatttatttcactcaggacagaaacaaatagcaatggaaatgaaaaataattatcatttaggattgtctaatgataaagttttcatatgattttaaaataccaaattctatttaataaaaatcatggtgacatggaacctcaagggtcttccaaatagctactttccaaaggttctatattactgtattgtgttggggggtatttatcgccaactgcccctcctaaaacatctttttgtattctctcccatcgcaaacctagtctaacttgtaggatcttcacatttgtggggaggaggttagagggtagggtagaagatgtgtgatcagattctgggttttggaagggttttttgcttctatttgttcacttctctattttcaaaacgtctgccatttgcactccataccactcatcctaattgtagctgccattgctgctaaaatccactacacttccaacttctatgtttgcttgtttttggtgttgctttcattttgttaggcttctcagcccccaagtgaaaggtctaattttcatatcaagagcatcagccaaacctttgattttaatccagtagcaaaatgatgaactgaatgtaatacccttctcaggaatgctcatttctggctgggtactcaggagttgcttttatattgttagagaaggcttattttgtttgtgttgttgtgggttttgttttctttcttttctttttctaaatccagaggttagataaaaccagtcttcaaagtttactactttgccatactaacacagttggcgtaaactgtctgatctctgcctgcacaacaaagctaccttttatcagactgtgaaaccacctttcatggctgccacagaactactcagaacaacacagtctacaaaaatattcctaagacatttactatgataaaattcccttgattgcagaagtagtcattcagacaactgtaagtattactaaataaatgtttattgggcactataatattatactaaaatgtaagacccatgaaggcaggaaattttgtctgttttattcactactagatattcagtgcttagaacaatgttgcaaacagtgaaactcaatacctattacaaatatttattgaatgaataaataaatgagcattattcataaggcaccatgaaagtattatgagtagaaacagtatctgccttaagaagctgctaatttgattagactaggttaaacatataaaaaggcaaatatgtaacatatataagccaaatgaatggagttgacatcaatgttgtaagagcccatagaatgggaatatcatcacccagtggaggaatctctactcacatttggcttgtcataaaaagtagtactcagcttagcacagaagggggaagtacaagtgtatgaactaatgtgagcaaatatacaaaatcaggaaatgatgaacagcaatccataagacagacttcccttacgaaggagacatgtttttgtttttctagttttgtttttaaagcaaagaacattttacgcttaaagtgtattttttaaaaaaacaaaatataatttttctttataattaataattatgctaaaatgcttctatatcatataagcaaacaaaagatgtttttagtaataacctctaggggttaccattttaatatcaacatgacttgtttcttacatgtgtaagcatttaacattgtgttcacaggtaaagaacaatatttattccatttattctgaagatttacacctcaaattatagggaaaaatgattaatttccatagaaacatgggttaaaaaacaaattttttatcctttcaaaatttctgagatgtggaagcatttaccattgtatttatatataaagttttaaaaaaatacaagaattcatagtacagtttccccaaaactaagattattaatattttaaaagggggttttaagattcttaaagatataatagagtagaacaaagtactttaatgtttcgtttcccaaaaatattaaaaaactgagattttttaacttaatagtaataacacatgtatgtttactatgtgcctgacactactcttaagtgtttaacatacatttttaacagtattaataatataagatttaacagtttgctttttttaagttattttcttaataattttaaggtgcttagttcttacatttaatgttttatgtgccattattttgcttttactgcaaaagaaagatctggctcccaaagataaaggagatttttggtaaatggtgaaggtaaagaaataaatgacccacttgcctagtgtgtaattacactgcctgagattgtaacaatctatcacatgaaggaggatgacaccacgctaaggggtgagtcaaaggagatagcctttgactaactacgggaccctgacgatcgatactccacagatattgtgctctcaaaaacaattgaattctaaaaaagtttgaaaatagattcccccccttcttttgatactgatcagagacctatcttgaccttattctggaagagtaatactttcttaaaaaggtatatgaaatacataaatcgtttctatctctggactgttctttcaaatggatatttaacacattcctattaaaataacagtctgcaagccaaaaaaaaaaaaaactgctgaaatctttccttattagataaatatgccttcctgattggctgttatcaagttatcataatacttagcacatgacaggtaagtactccaaaggctcaaaacttgaaaaacctatcagaaaataaaagtctccctctccctctccctctccctctccctctccctctccctctccctctccctctccctctccctctccctctccctctccctctccctctccctctccctctccctctccctctccctctgcctctccctctccctctccctctccctctccctctccctctccctctccctctccctctccctctccctctccctctccctctccctctccctctccctctccctctccctctccctctccctctccctctccctctccctctccccacggtctccctctcatgcggagccaaagctggactgtaccgctgccatctcggctcactgcatcctccctgcctgattctcctgcctcagtctgccgagcgccgccacgcctgactggttttggtggagacagggtttcgctgtgttggccgggccggtctccagcccctaaccgcgagtgatccgccaacctcggcctcccgaggtgccgggattgcagacggagtctcgttcactcagtgctcaatggtgcccaggctggagtgcagtggcgtgatctcggctcactacaacccacacctcccagccgcctgccttggcctcccaaagtgccgagattgcagcctctgcccggccgccaccccgtctgggaagggaggagtgtctctgcctggccgcccatcgtctgggatgtgaggagcccctctgcctggctgcccagtctggaaagtgaggagcgtctccgcccggccgccatcccatctaggaagtgaggagcacctcttcccagccgccatcacatctaggaagtgaggagcgtctctgcccggccgcccatcgtctgagatgtggggagcgcctctgccccgccgccccatctgggatgtgaggagcgcctctgcccggccgagaccccgtctgggaggtgaggagcgtctctgcccggccgccccgtctgagaagtgaggagaccctctgcctggcaaccaccccgtctgagaagtgaggagcccctccgcccggcagctgccccgtctgagaagtgaggagcctctccgcccggcagccaccccatctgggaagtgaggagcatctccgcccagcagccaccccgtccgggagggaggtgggggggggtcagcccaccccggccagccgccccatccgggagggaggtggggggtcagcccccccgcccggccagccgtgccatccgggagggaggtgggggggtcagcccccacgcccggccagccgccccgtccgggaggtgaggggcgcctctgcccggccgcccctactgggaagtgaggagcccctcagcccggccagccaccccgtccgggagggaggtgggggggtcagcccccccacccggccagccgccccgtccgggagggaggtgggggggtcagccccccgcccggccagccgccccgtccgggagggaggtgggggggtcagccccccgcccggccagccgccccgtttgggaggtgaagggcgcctctgcccggccgcccctactgggaagtgaggagcccctctgccaggccagccgccccgtccgggagggaggtgggggggtcagccccccgcccggccagccgccctgtccgggagggaggtgggggggtcagccctccgcccggccagccgccccatctgggaggtgaggggcgcctctgcccggccgcccctactgggaagtgaggagcccctctgcccggccagccgccccgtccgggagggaggtgggggtgtcagccccacgcccgccagccgcctcgtccgggagggaggtggggggtcagccccccgcccggccagccgccccgtccgggagggaggtggggggggtcagcccccctgcccggccagtggccccgtccgggaggtgaggggcgcctctgcccggctgcccctactgggaagtgaggagcccctctgcccggccagccgccccgtccgggagggaggtggggggggtcagccccccccgcccggccagccgccctgtccgggaggtgaggggcgcctctgcccagccaccacccggtctgggaggtgtgcccaacagctcattgagaacgggccaggatgacaatggcggccttgtggaatagaaaggcgggaaaggcggggaaaagattgagaaatcggatggttgccgtgtctgtgtagaaagaagtagacatgggagacttttcattttgttctgcactaagaaaaattcctctgtcttgggatcctgttgatctgtgaccttacccccaaccctgtgctctctgaaacatgtgctgtgtccactcagggttaaatggattaagggcggtgcaagatgtgctttgttaaacagatgcttgaaggcagcatgctcgttaagagtcatcaccaatccctaatctcaagtaatcagggacacaaacactgcggaaggccgcagggtcctctgcctaggaaaaccagagacctttgttcacttgtttatctgctgaccttccctccactattgtcccatgaccctgccaaatccccctctgtgagaaacacccaagaattatcaataaaaaaataaattaaaaaaaaaaaaaaaaaaaaaagtttccaaatgagggttacagtgtataccctgaacctgatacagtacttaataaatagcatgatttgactatgtaaaaagcaaacagaggccaggcatggtggctcacacctgtaatcccagcaatttgggaggctgaggcgggtcaatcacctgaggtcaggagttcatgaccagcccgggcaacatggtaagaccccatctctacaaaattggcctggtgtggcggcaggcacctataatcccagctattcaggaggctgaggcggaagaattgcttgaagctgggaaagccaggaggcggaggttgctgtgagccgagatcgtgccactgccctccagcctgggcaacacagcgagactctgtctcaaaaaaaaaaaaaaaaaagaagaaagaaagaaagaacttttacaaataaaaaaaacttttatgtccattaaatattttacaaaataattctacaggataaataatcacattagaattgtcttaaaacagtgcatcatgttttattttatttttatttttgagactgagtctcactctatcgcccaggctggagtgcagtggcacaatctcagctcattgcaacctctgccttgagggttcatgtgattctcatgactcagcttcctgtgtagctgggattacaggagcccaccatcacacctagttaatttatttttttatttttttatttttagtagagatagggtttcaccacgttggccaggctggtctcgaactgacctcaagtgatccacgagcatcggcctcccaaactgctgggattacaggcatgaggcaccacgcccagcctcatgttttatttttaaatacttgaactgtatctccacatgattcctattaccatagttataattaaattcattaagctatatcaaaaatttttcaaattatattttacataatttctgggatgtttgtatacagcattttaagtatctgtaactacaagagcaagtgtctaaaatacactttaaagtctgaaagagattaagtggaaagtaaaatctcatctaaatcccaataattattttcttttcacagaggctaatattaacaaatataatgtaatccatgaaaaatcatgattattataatatgaaagattataaaattaaactttttagaaagttcagaattttgtattgatactatagcatttgctattcgcagaggatgacaggtatttcgcaaaaatgtcagtacgagaaggatattacatgaaactgcaagatgtcacctctattctagagggttgtagcaacccactccctcccaaagcacacccttgttaggataaaagaagaattaccagataaataggctgtgcctcaaaccaattaaatccctgggggtgcaatccaggcaacggaaattttttaaaagcttcctacattccaatatgtagacaaggttaagaactactgctgtatggtatagatctgtttgcaaaggtgaagaagtttgaaagaagtaggcaaaaagagtgaaagtgtaagataagaacactattggataacaaagatgagtatatttcactccaaaatctacaaaggatttgtgaggccagtacctcaggcctgtaatcccagcatttaggaggctgaggcaagaggcctgcttcaggcctggagtttgagaccagtctgggcaacacagcgagattctgtctctacaaaaaaattaaaaaattagccatgggtggtagcagtcttagtactcaggaggctgaggcaagagaatcatttgaccccaggaggtcaagactgctgtgagccaagattgtggcactgcactccaacctgggtgagagagtgagaccctatctcttaaaacaaaacaaaacaaacaaacaaaaaaaaacagataaaatctacagaagataaaaggggttagatcagtagaaagccctcacaaactttacaaactagcaatttaattacattaacaaattattctgttaaaatacaaatacaacttgaggaaatttattgaattgctcacattcagaccttgatataaaatttatttaacaaaatgtaacctagctaaaataagtcacggttaatgagaattctgattgtctatagggaactaccgtttcagagaataaagggatctagggtgtagatcttgaatttccagaaaaaactttgaagtcactgtatatatatgaaggcaaaggagtctacagaagaccaggctcaagtaagatggcaaaaattatatcaagtaagatgtcaaattgatgacagaaggtgcacaaaagagtatcatttccattactgtctaccaaaatttggtaggatgtcatatgatataaaaataccagacttattttgaatataaaaaatttcataaactcagtttattcctgtgttttcaattgaacttaggacagttctactcaccccacttatgctgaaaaaaaaaaaagaagagaaaaaataaaagtacaaaagacatccatggaatctcatatcaatgttccttcttttattcagtatcaaatatttaagaccctggtagtatatatcaggtattggaccagggatgaaaacatcaaaattaatgttacgggcttctactctacaagtactttatagtatactgggaaaaaataaaatgtgtaccagactataagtgctttaatacttgtatttatcaaacgctatgagaacacatataagcaaagaaatatctaccaagtaatgcttctgagagaaagaagaggcaatggctgataaagtacttggacacagtcacatttcggaaggattctgaaagacaaatgggaactcaccaagaagataacatgggaacagaactgaaaacacaaagaagagcatgagaaaatataaagaaaaaataaaaggtatgtctggatcgcaagttgcttggtgtggttagagatgcacgaaaaagatgaatggcaaggaagatttaaggaatggcactaacaagccttgaatgtcatgtcttaggtttttcaatgaagtggttttaataatggtactaggaaggctgcaatagcattgaaagagagtaaagacaaggaaacccactggtagactacttgcagacttctataaccaagggtttttcaatgaatctaggttgtaatcataaccgattgttataatggggtatagatatagatcatataaacaatggaaagctgttctgatctcagaatagacccttgagttttctcttttcaatgaatacctaattatggcttgacatattatcgaaaacagaccaggaaatgtataatggcattacctaatacaagtgtatcataaagcataatagcctgtcactgacatttcacttctttatttctccatttatatatcctctaatcacatgcagtgtggatttcatgccaccggttcacaggatgtgttccctcaaagtatatataatccaaaaactcctaaatccttagcccctaagcttttccctaacatttcacatatgacacaggaattaacattgccatttaagattgagtaaactgaggtttagtgcacattatataattccaaggccaaaaaactactaattaaaagtgcttattttcaaaaacccagaactgtatgaggccaaaaccgatgatcattcttctatgccaaacttacctcatgagataattttcttctactcatgaatagattacaaccttaagaagcctagcaacttcaagttcattttcttttataaaataaaacattacataagttgagaactttttgagacataactcacatataattttatgagttttgacaaacacatacaattatgtcaggacccctaagataccatcagattcaattattcacaaggaatcacaggattgagtcatcttcatggctatgacttcctgaatcttgtcttagtacaaacaaaatcaacaaagggagtgccatggtacaagatctagagaaaccaggtacaagcttccaagagtcctttccttacgcaatcacacaggatgtgtctaattcctccaggaatttcacacatatcacaatgtgtgaaatgtttgtcaaaggaaccttatttagagactcagctcccaaggttttcatttgggactggttgcttagggaccctctgtctagtacatgctgtaattctagactcccagaaagaaaactgatgtttacaatcaactacatcgtttggacaaacagtctaagcacagtgagccactcatcatttatgtaaagttctatatcagtgtagggacctgtttactattcaaattcccagatgccagccaagggtccaccttgtaactgaccctttgtaaaggatgagacgctacgttaacacttttctgcaaagttatataatcaccaacacaatcacgatacagaacagctccatcatgccaagaaaaaaaaaatctttgcacccctttttaatcaacctctacaaccactggtctaatttctattcttataatgtgcctattccagaatgtcatacaaatggaatcaatcacatttgcacatagccttttgagtctggcttctttcacttattgtaatgcacttcagattcatccatgttgttatatgcaccagtaatttgttcctttttattgctaaataatagtctactatggatataccacagatattttcatctgccacaattcaatatggttttctccggtaaactgtatttctacttcacttgagtaaacatctaagaactatatgaggccaaaacctacgatcattcttctatgccaaacttccctcatcaaaacacgcagtagaatggaggaacctcaaattactatgctgagtgaaagaagacaaaaaagaagtacaaattgcataaaaccatttatataaaattctagataatgtaagcttatctagagtgacagaagatcaatgactgcctaggggcagggagggtgggagagagtaatcacgaaagggtaggaaaaaatctctagattatgatgatggtttcatggatagacataagcagagtcaacactcggtatcctcaggttctgcatctgcagattcaatcaaccacagactgaaaatattcatataagaaaacaataaaaaatagcaataaaataaaaaataggtcgggtgccatggctcacacctgtaatctcagcactttgggaggctgaggcaggcggttcacttgaggtcagggattctagaccagcagtctctactaaaaatacaaaaatcagtcaggcatggtggtgtgtgcctgtaatcccagctactcaggaggctgaagcaggagatttgcttgaacctgggaggtggaggttgcagtgagttgagattgtgccactgtgtactccagcctgggcaacagagtgagacaccatctccaaaaaagaaaaaaaaatgcaaaatttaaaatatagtaaaacaaccatttacatagcatgaacattgtattcagtattatatgtaatctagagatgatacagcagaaggatatatgtaagctatatgcaaatactataccattttatacaaggaacttgagcatctgtggattttggtattcatgcgggccctgcaaccaattctctgtggatactaagggattacatgtcaaactgtacattttaaatatgtacagtttattgtatgtcaattgtaccacaaaaaataaacaaagccttagtcacatccattaagttttcattctatttttttatattattgatgtcattttttctgtacccaggactatgtaatacatttcctatttcacatttgatattaaaccatgtgaagaatcatccttatttaactaatgaaaggaaaatatttaaggaagctgaaacccagagagactaagtggtactgaaaacacccaaaaaccaagtgctctgccagtgtcacgtatctgttaagtaaagagattcaaacccatgtctgctttacttaaaagctaacggtcttaatcactataccatacaatattaatatatcatcttaaaggaaggattcagaggatagacactgtgctaggctgaataacagcctcccaaatatgtctaaatactaatccccacaacctgtatgttactttacagggactttgtggatgtgattacattaaggatatagatatgagggcattatccaggattaacttcgttgggcatgtaatcataagcatccttataagagggaggaaggaaggttagagtgagagaaggcattgtgatgatggaagcagaggaaaaggagactgacaacagagaagcagagtcagagagaaatttggagatgctatgctgctagttttgaagatggaggaagaagccatgaaccaaggaatgaaggcagcctgtagaagatagaaaagtcaaggaattttcccccaaaaacctgcaattgattgaatgtttgtgttctctataaattcatatgttgaaattttaacccccaatgtgacaatattaggaggtagggtcccttagtcagtaattagattgtgagggtaggaccctcaggaatagaattagtgcccttagaaaagaggccccagagaactctctagctctccttccaccatgttaggatacaatgagaagtcagtagtcttcaacctgggagagggctctcaccagaatccaaccatgctgactggcaccagatcacagacttccagcctccagaagtctgacaaataaatgtttgtactttaagccactcagtgtacggcaatttattataacaacctgaatagactaagacaagcctccagaggaaacacagccctgccaacccatttcagacttctgaacttccagaacaactgtgttattcaagccagtaaatttgtggtaatttattacacagcaataagaaactaatacaggctctatagtcaatgtagtttctttcttccctatcataaatgttctatgcatttggcctacagtaaaagttcctgataatgatggaggtaaaaatggcctctggaagtttgggtatgggagaaaatataaaaggcagtacactaagcaattattcttgtggactctagatatctatgagtcttagtaaagtccaaaacccagtatgtgccaatagctttaggtcttcctttgcaaattttaaaaactcaaatgatgccaaagtaaactattccctaggctgacttaagacaatacaaattcattagtgggtctggagggaaagagtggtatcagagatctcacagtcagtctgagaatgatgtggtgttaccaaatcatactaaacacagactaggaccaaacaagctataggcagtgtgtaaaaagcaattcactctagactttattttattttgtttttaattatccatgtggcctaaatcccacaaaagagaatgttaaaacaaatttcaaacctgagacttgatttttcagttcatttctatcatctatagttaccatctttaaagcttggaacctgtaattctttcattcattcaacaagcatttattgtgtacaattcacagcacatcataatgaacaaaaataaatatcaccctttccctaatggcatttataagttagaagggaaagattatttcaaaaacaattaataaacagcttaacaagtaccataacatgggaagtagaagttgatgtgaggggcatggcgggaaacctaagttagtgagggaaatagaatatgaaaatgcttggagactagagatggaaaagagcataaagaaagagtgtgagagtatgtaagtggctgtgtattagaggggaagtgtcaaagggagggataaggagagataaggcctgataggtgagtaaaagccagccatgaagagactgcgccctggtcttaaatcccagtggtacatatagagatagcaaaaccagtcattgtgatgattctcaatcctggctgcaaatctaaggtcgtccagtagagtgcttctcttctactgtggcctggcaaacacagtttataaaatctgtgaaaagtgagagtaactgaaaactctaagaactgagactaatagtttcatgcatatgcaataataatagctattaatttttaaaatttgacaattttataagttacaaatattagagttcctgtatacccttcactcagcttcctctaatgttataatcttatataaccacactacaattatctaaatgaaaaagtttacagtgatacaatactattaactaatcttcagagtacatttgatttttgcaaattttcccattaattttcttttcttgaccaataactaatacagaatcccaaactgcagttagttatcatgtcttcttagtctcttcaaatctggaacaattcctccatttctccttgtttttcatgaactttatatttttggagactactgaccatttgttttgtgaaacatccctgagatttgagcttgtctaatattttctctttttttttttccctctggctctgtcacccaggctggagtgcaatgacacgatttcagctcactgcaatctccacctcctgggttcaagcgattctcctgcctcagcctcccgagtagctgagattacagtcatgcaccaccacgcccagataattgttgtatttttagtagatacagggtttcaccaagttggccaagctggtatcgaactcctgacctcaggtgatccactcacctcagcctcccgaagtgctaggattataagcataagcaactgtgtccggccaatattttcacttaattaaatggaagatttgtatttttggcaagaagaccatggaagtgctcttgtgcacttctcagtgcatcacatcaggtggtatatgatgtcaagaagtcttcttactgatggtattaagttgatcatttggtgaatatgatgtctgccacgtttctacatattaactatgaagttaatatgtttcctgcttgtaattaataactatcttgttgggagatactttgaaacaatggaattatcttttttctcattattccatcgccttaagtttcagtattcactgattattgcctaaactgtattgtattgtacagtactgtggtgtctgccaaaagatgatttttctacatctattaatctttttacttttaaaaattgacattctactgtaaagaagagctgtctcttacctcccatttataaattattgacttcacgataaactaaaaaatatttattctatgggtttttaatctattactgtcaatattataatgttgctcaaattgtcacagatttagctatttaaagatctttgggatttatgtccttttgacatgctgctacccatttttgagtacttccttaccttctggcaccacaagataatcttatagttgccctttcctagctctgaaatcagccatttatccaaaaagatctagttttttaagttaacaaatggcatacagaaactaagatttgggaactaggtttgcattttatcattggttgtcactgcttctatgtcttctcaggagacagggctaggtgatataagtatgtatgctaattgtgcatactaacacatgtatatgtaattgtttatatcatctttctatgtgtgtacacataacaataaattcacattgatatttcattccaatcaatcaccacaggattcattctagagtttcctctccttatttgtaactcctttctccaaaagaaagaaatcttgcttttactatccaaaatatatttacttatttgctctaatcctaggatacatataaaggaattttagattcattatctttctcccccacaattattggagcaattatgctgttcatttgtaatgctgttagattttcactttgtcccacaacatagctgatgtgtgtgtgtgtgtgtgtgtgtgtgtgtgtgtgtgtgtgtgagagagagagagagagagagacagagagagagattaggttctaagagtccaaagcatacaaaaggtatagtcagagaactgtcactcccctttcattgcttgtactctgttcccattccccagtcctttccagcacattctcacctacctgctgcagataatcaatattattagtctatgattcaacccttcctgtatctctttttgtacaaatcaacagctaacagttattaagcatttacatggtatatgtcagacactgttctatatgcctttctacatattagctccttcacctttcacaagcacctaagcttcaagagtgtagatgctctgaaacatcgttttcatctaggaatcttttccttttcgtaggtgttcttgattgcctcagatatacccaagagatattcattatagaattagagaactaaatagtacattgccaagtactagattttgttctgatgataatgatttaacatgtgataacaatttttatttcctcaggtagttaattcattacaaatcagtcactaagtacccataaaagtacatacaatttctcatttgtcacatttattctcacaatagcacaaggagacctgcatgtaggacaaatagcatccttactttacatgagaaaactgaagaacctataaacataaaaaggacttctgtgctcccactaaaaccctggtaagtaagttcatagaaggcttgagtcttcaggaagaagagagagacagagacaagggcagccagcaagaaagggaggagagtgaatcaacacagggaaagcaaggtctgaaatgaatgcctgagtacagacaactgacaatagacaactattgcaaattgttgattagcaaggcaatatgaaggaactgtttaaggaaattagcagtgtgtaaaatgcagcagaggatagagacaacaaggtgtaacatttctgggaaatctgaatgtataatataaagcattaaagtacctttctaacatcaatttctaggaatgctcattttgttagtcaaaagcaattacaggaaaatccaatctttgactatttaaacacagtgatttttaccattgaccatattaggataaaatggggagcttcttaaaaatactaactaccaagccattttccagaccaattaaatcagaatcctgggaaaggtgtacaggcgtcagtactttttttaataatcccatggtgattctaatagacagctatagttcagaaccaacacatcagtagtaaacattgacaagaagatgcccatatgtaataaagtttcgattttttcttttttttttttagaagatactctctgttgacagtgaacattctgcttttgcagaagtatatacttactaaggtaccataaacttcagaaatgtaaaagtaaaactaagaaaatgtacatctacaatttcctaatgcatttttataaataattgtagaaaagcaatttttcatatatcaatcctttagtattctaaagttattataatttattttttttaattttttgataataaatactccgtattaaaaataccctctctggaaattttccaaattatcatctggatcagagatataagtaacaacattctaaacacacaatgctataggactggtttagcatgataccaggggaagcagaaaataaaaggaaatctaaactacactcaaagcaacaatctgttaaattctaagctacgtgaggacagtatccaagtctgtctattctactgttatatactcagtaatttgcataaagcctggcacataataggtgtccagtaattcttagttccataacaaatctattttgaaaacttatttagaaatgcatcaacggaaggaagaatgaaaggaaagtagtaaggagaagggaaggaaaagacccttggaatgacgaacaaatgactgactgatttagtcagtcattctcaaaatggtgaagtgggagtcaggagagtaggattctgagtcttggctttgccagaaaaccagttgtatactcttaagcaaatcatttaagttctccacaataacttgctcatccataaaacaaggagaggcataaatgacttctctcatgacctacagtgttgaaaatctctatatatcactgtatcagatattttgaaggaaagtatacattaatctaagtattattttttaagacagaaaaaaattgacaagaatttactaaaccgaaaattttaagtaaaagaatttctaattcggcatatacaaccaaaatttctaattacatatttggtgaaaaaagataagtcattgtatatccagctatttcatatttaactccaagttttaattctcagttatccacagatagaggaataaaacataaggaaaactcataacaggaattctctcagtattttctcagatgtatttttcccagcaaaagttaaaaactaaaggaaaagttgcaagaacacttaaaaaaataaatcctacatctaaatttcccaccttgcttacatttcagtacatttgctttatcatgctacctcttagtctctcttggcatatgtgtgatagacattattttttttctgaatcaaatgagagttagttacaaatatcatgacacttcaacctttatctatatttattgactaagaacaaagatgttttcttatataatcacaacacaattattacacttcataaacttagtattaacaattcatgtggttggtttttaatccgggtccaatcatgtatcactttcatactaatatttgaataatattgtgttatttactaaaaattaattatacttttaaacaagataattcaatacaagacaatgagagttatagggaggctggacaatgccagaaagagtcatatattatgatttaagaggttaggttccacttcccttttattataacaagctgccattggaacctatctccttaatgggctggggagtgattttcatattgtgagatgccttgagcagcagtgagtaagaaacccatgagctttcgatgtcagctaggatggttcctttttatccattttatatattggggttctaactaagaacagtatttacaaaaaaaagtaatttttgtggtgttttggttttggggttttttttttgcataaaaatgaatttgaaaacaggctaaagaagtaaaggtaaaaatcattaggtaaaagagtagggaaaggaaagagaaatcaaattctcaacagaataagaatgatcctgacccaagtatttcagaatacaaaaagtcaaacagtcacagccttttattgttcaccacagttgaagtagcaaacagtaaagtctaaaaaaaaaaaagctttattacttgaaaaaccaagaatgcttctgaaccttcatttattccactgcaaaacagaaataataatatacacttcacagggttgttgtgaggatttaatgaaataatgtttgtaaagggctcagtaaatccctggcaaattgtaaacactcaaaaataaaaattaaaaaacatcctaatactgttgggtgaagtggctcatgcctgtaattcccagcactttggcaggctgaggcaggaggatcacttgaggccagcagtttaagaccagcctgggcaacacagtaagaccccatctcgacaaaaaaacttaattagtcgggcatggtgtcatgtgcctgtggtcccagctacttgggaggctgaaggaggagggctgcttgagccctggaggtcagggcttcagtgagccatgtttatgccactgcactccatcctgggcaaaagagcaagacccagtctcaaaacgaaaaaaccacaagaacaaaaaccaaactaataccaactactaatattaagaagttgactgggtgtaatggctcacgcctataatcctagcactttggaagccaaggtaggtagattgcttgagcccaggggttcaagaccagcctgggcaacatagtgagactttgttgcccagaaagaaaaaaaaaatagccagatgtggcatgagcctcagggaggctgagttaaaaggactgcttcagcccaggaggttgatgctacagtgagctgtgatctgcactccagtctgggtggcagagcaagaccctagctcaaaacaaaaaaacaaaaaaacaaaacagaagttgcatgatagttatgagtacaggctctagagtcagaatgcctgggttcaaatgttaactactcaatatactagcctttggatcttggtcaagtaacaaacttttaaagctctagtttcttcatttgtaaacttgggacaattaatactacctatctcattgctctgtttttaagatacgatgagataatccttataaaaatacttggcacagggctgggcgcggtggctcatgcctgtaatctcagcactttgagaggccgagacaggtggatcatgaggtcaggagttcgagaccagcctggcgaacatggtgaaaccccgtctctactacaaatacaaaaaatcagccaggtgtggtggcacgtgcctgtagtcccagctactcatgaggctgaggcaggagaactgcctgaacccgggaagtggagcttgcagtgagctgagatcccaccactgcactccaacctgggcgacaaagcgaggctccgtctcaaaaaataaataaattaattaaataattaattaaataaaaatacttggcacagtgtctggctcaaaattaattgctcagtaagtatcacctattattcacatcactattattataattatttaaaatactagcatatctagcctagatattaacatataaagctctaaattttattttctaattcttgaataaacttttagaatcacacaatcttagaggtgaagaggaccttactatccaatgaacttattttaatagtaagattgcccatatatttgcagtaagttatttgtgttaacatctcccctctttaaacctcaagctctatgcaaacagactattactttcttctcacttgcaatttgtctataatgaatgtatatgaaaattatgatcttatttttttttagcttattcattgtcacataaccagttaatgacaacggctgagaatacaaaggcatcaaactgcacagtgctctttccataaaatcacactaatcttgtattagagaaagacaacattttaaaaaagcccttttataacctccaaatatatccttgtttatgaccatttacagtgaaaaattataatcattgctttttaagctatttatttatagtttttcacttttctatttcccctattagagaaaaagttacatgaaggcaagcgatatatttgtcttattcatattgatttctacagtgccaaaatgtgcatagtaagtggtatacagccagtactaaataaatacgaaaagaagaattgttccaataggcaggagaaacaaaatttgaaacgtcaaatatcagctattataacagcctacagggtcctgaagtagaagcagccctgtcaacaaacttcaaggctgggctaaattattgctgtggttctcaagtgattctcatattgggattttttttttaagactgtttggtttcactctagacccatataaaaccataatattttctcaaattccttaaataattttatttgctcccaaccctttggaatacttctgaaaatttctggttatagcaaaaattactacagagacttaaaagttcaagcacccccaaactacaacttctagttatctgctgaatctcaaaattttctcatctactcagaacttaattgtcaaagaaaagtgttctttacaaacagaaaccaaaattcccaagtctgtattatctatagtacatctcttttcagacatactctacttctattacactcctcttaatctctgaatcaatcttatccttcatagtttacaactagttatgataaaatattttgaattttatttttcaaaatttattactgctttggttgaaacaaatatttctcagttcatacagcataatgaaaattttaagactaatagtttacctgaccccccaacccccaaaaatgatttctttatgacatactgtaggttcagtactatgctaagaactacagaaataacataaggctaaaatcttataatctacacacaaaacaaagaaatagaacttactgtcaagtactaaattctgcaatataaattgattataaatgccacagaagataggaggaaagaatatcaagaaaaactggagacttgaagaaaaactgcataatgagacttgcaggatattccaaaaatgctacaaattttttaatgtttcaatgagcatatgtgcaacaacttgaatttatttttcaatttgtttttatttacttttgtaatatattgactaatgctgacacttggatgccataagtttattttattccttatgtctttgaaattatacaaaaatattttactcagaattataaaaagcacatattcaattttgaatatggcaaaacatgttacttgccaatgaaattatgtggttttttgctttatattcattctttgaaaatgtagttaacctggcatggtggttcccatttgtagtcctagctactcaggagaggctgaagtgggaggattacttgagcccaggagttcaaagttgcagtaagctataatcacgccactgcatccagcctaggtaacacgacaagatcccatgtcttaaaaaaaaaaagaaaaagaaaaagaaaaaagaaaagagaaaagtgtatagttctctgattcccatatgttcagtatcaggcctgtaattagtacatcacaaatatacaaaagataatattcatacatttttctagccattaaaagtagaaataggccaggcatggcggctcacacccataatcctagcactttgggaggccgaggtgggcagataatttgaggtcaggagttcgagaccagcctggccaacatggtgaagccccatctctactaaaaatacaaaaaaatcagcttagcatggggcacacacctgtaatcccagctacttcaaaggctgagacaggataactgcttgaacccaggatggggaggttgcagtgagctgagatcctgccactgcactccggcctgggtgacagagtgagactctgtctccaagaaaaaaaaaaaaaaagaaagaaaagtacaaataaggtttgactaataataaaaattcaaatctagtgccataagtatgtataattatatgacacaactatactgtgaccatataatacatactacacaagaaaaaaatggctcctcagtatcagtactgcaatatgcctctgtggtagagacagatcccagaaatatcaacttactagaaaaatgagcatataggtgagtctcattatgtatctggccacaggcatttaaagtacatagtgtttaaaactaaacactaagtcatgcaaagactttcaaaaatatacctgttttctttaactaacatctccattgattcttccatttgttttgttagctattgattttttccctctccttcttatgaaaggggaacaaggaggggatacatggggaaaatgttacctttattaagccatcttacaatgttattgtcaggaatggctataaagaatttctagcatcgtcaaagtcccagagagagcaatgagtggtgcctgcactgatgtcaagtactagctcctaggcatggcttaggaataaaaataaacgcattagaaagaataagaatgggtgtatattgcacttatgagtacccatttgcttgattatccacatagcgtaacggaatcaaatgcctaagatgaactcttagtaagtaaggtatattagcattttagtatactaatttcactacaaattcattgatattacttatttagtaaaaaaaaaattagaggtaaaggatttttttaaagataggacatgatatacttcttttggaaaagaaaatacgtcaagatgagttcaatattgaatttcaccaatgagtatatattaaaacatcagaaattattttcaaaacaatctttccttaggcttaaaaggagaacctgatttaaaatcaacaccaccctagccatagcttttaacgggtcaagtacattagctactcctttctgcaaacaatggtacataaaaacaaagtgggatatttcctacaaagaagattaaaaattctttaggcctgcctttccttggactctggattttaaaatgacatactacaagataaaatagtaatgctaatattgatagtttgtccattacaggtcagctaactgtccactggaacagttacaaagctgttagtttcgatttcacaaggccaatcaatacagaggcatactgtttcaattttgtctgcattgatttttttttataacactccaaccttacagcattcatctttctgaaagaaggaagatttgatttactgaagaaaaattggagagagcatcacaaagattttaccggcaagcctgtgacacagaaaaaagatgaatgtctttcaggaagagacgcctctagcttgagggcatccattagaacacactcaagcaatctgaaaaggagtttcttaaagcagcagaaatctaaacctaaacagtctcctaaactaatcaaaagcattcaagaattttgatatgaggttccgttaaaaattcctaaaccttattacttctaaaataatttatgtctctagctctacctatgcattttttagagatgagaaccacctctttcccagactaataccaagagtgaatttccatggtacattagtcagcctattagaatgcaatgaaggacgatatgagaaaagggtagtatgtcctctgagacttccatccagtattctccatcatctctcctcatccttcttacattcagccactttaccaggtgtcatctacatgaaagatgatttgtctcctgacccaaataaacacaatgcctgctccatgcaccggaaaaaaattacttctgccactctgttcatttgtggcttctttcttgcttattccactattcttatcaagctctctcagttttcacctgagcctcactccaggtgacagtaatgtatggatgaacaggtacttgtctgtcccattatttcctgaaatctctaagcatttgaaaaaatgcaatgacagtaaagggcacagttatcagagctccaagggaggaatactttcctttacttaccaatgcaatagtctaggcatcaaagaaaaaagagagagagagaaagaactctcatggcaaaagctggtgtaagcgagatattaagacacaaattgcattcaggcaggtcactaggtgtcaaaagatattagatgcctgctgtgaggaaacaacaattcccatctgcctctgagaaaataatattttcattttcagtttttattgaatggaaacttttgggaatatgtctttataaagggtattaagtctaccaactataacatgttcaaaatggctataatcatcattgtgttatccataaagcagcagatttcatttggtctctttagatgggataaattggattcttttttccccggcttgcagttttgtcgcaggaccagatgtttctcaaatgccacatgctgaggctcctatactgaatgtagcacctgaccttctctataattgactaaaaatattgatgtaatggcatgggtctgattgtgatttattaaaaccactgccgatcccaggccagctgccagcattgcagcccactgatcgtgtggcattagaaaagccatcaatagtgaaacaaaataaatgacattaatgggaaagtatcaggcctacataaccatggctacaagcaaattacgtggattccaaaggagggtcaaaataaaaaaaatgccacaaatgaaatttctaaatattctaatatgattgagttaaaagacaaaatgctactataattctttagataaaatgcaaagaaattatacttaatttaatcctcttcactagaattttgctcattgtgcatatttcttttagcaggcttagcatagttaaatgcattacagctacagtatgactctgatttctctctaatgccatttatgttttctagaattatgctaagtgaagaacaaagtacactgtgttattcccatttattacaaccatgtccataatttacaagctgattatgcaagcctcatacaagggaaatcagagaatagttaaccactgtcaaagtatggtgagccagcatacatttttgtcagctacattttcttacatggaccttaaaaggaacattaagatccacacttcacattattgggaattaatattgaaaaggactatttaaagataatttttaaaaatgcattagggagaaaccaggtattctaaataagtaacagttgaatatgatacagaactaaatataatgacaaagaaatatgaacatacaggcaatgtgctttgttacatattgttttttaatgtaagatgagatttatagagaggaaaatattaatttaatcatgtccattttgtgatggtacatcctttcttgttgttctgaatttaaaatgtacacattagaaagctaataatttgacagctattttcatttgagaggaaaaagtaagagatattttgttctgtggacttgcagaaatattaaaatttcaaaatttatttcagttgtttctggcttaatgaataatagagttgataccttagaacaactctattactgaaacactaattatttctagataaatacatttcatggtccatttagctctccaagatattttattacaccaaaatcacttcaggaaaactatgttttccttttgataccacatgtatatactatgctatacaaaggtacagctatcaacagaaagaattttgatcccatcaaaataacccatgaaacgcttgacataagttatctaaatgtgtttattttaaaactgcaaaaccttttgggtgaaaagaataactttttaaaaagattcaacaaatgcacattgggttcctactgtgtgtcaggcactatgcatcagagtaatatcctaattcattcagtatctgatgtcaaaatgatatcaaatctgtaataataaagcactttgaaactctaaaaccctcaatacaacactcctccattctcctcgccatgggcttttagatgttgcaagataaggcaccagagatcactgacccatgaatagatgttatttccataaccactcttgcacctgcagatcaactgaaataacattaaaacaaacaaacaaacatggttcctgttggctgtccttttgatctcaagaccttgacttgcctttctttctctgaatatcaaaaattaggtacccagaaatataattcattatatgcaaatattctttgtaataaatatcacacgctacatttattctatattagtgaatactttatacaaatagctttcaatgcaaatttttgaagtttacttttctaaaagttaaaatttttttctttatactggaaaatttctaacactggattttgatgtctgatagacacataagttgattaaaacacaaatggaagcaaattacactcttatataatatacaagtaatttactatttttgtttttgttgtcttctagaaaaagttggtcaaaaattagaaattaaaatataatgttttctaatagcaaaataaaaactttctgtcattaactttacttaaaagagtcaacacatgttcctgaaatttgtagcataaaatatttcatggaggatatataatttgtccaagttccttagtcttaaaggcaatttaattaatttctataaagtaaaatcaacaacagcatgtccagtttggctatcttaaaagaaggtagatatattgagtaaaactttaaagaaggcatttaaccaagtttatcatcacagtcctgaaatttgcaacataagaaaaaaaatcattttattgtattttcaaaattatactttgaaaatatggttactttcaaataactaaaaaatataaaaagagcatagttttttaaaataaaatgttatatacgtaaaaatttggctataagtgtagatagtaagatagtttaactgcttcccttaagaattcatttcaaaaggagtaagtagataaagcaaatatgattttggaagtagttgaggaaactgatctacaaagatccataattgtacacatactgattggataaatatggatctataaagatccataattgtacccatactgattttctccttccctttggctttaaattcatagagatgatgaaagacaaaattaaattactctcttcttcatctggctttgatcatatccaaagtcatttatctaaacctaagccatctacagaaaatcagtggccaaatcctaaaggtatccctttacctcactgcagaatttccccaggctccatgcttgtctgtgagaatgttgataattttctggattagttgagttgctgtcacgtggtcacgatattttgctgctcttatcaaatgatcacacatcttctcatcttctcgtttgtctgcagaatactgggcacacagtgacttggagagaaaaaaaaataatactataaaaaatgtgaaaaaaacctttaaaatccattatgaaataatctttaccctaaatcaaaacaaccaaaattttaaatctacttttacattcctcattcacctaactgagatttagtgatctgctgtctcaataaaacatcccacaagaatttacttctgtgaagtcaatcatgagatacactcagaagtggtaaacattcaagtagagacctgaacaatgagacaaagacagtcttgtaagaagcaggggcccagcacgacaaacagcatgaagtgaagttgcaaaggacttgagacatagtgaataaggagaataatggttaagaaataattttcaaaaggcaggccagggctacatcatttgtattatggtaaggagtttagattttattcaaatgtaatggaatcccagaggaaagttttacgcagtgaagtgataaatttacatattaaaatgatcatatagctgctatttagagaatggattgtagtgggacaagagaagtgaagttggcagttatgaggccactgcacagggccagaaaagagacaatagcagcttacaatagtaaattgagctagttctaaatacctttagaacatgaaactgtttggtcttttaagtcctagcaaaatgtaccaagagctctgggattgcctgggatcttatttcaaatgcagagtctcaggccccaccccaaatctattcattttgtgtttgaattttaattcccaggcaatttatatacatcaaagtctgaaaagtactgtcttagatatcatcaattttaccaaaaaacaccttagaattatttgtcagtaatcagatacactataattgctagtctccaaaatgcttatttctcttcttttggaattcggatacttgtggtgtcatgtttatgatactgtagttaaggcattgtttaaaataagaaaacaaagatggatgtagacttggtcctttgttctattcagtgtctactggagtcctctcccccacccccacacacatatcctttgatagataagtaacataaacttgatgttgggataaatatttctagtttacatacggaatatgcattgtggatgcttgcctctcctacagtataccagtttcgatagattgctgccacgcactactcccaccaccaccccagcaacaaataggagtcctgattgtcctgaaccaatcgtaataatcacacccacactggcaaactggattagggaaggacacttgatgtaactggtacaggtagggcaaagttcaagatttagttggacagttggttccctccttcctctcaaggtgtaaaagaagcagcaaattctaggagtattggaagctctctgtaccatgagggaagctggcctgaagatatggccaaaatgagagcagaactatgaaaattgtagaaaaacagagctcactccagaatcatgaacttccagatcaatcaaattctcaagaccagccaacccctatgagactttttaaagatttttttttaagagccaataaactcctgctcattgtaaaccagtaaaaacatccaaaaaaattggttttttttgttccttacaccaaaagcaattcatcctttgcatggtgtatatgtacatgcataaggaatcaaatatatatatatatatatatatatatatatatattttttttttttttttttttttttttttttgagacagtcttgctctgtcgcccaggctggagtgcagtggcgtgatcttcttggctcactgcaacctccgcctcctgggttcaagcaattctcctgcctcgacctcccgagtagctgggactacaggtgcacgccaccacacccagctaatttttttgtattttagtagagatggggtttcactgtgttgcccaggctggtcttgaattcctgagctctggcaatccacctgcctcggcctccaaaagtgctgcgattacaggcgtgagccaccgcgcctggccaagaatcaaatatcttagtctgtgcaaaacactatgctagggagatgaaaagctgaattgtataaagaggaattttagaagttagtcttgggtgggaataaaggaaacctttaaagcaaaggcaaggcagaaaaacgttaatcaatttcagggagggacaaagcaagagagtttgacccaagtacaaaatacaggtagaacgagtaatagtctgaagaaactctggaatgcagaatgagtatagaaaaaagtcacaggaatcatagtatacttatatgaatgactacaagattgggaagcaaaataaaaaccaggttacggtatcacccttgctaatatctcctgtcagtcttgatcaattcactcatttacctctttaggtctaaatgtcctcatctgcaaaattagcaggttatattagatctaagattgggtcaatccgaagattctgggcaacctctgtgagggtacttgagagtacctgagttcaacctctgagagatgttcactggtaaaggcaaactgtttatttaatctaaacactgatgtggagaaaataaatcctactaagaactagaataactcatgagaaattaaaagcaaatttcatacgctatatttttaaaaaagattgacccaaaccacagaagagttcactttgtcaaaaatatgatttgagcaaataaaagaaaatgattaagaaatgtatgaaagggcagcagtttaagtgaagataactaggaaattatttcattgtaacaaaaatgtcaactgatatgtcattttttatatattcattcaagaactgagaagcattctataggttatttcatatctaacccaaccatacactaaaacaaatagtacgaaatgacagacattcacagaactgtaaactttcaacattctctactatatccatatctgtccttgtctaacttcacctaagaggaaattcaaatctactgatgagatttagaaaatcaccggtttctgaaatgctatgaaccaccacataccttcatattaaacagcattaaaagtaaccaaaaacacattattaaatagcttgtcatttctatctcttattaatatattaatttaaaatcaaattatattttgtaaacatttgataagctattaaagtttgttctaaaaggcataattctaaaaacaagggctcaaggtaagctaaacggtaaaatggtttaaagtgttctttaatggatccttctttacaatttgaacagcaacttttcatatctgacataaaatctatagatataaatcacattaaagggctattctttcctgattatcaatctctgtctctttgtggaaccttagggtcacatctgacctaaaaacatgataaaagaaaaccaaacaagaatgtttcataaagatataatgaacttgtaatattttttaaatgtccttataatgtaatttgaagatgttcttatttaaaaaccaataataaatcctatgtatgaaatattgttcaaagtcatgtggagataagaaatatttactctagaatcaaatacatattatttatttgtagtatacatatttgtgtatgtatgtatacctgtatttggaggttgagtggaggtacaagagaccttaacaaatattgctatttatcggtaacataaacggtcaaatctaaaactttcattcaactttaaggcagaattttttatgttttatatcaacttttctgtgttcctatttgtaagcactatataaactagataatataacatcacaacatggccacaaaatatttgactataaaaagaaaaaaataagcatttggggaacaattctattttatgtgattattgctaaagaaacctaagatttataaccaaagaatgaagaaactcaatataggataaataaacctccacagaagaaattcagtcactcacagtaaatagacaaagcgaccattttagctctttaaatgtaaatgaatagagacaatatttaatttttccttccagatgtcatagctctacctaattttactattcatcctttgcatgaaagtaagagaggacacaaacaaatggaaaaacattccatgctcatggataggaagaatcaatatcatgaaaatggccatactatccaaattaatttatagattcaacactatccccaccaacctaccaatgactttcttcacagaattagaaaaaactactttaaatttcatatggaaccaaaaaagagcccatatagccaagacaatcctaagcaaaaagaacaaagctggaggcatcacactacctgacttcaagctatactataaggctacagtaaccaaaacagcatggtactggtaccaaaacagatatataaaacaaatggaacagaacagaggcctcagaaataacaccacacatctacaaccatctcatctttgacaaatctgacaaaaacaagaaatggggaaaggattcgctatttaataaatggtgttgggaaaactggctagccatatgcagaaaactgaaactggaccccttccttacaccttatacaaaaatcaatccaagatggattaaagatttaaacgtaagacctaaaaccataaaaaccctagaagaaaacctaggcaatgccattcaggacataggcatgggcaaagacttcatgactaaaacaccaaaagcaatggcaacataagtcaaaattgacaaatgggatctaattaaactaaagagctcctacacagcaaaagaaactatcatcagggtaaacagacaacctacagaatgaaagaaaatttttccaatctatccatctgacaaagggctaatttccagaatctacaaggaacttaaactaatttacaagaaagaaacaatcccatcaaaaagtgggtgaaggatatgaacagacacttttcaaaagaagacatttatgcggccaacaaacatatgaaaaaaagctcatcatcactggtcattagagaaatccaaatcaaaaccacaatgagataccatctcatgccagttagaatggcgatcattaaaaaatcaggaaacaacagatgctggaaaggatgtggagaaataggaacgcttttacactgttggagggagtataaattagttcaagtattcaagtattgtggaagacagtgtggcaatttctcaaggatctagaactagaaataccatttgacccagcaatcccattactgggtatacacccaaaggattataaatcattctactataaagacacatacacaggtatgtttactgcggcactatacacaacagcaaagacttggaaccaacccaaatgtccatcaatgttagactggataaagaaaatgtgacacatatactccacggaatactgtgcagccataaaaaagaatgagttcatgtccttttcagggacgtggatgaagctggaaaccatcattctcagcaaactaacaccagaacagaaaaccaaacaccgcatgttctcactcataagtgggagctgaacaataagaacatatgggcacggagaggggaacatcatacaccggggcctgtatggggatggagggcaaggggagggatagcattaagagaaatacctaatgcagatgacaggttgatgggtgcagcaaaccacaatggaacatgtataactatgtaacaaacctgcacattctgcacatgtatcccagaacttaaagtataataaataaataaataaatatttttaaaaagtcctaaaagatttaaaaaaaaaacagaaatggaaaatgttaatagatatattctctattaaagaaattgaactcaactactttaccataaagaaatctcaggcccacatgtttatatcggtgaattccaccaaacatttaagaggaaataatactgaggccgggcaagatggctcacatctgtaatctcagcacttagggaggctgtgacaggaggatcgcttgagcataggagttgaagaccagcatgggcaacatggtgaaaccccatagctacaaaaatacaaaaattagcccggtgtggtggcatgcacctttagtcctagctacttgggaggctgaggtgggaggatggcttgagccctggaggcagaggctgcagcaagccgagattgtgccactgcactccagcctgggtgacagagccaaaaagaagaagaaataataatgaaaaaaaaatttacaacagcatgaaaaatatgaaatacttagctatattttaaaatttatacagatcttataaaaaataaaaccataaaatagttaagagaaattaagaagctagataaatgaagaaatatataatttatgtatacaaaatatacagtttatagatttaaagattcaacattttaaaaattgattttatatattcaacacaatcttaataaaaatttttagcaatttttataaaactgaaaagctgattctaaaacacatataaaaacagaaggtaggccgggcgctgtggctcatgcctctaatcccagcactttgggaggccgaggcaggtagatcacaaggtcaggagatcgagaccaccctagaaaacaaggtgaaaccccatctctactaaaatacaaaaaaagtagtttggcatggtggcacacgcctgtaatcccaggtactcaggaggctgaggcaggagaaacgtttgaaccagggagttggaggttgcagtgagccgagatcacgccactgcactccagcctggcaatagagcaagactccatctcaaaaaaaaaaaaaaaaggtaataacagcaaagtaactttagaaaacaaagttgtaagacttcacacccttcccaccatattataaaactagaaatgaagagcactggttattagatgaagaaagagatgacaaaatgaagaaacaactggtactgaaacacctggctatccacatgagaaaaaaaaaaagacgaatcttttctttcacctaatatcatacaaaaaatacttaattcaaactggatcaaggatataaatctagaagttaaaactataacatttccaaaacacaacagcagattttttttataactttgggataggcaatgttgttagactggacagcataacagaaagcatagaagaaaatcacaagaatttaaaaactgacaaaataaactttatcaaaatttaaaacacctggtctttttttttttttttttttttagacagagtctcgctctgtcgcccaggctggagtgcagtggctcaatctcagctcactgtaagctccgcctcccaggttcacgccattctcctgcctcagcctcccgagtagctaggaccacaggcgcctgccaccatgcccagctaattttttgtattttttagtagaggcggggtttcaccatgttagccaggatggtctcaatctcttgacctcatgatctgcccgccttggcctcccaaagtgctgggattacaggcttgagccaccatgcctggcccaacacctgctctttaaaagaaccatttataaaataaaaggtaagccacaaattgtgaaaaaaaatttaacatacatctaaatgacaaatgaattctttacagaatatataaagaattcatacaattcaataagacaaacaacctaattaaaaataattagcacaggatttgaacaggcatttcacaaaagatatacaaatggctaataaagcacatgagaagatgcttagtcagtagagaaatacaaataaaaatcacaataagctatcactatacacccactagaccggctgaaatttaaaagagctacaataccaagcactgacaaggacatggaacaactggaactctcatacctaccttggtggttgaattgtaaagtcgtcaactactttggaaaatagtttgtcaatttcttgtaagcttaaacatatacttacagtagcatgtagcaatcctactcctaggtatttcctcaaaaggaataagaacatatttctacaaaaataacttgtatgaaaatgcccatggtgcatttagtcataaaagtcagacactgaaaacaacccaatgtctgcctatagctgaatggataaacaaaataattcaacttagtatttaaaaaaacaaaccaataatacacacaacaatgtgaacgaatatcaaaaagtttatgctgaccaaaataatccagagtacctactatttgattccatgtatataaaattttatagcagataaaactatctataataacagaaatcagatcactggttgtctgggattggatatgagtatatggagaggaattgaccacagtggatcacaggggaattctctaggatgacaaaatttcctatatctttattataatggtaaaatcacagatatacacctttatcaaaactcctcaaattgtatacttaaaattttattacatgcaaactatacttcaataaagtttatttaagaagtgtttgtttgtttgtttgtttgtttgttttttcaggcaggatttcactctattgtctaggctggagtgcagtggtgtgatcttggctcactgaaacctcaatctcttgggctcaagtgatcctgccacttcagtcccccaagtagctgggactagaggcatgcaccaccatgcccaactaattttttcgatttattgtagagatgaggtctcactatgttgcccacgctggtctcaaactcctgagcgcaagcaatccactcacctcggcctcccaaagtgctgggattacaggcatgagccaccatgcccagcaagaagtttttaaaaagtggatggacaaggtatagatggaggaagcagttaaaatgctcataccaaaaaataggctcatatagcaaataggtaaataccttctacaaatcaatgaggaagagacagataaccaataagaaactgggtaagagagcaacatgtacttcacaaaagtaaaaaatagataatatataacaagcaggagaatagactcaattcttttaaaaattcaaaataaaagtacatcagaatgccaaaataaaaatcaccagtcaactgttgatgagaatgctgaataataaagaacaattctacactgaggctgggagtggtatatacttttgcaagatagtgtgacaatatctattaaaagtgaaaatatgaacattttgtaatcaagtaattccaccatacagaaatgcacaaggatgtacgccagacatataaaatattcaaagtgcattattcataatagctaaacactgaaaacaaccaaacaaacagaagagattatttaaaaactaatggtctacatattcggaatagctaaaaattggaaataatccaattacctatcaacagtagaaagaggtaatgaacagctagcagtctatacataatggaatactatgtagtaatgaaagagaagttgaaaaatgtaagaaaataattaaatgttggaaacataatgttgaaataaaatttccagaataaaatacatgttttataattccatttatataagggtcaaaaattgggcaagggccgggcgcggtggctcacgcctgtaatcccagcactttgggaggccgaggtgggcggatcacgaggtcaggagatcgagaccatcccggctaaaacggtgaaaccccgtctctactaaaaatacaaaaaaattagccgggcgtagtggcgggcgcctgtagtcccagctacttgggaggctgaggcaggagaatggcgtgaacccgggaggcggagcttgcagtgagccgagatcccgccactgcactccagcctgggtgacagagcgagactccgtctcaaaaaaaaaaaaaaaaaaaaaaattgggcaagaaattacagtgctaaaagaaacatacttaagttttgaaagaataaaacaaaagcaaatgtcaaccataaaattcagaacagtggttaccttaacagggcagaaaggggttgtgattggaaggctagaaaacttctcacaaactcttcgtttcagtatcacaaaaaaattaaattaatgatgttaaacatacattgtttctaaagttaggttttcagagtaataagttttttaagaaataggttataaaaagcaaatttttattaagtttgcaattaagttcttgttaagttttgaaataaaaataaactacacacaattttaatgctaaaatagcaagcccttttcctaaattaataatgtttaatgctaattaaacaatttgttttggtctcacaagttttgtatttaaaacctcttttaaagacttttaaaagaaacatatacttgcttttaaaaacaaatcaaagaacgacataaaaaagaaaaagaaatttctctcttctacctcctccctgtttggtcagctgctttctacagaggtagtcactgtttagagtaagatgtcattcctatataatggaatcaaactgtacatcattccatgtcaggaccttctttcttttacatggctacaaacagatgattacatttttagttaaccaagcattgcttctgctaaacacgtttaagtgtagtactttccttctcaatttgtctcaaaatcacttacactataaattacttgtctcactgaaaacaatttaaaagtgaaatcacttcagggacaataaatgaagaagtttctcagtatttcacttttggaggtctttgtacttgatcccttaccttaaagtgtgatctttaacaaaaaaaaaaaaaagctatctacagaaactcagaaagactcatagaaaagacagaaaaatgaaagcttagaaaatctcaacagcaaacaaaagtcaaccaatgacaatgtgtgacagccacctttaattctgtagtgattcctctgtcatgcaacgactcaaagtattgatttctctcagcatgaaaaagcctaagccaatgaaacagacagagcagcaaccccctcctcccttccccccataacagcattcaaggttaaaacaggcagaacacttatcaaagtatctcttccatttcttcttgttttaatagactggatacaacatgttgggttcttatcgttacaaactatagtcctcagacaatatttttaaataatttgaagattaatataggttattctatttttttgcttcacacttttggtaataaaaaacttgtttcaaatgctttttttttctgtgaactcttaacagaagtatatataatatttgtaaaaacaagccgacactaataagaaggctatagtttctacttgtgtgccaattccacacataatattttgttttcattatttctttagagtacttattaacaataaaacccacaaatacctaagcatcttccaaaaagacaaagtgaatccttcaacaatgcaaacacacatcatacatctgtttggaaaataaagtaaactatggctgctatctgtgttcaagaaaatagtaataacataaaatgtaagcaaaggatagggttgaaaccacagaattatattttaaaactatagtatgagacaaaaataacaatcagctctctgtatccccaggttctacatctacagattcgaccaaattttttgttttgttttgtttttgagtcagaatctcactctgacacctaggctggagtgcagtgacatgatcacaactcactgcagcctccatctcccaggttcacgcaaccctcccatttcagcctcatgagtaactgggactacatgcacacatcaccatgcccagctaatatttttctgtagagacagggtctctcagtgttggccaggctggtctcaaactcctggcctcaagtgatcctcctgcctcagcctcccaaagtgcttggattacaagtgtgagccactgcaccaggccttgaccaatttttgatctgcagttagtcctggaaccaattccgcatggatccagagggatgactgtgtatcttcacaaaatatgtataaatggttacacacagagaggtaaaattaagaagctttaatttcttaaactttactttctgctaatctgcaaaagagttagatgatcttaagcaaatcctatcatcttttaactctacctaaccaatggatttttaaaagcataaaaaactagggtcttttagttgtattagcaaggtctcctacttatgaataaatatatttgctactacaaataggtaaatcttacacttaaatatcaaggccagacatggtggctcacacctctaattccagcacttagggaggtcgaggccagcaaatcccttgaggccaggagagttcaaagccagcctgggcaacatggcaaagtcctatctttacaaaaaatagaaaaatcagctgggcatggtggcatgcacctgtagtcctagctacttgggaggatgaggcgggaggattgcttgagcccaggaggttatgctgcagtgagccataatcaggccactgcattcctgcctgtgtgagagagtgagaccctgtctcaaaaacaaaaataaatttcaaataaaagcagttcaagaacaagcatgaaaaccagaaagaaaataagcaattatgtataaaaatcataattaacaatgtagttaagagcaccaactctagagctagatgacttgagttttaactcttggttttgacacattcatgcttaagcaagttatttgaaaccctgtgcctcggtttcctcatataaaagaggagatgatgtggtatgcttttcaggaggatcaagaatagacataaaatgattagaacattgccagtcatataaaggtaacacctaacatttattgtaggcttaattgtgatgttatcaaaatacgtaacaaatagtccctgtcttccagcatctcactgtagtttagtaaaataaatacaatatgagaaagaaataaactatgagataactgctcaaagagttatagacagtatgtttggaaagagagaaaaagaaggaactattaggaatcagggagaggctgggcacagtggctcatgtctgtaatcccagcactttgggaggcgaggcaggcaaatgaataccttgcactcaggagttccagaccagcctgtagagatggcaaagtcccatctccacaaaaaaaaaaaatacaaaaattagccgggcatggtggcacacatctgtagtcccagctacttgggaagctgtggtgggaggattccttgagcccaggaagttgaggctgtactgagccgagactgcagcactctactccagcctgggtgacagaagagaccctgcctcaaaaaagtaaaaagaaaaaagaaaaaaaaaaaggccgggcgcagtggctcacacctgtaattccaacactttgagaggccaaggcgggtggatcatgaggtcaggagttcaagaccagcctggtcaagatggtgaaaccccatctctactaaaaatacaaaaattagcctggcatggtggcaggagtctgtaatcccagctactcagaaggctgaggcagagaagtgcttgaacccagcaggtggaggttgcagtgagccaagatcacaccactgcacaccagcctgggtgacagagtgagactttgtctcagaaaaaaaaaaaaaaaaaaaaaaaaaacagggagagtttcacagaggaattaaaggctaagtacctgttcaccaagaagaaagggatagaaaaaataaaatgtagaaaataaaagaggtcaaaaactaagagaacaagctcaaataaatgcatttttttaagcaaagataggaataacagaatgagacatgtaataaagagccttctctttttaaatatcctgatacatgtttatatttttcttgggtaactaatacattttttttaccaattaccttcataaaggaattattcctcaaaggtttatataaatcatttaacatacaaaatattaactagatttgtatttctcagctgatgattgttataatgttataatttctttaattcatattcaaatgtattgccaacacagaccatttcaaaacaacacacctgaatattaactgggttataaatactgtttctcaaactacctgtagggaagggccagttttgttttttttttaacctttttaaacacctttagcactgatgcctttgatgacattgccagacattcaagctataaaactttttaaatattcaatttctgtactcagctctttgtggattactaagaagtaatttagtcagcagaccatacttaaacagcactaatataaaaaggtaagtagaaggaaactatttttatcaactcaagtatttccattttgctttgtatggtaaaatacttgctttgcaaaataaaatactttgtattataaaatgcttggtcttatattcagtgctttaatttttattaataaaccagaaacaacaatagccaatattctaagtgcacatgagaaaagtctaaattataaacaaatgttgtataaaatacactgtaaagatttttaattagcttagtttcttattaatctttattttaaaatccattaagaaaaggaaggctttacattagtacataatttggtctatggttaagataaccagaagataccataaactgaaagcttaagtaaaggcttgatatatctatgagggatatattcagacattttctttgaagagattttcaatgcattaaaaggtctggttttcaaaatatattttacaagaacatactgagaagataatgaaaaaacactcttccagtttggatttaatttgatcaacaatgcctgcaacagttttacctacatataaaccttttgctttttctagcttgctagctttaatagaaatatagtaatagtaagcatccgagtaaaatagctgtttttttaacctggtgcagcatcacttaacaatttgcaaacaaaatctcatcgattcacttttaagtggtcttcctttatcccaccaatgatagttcctttagtttcacaaacagctcaaaaattattatttcttgttatatgtatgtatatacctgtcctttatacaggtaagaatatgatgttcaaaagatacctacagaagagtaacagcagaaaatattgaggcctttcttttaacctggtcattttcaaaaagctaaagttgagagtatgacaagtaaaacacatcatggaagaacctctaaaaatagtgtgttccagactaaatacacaagactttggatatgaaaactgaaaaatattattactgcatagtccaggtctatagacgctacaacatatatgataaattggggtaagagtttccttaaaaaaatttgatggtgccgttgtcactcaacctgaggcaggaaaaaagggtaacactggactgaggaaaaagcaagattcttctctaagagaggaagcaggtgatcctgaactcgagaaagaatctggtcaaaagagctctcactgttggagagctaaactggcttctgcagcatggcaaagggagacgacctggggaaagagggagacagagtcaagaaaaactgcctgttcaagagtgtggcctatgaatcctaggagatgcaatatctagtattgttttgttttcctcttctgcactgtgatgcccttctatcattgcaaggcccacaaaagagaaaaggagaggtctatgtccacgctttgggcaacaggataaagaaaaacagctactgcctggaaaagttgtttgtaagatgggaagaggtattctccagagctctgatacaactctatccagcaatagtgtagataggaacctgatggcagagataagagtcctagattcactgtggcacatataagcattcaatttccagagattacttgaagaaaaaaatagctgttattaaacacttaatatggattcagagtaatgggtacattaggtttatcaaatcccatttattcctgacaacatagctacaggtaaacatcattattatcctgatgtaaaggtgcagcagtggtgtcttacttcacatggtttagtgaatgacaatgccaagactagtcaacaattttatctgatgaggtagtcagagctaaggtcaactgctgcagagtaatcatgtctcactggttgggtattcaaaccctagcaatttggacattaaaaagaacttgaatacttgtcagttggttatactggtagaggttgagtatcccttatccaaaaattcaaaattcaaaatgctccaaaatctgaagctttttgagcaccaacatgaccctcaaagaaaatgctcattggagcattctgatttccaggttttcagattagagatattcaaccagtaatataatacaaatattccaaaatctttaaaaacctgaaatttgaaacacttctggtcccaagcattctggatacgggatactcaaccggcattttatctttcatatttattgatattatttttatcaaaggtgaagaaaataacaatgatagaaaacagaaaagccacaatttatatttgtatatatagtcatgcatggcttaatgacgagggcatacatcatactgtttatagcctaggagccatacaaatatgtacagtatgttactgtattaaatgttgtaggcaactataccacaatggtaagtatttgtatacctaaacacagaaaaggtatggtaaaaatgggtataaaacaaacaaaaaaaatggtacagggcacataccatgaatggagtttgcagcacttgaagttgcgttgggtcagtcagtgtacaagtagtgggtgaatgtgaaggtctaggatattactgtatactactgtagactttataaaccctgcacagttaggctatgctaagttaattagaaattattttcttcaataataaattatccttgctcactgtaacatttttacttcataaacttaaaattttttaaaattgtttaactcttttttaataacacagtttaaaatgcacattgtacagctgtgccaaaatgttttctttctttatatccttattctataatttccttttttttttttttgagacagagtcttgctctggtgagacagaggctagagtgcagtggcacgatcacagctaactacagcctcaactcactgggctcgagtgattctcccacttcagctttctgagtagctaggactacaggggtgtaccaccacacccctggctaacttttttattttttgtagagacaaggtctccctatgttgcccaagctggtctcaaactcctggactcaagcaatcctcccaccttgaccaaagtgctgggattacactgtgcctgatctataaaccttattctagtttcaaatttcattttttcaatttttaaattttgttaaaaagtgagacacaaacacacacattaggctaggcctatccagggtcaagataatgaatatcactgccttccacctctacatcttgtctcactggagggtctttggggcagtaacatgcatggagctctcatctcctatgatgacaatgccttcttctggaatacctcttgaaagacctgactgaggctgttctacagttaacatttttttttaataagtaaaaggaatacactctaaaataacaagcatagtatagtaaatacataaaccagttacacagtcgtttaatatcattaccaagtattatataattgtgctgcactttcatacgaatggaaacacaagtttgcttctgccagccttaccacaaacacgtgagtaatgagttacactatgacattacaatggctacaatgtcagtaggcaacaggagtttttcagctccattaaaatctcataggaccaccactgtacatgtggtgcgtcatttaccaaaacatcattatgtggtgcatgactgtgtatatataaagcaaatattgtcaagcttagcatttcgtggttcctatgctagagatgcagaaatataaataaagacattaactaaaatgtccaaaaccgccatggtagtagatatcaaaactggaatgagaattgacattctaatactttgctatcaagctatgatgacacaaaatctatcaatccatcatctcttcactaaatgacaaaagtgatcaacacaaagtgtatatcaagggaggaatgtgggaagagaaaggggtacattaatcactgaggcagaaccatcctgggccaaagaatggtattcttagttttaaaaaagttgtccttgactttgaccatccttcttctcactaagggtttttaagataaggtggccaactagaaacagaaaactataggggaaaaagttaggagaaaatcaagcgggagaataaagaagaaaagacaaacaggaaagcataaatagcaggttcacataaaattacttttgcactatttcctaattatgagtttactttaaaagctagtaagaaaaaatagtattataagatttcgtttgcactgtattttaaccactaaatgagaaacaaaatggggagttcaattcagtaatggtaaaaatgagataatggacaaaggtgggaaaaaagtttgtcatttaactaatctttacacagctcaagacattttgcactctaccaatttcacatgcacataggaaaaaacatataaagtcattagaaaagagcaaggtaaacagaaataacaaatattcaaggtgtagtttcaatcatcgacaaaagtgaatgaaaaggaaataccaagataattacataggtgagactccaaataactaatactgccattttacaacctatgttttagaataaaaatattacaagctacagatttgagactacactaatgagctttaaggaacctcatattattacaaagaaattaagtatcctatccaacactacatagttaattagtggcagaacaatgcctaaatcctagttcttacaaatcccaaatctgtgctttctatcatacactacagactgcaaaaacgattttacaacttacgtgtaattaaatattttaaattcatgctcttaagcatgaatttaaacatgctttaacaaaccaactcaacccttaaaaaaaatccaagtattatacaaagtccatatttcaaccatcaaattgttaagttcagaaataattttcatagagatttaaattccggccgggcatggtggctcacacctgtaatcccaacactttgggaggccaaggcagggggatcacctgagatcacaagttcgagaccaggctggccaacatagtgaagcccccatctctactaaaaatacaaaaattagccaggcgtcatagtggacgcctgtgatcccagctactcgggaggctgaggcgtaagaatcgcttgaaccctggagacagagattgcagtgagccaagatcgcaccactacactccaacctaggcgacagtgcgagacttcgtctccaaaagaaaaaaaaagtatttgcctttatacatcattaaatgctcattaagaaaaacagcgacaatccagtaagcaatgctagggaacaaagtgattactttcttacttgctgtatctactaggatacaaacagaaggtaatttttaatgaaacattatcttaatattaaagaatctaggatctcaaatgaaaaaactgattcctcaaatttatgttagctggatatggaaatcttctttaatcctaacatatgtcttctattactgacaatttcattcattcagcaattctttgggagcttcctatgttccaagcctataccagatgttgaaattaaaataaaacagaaccttttataaagaagtcaatatgtaatatttgtttccctcagtagtcaccaataatttcaaaacatttttaatggttaaaagtaattctcacaagttgtccaagaagaatataatccagaaattgctaatgtaacgtccataacaaaacaaaaggtagtaaaggtcagcctttaacgatttctcctacatgattgtaataagagaagtgatacatacaaaccatacagacccttacataagaaaatctcaagacagaatccataaacatgtaaaaattacatgtaaaatgtgttatatttgtatgaatttatcaaggttagattctcaaagagtccattagcccaaaaaaaaaaaagaactattaactcaaaatataaagaacagaacatttcacctaatatcccatttttgagccagactaagtggctcatgcctgtaatcccagcaattggagaggccaaggtgggaagatcacttgagtccaggagtttggaactctcctgcacaatatatagcaagaccccatctctacaaaaaaaaatttttttaatgttagccaggaatggtgaggcacacctgtagtcccagctaaccttggaggctgaggtgagagggtcacttgggcccaggggtttgaggctgcaatgcaccatgatcccaccactggacttcagcctaaaccacagagccagacgccgactcaaaacaattatgtgtgtattttatatttgttttatattatgaaatagatacacaaataaacactcataataaaaagcctaaaatgctatgtgccaaaacattgtcttgcctcttggtggggcaaagatactggagaaggttctctttttattattatcattattattattattatttactgttatatttttcttcttttctttgctacagtattctccagctcaaaaattaatgaattaaaacacaaaaagagccactgatctaaatcaaatttttcttaggtcagggtatttcaggttaaccttctgggaagtacctgaattctatttttaaaagaatttttgatttcatttatataatagtgccaataacaatagatttgggcatatctacattatacatatatagaagcatttcatatgcttatagttcttatacaaacacaatgaaataaattacaaaataagttgaagcagcagcacagaatttatattttttgtgattgtgtaaaatgaaatataatttgtaataaattgataatcactagattggactatcatgtaaaaatagcatcaaccaagccatgaaaattgttaaattcagtctatttaacaatgataattgataatgacaattaatgacaaaatttcttttgcataataagaatatgtgactcaaagtcatttttatagactaagatttcagtatttacttaacacatacagcagattctatactacggaaatggcttgttgtaccgagtaatgtaataattgtaatattgctggttacataaaaaaatgaattcacatgaagtgatgtatcatgtactacatgaataaaaatttgacagaagtttaaaaatagaaaagtaaaggcagattatggcacagacttcaagttatttgcccaaatcctcttcccccttcaatagtaccaggggctcctgattcttaagagccggtaaccgtctagaatgaagtgtatatttcccaatttcataccattttgcttttattaataaagctaatgaaaatctgggaaggaaaaacaatgaatttaagttttagacaaagtgaatataaacgggtaagaagacacctaggtaaagaaatatggcagatttttgaaaatgtgaaactggaaatgaggtctgcattatagtcagtaacattaaaggtgaatcccaccaaacctttaaaagagggtaattccaatgctacccaccctgtctctgggcatgaaaaaagaatggaaattgtaaagttattcacaagaggcaagtataacactgaagctaaaacctcacaaatgactaagattgcatagaaagttaaaacaaccacaacccaatttaagaatagaacatgacaattacaaacaaaacattagcagatacaatctggcaagattaaagaaaaaactaagaccaaaatatattggcataatattgacatatgtaacatcaaaaaaagtatactatgaatatcaactccactgctccacttaaggatgacaaaattgaacattcttcatttacagaaaaactccataaaaagtactaaataaatatttcattaaaatgataaagcatatatatatacttcagatcaaaggctatgtcatacttagtagggaaacactgaaacacctctgctaaagtcaggaacaagaaaaagatgctattattttttaacatcacactggtgatagaagtcaattcaattagacaaggaaacgtaattacaagaattaaagttggtaagttgataccaataaaagttggtaaaactatcaatatctgcagaagatgtgagtgcatgcctgaaaagcccaagagcatcaaatgaaaacactcttttgaatcagacgagctgaatctaatgttagattaacaagccaaagaattttgaaaaaagaaattcaaaagggcaataagaaggaggaagaggaggagaagcaagaggaacatagacctattagtatcaaaacacattgtaaagactcaataattaaattgattaatatgctagcttgacactagtatatgaaatcacacacagactaatgggaaaaaaatcaaactcgaaattgaccccaaacatacaggcatttagtatataacagtagcatcttaaatgaaaacttagactaccgggtaggtggcatagggaaaactaggtaggcatataaaataaattgaattaataacacaatctgtactaagataaattccaaataaattaaatatttaaatttaaagcaataaaactatagaaatattagaagaaacatatgggaattcctttataatctatgtgtttctacccttccaactaccaaacagaaattgagatccatgagagaaaatatccacacatttaacaaaaaaaaaaaatttaacttctgtaaggcaacaaaaaataccatcataactaaacaaacaaacaaattggtaaaaagaaagaaaaaattctaacatatatcacagagttgattccttaatacatgcagagcttctaaaacaaaatcaataagaaaagagacacaatcaatggaacagctgcaaaggacatgctcacagaaagggaaatactaaggttcagagatcatcaaactcactcataaaaaaccaaaaatgtagtttaaaacaacactgagaaatacaaattaaaactctacactaccatatataacctatgcaagtgacaaaagtccaaatatgcttcataacacattctataaggaaacattcacactttgttgatcaaagtataaaaattcttcagaaaataatattaagtttaaaaagcaaaatacagaacattatttataatatgctagcattcatacaaagaaagataggaatatgtatctctatttgagtgcatatgcataaagaaaccctgaaaaattcatctaacagtggttttctgtaaggataaggggtggaaggcatcctggaagagattagaaggagatttttcactgtgtgctttcttataattttttattttaaattacctatagaaaaaactaaatgaatagattgaaaaattttaaatacttaatatcttctatataaaagtttcagataaggtagacatgagattgttaaaacagcacagaaaagttaaaactacaaagaaagtattcctgtgaaagacctatacttttaaaaaagcaaaagaaattggatgaaactaataaaagattcatgagaaataaaaaaccaatcagaaaaacatcaagaaagtcaagcaaaaaaggagtttaaaaatggaagggtctgtcatcagtgtcaaaaactgcagagaccaaggaagataagaaataaaaaaggaccactgtatatataattagtagatcagtaatgatattgaaaacaacaagtttaatccatttgtcctagaattggggatgaaaaggagaggagagaagccaaactatgacactgaacagtggaagggggtgagacaataaagaccattctagcaaaaaagtctggtagaatcaaaaagcaagagagaaaatggaagcttgagaattccagcagcatttaaacaaggttatcaagctctagcatatgataattagacagaggcatgaatatataaatagtgagaagctgcaacatacttccagaaaggtcatttaaaataaaaaaattttcagtgtattaaataataacttcattcaaaataatacacaatttgctaaagaaaaccagacattagtcaataaatacaaaaattacctatgacatcaagtaaaagaaaataagtcctttcaatcaaaactactcttaacaataagcagcctatttcatacttaatgagggcctgcaactgatagttcataatattctggaaacaggtatcaaggcaaatctcacaagtaacaggcgcatcatctaaggatctttttcacattaagaatcctattagaaagaaaacactaaaaggtaattgaatttccctcagttatcttcatctctgtcagctcctgctacaataacttactctccagagcagagataactcaattctgttcagcaagcatatgttatgaatctccaaagcaaacttgtctaaatcattctggtcttctatcaaggttgcctgtggatatgaactctgacagaaagcaaacaaatttatttttatcttttcaataattcacttctttatgccttgatagaagaaatcatgagataaatatatggtctacagttatgttataaagtcgggctgaaatggtttccatgacttaaataaaagacttaatgaataatccttcttaaacacaaagaaaatggtatcaaaaaatagaattggtaaattacctgaagtttcaatttgtttatactgttgccagatccttattatgatctcacaaatgctagtttgactatttcatttttgaagctttatagtaaaacatgttttataaaatgctagaaaattgaatttttaaaaaagataccaacaaaataaataatagttcatatgagaaaatgcatttcttatcggtattttaagccagctggcattttataacagaaaagaattaaaaaggctatataatagagacaaaaattctatgagtgtgagtttcttaagttggggtatacatagatcattgctattcagaacaaaaaacaatccaaattcaaattgttaatgaatacaaccctttcagtcataatccctttcctttaacacaggttaaatttctcaaagattctggcttggctattcatgacctttaaattctacactagtggtcacaataatagcaacaatgataatcactaacacacttcataatgtgttttaacctacattatataattttactctccacaataaaccttttattaacgtttcattatatccatttcatagaagggaaattaagactcagagaggttcaatgaattttatccaatattctccagctaataaattgtgaagcctagaacccgaacatgtttttggaaaccatgttccttctatcacattgtaacacactgtttcaaaattaagttacccttaaacagcagagaaaatgtcaaaaaatgtagccaacaatgcgccttgaaattttgatgtaaagtgtgctaacttgtatttcataaatcaaatggcttatttcttcatttcaagcacaatcagtatgtttttggattgaagacctaaagcaacccattgcagtaatttgagacgctattattaacctataactcctgctaataataggctgaaaataattctaccttggcctttctcatgcataatccatttgtttccatagagaaccatccttactacttttaatcaggtaaaaaagaaatcaaatgtgtggactgtaattagtactcatttattgaataattatttactgagcacctactatgtataggcaatgtacaagtctctatggatatgttatgaatagacatagagttcttaccttcatgaagcacacaaaagaacgaggcaggaaataatcagggaataaaatatataattacaaacaattattaagtgctatgagatattataacagaaagatcttagttagatttacattgggtgattggtgggggtaaaggatgagaggcagagaaggcttctgtgtaaaagtgacacttgaaggaaaatctaaaagatgagtagaagatgaataaaagggtattgtgactaggagcaaaggtaaatggagaatgaggttttgtggttgatattaaggattgtaggtttaacctaagagcaatgggaaggaactggatgtttctatgcatgaacaacatatactaaatttcagaatgactacactggctattctgcgtaaaagaaagaaaatataggtggggaagaaaaataagacaagagattactccaaatgttttgaactatagatgtgatggttaagataacaaaacacagtattgataacaaatgtttttggaggcaaaataaacagaacttgatggtggacagacattaagtgtgtagtaagggaaaaaatgggtaatgggtgatttatgtaagcaagtaagtaaatggaagtgatatttctcagatgggaaaaaatggaggagtagttaacaggggaatatacagttttagaaagtctctccccaaaagtggggcttcttataagaaatttcaagtggcaattacaagtatacagtggtatcacacaggtttgaagctcggaaaagaagtcacaaagacaaaaatcagaaagttttagataataaacaaatgctaacaaaaatagggggaagaggtcctcagaaatattgggtcaaagtgaaaaaaaaatactatatttaattaccttaagataattttccattcacagaaaaaggatatattctggcccagctcttgattacaggtagtaaacatgagccaaagagacgtaccaaattccctatttttcttctttttcagataattagctaatctttatatattacttacatgtgaattactttgaccctaaacaaggcagtgaagaatgagtgctttacctcctacagctatctatcttcatgtaccaataacgtgaggaaagatgtagactcattaattagaagaaaaagaggcccttgtttattagaactacactttacgtctctgcttgcaaactcaacatatcagttcggttggctaaaggatactattattcaggctaagtttacagttctatctctgactgagagctaaatgtcccccaaaaagcaagttcatgaccacagattgcaccactaattcccaggagctatctcataaataagtaacagacgtataaaagaaagctacatcaaaaaaaatttgaaagtttcagtatgaaccccaatgaaaaaaaattgccttacctgaatatcttattaactagagggcagtgatatttgtatgcacagagagacccttttgtggttaaaaatcacaggtttcaggtataacataggaaacatagtgacacaaagaagtcaaatctaagaagttaattttttttttttttttgagaaagagtctcactgtgtcacccaggatggagtacagtggcaaaatctcagctcactacaacttccacctcccaggttcaaacaattctcctgccccagcatcttgagtagctggaactacaggtgtgcaccaccacacccagctaatttttttgtatttttagtagagaaggggtttcaccatgttggccaggctggtctcgaactcctgatctcaagtgatccacccacctcagcctcccaaaatgctgggattacaggtgtgagccaccacacccagctggaagttaaatttgcaaccacaatataatttcaagagttgtatttttaaaatagcattgtcaggtatgtcaaagcaaagtgccaagtttatttagtaagattcactaccttctagagaatatgtaagaaaccatcaataactataaataactattaaaaaacccatcaataactataaaggtacttatgtccagcagttgtaaaaattacttttaaacacatttctgtgtaacttctcctaccagagtaatgataattgggacacaaagtgccaaagtaaaaattatttgtgcaatgtaaaaaatacaggaacagaggcaataatatcaataaaagaccttttaaaatgctcagtatcatcaatgggtctcttctgaattcaaaagtttactcactgatgtttccaaggtttatgaaggtactcatttagaagagctcatcattatataatgacaccctatctagtccatttcttatcattaaggaagagaaatcattttttactcaattcttctggtgcaactcaaggacaggcagtatactgtagcgattaaaagagcagaacataaagttttgagttgaaatcactgagcaatttattaatcagtctttgtcttttcttcatctgtaaaacagagataataaataatgcccacctggctcatgggttatttattgtaaggattaaatgaatcaatgtatacctgacccataaaatgtatgcaataaatcatagctactattaatgttattagtatccccatcctcaacgtttgagtatccagttagggccaggccttgtaagtaatccttaaagatttaatgactacaaattccctaagttctaagatagtccagatacattaacatgttgatgactatattataggaataaaaaaataatgtgctcacaattgtttgaactaataaaaaaccctttagctgtctaaaggaatgccaatgtcctaatcaaaacataaagtgaggtaaaagtttacaattttttctccagaagtaatattttcatgtcatgttctctcctcagaaaattccttaacttgtcacctgacaaccaaatttcacatttactggcaagaacgaagcaccaaaaaagttcctgaatatagcaaaatatttactgccaaaaaattacgctacgattacaattctactggacaagacatgtaaaggagagaaaacagcaacatccctaaaaagcctttatcaaagaatactaccaagctacaaaacggcaaaacccaaagagattcctacttaataagcaaaataaggagtggttcttttccaatatatcacacacacatttaggaggaaacacaaaaacacacagaaacattatgtttcgaaaagccacaaagaaaaccagttttttggttttttggattttgtgtgttttgagatagggctttgctctgtcacctgggccatggtacagtggcccgattacagtgcactgcagcctcaaccacctggactcaagcaatctgcccacctcagcctcccaagcagccaagactacaggcatgtgccaccaagcccagctaatttttaaatttttgaagagatggggtcttgctatattactcatgctggtctcaaactgctggggtcatgcaatcctcctgctttgacctcctaaaaggctaggattataggcatgagccactgcatccagccacagttctttataattcaatcacaaaatgttgttggtatgatcatctgtaccataaagaaatataatcaatgacatctcagttcatcagccattgtcatacaaggcactgtttgctacacataggtagagaaggaaagttggcatattacattattctgtcctatgttcaggaggcaacattccttacaatttttcctgtgaagaggatttcaggaactcggaaaaatcactcaacaaaaggaaatgacaagcaaaaagtccaggagattgattttcaaacttttggttttggcagtactctttttgcctatgtaactgtaacgtggcaaagtataatgaaacctattcttttaaatttgtgttttaacaatatttgtctaataagtgaagtaaatttttatgcaagcccaagaatgtaatacagataaaatcatgtggcctatccctgttcacagtattgcctgagataccgtaagtgatgatctaaagcaatgagttttgaacatatcacttctagtttgatgaaattagggaggagttaaagggatttacaatgctaacagtgaaatagagacacttttattaaatcgacaaatacaattatcacattttccccatataaaaccaaagacatgaggaacagaaggatctctgggtaaatatgaaataaactttgaccatttgtggctgctgatggagatcagatgagtgtgctcctaacaaaaatattcaattagtttgtgagccagtctgatagtttagaggtgtgctattcaagaatggtcgatcaacgtttctgatgcaagtctaagtaccacttctttacactccacaatgagataagtatagaaattgagggaatttagaaaggtttatagcaagtagacatggccacagcatccaaccacataatcagtggactcatctcaataaagtttatgtcttactgaattccctttatgtggatactagttatgtacagtacaaatacattatgtctaatatttcaagaacagtttataatttgtaactcaaatgtacttgtttatataacatttttacaattattttaatgaaagctattattttaaatttatgttttaacagtatttgattaatatgggaagtaaattttttattatctagttttaacgatgtttacaattagcaaaacaaacttcactagacttatttgacaaaaaagacatgccttttcataatgtatcaatagtagcaaacaaatcataactgaagtaattacaagaaaagattccaatctaactaaaattttatatcctaaatttcaactaataggaggaatgagttcaagaaatctattgtacaacatggtgactctagttaataccaatgtattgtattcttaaaaattgctgagagtagatttcagtgttctcaacacagaaaaatgatatgtgaggtaatgcatatgttaattagctatgtttagccataatgtatacacacttcagaacatgttggtataatatttaatttttgctcattaaaatatatttttttccaatagaatttataccagttttagtctaaattaagattgctaatatagtgagttcagttttgagaaacaaggccatccacattcacctaacaagcagggttaaaaactgagacaccagagtcaatattatttcaccatttgtttcaggaaatcctaccccaggaagataagattgcaaagaacaaataacttcactgtttgcttcaggaacaccaatgtatttgaataataaactgcttatttagacaaacagtctcattttcagaacaataagttactcaggaaaaaatttcacttaccaactgtttactaatcaacacctacatcagaaccgttgcctcactttctcccaatcctaaaatcttctatgataaatttatacccaaccacaatcagacctcgtattgaaagacctaagatgtaaaccatttgagttcatacctagaaactctataaatacccaccccaacctctcaccctgagatccttctaagatactgtcaaggttgcattctcatttagtgcagtatataatcaacttagctttgccaggctattctggtggtggtcctgaacagttgagagatggcagtagttttgtagccataaataattaagaattaaaaagaaagtgtggctatgtgcaaagatgtaataaataaaataataaaaacaaacagtttaaataaaaactgcaaagaaaaatgttcaaagtcaaatgaaatattgaaaagaatactgaataagccaacaaaagcagacatttaatatttcacataaaaactacattgtttggtgtacttataaaataccacatcaggttgccaaaatttaaatatgtatattttatttgtatgttttgtgtgtgcacaattgccaagtgttagtgaaagactacatcataagcattttcttcaaaatgttggtgagttacagacacttgccaatgagaccagaactgaatgtattcaggaactgattaatgaacaattactaatagaacccaaaaactagctaagtacttttcattacaacttaaagactgcattgatattgctaagagaacattttgtttttaagaataagtgatatttgaacatgataatatgaaggaaaaatccttatgttttttagatgcactagtgacaaacacaactacattgctctgaagaccatccatacacccaagaagaattatactgtgagcaaatatgatttggagtctgactttcgtttaggaaatgttctgatgatatagctcgaaacaaacatcgtgtggtggttaagatttaagaagtggaaccagtttccttcatcaacaaagccttgataacaacaaaaaaaaaaatcacttacagtgtattagtgacaacataaaaattgctaattgggctgggcgcagtggctcatgcctgtaatcccagcactttgggaggccaaggcagatggatcacgagctcaggagttcaagaccaacctggccaagatggtgaaaccccgtctctactaaaaatacaaaatctagctgggcgtggttgtgggcacctgtaatcccagccactagtgaggctgaggcagagaattgcttgaaccaggcaggcggaggtttcagtgcataaaaaaaagaaaatagggtaaaaaataggtatgacctttgcattaccttcgcaacttgttttacatctatagttatttcaaattagtcaaaaacaaaaagcaaaatccaacgaagataaacagatgttcaagctaaacaataaatgactttcactctttacattttttattttctaaattttctatattaaaaaatacttcatttttataattagaaaaataaacacgtttaaatttaaaaatcgatcaatgaggagaaaagcagctacttaagaggaaaattgaataatttctcatgattagctctaaaattggtatatacagtaccctaaaatacataacactaaaatatgtaattgttaaaatgtttcacattcctttagaactgtcaagaatatgttcaataatagaatatattattacaatagcaaaacactgccatgaagtcgacagaggctatggggacagactgtactgggttattgttatgaaacctgggttctaattcagaatcatggatttaattgttctgtgatcaaagctaaatcacattctctcaatctaccttgcatacatacatcaaagatgtgttgtggtactgaaatgagacaatgtgtactaaatcacttaatagatgacgttaggccacatagcaaagagatcaccagtttatactgggtatcagactaccctggttcaagtccaagcttcatcatatactagctatatgacctaaaacaaaccactgagcctcgctgtagttttcttatctgtaaaattgggctgaagataataacatttacctcagaggactgttatgataatttattttatatttgttaagaattcagaaaaacaagtggtactatagaagtgtttatttttaaaaatttataagtactcacaaaaatgttcactattttaataaaaatattttgcttgctaattggaaaaaaatctttgaattcttcacctaaaaaatatatagattgctatatttgccagacatagtggctcatatatgtaatcccaccactttgggaggcttgagctcaggagcttgagaccagcctgggcaatatgacaaaaccgatctctacaaaaaacaaaacaaaaattagccaggtgtggtggtgtgcacatgtagtgccagctactcgggaggctgaggtgggaagatcacttgaatccaggaagctcagtttgcagtgagccaaaatcgcaccactacattccagcctgggtgacatagtgagactctgtctcaaaataacaataatagtaataataataataataataataataatcagtgctttcatggtctttatttaataaaaaaaaatactccatttttattacttcaaaaaaaccgagagaccacctggtttgcagttccactgaagctagcaacaagtgagttctacagtatgttagataaaattcaaagcaacattggcccaaagaccttttgaaaattcttactgaagttgattttaactcacatagattcctaaaagaaaaatcattaagtgataatcatcagtacatatgttttacagatatatcacattagtttaaagaaactaaaattctaaaagacaaccttctttacaaaaatgattgccaggaaacttgtatattcacacatgcacaatgtttacaaggtatgatgtttctgcatgacataatttttttcataaatattctgtttataaccataagattaagaaacaaagttaagatgtacagctcatcaatgatgtcatgacattcatggaacctctctgtaaaccaaaagcataaaatgtcaaggatatcccactccaatgataagcatgcaatgaactaaatagatgcacattgcagatctacactgtcatcaatcctctgataataaatgaaacaagtcagctactttacacacaaatcgtacattaaatagatgacaacatctttttttgcagaagaaggtaattagcagtagataaaattcagttatattatttaagaatgtacagcttgaattcaaggctgaatacagataacctctaagatataagctgtctcaaaaaaaaaatgcctcatcctgcagagtattgtttaagagcaatacagttagaacatgagcatacttcaaccaattgaagtttgttgaaaaagggtaaagactagcagacataagaaaaaatatacgtttgctctcttaaaattgactctgatgtagaagagatgaacaaatatattttctctgctaaaattttaagtaacaacaatatttatttggaaatatttcttgttttatttagaaattttattataacaccttaaaatactacacaatattgcaaatctcatagcacaatgattaaaatgaaaaactatattagacaaaacataaaattaaatagcttagaataaagctgcaatgtattcgaggattagatcctattcacacggtctttagaaatctaataaaatttgaaccaaattcatagattagtaattgggaaacagattacctggatctggatccaagttgtaactctaggttatttctacttcatgctattttcaaacttataaaatgagggataatatcagtactatctcagaggtttgttgtaagaattagttgctacttatatatacctctaatagctactgaaatagcataaggattcatgaaatattagctactgttggcaccatcattcctcaccgaaactgaaaatatatatacttttcagatcaaatcaatttaatctctttcacaacagagttttagaaacatttcttcaattttcaattccacatttccaccttcctcgttctctctcattcatacaccaattccacgtttactccatcattctctctcattcacacacaaaagaacacacactacccaccaccacaatcactaaatttcaaatttaaaaaaagtgcaatcttaacccatagttacaacaaagaaagcatctccataattaattagaaagtacactaagaaatagattccaggttaggatggtaggctgatattgcaattacatattttttccttcctcatttcctaaaaacaaattagcaaaaaataaataaataacaaaaaataatttttaaaaataatgaaacaatgtaaggaatgtaccataaatcaccaaacattaaaaaattggttgccaaggggaacaaaaacaaactggttctagaactgagggagcaacaaagcttagttcttaatcatgtccccatgcccccaaagcaatattggtaagttgacaaaattctgataattttcttaacgccttcaaatacagagagaaacaaactgagtaggtaacgttacctctttcctcttctacctggagatgccagaaaaacttacagaacaaatactggtgaagcaagaaattgaaaaatgcggctgattcactaaaacagaagtaaactcgactctactctcttaaatgactgagggaaatgattcaaagcctaagcacatcttcccatgagaactgtctatagtctaatgagatagaatgaacttggtagaaaatatttaacaaaatcttagaaaaaaatgaggatttctaagaaagactcctcacctatttcaaataagctcttcctcttcatgataggccataggatattctacaaaaatcaaactgtagctcaggagagggaaatattagctttacacagagaatggagagggaaataagtcactaagatatcctgttgtctaagccaacagaatatctgcacagagcattctaagaatgaacacaatggaacaaaaaagtatggtagttatacaaacatatagcaccaatcaatcaacaaataagttaatacataaatttaaaataaaacgttaatatagaaaagacaaaacatctgatgaaaaagtatctcaaggagtaaaagaaaattattcatgattattttttctaatgaacaacataacaaaaacataatgcaaataagataaaactcaaaataaagtgactaaggaaagaggctgaagtcctaaataaacaaaattaggaacaaaacataagctttatagacataataaataaattacaaataaatatcccggacaaaataaaacattaaaaatgtacttactggtggaaaaataaggctaaggatcaaagaaagtcaagcaactaaggaataactaatagatgtgaaagacaaacatatatctaacatattattaagtgttactaagcaagaaaaaacaaaataaagtgaaagtggtatttcaaagtataatctaaaaaattttctaagaactgaaggaaaaatcagaatctgctgattataacaagaaactatgtcccaggataatttgataaataatgttcaatactgaaccatattcctcttaaagaattttttggacaaagaaatcacaggcagaagacacaaaaagcaaatcagaaattaagggaaaatatcagactgtcctctgaaagcaacattcaaagtcagaagataacaaagcaatgtctgcaaagttctaagggaatttaagtgttacccaacaatattaagtcaagcaaggcagtcatggcacagaaagagggagatgttagagattacaatttgactgaggaacagaaggcgatcaaggccaactatcctccagttaataggaattatgagtatttggatcatacagcagatgtccagttacacacatggggagatactctggaggaagcatttgagcaatgtgcaatggccatatttggttacatgatagataccaggactgtggagcctctccaaacaatagaagtagaaacccaagaagtttctacttttctttttcactttttagatgagtggctttataagtccaatgctgatgaattcttcataccctgggaagtgaaagtactttgtattgatcaaagacatttccaattacaatcaattgggtggagagaagaattttcattgtccaatcaccctcagggaaccgaagtcaaagttataacatattcagcaatgcaggtctataataaagaaaacccagaagtttttgtgatcattgacatttaagaccaaaaaagaaaagactcctaagaagaactgggttttttttttttcctcttccttttgggaagacaatgtgaattaaattctatagtatcttatgaaatacagaaattgtagaacaaaaacttataactttatttatttacttatttttcctgagacagagtattgctctgtcccccaggctggagtgcagtggcacgatcttggctcactgcagcctctgccttccagattcaagcgattcccattactcagcctcccgagtagctgggactacaggcatgtgctacctcacgcctggctaattttcgtatttttggtagagatggggtttcatcttgttggccaggctggtcgcgaactcctgacctcaagtgatccgcccaccttggcctcccaaagtgctggaattataggtgtgagccaccacgaccagccagaaatttacaacttgaactgtgactttccaaaatggaaaattagggcatgtccttggtctgtgttccccaaatagtcaatctttaaagaattcttcaattcctacggggcagttatggtccttcatttgttgatcatctgctgtggcagcaagtgcctcatgcccttccattgcaatgcaagccttccaccctcccctcagaacagaatgctgatgtcagcagcagcctggtgctaaatccaatttggaaaaaaaaataatttgagaaaatatatttccacacccagaaaaaaatatataaagttaagcagaatgccattcaaatataaagatagcaggcaaatattcttaaacatggaagaactttaagtttacaacacatataagccccttgtggaaaaagaataaccatgaaatgcagccaattaagaactgagtcaaaagaaagaatctggaaattaagttccaactaataaagttggggaaaatgaagagtgagtattgaattcacttaaataaagaacaaatactcaagtactataagaaatgtgattataaacatgaatgttataaatttagacaatatgaaaattaaaatataactaaaaattaggaggtgaggggagagaaaataaaaggaacatacaagtgactaatatcctcagcctccataagagagtgtgaattgacatatgtaacataaaaatcaacatcagaggagggcagagcacgatggcagaatagaggcctatcccgtttgtccaccctgctgcaacaccaaattttaacaactatctgcacatagcaaagcaccatcactagaaccaaaaatcaggtgagcgatcacagtacttgtttttaacttcatatcatggaaagaggcattgaggggggcaggagagacagacttgaatcactgatgccacctctgccccatcgcccagcagtggccatgcactgcagacagaaactgcactttggggaaggagagctcaacgactggagaactttacattggtctcagtgctgccctgtcagagcaaagaataaagctatgctgggctccttccatagagggagcatgaggaccagccctagccagaggggaatgacatatcccaggggacagaacatgagtttcttggcaagcctcgccacgcaggctaaagtacactgggttcctagataaacttgaaaggaagtctaggacacaaggacggcaatttctaggctcctcctagtgctgggttgggctcagggccagtgaactagggtggcacatgacctagagacacaccagcttgcgtggctaaggaagtgcttgcattagccgtgccctaaccccagggagtgaagctcatagcaatgaaagttactccttgcttctgcttaatgagaggagagcaaagagtaaagaggactttgacttgcattttggataccagctcagccacagtaggatagggcaccaggcagagtcatgaggccccgttccaggccttagctctcagatgatatttcatttctagacacaacctggaccaaaagtgaacccagtgccttgaaggtaaggatccagtcctggtaggattcatcacctgcagattaaagaactcttgggccctgaataaccagcagtgataacgaagggaatataccatgtgtcttgggctttgagacttactagcttcaggggtgacccagcatattcccagctatggtgcctacagtgaaatactactaatgtttcagaaaagcagagggaaaaataaagggaactttgtcttgcatcctatgtaccagctcggctacatgggggtagagcaataagctggctcttggggtcccaaagtccaggcttaggctcttggacagcatttccagatgtgctttgggacagaggggagctcactgacctaaagagcgagtctcaggcctggcagcattcatcacaagctgacagaagagcccctaggctctcagtaaacatcagtggtggcctgaaggaatcccctgtggaccggtggtgggggtggccacagggaaaggcagctctgcctgtggaaagtgaagagtaggaaagactttgtattgtggtttgagtgcaggcataatgacagtagaatagaatatcaggaaaattgctaagctgtttaactccagtccctggctcccagacagcactttggacattcccggagcctgtgggaactcacggccctgaagggaagaaactggggcaagacctagtgctgtgcaggtttcaggtctaacccagtgcagccctagtggtggtggccacagacttacttgcatcaccacacccccagttgcaggtggctcagcaaagagagacagaccctgtttgtatgggagaaagggaaaagaacaagagcctctggctggtaatccagataattcttccacatcttatctaagaccaccaaaatggtacctctacgagtcagcaaaaaacacagccttattggggttggggtccaagtcctttcaaatacctggaaagccttcccaaggacaacagtcacaaacaagcccagactgtgaagactacaataaatacctaactcttcaatgctcatacactgaagaacattagcaagtataaacatcatccatgaaaacatgacctcaccaatgaactaaataaggcaccaggaaccaattctgacgaaacagagacatatgacaactaagatagttaattcaaaatagctgttttgaggcaactcaaagaaattcaagataacacagagaagaaattcagaattttatcagataaatttaacaaaaggattaaattttttttttaaatcaagcagaatgagtagggaggtggagtttacagtgagttgatatcccaccactgcactgcagcctgggtgatagagccagaccctgtctcaaaaaataaaataaaataaatttaaatatatgtatatatatacatatatatatgtatatatatacacacacacacacacacatacatatagcagaaattctataattgaaaaatgcaataacatgctgaagaatgcatcagagtcatcagagtctcttaatagcagaactgatcaagaaggaagtagtgagcttgaagacaggctatttgaaaatacatagaggagagaaaaaggaataagaaaaaatgaagcatgcctacaaaatcagaaaacagcttcaaaggggcaaatctaagagttaatagctttaaagaagaggtagataaaaagagaggggtagaaagtctattcaaaagaataatcagagaactttcccaaccttgagaaagatatcaaattcaagtaaaagaagcttatagaacagcaagcagaaagaagattacctctgggcatctaataatctaaaggtcaagaataaagaaaggatcctaaatgcagcaagagaaaagaaatcacatacaatggtgcttcaatacatctggcagcagacttttcagcggaaaccttacaggccacaagagtggcaagacatatttaaagtgctgaaagaaaaacacttttactctagaatagtatatccagtgaaaatatcctttaagcatgaaggagataaaaagactttcccagtcaaacaaacgctaaaggatttcatcaacaccaggcgtgtcctaaaagaaatgctaaagggagctctacaatctgaaagacaaggatgttcatgagcaagaagaaaccatctgaaggtacaaatctcactggtaatagtaagcacacagaaaagcacaggatagtattacattgtaattggagtgtataaataaaccaagtagaaagactaaataatgaaccaatgaataataactacaaaaacttttccagacatagatagtacagtgagataaaaagaaaaacaacagaaagtttaaaactagagagacaaagttacagcatagagtttttattaggttcctttttgtgtgtttgtttctttatgcaatcagtgtgaagtgaagttgccattagttttacataacaggttataagattgtgttggcaagccttgtaataacctcaaactgaaacaaataaaatgggtacacaaaatataaaaagcaagaaattaaatcataccaccagagaaaaccaccttcactacaaggaagacaaggaaagaaaaaaggaagagaagtctgcaaaacaaccagaaagcaaataacaaaatggcagtagtaagtctctacttatcaataataacattaaatgtaaatggactaaactctccaatcaaaagaaataaagtggctgaatgaattaaaaaacaagacctaatgatctgttgcttgtaagaaacacacttcacctataaagttacacatagactgaagataaagagacgaaaacagatattccaagtcagtgaaacaaaacagagcaggagtagttacatttaatcagataaaatagatttcaagacaaaaattgtaaaaagagacaaagacggtcattatatagtgataaaggggtcaatccagcaagaggatataacgattgtaaataaatatgcactgtattagtccgttttcacactgctataaagaactacccaagactgggtaatttataaaggaaagaggtttaattgactcacagatccatgtggttgggaggcctcaggaaacttacaatcatggtcgaaggggaaactggcaccttcttcacaagttggcaggaaagagaagagtgaaggaggaatttccaaacacttataaaatcatcagatctcatgagaactcactattacgagaacatcatggaagaaactgccccccagtgatccaatcacttgcctcccttgacacatggggatcataggtccctccctcaacacgtggggattacaattcaagatgagatttggatggggacacagagccaaaccatatcatgcacccaacactggagcaactaaatatataaggaaaatattatgagaactaatgagagagatagactccaatacaataatagctagacacatcaaaatatcccactttcagcattgggcagatctcacggacaaaaaaaaaaaaatcaaaaaagaaacagcagacttcatctgtactacagaacaagtggatctaaagttatttacagaacatttcgttgtttttttttttttttttttttttgagatggagtcttgctctgtcacccaggctggagtgcagtggcatgattctcagctcaccgcaacctccatcttccacgttcaagcaattctcctacctcagcctcctgagcagctgggattacaggtgcatgccaccacactcagctaatttttgtatttttagtagagacggggtttcgccatgttggccaggctggtctcaaactcctgacctcaggtgatccacctgcctcagcctcccaaagtgctgggattacaggtgtgacccaccacgcccagccagatatttacagaacattgcatccagtagctacagaatacacattcttctcctcagcacatgggtcattctcaggaacagaccatacgttaggtcacaaaacaagtcttaaaacactcaaaaaacctgaaatatcaagcatcttctctgaccacaatgaaatataactacaaatcaataataacaggaatattaaaaactatacaaatatattgaaattaaacaatatgttcctgaatcaccagtgtaatgatgaagaaattaagaataaaattgaaaaacttcttcaaacaaatgataataaaaacacaacatactaaagcatacaggatacagcaaaagcactattaagaagagaatttatagctataaatgcccgtgtcaaaaaaaaagaaaatcttcaaataaataacctaataatgcatcttaaagaactagaaaagtaacagtaaactgaactcaaaattagtagaagaaaagaaatacttaagttcagagcagaaataaatgaatttgaaatgaagaaaacaatacagaagagtgattaaacaaaaagttggcttcttgaaaagataaacaaaattggcaaccttttagtgagactaagaaaaagagaagatccaaacaaatgatatcagatatgaaaagggagacattacaactgatacggtagaaattcaaaggatcattagtggctactatgagcaactatatgtcaataaatttggaaaatctagaagaaatggatcaattcctagatacataaacctaccaagattgaaccattaagaaatctaaaacctaacagaccaataacaagtgacaagagtgaagccttaataaaaagtatcccagtaaagaaaagcctggggccagatggcttcactgaattctaccaaacattttaagaactaataccaatcctactctaagtattccaaaaaatagaggagggaagaattccacactaattctacaaggccaatattaccctgataccaaaatcaaagacatattaaaaaaagaaaactataggccaatctcactggtgaatattgatgcaaaaatcctcaagaaaatactagcaagctgaatttaaaaatacattaaaaaggtcattaatcatgaccaagtgggatttatcctaggggtggaaggatggttcaatgtatgcaaatcaatcaatcaatgtgatacatgatatcaacagaatgaaggataaaaaaatgatcatttcaattgatgctgaaaaagcatctgataaagtacaacatccgttcatgataaaaaccctcaaaaaaaaaaaacgtgatacaaatggaatatgccttaacataataagccatatatgacagacccacaaccagtatcatactgaatggagaaaactgaaagcatttcctctaagatctggaacatgacaagaacatgtactttcaccactattattcaacatagaactggaagccttagctagagtaatccaacaagagaaggagataaagagcatttaaattggaaaggagtaagtcaaattatctttatttgcagatgatgtgatcttatttttagaaaaacctagaatccaccaaaaaactataagaactgataaacaaattcagtaaagttgcagtatacaaaaaccaacatacaaaaatgagtagtggccagacatgatggctcatgtctataatcccagcactttgtgaagataaggaggtggactgcttgagcccaggagttcgagaccagctgggcaacatggtaaaaccctgcctctataaaaaacacaaaaattagccggacatagtggcacatgcctgtagtgacagctactcaggatactgaggtgggcagactgagcccagaagctcaaggctgcagtgagccatgactgtcactgcaacccagcctgggtgacaaagtgagatcccatctcaagcaatcaatcaatatcagtagcatatctatatgccaacagtgaacaatctgaacatgaattcaaaaaagtaatcccatttacaatagaaacatacaaaattaaatacctagaaataaattttacaaaagtggtgaaagatctctataataaaaactataaatcactgataaaagaaattgaagagaatataaaaaaatggaaggatattctatgtttatggattggaaaatcaatactgttaaaatatccatattaaacaaagtaatctacagattcaatgcaatctctatcaaaatactaatgacattcttcaaagaaataaaacaaaaccctaaaatttatgtggaatcacaagagactcaaaatagccaaagctatcctgagcaaaaagaataaaactggaggaatcagattatctgacttcaaattatattactgagttatagtaaccaaaacagaatggtattagaataaaaacagacacataaaccaatggaacaaaaagaggacccagaaacaaatccacacagctacaggaaatgaattttcaacaaaggtgccaagaacaaacattggagaaaagacactctcttcaatatatggcactgggaaagctagttatccatatgcagaagaatgaaccttgatccctacacctcacaccttatgtaaaaatcaaatcaaaatagattaaagacttaaatctaagacttcaaactgtgaaactactacaaaaaaaactgaggaaactctccaggacattggtctgagcaaaaatttcttcagtaataccccatagtcacaagcaaccaaagcaaaaatgaataaatgggatgatatcaagttaaaaagctactgcagagcaaaggaaacagtcaacaaagtgaagagacaacccatagaatggaagaaaatatttgcaaagctacccatctgacaagagattaataagcagaatatgtaaataactcaaacaactgtataggaaaaagtaataatccaatttaaaaatgggcaaaatatttgaatagacgtttctcaacagaagacatataaatggcaaacaggcacatgaaaaggtgttcaggccgggtgcagtggctcatgtctgtaatgccagaactttgggaggccaaagcaggcagatcaattgaggccaggagtttgggaccagcctggccaacatggtaaaatcccatctctactaaaaatacaaaaattagctaggcatgatggcacaggcctttaatcccagctacttgggtggctgagccatgagaatcccctgaaccagggaggtggaggttgcagtgagccaagatcgcatcactgcactccagcctgcgtgacagagtgaggctctgaaaaaaaaaaaaaaaaagaaagaaaagaaaagagaaaagaaagaaaaagtgttcaagggccaggcactgtgactcacacctgtaatctcagcactttgggaggctgatgaaggcagatcacttgaggccaggagttcaagaccagcctgaccaacacagcgaaaccccatctctactacaaatagaaaaattagccgggtgtggtggcacaggcctgtaatcccagctacttgggtggctgagtcatgagaatcgcctgaaccagggcagtggaggttgcagtgagccaagatcatgtcactgtacttcagcctgggcaacatagcaagactctgtctcaaaaaacaaaacaaaacaaaagatgctcaaaatcattgatcatcacagaaatgcaaatcaaaagtaccatgagatatcatctcactcgagttaaaatggcttgtatccaaaagtcaggtaataacaaacgctgtcgaggatgtggagaaaaaggaacccacatacactattggtggagtgtaaattagtaaaaaccaccatgagaacagtctggaggtccctcagaaaactaaaatagagctaccgtatgatccagcaatcccactgctaggtatatatccaaaagaaaggaaatcagtatattgaagatatatctgtactctcatgtttgttgcagcactgtttacaatggctaagatttagaagcaacctatatgtccagcaaaagatgaatggataaagaaaatgtggtacttacacacaatggagtactagtcagccataaaaaggaatgagattctttcccatttgcaacaacatggatgaaaatggagatcattatgttaagtgaaataagctatgcgcagaaagacaaacatcgcatgttctcacttatttgtgggatctaaaaatcaaaacaattgaacttgttcagttgaactctgaacaattgaactctgagttcaaaacagttttactcagagagacagtagaaggatggttaccagaggctaggaagggtagtgagggtgtcacgggtaggtgacgatgatctataggtataaaaaaaacagaacaaatgagtaagatctaatatttgatagcacaacaggagacaatagtcaataataatttaattgtgcattttaaagcaactaaaatggtgtatctggattgtttgtaacccaaaggataaatacttgaagagatggatacccaatattccatgatgtgattattatgcactgcattcctgtaccaaaatatctcatgtactacataaatatatatacctactatgtacccacaaatattacaacgaaaagaaataataaaaaatcaatgacataattacactgaaaataattaactaaaatggcttggtggaattctatgtcaaaactcatgtttaaaaactgaagccatcaacctcttaattttttcataatttattaaccttctattctttcagaaaataattttcctttacttaaagaaacatttccttgttttttccataattattattttgctaaattttatacaatactgcaataaatagccatgtatacctatctttaaatactattatttttaattcctaacagatatattcacaaaaataggattactcggtaaatgggtatttgcatgtttgtgagtgtcaatgtaattttttaatagctatgactatactgctttcccttaagactaaaaatgtactttctgttaacaatacaaaagaacagcattgcccatttcatctctcttattcacttcaacagtacgttatcattctttttactgtctctcaaccgaagaacggaaaattgatagataataatttatctaatttacataggaatccttttcatatgtttactggtcacttttaggttcttttgtgaatttcttattgatatcatctgagtttctgtctattgggttgtttttcttataagaattattagtacagtgaatatattaatcatttatcagtcataggcattatgtttttccaagttgttgatggtatctttcctccacttaatgttataggtagtaatagatgtctacttttttatttctactttctaaatatcctacattttggttatcaaattcacacatatgcccaagttctacttttacagttttccaaatatgtttctgaagtatttatcatgtcatcttcctccctattgcttatttcatctggaagaattttaatatatgctgtctttttagtgatgttttaatttctggagaggcaagtatatcccattactttttcacaaattgtaggactacattaaagcatttattttcccacattaactgaatatttaaatatccaaatataatagttgtgtcttaaatttgttataaagaatatttaaatgtcaaatcaactctactgttattttaatggagtgctttactaatggatattgcactgagtttacatactgacttgagaaaaatgaacatttttgtgacgtaaaattttctctctttggctataaaagacagtgtggagtcttttttccagttggaaaactggaaaaatacaagtaatgttggtatattaagtaacagcatcctgccaatgttaattttctgattttgataactgtaccagattaagacagagaatgtgcttaggaaatttccactgaagtattttgaggtagaagggaatcctgactttaacttactctcaaaattcagaaaaacaaagcataaagagaaagagaataaatgtcgtaaaaatttaacaatcacaagatctgggagaacagtgaataggagttcctgctttattcttacaactttcctgaaagcctcaaattatttcaaaacaaaagactgattctgtctctctctctctctctctctcacacacacacacacacacacacctcaagaccccaagacagactatccagcatggaattagtttatattttatcttatttgctttaataaaattttgtagcttcattccaaagagcatgtgtacttttcttgcagaatttggcccaaaacattgtttttgtcatatttatgaatacactgtatttctgatttccattcttagctggttactgactgtcaaagaaaagctattaattttttgcataactatctcatacctaataacctcaccaaattctcttattaactctggtagaaaaatgttcaagatccaggtacacctcaggacacaggaattagattttcctagaccacagcattagaaatttgaaagtaatcttctttctttctttactagcatttatattagctgtatcttgcacttgcaagaacatcaaaaaatatgttaacaacagtgacagtaggtatcactcatttttcctgattttaaaagagatgactttaatcatttaaaatgatatttaatagtctttaccatatttgtattgttttcttatataaatctttttctgtgagttttaatacggctggcagctaacaatcatcatatgctttttttctacctttactgatatcttcgtgttttttctatttttaatttgttgatataatttattttgcaggtagatatcctaaagtaaacaattttgtaattccagtaaaaattttcagtcatcatactatataattcattctttatattgatgaattatgttatttaaagttatagtttaaattttgtacttatattcttaagtgaaattggtcttctagagttttatttttctagaataattttcagatttgctggttgtataaaattcacttggaagatttttcatcttttctaatgtaccagaaaaatgtcagcaacatatgagtttatctgttcttgatatgttagaagccatacagtgcttttaaatatttttccaattctatagcaaatgtactacttgtcaaattttctagttcaccttaggtgaatttgggtcatttctatagctacaaaaccattaatttcctctagaaatttgtatttcttatacatgttcaggcacaactactgagataagcaatggtcccaggatgagtttatcacttagtcctctcctatgagaatccaaggagagaggtgtgtgctccctcatttcctcagctacaaatactgttacgctctcaaaccctaaagacagagaaatttcacacccctgtgttcagctcctctctagaaacctggatgatcttacctttgccatagagattttcatttctggctaactagctctgttttgtccagaaagggccaactccttcaccagttttctttataggaaaaccatcagagccaagatttacctctgattattaagattagagcagccaaacaagaagcttctctgatcaagcttctgtggtagctcaactacaattgagacaagagggctaaagagacatgtactatctcccagaacccccatgactctcctataaacctagattttaattttttgatgacatatactatgtttctttggacctgccattttaccgggacaatttctcatgattatcattaaaaaacggtaacttccgcacaccaaccatatgtgtaacctacctcaaattccgcatgtctgtgaatatcttctgctctctgcctgctcaggataaattcagcttcatttgctactcttactagatgatccttcattgtctggctaagcaacctgtaagaaatgaatgttatcaaataaatatatgtatacacacacaacataaatgattattcactgcttacggtggagaggaaggaatacttactttcttcttttgacatcatacacaatgaggtaccattatttcatgctaaataattgaggaatgtaacaacagcaaaaggttacccttctggcaatagcagattagcttctatcagactagccatgtaacaaaagcaactaaaaatactggattaaagttgtgttttaatcttttaaaatgcactggaaagttaccaaggcagccaaaattaaccagtgaagatcacagagaagaaagcacacaaaggacaatcagtgtgactttttacattaaggcatttgctattcccaagtgagaacagaaaagctacacagacctgtcactagtctcacaaagataaatagaaaaaaattgaggttcacagtctgtcaaggtggaggagtcccggtagactacccaagagttacagcaggaatcaagtgtaccccagaaagcaagaaatagaccaggcctcaaaacactgaaacagaccttcagagatttggtgattggtatttaggttaactggcagccaaaaagctaagcaaagctttcagggtggggagaaaaaaatcagaaataccaatgcaggagggccatggcaaaaccccaggttttcagagtacctcagaagggctacacactaggagaaggcaaacaaaataggccaaactctcacaagaacttaaaaataaaaacccagccttgagtcagctcagaccctaaattaatacaatcggccattagtctaactgctaatcagaaaccaaaaggaagtcctttctaaaggaagataatatcatagagacttaaatttacccttgccattttaaaatacaattttcagcattcagtcaccaattaataggcacaagagacaatatcatacgaatggaaactaaatagaaactggctcacatctggacattgaaataaatatagttaatatgtttagaactaattgtgtaacagagaattccagtaaagaatgaaaactgtagaagaactgaaaaaaaataaataaatataaaaatagatttactgggttattaagctcagccaaaaaaggaaaaatttactgaaagataggtcaatgacaactagactgaaacatagtaagaaaaattaatgaaaattgaacaaaataaataacagacatataggacatggtaaaagaatctaatgtaagtgtatctgtagtataagaaagagtagatacataattagaaaaaagcaatatttgaagagataatggccaagatttttcaaaactgggaaaaaacactgagccatatgttgatggagtgctacaaaacccaagcagggtttttaaggataccctgcttaggcagtaatagtaaaactatcaaagaaaaaaattcttaatagcagacagcgggagaggccttcaaaagagcaacaataagcctaatggaagccagataagaatgcaatgacctatttgaaatactaaacaaaaatactacctaaaaggccaggccagtggctcacacctgtaatcccagcactttgggaggtccgggcgagaggatcacatgaggccagtagttcaagaccagccttggcaatgtagtgagatcccatctctaccaagaaagttttttttaattagcgaggcatggtagtgcatgcctatggtcccagctactcaggagcctgaggcagaagcatcacttgagtcaatgagtttcaagttatagtgagctatgatcacaccatggcacttcagcctgagcaacagagagagatcctctctcaaaaccaaccaaccaaccacctaagaattctatcctcttcaagaccagcctgggtaacatagtgaaaccctgtctctactaaaaatataaaaattagccaggcatgatggcaggtgcctataatcccagatactagggaggctgaggtggaagaatggcttgaacttgggtggcggagcttgcagtgagcccagattgcaccattgcgctccagcctgggtgacagagcgagactccgacagaacgaatgaacaaacgaatgaacgaacgaaggaaaaagagagagagagaaaggaaagaaaagaaaaaagaaaagaaaagaaagacgaaagaaagagagagagaaagaaaagcattctatcctcagtaagtatccttcaataatgagatttaaagggtcaagagtataccactgtgggaaaaaaaaaagagtatttttctgaactttctttatccacctaaatgaagaagctcccaaaagaatttagctttcatcaatcccttcccagggagttttgcaaccaaggaagattgactattgtcagtaaagatgagaagttagtaccaggatgagaaattatctaaatagacattgatacaaaactataatatcacttaactattctcctaagggcccacttactgttcacaaaatcattagctttcccaaatgtgcccttcattacttcacttttaccctattaaaatggtatgtatataaccccaaattctaaccccctcctcaagtcacatttttctctgaatcttttttttttttttttttttttttctgagacgaagtttcgctctgtcgcccaggctgggtataatggcacaatctcgggtcactgcaacctctgcctcctgggttcaagcgattctcctgcctcaacctcctgagtagctgggattacaagtattcacaatcatgccaggctaatttttgtatttttagtagagacggggtttcaccatgttagccagggtggtcttgaactcctgacctcaggtgatccgcccgccttggcctcccaaagtgctgggatttcaggtgtgagacacagcagccggccgaattctgacagacttatgactaaaaataggtcttttttcttgctaagctgtgtttgtctgtttaattcacaggtccccaaacaacaaacctaagagggtagaggaaaacttttcctcatcatcaaaagcaaaataagaacattccatgacaaataaaatagtgagaatttgtcaccagccaaccaacatacttcacaaggatgaaaaataatataagattgatacaagtcaaggaaaacaattggagcaatgaaaatgacaaacgtgggtaaatctaaaagtatactgaatgtttacaataattatgtaacttctagaattaaaaaatactgcaatctaaaatatataaccacagcatacaaggcaagagaaaccaactgaattagtgttataagtttcttgtgtcatacatcaattggcaaaagaatcagtttatgtaagatgttaattataatattcatactacaatctctgggtaaccactaaagttatttaaaataatatataaccaacaagccaatgggaaaaaaattaagcaacaaatacttagctcagaagaaggaaaaaaaaaagaaacacaagatgtggagcaaatataaaggacataaataataagatgataaattttaacctaaacatatcagaaatacatagaaagtaaacatttagtagtaaaattattgtcaaatcaattttttaaggcatatgatgcttgtaagtgacacaatttcaatataaggttaaacaaagattgaaaagtataatttcagaaaacatgaacaatttttaaaagctaaaaggtaataaactttttttagtatgagaagcaaacagaaataaaataaacctgttaaattaataaaaggataaatgaactagagatacagaaatttagtattttgagattctaaatttgtatgctcttaagaatatggcctactaccagatatagaatatataaagctatagaatattttttaacctgacctgactgacatatcgagaacattatacccagtaagtgaataataaatattattttcaggtaaacatggaacatattaaaaaaaacaggcaaaatgcggggtcacaaagcaatttacagtgaatttcaaatgatggaatcatactcagtatgttctttgatacatttcaattaaactagaaataacaggatacagatcactctgcaagaagctctaagctgaccactgactttcctaacctcctggtatccacagcattatgtaatcttcccctttagagtgtaagaaggagatggggcttgcctcgaagcaagaaaatatggcaacaatgaaggaataacacttcaataattacattaaataagatggtaacttgcatcttgctagcagactctattgacgctctcccttaatggcttagctaaagaaagctgtcatgttatgagctgccctgtgtaaaggcctccatggcaaggagctgagtagagccccagacaacagcccgcaaagaattcagactctcagtctaacgactcaaaaggaagtgaatcctgccaacaatcacatgatcatggaagcagatcctttcctagtcaaacatcaaataagactgcaactctggccagcacctcaattgcagccttgtaagtgaacctgaaggagaggcccagctaagccatgcctaggattcctgaccaagaaaaattgagataacaaatgtatgtttctttaaggctaagttgtgataatattgttaacacagcagtcgctaagtaatatcatttcatgtctaaaaattaaagaatgcacctctgaaaaaaacgcacacataaaagaatacatcataatggaaattaggaaacgtttgcagtaaaacatagtaaaaacaatgtgccaaaatctgtggatttagataaaccttaaaccaatgcttagagggaaattgatacactgaataaaaacactaaagaagaaaaaaattgtcaaaataaattatgcaagtattgaactgaagaaatcagaaaaagaacagccagtgaacactgaaagttaaataaggataagaacagaaattaaatagaaaataaaaaatacactttagaagataaagttaacagttagttatttgaaatactgaaaaaatccaaaagaaaaatgtaaacaattaaaagtaataattgaatttaggagggtcactggatttaaggcaaatacacaaaaatcaactagattatatgtataggttactaacaaagtaaaaatggtttttaaatactattttgaaaagcattcaaaaccatcaaaatatgtaggaaaaagaaacaaaaatgtgctagaattctgcatgtcaaacagaaagaatggtaaaaaaaaaaaaaaaagttaaaacttaaagaaaaaagtataccatgttcatgaaagggaaaggcttgtattaaagatatcaattctccacaaagctatttatagatacagtccaatcaaaatcctagcaggtctttctgcataatctgatgagttcaaatttaattctaaaatctatagaaaatgtaaacaaacaagaatacatgagacattcttaaagaggggaagagagatgataataatgataatgatattaaaagacttataagtaagatggtcttttccaaaaactggtcttagatcaatcaactgatgctcatatggacaaattaaccctgacttctacctcaaaccatacaaacaaaccaattccaaatgaatcctagacaagacctaaagatttcaggaagtttaaaaagtttctagaagattacataagagagcatcttcctgactgggtcgatgtaaagacttactgcaccaaacaaaaatacacaaaacataagaaaaatagtgacaaaatgaactacatcaaaatttaaagacttgtgcttatgaaagccaccactaagagaattaaaagccaaacttcagagagagagaatatacttggaaaaattacaaccaacgaggaactgctatcttaaatatattaaaaagcctcttacaaataaaagaaaatgatcacaatttttaaaatgggaaaagtacacaagcacttcacaaaagaagatttccaaatggtgaataagattatgaaaagttgttcaggattactagtcatcaaggaaataaaacttaaaaccataagatatactatactccacagaatggctatatatgtttaaaaggctggcatcaccaagttatatcaaagatgtgaagtaacagggactcttataatcacaaaatcgattaataaaaatgttcatggcaattatttacaatagccaaacactagcaactacccaaatgtccattaaaaataaaactaatttttaaaatgttggactttcataaagtaaaatgctaagtaggaaaaaaaagaatcaatattatgcataacaatatgaatttcactaacaatatgaatttcactaacaatattgagcaaaagcacacaaaaaatataaaatgtatgaattgccttgtataaagataaaaatttttaaaaacaaaactatggtattagaagttaagagattaagaaatggtaaccttcagtgctacctctccatatgaggactcacacggaacactgataatggccacggagttctaaatattttaataaaatgtcttagatgtataaacaaacgacccattctgattagcgcttttataacaccatttacttataaacatatcaacagaatgattcactttatgtaatctggaacatttttgatatgtataggtcttctaaacttccttctttaataggagttgagaacatagagcgggcagggatagaattattattattatcattattattattattattattttttttttttagggacagagtctcgctctgtcacccaggctggagtgcagtggtgcaattatggctcacagaaacctcaacctcccaagctcaagtgatctgcctacctcagcctgctgagtagctgggactatatacatgtgccatcgtaccctgtaagttattttggtggtgttgtagagacagggtctcactatgttgcctatattggtctcaaactcctgagctcaagtgatcctcctgccttagcttcccaaagtgctgaaattatgggcatgaacatacatggcctgcaaggattatttttttaaatttatataacaaaagtggctaaactgccactagaaaatgcccacctacaaaagttacacctagcagtcatcaacaatgacatgaacttactcccattccacagggcacttgcctcactttgtagcaatgttttcatttaaaatataaataaggccaggtacagtggctcatgcctacaatcccagcacgtagaaaagagactccttgagccccaggagtttgagacaagcctgggtaaaataaagagacttcttctctacaaaaaaacaccaaaaacaacaaaattagctgagcatggtggtacacatctgtagtctcagctactcaaaaggccaaggcaggagaatcacctaagcccaggaggtagaggctacagtgaaccatgatggcatcactgcactgcagccagggcgacaaagtaagaacctgtctcaaaacaaaaaacaaaacaaaaacaaaaaaagagcaaacataaacttggatccaaagcaattgtcacaaaaattgtttttatttttttggagatagagtctcactctgttgcccaggctagagtacagtgacaggatctcagctcactgcaacctccgctccctgggtacaagtgattatcatgtctcagcctcccaagtagctggaattacaggtacatgagtcaccacccccggctaatttttgtatttttagtagaggtggggtttcaccatgttggccaggctggtcttgaattcctgacctaaagtgatccacttgctttggccttccagggtgctgggattacaggcgtgagccaccgcgcctggccagcagtcttaataatgcgctatatgaacatgttcccacaatgcagaaaaacatgtggaaaatattcctcatgaatcaattaatttcactacaacactatttatgaaagtgagaatcttaaagaatcaaaatatacaatcatataagtagattgttccaaattgacaaaataatgtccacaatatacattaagaggaaaaataaacctgaggaatattatgaacaatatgagcttggggaacatataaaagaaaatacactttcttttaattgccaataatctagaacaggggtcagcaaattaaggcctgtgtgccaaatctagcctgccaacattttttggttagtaagttctataagagcacaactaggcccatttgtttaagtgttatccatggctgttttcaactcaccatactacactgagttgaccagttgtgaaaaagaccatgtgtactgcaaggcctaaagaactatctggccttttacagaaaaagcatgcacatgtctgggctagtgagtgaggcttaagtcctcctccttacatgtctctgttctttgaagctttacaacaatcaataatcaaaagaaaggaaaacagaaaatccttaaagaaaataaaaaagctttctgccattctatcactttgtttcgatctctattaggctcacatacactattttaatttgactccagctctgtcagactctctcttctatccccaaactgtcttccagctactttagaagttaatgcaatttcttatctatgattttggggtgacatcatcagggtattttttttcaaatgctattaaacagtactcatttaggcattacagacaaaaaccatccctagtgtaattttaaaacccactaatgaataacttcctctgattctacgatagaaaaaacaagggctttcaagagtacagatgtgaaatactggtttgggttcttaatttccctctagagacctaaaaccacattgtgaatttaacatcaatatattgccttgtactttcaaacattaattgaattgattagtcaatggcacactatcctactagtccccaaacaagtaacctcaaagttattctagtctcttccctcttctctaccaccttccttcaggcccctaatcaatcaataagtcttgtcaatatttcctttgtaatattctcagctttaatttatgctgttttatagccaatgtcctaaaaataaaggtttcatcatttcatatacattataactgaataaatcttctgagtgctaattctgatcttttaacatttttgtgcctctgccttttaaaaacactgtccaacatctgttcaacacctattacattatagactaggctaagcagcaaagatgacctttcattatattttagttggggaaaaagagaatccactggagtcctttccagcttgaaactcatattaacataagtgctatggtggacacaccctaatgtgacctccagtgagtcgtggctttaaatgatcccaaccccttgagttcaacctgggcagaatctggcacttccttctagcaaacagaatatagtaaagataatgggataatcattccttaattagggtactttacatgccaacggtgatgggataatcactctggtacttatgtaataaagttctgccctagcatactgcagagattctcctgccacccctgaagaagaagtaagtggctatgtgtgaccaggccatgagacagggaagtatggacagcctgtaggatctgagagcatcctctcagtgacagtaaacaagaaaatgggaaactcagtaccacaacagcatggaactgaattctgccaagaaatttgtgaccccaagctccagaaagaaatgcagtttgaccaacacctttattgtagacttgtaaaaccctaaacagaagatccagctaagctgagtctagacttctgacccacagaaactgtaggatagtaaacataagttgctttgagctgcaaaatttgtgggaatttgttataaaataagcaatacaaataaaattagaacataagaatatgtttgctatcatatctctatagaagcaaagatcacaataatctactaaagatgaaaaaaagctccaatagaaaattagagcatgaagatgagccttaaagggcaaaagcaacaaaaagagaaagatacttcagataacagtatgaacaaagttataaagagaaaaaaacctttgttttttgttttttgtttttgttttggagatggagtcttactctgtcgcccaggctggagtgcagtggcacgatctcagctcactgcaacctctggctccctggttcaagcaattctcctgcctcagcctcctgagtagctgggattacaggcacgcaccaccacgcccagctaatttttgtatctttagtagagacgggatttcactatgttggccaggatgttctcgatctcctgatctcatgatctgcccgccttggcctcccaaagtgctgggattacaggcgtcagccactgcgcccagccgagaaaaaatcttgtgtgttctattttcaagagaaccgaaacatccctttctatcacttagttttcaagatgtccatttactgacatatacacttagataggtaggatatttctgtcttgatgtttcactcatttttctggttacatagcatttaaaaaccatgcaacactttaataatgaagcaacaagtgaaagctcccagcccccttccctgttcacttttcagaatacatcaccaccatgagtagtttatgttcctgtccttacatttatctaaacttatagaaacatatacagtatttatgtgcatatatatgaaacacatacagtatttatgtgcatatatacatatatacaaatgtacatgttcatgtgttttgtaaaaatatttttaaatacttaagaagtcatactataatacttgtatattttacttaaccgtataccattatgtaatcagaacagcttcaagtgactcatgtggatggaatgtaccgtaatttatcaaaatagtcccttatccagagatcattcattctttcattctttgccccattaacataaccattatttatccagttactgaagctagaaatatcagtcatatcttccttcttcatcatcctacagatccaatagaccaagtactgcccattctacctctgcaataactttaaaagttgtttctcttactttttttttttttttttttgtgagacagagtctcgctccatcgcccaggctggagtacagtggcatgatctcggttcactgcaatgtccgtctccctggttcaagtgattctcctgcctcagcctccagagtagctgggactaccagagcccaccaccatgcccggctaattttttatatttttagtacagacagggtttcaccgtgttagccaggatggtcttgatttcctgaccttgtgatccgcccacctcagcctcccaaagtgctgggattataggtgtgagccactacgcccggccaaaagttgtttttctttgtaaccttttccggtgcccttcactggaaactcactggaactcaggatcatgtctttgattatgataatagcctccaatccaacttctttccatgagtcttactattcttgcccattcttcactgggatcatctttctaaaatgaaaatctgataatcactgtattgttgacaaggtatcagccgtcagccatcttcccatgatctacaaaagagactaaacacctttccatggcttataaatcagtctcattgttgttaaacttttatactctaagaactccaggtcaggaactactctctcaaacattacaccctgttactgtacactcctttgcctctgttgctactgtcccaggaatgacctcacttcatattctatctaacctaccttcaaagctaaaccaaagtaaaggttcactacagaaccttttctgatcccacacctgctttccctccacagaagtaatcccctaccaacgtgtatcagtctcttctttagtacttattactttgaaactttctgtataacacaatttcaattatgtatttacaaatctgtcttccatttgacactgcaccaaccatttataatttatctttacacaaccaaagcatagaacagtgcctggggacccagcagtgcttataaggaaaagaaactttgactatccacttctgccagtcacttctaagctgctaactgtaaggaatacaaacatgcataacactgtccacaaagagttcacaatctaatatggaaagttataggactatatacaaacagcaagataactgtgaaaaggttcttaaggttcttaaaacattttcttctcttaacttttgcaataatacatagcactttcttggttttcctcctatctagctgctgcttcttcattgcccactttgctacatcctccgctgcactacctacaaatcttgtaatgtccaagagctcagctgtgtgttctttcctccctctaaattatttcatccagttctatgacttttaatctcacctacatagtactaattcctgtgtttatatctctaaccctatccttggtctcctatatttcagactcacagggccaactgtccaactaaaatcttcacgtggatacccaataaggcatttcaaatctaacatttccagagcagaactcttgattctacctactcactgccaataatacctcttccccatcactacctcagtttgtcccaccacaataaatagcgccaaagtccactcaaactcaagaaataatctttgattttgtcatttcctcacctccaaatcccattcatgaaagcaagttctactgctttaactattaaatacatcacatatatgtttatttctctccatcatcattgctaccacatcattctaagtcaccattccctcttttctagaatacttcagtaatatcttcactgacttatctgctttcattcttgccctgtataccaatcctatcacaattcattcttctaagaatgtaagccatggtgttgggaaagctggatatcaacatacaaaagaatgaaattgagccaggcgcggtagctcacgcctgtaatcccaacactttgggaggccaaggcaggcagatcacgaggtcaggagttcgagaccagcctggccaacatggtgaaaccccgtctctactaaaactacaaaaactagctgggcatggtggtgggcacctgtaatcccagctactcaggaggctgaggcaggagaatcgcttgaacctgggagacagaggttgcagtgagctgagatcacaccattgcactccagcctgggtgacaaagcaagattccatctcacagaaaaaaaaaaaaaaagaatgaaattggatgcttgttgatatggtttgaatatctgtatcccctccaaaattcttgtagaaacctaatctccaatgcaatagtattaagaggtgaggcctttctgaggtcattaggtcatgagggctccttcctagtgaatgtaattaaggcctttaaagaatagtcttcacacaatgtttagcctcttctgccctttcggcttccaccaggtgaagacacagtgctcaaagtgccatcttagaagcaaagacccagccctcatcacacactgaaacctgccagtgtcttaatcttggacttctaagcctctaaaactatgagaaataaattgctattatttataaattacccagtctcaggtattttttatagcagcatacagagactaaggcacttaccttacatcatatataaaattacctcaaaatggatcaaagacctaaatgtaagagttataactataaaactcctaaaagaaaacataaggaaaagcttcatgaccctgaatttggcaatgatttctaggacgtaataccaaaagcgcaggcaataacagaaaaaaaaaatagataaactggactacatcaaaacttctgggccaggtaaactggctcacacctgtaatcccaacactttgggaggctaaagcaggaggatcgcttgagctcaggaatttaagatcagcctgggcaacatagagagactccacgtctatttttaaaaagataaaggaaaaaacaacaaccttctgtgcatcaaaggacaaacccaacagagtgaaaagacaaccccagtgactcatgcctataattcctgcactttgggaggccaaggcagaagggctgcttgagcccaggagctcaagaccagcctggacaacatagcaagtccctatctctacccaaaaaaaaaataataataatagctgggcatggtggcatgtgcctgtggtcccagctactcaggaggctgaggtgggaggatcacattagctaggagtatgtagctgcaataagccactgcactccagcctgtataacagagagacgctgcctgtctcaaaaacaaaacaaacaaataagcagaaaaaaaaaaccctgtaagttatatcatgccactcgtctattaaaaactctgctcttactgaatatggtttaatccaaatttcttagcatagcttatagggccttatatgatctgaatattgaatacttctcttgacattcccaagccttactctttcttgctgattttgttccagccactctggccttcaatttgtttaaataatacacaatactattcactccttatggcctctgctcttgctgtttccttgccttaaaatgttgtgacatacatctcaaaagggttagctacttctcttcattcaaactgtttccccttcacaagatttttctaaacactccacactccctaaaagccagtatgtttactctcataacattatcctgctttgtttccttctaagcatttattactttctaaattgtcttattttgattacttgtttattatttgttctctcctttatgacagcacagacttattcacagctatatcctcagattccagaatagtacctggcacatggattataatcaataaatggatactgaatgataaaaaatgagtgccataaaccactcccaatctacttttttgtcctttccttatatccaaaaccttaacttccttatatccgtttcaatcctctttccctctaaggaatattctgcaattctatcctataaagacctttactttatgtcaatctttatttttaatatcatttttgtagagacaggggtcttgctatgttgtccaggctggtctcagaaatcctggcctcaaattcccaagtagctaggactacaggtgcatactacccaattttttttaaagagataggatcatgctatgttgctcaggctggtcttgaactcctgggctcaagcaatcctcccatcttagtctcccaaagtgctgggattacaggagtgaactacaatgcccaggttattttatgtcaatcttatccctaatgattactgtaggtacggcatatattatacttgtttatagaatatcttataaacattctattagaattatatgtgtattactctattctctcagaagatgtgcttccttaaccagaactgattaaggaagcagggaaggaaaaaggaaaaatctttaaaaaaaaaaaaaaaggactaaaaaaatcttttgcttctttttattttaataaacataacatctaagaggtactgttcaggtaggctataccccatcattatttgatgagtggacagtttgtaaaaatacttcaaaccaaatattctcaagcatctaaatttatctaagcaattaacagcaacaccatggagcttttagacttaactgtatcataaatttaagtttgaaatatttttgctggataatacaaaatgattaccatctaaccttacttatttaaaagaatattataaaaagtgattgggatgtatgtaaagtatttaataatactttcagagaagaagggaagcatatatatcttttccttcacaatttacaaaatgttttaaaatcaaagtttctgagaaggtcctgaatacatacctctgatttttttaaatattcacacaatgttatttgtcctttcattaatgaaaatattaaaatgacttcaaaaattaaactaataagatatctaaatgatttttttttgctattctaaggggtcaatttttcttatctatatgcctattttcctaaatatgcaaattacacaatatttagcaacagcaattttatctaatagctgtgtaaactattctttcaaaaaagaattaaaggtaaattaaagttttaattattataagcaggctcaaaatgttgggtttactgtagattaaatgtctaaatgcagagcataaaatgattcacatattttaatattaagaagaaaaaactatgtataatttacacctacagtgcaagaaggaagaaaaaatgcttgtgtcagccttaggaaacaaacagccctatcaagtaaccaactagaaaagattcatactggaggctcaataaataacagtaatgatgacaaccatctcccataactacattacagcccattgtccacatctgattatactagtctagaccttgggtaagcacatacacattttcaccaagagttttccaatattactgctctgtttcctgggctttctgtgacccccattagcagcaactgtcattttcactactaaacatgaccactgatgagaaaggaaagttactacttttctacactctaataattgagaatgtggaaataatgttcctgaattggcaatccttctaaatatagtaatttctttagaattagctacagagaagaggataaattgcttccaaagattttcttccataatatgagaactactaaagcctcacttttcaaaatatcatctccatatattaacatagcctttattcttatagtgaagaattattgcctaactctccatgtatctgcctccttgcaacatctatctctctctgtctctcacccagcacatccaataattcagtatcacaaaaatccctaaactgttatctctctgcacctttctcagttaaagctctcagtaacaactttgaataagggatgtaaaggttctaacatcacagaatacacatgcctggaacctcagaaagaatagattttgttggtaactgaaaaaattaatttaaattaaaaaaaaatttttaatgggcttcatacacatttaaggccagtctagatctttctcggttgaaatttagcccaggtagtagccactttttctggaaggcagtatccttgatcagagaccacaaggtatccatatgctttattagactttaaatggagatagcaaatactccataaagttatttcatcctgagaatataaaaccttagtaatttaatataaatgttacatcctcacatcaacctgtttttccaaacttactttgcatgataatccctagttgaacattttaaaacaactcatgatattacagaggctagaatggaagcaaaaagaccaggctgcaagcttttatctgattattttagataaaataatttcttaggactatgaaataatctattctctagaatgtgcaaataaaaagagacagaagatagttacatgtagaaaagcaaaaatatagagaaatggctctcctgactctccacttggaattcagtttatttggaattcagcagatttctctgctgcacagtatctaccaccttctatcttcttataactgcctttgtctcttcattgtcagtgacatttccttggcgattcatagaaattcatcttttcagattccactctgaccactcttatttaacactgcaatgtcctctgtatccgactgtacctattctcctcccctcgttttaactttctcatatcacttatctcctgaacatactatcaactttttaatttctttattgtctaactttaccaattaaaataaaccctattaggcaggcatttctattctgaccattgctaaattcccagagccaagaatatggaccagcacgtggccagtatggattaatatttgctgaacaaagtgaatgacgctattttcattttatttttattttactcttctcaaaggttatgagagttccgtttttcacctatccctaatacacatcccttttttctataatcattcttatttaataaatgatcctacgtacatagatgctgttgtagtttttttaaaatgtgtaaggctatgaaacatctatacaaacataagcatattctacaggcacgctatatccaagccatctttcctaaaagtcacatacatttggtcttggtaaaaaaatgtcaaacagcaaatcctatttagcaaaacatttaaagctctgaaatctagtagaatttagcatttttagggggtgaaaaagcacaattcaaacgcagcaccatttttttacataaatcagaacaaagcaagcttaaaaagtagccacagaccagtgtggtggctcacacctgtaatcccattactttgggagtccaaggtgggaggatcacttgagcaggagttcaagaccagtcttggcaacatggcaaaacaccaactctacaaaatgtacaaaaattagttgtggtgtggtggcgagcacctgtagtcccaggtacttgggaggctgagataaaaggatcacctgagccagggagatcaaggctgcagtgagccttgatattgctactgcactccagcctgggcaacaaagttgagactccatccaaaaaaaaaaaaaagtaaccattgaaaaatcatttaaatataaaatcccatataaagtgcacaaaacaagcctccatattcaaaacctattaaaggaagtatattaatgataagctgagatcaagctataaaattaaaaataaaaaatgacctgaccatgtcagtactttaagccaaaacatatgaataaaataaataagaaacatatgcttatcctaattaaggagagaaaattctaatcttctttgataagccattaaaccttcacaaaatgataaacattaatttaaataatctaatctttaagagcatataagagcatatactttattctaaatcacccagagaaacttctatactaatacaatccaggattgaagtaaacagagataaagacatgagcccaggagctaagcggttgcagcctgggtgacagaacaagaccctgtctcaccaaaaaaaaaaaaaaaaaaaaagagagagagagagataaagtctctgctcaattaatccactgttgatctctgactctaccctaaaaatagcatcatttccaaacaactgtttacaagatgtaattaagcagagcacagtaactcacgcctgtaatcctaccaacttgggggaccaaggtaggaagatcacttgagcctgagcgacaaggcaagaacttatctcttaaaagaaaaaaaaattacaataaaaaaatttaattggagtttttctataaagtatcttcccacatatataattttaaaactgaaaccagaaaaagcacatggctctttaagtaacactcaaggatttccaagtgataatctctacctcaattcaaattttatcttccactgatacagataagaatatattctagccacactgtttacttacgtgcaataaatacctttgtctttttatcaaaggataacccagatctaaaatacaagtgctaatggccaacagggtccaaatgaaatattttctggcctctctccctctctcccttttccctctccacctttccttctagtcattcttcttctcattccaccaacattattagtaatcgtgctattcagagaagtgaagaaaaaggatggagcggctaaatgaatgctcagaaagaagacatgcaatctaagtagatgaattttgaagacagaccagtgtattaatactcgaagcattatgtcttttatgtgggctatttatatatttgtatacaagtctgagttactgctgtaataagcagacactgactggctctagaggatgattaagcaacgtgcccaacagtatgcaggataatctgccctttctgtgctttccaaggatgggagaaaaagaagagtcacagcagcacatctaaaagtaaagttgtaagaggctatgaaagctcttaaaatgtgtttttattaaattaaacacaaaactataattataggttgttttaattatttatatatttaacaaattacaagattcaagatgagaatttaaatcttaaaatttttaccaaatattgtacctttaaactaggtttcatagtctactacttccctgatttttactatcaaacatttaaaaaattagccaataaaactatgccggtttttttatttaaagtataaatgaaatagaaacaatgaggagaaactaatagaaacattaataaaactaggaacaagaatgaaaggaggccaggcacagtggctcatgcctgtaatcccagcactttgggaggctgaatgacttaagtccaggagttcaagactagcctgggcaacatggcaaaaccccatctctacaagaaaaaaaaaaaaattaaaaattagccaggtgtggtgtcctcaacagcagtcccagatacttaggaggctgaggtgagaggatcacttgagccagggaggtcgaggctgaagtgagatgagatggtgcccctgcactctagcctgggcaacagagcaagaccctatctcaaaaaaaaaaaaaagacagaaaactctgatagaggatttgcacttatttttcaaaattctagaggttaagaacaaaaagagtaccacctaaacaaataaaatattcatcattctctctaagacacacaagtcataagacaggagaccaccaacaaatcattacaaatttcacaaaataatgtctcagaacagctgacttgatcactgctacctagaacaacatcaggagcttaaaatgctctaaaaaatatttggagggatcacaagcaagctggcaagaagaaaggaggcaacctagcagccagatctatttctgccagcaaaattaacatcaatactgagatactaaatttttttgcaagtaatatcaccaaaacctctaagaaaataagaataaaaggcaaaataagaacttgaagccctttatttatccaaataagaaaaaacattcaagattcattggcaaagaattgagttgaaaaatgtaagcaacagtgttatggaatgtaattaaatatatctttcaattcaattcaatttcaattaaatacatttgtaaagtgaagaaaaaaataactaagataaagacaaatcgaatacacaaataaatgaatttaggtccaatatacataacaatgtaacctacaccacatctaaatttagtataacactgaatcctcagatttcattcaacagggtcaaagggagtagtaataactgtacattattttctattgatgtggtgctacagcatcacagagactctaaaaggtggctttaatattctttaagttctttaaaactattagtttagagaaagttgtgcctttcaagaataagaaaactcttttagatctttcacttgcacatttaaaaagtaaacagaggtgctgataataatgattcaagatatcataaaacactcataaacaaaattagtattcaggaataacaatgttcttgctcataacttgtgaaaatttaattatttaactgaaatcttttattataagtatatgtatttttttctctttaaagtcatcaaggttgtaacaattacgtcagtgattatcaattattctagctctctaaaataaatttgtttaaaatggagtgttgtttacatgaaaaataccaataattgaactcaaaattaccaaaacaatgtatttaaaaatatcttattaaacaaatgtaagttaaagagaccatcagcaaatcactataaatttcacagagtaacatctcatcgagcagctgccttgatcatagctagaacaacatcagcagtttctaccaaacaacaattacttatgtctgaacttagtaattgatttgctaatgacactctacaagtctgttagaccttatgctgtagtctgtctataaaggtcttcatgttatttacacaaatacgacattaatcaagggcaaaatttatagcagctactctataaatgaggtcaaggcaggtcagacttacataataagaagaaaaaaaggttagtctttgcagtaaaaaggaaaatcattattattattcttcctgcccctgggattaagtctagtagtcaaacactccaaactatttcacaaacacatctactcctatgaaaactcatttaacctcaaggcactaaatatttataaaaggaaagccaaatccactgatttagaaaaataaaccactaaaattttcctttaaaatatattctacactgtaaataaagagagaacgaaaatttccaattttacctccactatttcactaatgaatcttagcttccaccactgtttatttcaaacacgtaaaagataaaggctgagtgttctctataggctaagcactgaagtaaagaagacagtttctaactatgggaagctaaaaaatctcaacagaataagaaaagcaaaggtaaaaaatcagagaaagggtactatgaaaatgataacagatgatataaaaataaattattcaaacaactgtttcaccaaattttcagaaatagcaatagcaggagtattagcatttgtgccagtacctccaagtctcagttccacagaataatacaggtccagtagacacctgtatatgcagtaaagtgtgttacaagagaggaactctgagcttagggcacttgaatcttctgtgacggccagtaggcccgttggtctttggcttggagaaagacattattatactagacagtaaacgatcctgctttgttctaaatgaagacactatttctatattccaaagctgtctgctatataaagatctttgaatgataatgcaaaacaaaggcatttggtatctcttcttacaaggccaaaaatcttaagagtgatgcctggctttctctcacaacccacatccaagccattagaatatcctgtcaggtcttatcttcaaaataggttcataatcctaccacttcttacctcctctactgctagcaaccttgtcccagtcaccatcatgtttaaccagaattactacaatagccccctaattgatctctttgtctttttttttttttttttttgagaaagggtctcattctactgcccaggatggagtgaagaggtgtgagcatagctcactgcagcctcgacctcctgggctcaagtgatcctcctgcctcaccctcccatgtagctgggaccacaggtgcatgccaccatacccaactaattctttttattttctgtagagacagggtctcactatgttgcccaggctggtctcagactcttgggctcaagcgatcctcccacctcggcctctcaaagtgctggaattacagacagaagccactgcttctggctatctcttcacttctatccttaaattcctacatgcatcagccatagtcattttttccccacgacagggtcttgctctatctcccaggctacattgtagtagcatgatcacagctcattgcagcctcgtcctcctagactcaagggatcctcccacctcacagctttccaagtagctggtactataggcacctgccactataccaggctaattgtttgcattttttgtagacagagtttcaccatgttgcccaggctggttttgaactcctgggctctaacaagtcacccacctcagcctccgaaagtgctgggattacaggtgtgagccactgtgcccatcccagagtgatctttttaatccataagggagactgtcttcctcttcttctcaaaatcatgcaatggctgtcatttcccacagaataaattacaaagcctctacacaaaatcttgccctatgttatctctctgaccttacttcctatttcattctactttaatcactcttttcttgctatattggcctcattcctcaaatacaccacagaagctctcacttgtacactggctgttccctaggcctggaatgcttttccatacatgcccctttaactgactccctgtgtgcttcaagtgcttgctccaatgttactttctcaatgagtcctaatcctgccactctatttaaactacaaaccataccaaccttttttacttccttcaaaaatttcattcccctcatctgctccatattttttctcacagtactaaccgtcattcacatattatataacttacttttttttttattgtttataatctgtcaatgcctatttgaatgtacaatccacgaaaaaaagaatctttatctattttgtttattgctgtatcctccgtagcaagaataattcctgggacatagtgtgtaataaatagatgaggaactgaagctcaaaaactaaaagcgcttgtcaagtatcaaagctgaaacctgaacccagggctatcttcaaagccaatgctcttaatcttaagtctatgttgcctcatctattaaatgtaacaataacatacataaataagggtagttacacttagtaaagtctacgatgttcaaaatcacctcatataaatttttctttaaaaaagccctggaattatacttcaataaacactaaaaattataaaaaatctgttcatgggtgttttgcattaagcagaacatttgtgtatttaatcgacagctccagtcacctctttttccatatataaacttcaatatcatccaatacctcagtgttgaaatcagtcgaaagctatttttcaataaatatacactttgaaatgtttactaaaagagtaaagaattagtcattatttcattaattgccctatgaattagtaatcactgatataaatctatatcagtttttattgatcacctactacttgccacactctacatgaaaatgtatctctatgtttcatatagatcactgtagtaaccttgctactgttcttcatttcaatcaggtcttccctccttcaacctatcctaaacaattccgccagttatctttccaaacccgaaatatcacaatgactcttttgtttaaaatcttccaaggcttcccacgatcttgagggatctagatgcccaattccaacaacacctctccaacacacacacacacacacacacacgaatatcctgtacaccttcccacattacaatgccttcagatattctgttccctgtgtttgaaatgtttttcacacaaatgtcctccaatttttccataacctccaattttctaatgtttacatgacaaatcgtactgatccttgaaatgcacctcaagaatcatggttcctggttaagttttaagcaccctgtacttacatatttctatcacagaatttagcatgaagtattataattgcaggttactagtctgtgagcacctgtaattatttctgaaggaaaggattttagtagtatttaaaatcaaataaagttacgaatactcttttcgcccttttccataacatttatgagagatagagagcaaaccttgattcctagatgcaagttcaaatagttaccaaaggactgatagggtcaatcttccaacaacattacctaaaacactaatcgaacattgctgaaacagtaagtttgttcagaatactatctcgaaggggagtcagtcacatcttttaatctatactctgggtcttcagttccattaatgcaaaatcagctactacaaatcagacaaaaagtggtccactaatcatttcctcaatttctttttaccttttaatgatttcactcttttacatttgttttctcccttttatctctcttttcatctctgtactttcttcccttctcttacccaccactgaattttctttccttgaattcttctgtttctgttctttaagtagaaaatatacctccttatttcctctatcacctttctcaccacatcacattgcgaaacttgtcccccctcccattatgatcagcgtgtgatataagaaagataatatagacatctaattctaattattggctctacacacataaaataacttgatagaaagtccaaataagtatggcttttccttatacctgcaaatagaattaacagtttacttttcccaaactcagccacactttttgaaaaataaaaatcagaaatgtatcagtaagcttgcatctaaagaaaattataaaatggttaaatattaacatatacataataattgatatatcagagctccattacattactgactgaacaaacagtaaatacagaacccaaaaatatcaatgcctataggaaaaacccaagattttaaagaaaaatacaaaatgaattaaaataaaataaattaccttccttcattgacaagttcgataaaagcaaggcctgcattcttctgaatagaattttgccactcctataaaaaaaaaagcaaaaatagctgaagaaatgtcactcagtaggttctttcttttaaaacaataataatgaaaaatatcacccatatcaatttcatgcctaactcttaaaagttatgttaaaccatatgaacaggtaatactgaaaagtatactgacactaaacaagttagcaacaatttgattctgtgtaaattaaatgagcctatctatatttatcttgcccttttcattacataacacgatatactaatttatctgaaatagttgggagctgggaaagaaggtaacaaagaaaaccaaggacaaatagacattttggttttggctttgtttttccatttattttaagatgtattacccaaaatgaagagaagaaagaattaaatagttcaataaccctaataaaaacagcatagttcaccataaaaattgatgactagcaactgaaaatgaaattagaaaaatcagtgaattgagctaaaccagttttgagttagaaactataattcactgccctatgaattagtaatatctggtataaatctactaactatattcttgatccatttgaaatttacccattaaactttatccactaaaaagcaatccattaaaaagcctaggaatgaaatcaatcaatagagtatgtacaaatgaatattttaatccttaaaacaaaaaatatatataataagcattaatacaataaggaaaggcctacatgaactgaaatatacctagatttgaaaaatgctcgtgaatgccacttgtgtgtatgtgcgtgtgtgtgtgtgcctatataaacacacacacaaagatttgcttttaaagaactggaaatacatacataatcttcatatttcttaatatttaaggagctctttgtattctaactacataatatccctcaactgatctttttttgttctttcataaaacccaaatcaaaaggccatgtctggctacttaccactgctcactataaaccatattcatattttctgagtgtaataactctaagactttcaaattccatgcaatttcaccctaatagctattccgttccactccaaattcttttctttttcattctcatcctttctcttctaccttctcttttccatgtccactttcatacttaccttcttttgtgtttttgaaaaacccaaggtggttcttaagactaaaacaatcacatgacatgattttgtcaaaggattatattttatgaatagtattagtataactatgctaacagaacaaatacagtagaataaaaattaaatagaaaatcagtaaaacgttggagggtagtcactggctagaactagcagagaagaaaaagtaacgtattctcaaggaatgagcaagaaacaaattcataaaatccatgttctcattctgatactaacagaatatatccttaggcatatcgtgctacatctgcaggtcttagatattatcttctaaaagtgtattctaggtataatttttattattctaaaatttactaacatttagaaattcatgacttgtaattgtacaatatatactctctaaaattcatactgaattcatattttaccaaaactgtaaaacagggatactaaattttttccagcgaggtaaaacaaaccaatataaaacagaaatatgaatctaatttaaaagcattttctttccatcaaaataaaatgaagacaagtagtccaaaaggaagcaatcaaattccacaagactatattcttgagagaagggcatgtgccacgaaaaggtaggagaatgatgacaaaaagcagaaacctcaaattttttttttattttggtacagagggtcccacacctaacttcccaagcacagcacagagagataagactcaaagacttaccctaaatctagtaatgcacaagaacagtagaacaggaacaaatttaaagacagatggacctcagctaggaagattcaaaaaattatcatggaaggaggcagaagcagcttaggatttaagaagatgaagagaacataaccatgacctctgtggataggcagcaagtgatcagcaagaagtacgatacttcaagagatgccacagccaaacaacacaagcatatgttcattcctcagctcttatacctaacataacattcttggaaacccaactagaaatttgacataatacaagaataggaaggaaagtgagacctcaagttgagtgagttttcacttagatcatttaacttacagaaaacttcaaaatagaaacttagttaaagaagaaaatgaagaaaattacctttcttgctagaaaaaaagaagtcagtaattacagaagaactaaaattctgtatataaatctttagattagtcattttacttttaaaagtatccactgtcaggaaaacgtcaagaatgtcccctctcaccactatctttcaacatcattctggaagtcctggctaatgcagtaagacaagaaaaggataaaaattgaaaaagaagaaataaaactgtctttgttgatgacataatcatctatatagaaaatcttaaataatctacaaaaaatcctggaataagcaataaatagcaaggttacaggatacaaggttaatatacaaaagtcaaccactttcctatgtatcagtaataacaagtcacacactgggataaaatcatttgtaaaagacatctgataaagaattgtgcaaaatatacaaataactcttaaaagtcaacaaaaacaaacaatcacattaaacaatgggccaaagactttgacacctcaccaaagaagatatacaaatggcaaataagcatatgaaagattgtccacatgtcactggggaaaggcaaattaagactagataccattagacacctataagaatggccaaaatccagtacactgacatcacctaatgcaaggatgtggtacaagaataaatgaaatctcagtcattgctggtgggaatgcaaaatgatacagtctcactggaagacagtttgatggttcctaacaaaactaagcctactcttaccacaagatccagcaatttcactttttagtgtttaaccaagggagttgaaaacttatgaccacttagaaatttgcacatggagatttatagcagctttattcataaatgccaaaacttagaagcaaacaaaatgtccttcagaaggcgaatggataaattgtggtacaaccagacaatggaatattattcagcgctaaaaaaaaaaaagagctatcaagccatgaaaggacatggagaaaatgtaaaagtatattactaagagaaagaaactaatatgaaaggttacatactgtatgatttctactatatgacattttggaaaaggcaaaactatggagaaatgtaaaaagatccgtgtttataggggttagtgggaatggaggggagcacaaaggatttttaggtcaataaaactactctgcatgaaactataatgatgaagacacaccactacacatttgtctaaactcacagaatgcacaacaccagagtgaaccctaatgtaaactatggactttgggtgataatgatatgtcaaaggaggttcatgcattataacacacatgccagtctcgtgaagaatgctgacaagagagaaggctatgagtgtgtaggggaaagggaaatgtgggaaatctctaccttttgatgaattttgctgtgaatgtaaaactgctctaaaaagtaatgtcttttaaaaattagtaataaaaaagtatttactagtactatttttctcaaatccatttgttctgatccaaaactgcaatgggaaaggatttttattacataattcagacaaaatgcaaaactccacatggatgaaatagataacagcagaaagacccatatattaagtaggcaggtaaagggtaaacatcatttagattttattttcattatatacagaaacttttaattacattgtcaaatcagaaattgtgccatttagatttcacaaagattttaagtagcattattggggttagactgaaaaccagttaaagttagtataactatcaaaacttaaccacactaaaaatttgtaatctaaacttatcttggtatgtcacaggaaatatttcttttcaattaaaaacaaattagacatgaaggtacatatataattgaagaagttcagtgttttatggaggctcagaaactcaaatttattactagtaatacattatgcttctggttttctcgaggatcatctataaacccatatttgttaaccttcagtaattattacataataacctgaaataaaatgttctcattaattttttcaaattggctaaaattaggaataaaatgaaaatacaaaccttatacttttggttattgttaaaaattatcacaaatctcaggaatatccttatgttttcatttctctataatacagtcctaattactaattattaccatttaataaaataccaaatgccagatatacaaatgcatactaaaaagaatagcctatataaaaagaatctgaagcccatgagaatattttttcaatttgtttataatccaggtgttagtcaaagccaacaagttttctccatactaaaacattctctacagtaattcacagaagttgccaaaactaaaaagaatattcctgaactatgctatcctaaaccatttttctccacttcagaaacaattatcaaggaaggtgttagtctaaacaatttcataaaccacagctcaatataacccttagtgagttttaatagttaaaagaaaagcttaatggtcatcgtctttcatgatcgtttcaatatttcatcacagtatttacaattatacagtgatgcaaaatgcatagtacatttaaaggtcttggttatccttctcccagaggtactgatgaaaaacatgttaaaagcctcaaatccaaccactaatgcaactaagtaatttcaaaacacatttcagcactttggagaggaagaactcaaaacaaaacaagagagtcaataatttcatacctgttcctaagctgtatttaattgactatcacttcctaaggccataattgttgactagtcaatttttactaaaatatactcttagcttactgatgcttttaagtcacacaacaaaaacagtgaagataatacatattagtgaaatctactacatagatctccaccaaatttcaagactgtattcttggtggtaaaagttagttagggcaacaaaagacttcattaacctaacattatctattcctgcctatcctcaacaaataaatataaagaaaaagataccaattaacacactatgcattcaaattattgtaataaaattctaatttctttagacatgaacttgacagttttctataaataatctcctagaacgtattttagtgacgaatacactaaataaatttatctcaattttaaaagtaattcccaaatattagcatgttctaaagcagaaaaaatcaggccacagattaaaaagattacatataatctactctgctatcattttattttgtcaagccatgaatactgattaacattaaatatagtagcatttgattctggtgggcagatctttaacataacttttagtattaaaaaattttttttctgtaatcccagaactttggggggccaaggcaggcagatcacgaggtcaggagatcgagaccatcctggccaacacggtgaaatcccatctctactaaaaatacaaaaattagccgggcatggtggcgggtgcctgtagtcccggcttctcaggaggctgaggcaggagaatggcgtgaacccgggaggcagagcttgcagtgagccaagattgcaccactgcactccagcctgggcaacagagcgagacttgttgcaaaaaaaaaaaaaaaaaaaaaatttggccaggcgcggtggctcacacgtgtaattccagcactttgggaggccgaggtgggcagaccaggaggtcaggagatcaagaccaacctggccaacatggtgaaaccccatctctactttaaaaatacaaaaattagtcaggcgtggtggtgcacgcctgtaatcacagctactcaagaggctgaggcagaagaatcacttaaacctgggaggcagaggttgcagtgagccaagatcacgccactgcactccagcctgggcaacagaatgagactctgtctcaaaaaaaaaaaaaaaaaaaagttttttttttcaagagaggtagataatgagtgacttcaggttaaacatagtaaatctgagaataaagagggggcaacagtacatgagatacattaagaaatttattttacaacctggaaacacatgagttagtagtaataaatgcacttagaggaccaaagaaaacaaaactctacacaacaaagtagaggaatcaacatgaggaaggaaatcaatgcttgtcacaaaaactccagaaaagctaggaattgaaggcactgagtacatacgaaggtggctgagggaaagagatgcaagttggcataaaaagaaagttagaatcccacatcttctccctatgctgtgtagccatcctaccatggtaaacattggaagtttattttccagaaaagttataattaaggaaattattaaaaagctataatgaaaaaggcaagataaattgaaagtatacaaactggactatgacattgtgagtgatatttgaaaacttttctgagaaaattgagaagctaggataaaaggtaatcctctacaaataacaaagggaactcatgcatcaccagtggacaactcatacccagacatatagattttctctgtgttatgcttaggaatgagcaaattgccaaagttaaccagacatttgaggaaaccctcttctgtgatgacagacaccaaagcaaacaggcagaggagaaaaacgactcatagaaaacagacaatattgttaagagggtgaggaaaagaagattaaagaaaagtataattaaatatcataggaaaatttttttaaatttcatctaaaatatcaagatagggattttatcaagtgctgtctccttttttttttttttttttttttttttttgagacacagtctcactctgtcacccaggctggagagcagtggcgcaatctcggctcactgcaacctccgcctctgggttcaagcaactctcctgcgtcagctttccgagtagctaggactacaggtgtgcatcaccacactcagctaattttttattattattatttttagtagagatgggttttcaccatgttggctaggctggtctcgaactcctgacctcaagtaatccacccgcctcggcttcccaaagtgctgggattacaggagtgagccaccatgcccggcctatcaactgctatttctatgccccggtattaatcaggattcttcagagacacagaacgaatgggaagagagagagacagagagagacacagacagagagacacagagacagagagagaaagagagaagagattataaggaactgactcacacaattacattggctaacaagtgccaatatctacaggatgagtcagcaagaccaatggcacagtctgaaggtcagcagcctctagacccaggaagagacaaatttgaatccaaaagtgagaaaaaactaaagtcataattagaaggcagttaggcagaagaaattctctctactgggggaagagtcagccttttggttttattcaggcattcagctgattggataatgcccaacactaacagggagggcaatcttttttactcagtctaccaatttaaacttaaatttcatccagaaaagactctcacagatacagctagaataacatttgaccaaatatctaaacagcctgtgacccaaatgacacacaaattaaccatcacaagtccaccccttgtcagcttggcactcatatacatctcctcaaaccacatttcattaccaaatgaagattaataacaaggttataattctacctaacatgatacaactattctgtatacaaccaaaaccattctaaacctgtgacagtcaattttatgtgtcaacttgacaggactaacaaatgcccagggagctgataaaacatgatttctggttgtgtctgtgaggttgttccacaacagatcagcatttgaagtggtaaagaagatctaccttcaccggtgtgagtcagcatcaatcacccgatttgttgagggcccgaataaaatgaaaaggcagaggaagtgggagttcatctgtttctgttgggaaagacatcctcttcacttgccctcacattagcactccagggtctcaggacttcagactcagactgggacttacaccattggttttcccgggcctttaagttttagacagcagatcatgggacctctcagcctccataattgcatgagccaatccctcataataaatttctttgtctgtatctatatatatcctattggttctatttctctggagaaccctaatataaacccattccccaccttagctgatatgtatactttcctaatatcccacaatttacatatttacatactaggatgtacagttaacaatatgatctacagttaacaatacttaaatactatggtgttgatattataaactcaatacatcttaagttgcatggtgagggattaaaagaggaaagaaaacaaagattttatatatatatatatatacacacacacacacacacacacaaacacatatacacacacaaaataagaaagaaatgtaacaattacatttcttgttctgtaaatggtcatgtgatcacagttggtatctacaactaccttttttcactgcctattctgtattccctttgtcttcagcaagcacctcagctggtcctggtactgtacctaatagggtgacccaaagcttcattcctgaagggtctgggctgctttagtagtcctacctggattgtattaccagtgctcctcaacttaatcacacagtatggtaatactaagatatgcactgaggaatctcttgtattctagacatactcttccttacttttattgtggtatagttcaatttccccacagtagtcaggatcaatcactactcttagcatgataactccatttttgcctgaggattcagaggcaggaggagcccaaagtggctgggaagcaatcttaacttccggttcaatggaatcattgttgtgcctcctggtggaagcatttctccctttggaagtaagacctctaggccagcagactgtaagatcacaggaacaggaagcaaaacttttgctattgggtcactagaggtaataacaagtggtaacactcccatttctacctgttgattcctggaccaatgaatcctacctgtggggagaaacagcaccatatactggatgctgattcagtacacatatatccttctggaaaaccttgtcccagccatataaggtattgccacctacattcagttctatcaagccagctgcttgaggatggtggggaacatagcaaggccagtgaattccatgagcattcatttgctgtgaaatagatttcttaatcagaagcaatgctaagcaatacaatgaaggttgataaagcattctgtgaatccacagatggtagtctgggcagaagtacggcatgcagggaagataaatttgtatccagagtgagtgtctactctgataagaacaaaatgctgccccttctatgatggaaggggtcaaatgcaatcaacttgctaccaggtaacaggttgatcatcctagggaacagtgccttatcagggacttactgttggtctccactgccagcagatttgacactcagcagtggccacagccaggttggcttgctgagtggaagttcaggttgctgagtccttggataacctccatccctgccaccatggccaccttgttcatgagctcactgggcactggtgggcggctggggaaagaggctgactagtatccacagaacaggtgttcccagccactttagtattaaaattatcctctgttgaagtcacccttcagtgagcattcacataggacacaaatacacagtattcagattttttctcccattcatagacatctatacacatacctcttcccctaaactttttttgtcaacaattttctactcatgtcccttccaagtctctgaccatccagacaaaccaatagccacagcccatgaattaataatcacatttatccttccaaaaaaagtaaacaatcaggtacactcctcaaagttctgtccactgagaagattattcttcactacagtccatcagggatgtcccaaaaaagggctgtagtgctccaactgttcactttcaggtggtgcctgcatattgtcagaacaatctatacaccaggcccaagtcttctcctctggcaactgatcacaggactcaccaagagaccataggtacgggctggcaaagagaaggtagtgtagcagaactgaggaccataggatatttgggccacttcatgcaacttacttgtgttttcaagcattgcttgggcctgatcacatgtacatcacttcgatttgatgacagagtgcttctgtgcatgtacaacttgatggcttagtaggacagataacattcagttcataataagcagctcagtcacttgttaatttggtggcccagtgttaactgttcagtctctacttaaacctagtgacaggccaagagttgtttctcaaaaggagaatatttgtctgggaaggatgtcagggccttgctccaaaatcctatgggtttgcattgcaatttacctaaaggggcccgtcaaaggctccaaatagcatccccatctgccactgacacttgaagcaccattagatctcctggagcctatggcttgcacagcagcctgaacctgttacagagccttctcttgttctgagttctactcagaactatcagcttttcaggtaactcagaaaatgggacagagtaacatatccaaatgaggaatacgttgcctctaaaatccatagagtctacagccataccaccctgaaaatgcccaatctcatctaaaagccataaacggtcactagcatgtacctttttggttataggaggggccagatacaacttattcttcacctaagaaggggtatctcgacatgtcccacaacactggagccctagaaatttcactgaggtggatttaccttccaacttctgacatgcaaatgccttaccaaaaagtctggtagttacaacttcttgctcactaagtggaaccagcataatgtcatcaatgtaatggacgactgtgatttctctgtggaagtgaaaagtgataaagatccatgcaaactaaattatgacatacagctagaaagccagatactcctgacatagagcagttaagggacactgctagccttgctagctgaaagaaaacgacttctagtggtccttattgacaagtatggagaaaaaaaggcatttgtcacgtctattaggtgccagggaatgtgtcaatttgctcaagcattgaaaccacatctggtacagcagcagtacttggagttaccacctggttatgcttataataatacactgtcattctcaaagattcatgtgtcttctgcataggccaaataggcaagtgagatgaatatatgctggaaattaccacacctgtgtcaaatccttgatggaggaaaatccttccagaaatacagtattgcttttggcttataattttcttaggtagaggcagttcagtggcttccacctggggcctttcccatcataataaccctcactcaataggtcaggaaaccaatgtggagacactgccaatttctgagtatgtctattccaactatgcattccagaacttgggaaataatgacaagatgaattcgaagactcactaggcctattgtgagagagtgctcacctaaaactctattgatcatctggcccccataagcttccctgatattttaggtctcttggactcattgtcacttcagagccaaagtccaataatctgattatttccttttccccagtgaacagtaaccctggtaaaaggtcacaggtccctttgaagaagagtgaggaaaagattaacagtataaattttggtggcacaccagtgtatagagcacccttgacataacatagacatctttctatcttagaaaaagactccattttatatttcatggagcattttgccaacaaggatgttttgtttaattaaaaaaataaatcaaaacctaaaaattgcatccaaccagatgaggatacaacagacacattcttccactatcagttctgaccagaggactctgtgactatgaaagattaggccttcaacatcttgcagtcacttgtgataagaatttggcatctgctgacaaaggatctaccacctcaaagacttgtcgttgtaagactgactgaccacccagccgagaccaggactccttttgtcttcttcgctccccaaggactggtttattaaccctttctcctatctcttttccctctcgatgttaaaatgttactttgttgtggaatgtttaacttataatatttatacattgattaaatatactattatgtatggtttgcaatactgactgacttgtagaatggcttcagcctgtgtgcccacagctctgactactgagtgaacgggaagtataaggataattgcctcattgagaaatccatgtagcttgtggcttttgtgattaaaatgcatcaataaaagcctgacattgtgaaaagacacatatatgtgtggacctggttacttctaaccttgtactggtcatgagaaaatgagtccttcctcaaggggacccagcttccccttccttcacaaagttctggtcctgtaaattggctcaacttgggaaattgattgaggggccatgactcactgcttttatgattaaagttaggtatttgttcacttgatctagaacttttctgcgtatacaggtaaaataaaaaaattaataggcatactatctacttctcccctacatacaccatgatcaattcaccaatgtcatagatctgctccagtcaaatcagcatcacagttctgcttgctgctttgactctgctgtccattatggtgaccacattcaacttgcctttggtgactgaatgccaccacttggctcctgccagctcaggatccaattactcccaatgcgttcaggttttctaattgaccagctgtagttcctaccataaggtctgatctacaaagaagggtagtcgtagagctcttcaagaaagctgagcctccctttaaaaatttatttctcacagtacacggaagtgtatcttcaagaccctgcagtgtgagtaagtaggtcttacattataaatctactccaaagttccaatctccccaaattattttatttatttagagacaaagccttactacatccccagtgctaaaacagtgaccagtacatatgaattagtgatccacaaatgttcaatcaacatacatttctaaaaggaagtctgcaatggaacacacacacacacacacacacacacacacacacacacacacacacacacagtgattgcagcataagagaggaaagagggaaattctaggctgatgataaaagaagcgtctaacataaaagcttcctatagatctaaaggacaaccagactagattggaataggaaaaaggggactctaggtgctatatttccaagcaaaacaattgaaccaataaatatccagtgggtttaaccactttttccaatgcgttttatgattacagagaaaaatttaaagatcaatttgtggtgagtgcacagaaatataagtaaaggaaaaaggacaaaatcattagttctacaagaaagaatgaaaaaaaaaaaaaaaaaaaaaagaccagcaagcaagagaggggagaggaaggacgagtaagggaagagaggaggagggaaaagagaagaaggagcagagaagagagaggagggcagaagaggagaaaagaggggagaaaaaaaagaaagaaaaatatgtaattcatagtacattttttagctctggcataaatacatgataataacgtaaatactaagtatggttttaacaaatgttattatgaaagtatattagaaagaagcaggagagtgaaagttaaaaggagaggagtttaagtactcaatggtcgtctttcacaaaagattaatgttcaaagtttaaaaatcaagaaacagtaattcatggctgggtgcagtggtgcacgcctataatcctagccactagggaggctgaggcaggagaatcccttgaacccaggaggcagagattgtagggagccaagatcatgccactgcattccagcctaggtgacagagccagactgtgtctcaaaaaacaaacaaaaaaagaaatagtaattcaagcatatcactgtcaacaaccaaaaacatttgaaagatgtggctgcttccaagagttaagaatcaatcacggggaagagggggaaaagaggcagagaactattgtttatctgtttcgtattatactattatttgggtgctttatttgatgaaaaataaattttaaattaaaaatcatatgcccagctgaacacactggctcacgcatgtaatctcagcactttaggagaccaaggccagtggatcacctgaggccaggaattcaagaccagcctggcaacatggtgaaaccccatctctactgaaaatacaaaaattagccgggcatggtggcgggcacccataatcccagctactcaggaggctgaggcagtattgtttgaacccaggaggcacaggttgcagtgagccaagatcgcaccactgcactccagcctggatgacaaagtgagactccgtgtcaaaaaaataaaaataaaaataaatcatatgccctaaatatatagaatagtagatgaataaaaaataaaaattgtaatacacacatatttttgtaactggacaacaggtatttatccaagattattcttgaaaatctctaaaaaatagaacatgcattcaagttttacaaatatgaaaaaaactatgaaaatacaaaagtattataagctaactattaagaatctgtactttttttaaagtcagttttttgaggggttttgttgttgttgttgttgttgttgttgttgttgttgttgtttgaaaaagacagggtctcactctctcgcccaggcaaagtgcaggggcatgattatagctcactgtagcctcaaattcctgacctcaagcaatcctcctgccttggcctcccaaagtgttgggaatattggtatgagccactgcaccggatctaaattcaatattgtaacctaccaaatggaatttgagtttatttccatttctactcgtagtaatactacccttttttataagttttgctctcagaaaccaaacataatttatattaaagaataaagaaaaaaaaaattttaaacctgaactcatgtcaaactgtttcattttccttattataaaaatataaaaatttaaaggtttaggttcttcaatgaaatatccacattgatttgttaagatgtagttatctatgcccttgtaaaacgaagcgaattggatggatgtacctccaattacctaaatagttgacagaaacactcctaggagttcagggagaaagccagggaggatagctcaaatgaggaagggaatgtattaacacaaaactgagaaacacattacacacaagactaaaggtcaaaactaggcaaaactggccaggtgcagtggctcccatctgtaatcccagcactctgggaggccaaggtgggaggatcacgaggtcaagaaattgagaccatcctggccaacatggtgaaaccccgtctctactaaaataccaaaattagctgggcatagtgcatgcctgtagtcccagctactcaggaggctgaggcaggagaatcgcttgaacccaggaggcagaggttgcagtgagccaagatcacaccactgcattccagcctggagacagagtgagactctgtttcaaaaaaaaaaaaaaaaaaaaaaaaaaactaggcaaaactgttcatgctcaagatacagtaatcttaagtgctcaaagtaaactatcattaacttttcaacaatgtttgcactttgtgtcagcactctctcaacatcatatctaacacaaacttaaataatcacataccacaaaagaatatagtgtaacaataaaggaaagattttattctattgtgtctttaatcactctgtgaaatagtaaaatagaatactgcccttcggaaagttttggtttcccttatttttgtgaacatattcatctaatatgtacctgtagcttgtataaatattacaggtcagttagtaaagaactgaataaagagaaagtaactattcatggcattcacaaaatatataaatatcttaaactccaaaaaattaagataaccatgcaaatcaattatgtaattactataaacacatttttaattatttgtaaataatcaaaaaatcctcttgcttttatgtttaggcacatgaaatattaatatatttgcaagtacctctaaaaatctgtatttacagtttttcaggtaaaacatatctccagacaataatgatccttccagtgacttccaaactggcatcaatttactcaagatctttcactaatcaatacagaaagcttaatttccataaaggtgacaaaaaagttgctctaactctttccagctacaagctctcaacagatgatcatcattaagtctgtatcagggctccacatttaggagccatataaatgtgtcctattagtacacggtcagtctgtttggcaactctagttcttcagacatatggcaattgctgccctttgaggtctgaagtcaagtctttagggaatctcaaagcttgcactgaaattacaaggagtgttcattagagacttctggaggggaaacatgaaagacttccattaaaactatataaaacagctaattatttttaaaagatttttaaaccatctaatgttctcaactataataaaaagtatttaccaactgaattatttttagaagcactacttcaggacatgggtgcaaacaggtttcttcctacctcctatctcccacctcaatacatacatatttattttataagaattatcaactcaagatttcaatacttttaatttagaattaaattatctcatacttctaaattctgtctacagaccactataaacattttctaaacaaagttattcttagagacaaatgtttgttttctaatatttagcttaggataatatatagccaacttaaacccagccagaaatacatatgtgtttctttttaaatgtttcttttttattcaaaagtctgcctctattttaatttttattttattttaaactaataatcataaaaaattttaagcataaaatgatataaagtattagtcaataaagtggcatttattagataatattatgcaaaacaggaaaacacatgaaggtttaatgtttactttttttaatatacttaagttgataaggaggagttcaaagaaatctcatatatttactgtcagaattttgaaaaacataaaaagtatattttctaattaatgattgcttccattttaactttttgaatgtctagacactttttaactcgagagaaaatcattatttattaagttttgcaataaaacaatcctactactgaatatttatttcagtaacaaatctttataaacttatataaaattcattagcttgcctcaatcatttcttgaatccacatatatgttggtttctgacagcgtaattccaaaaagtaattacaacctcaatccatttgtaaaaagacaacagaaaacaagtatgttacaccagtttaaaagaataaaaatctaaagaaaacagattacaaatgatttatatgaatgcctagtggtgaagttaattacaagtaacccaataaaatagtgcctttattattgtacagcaagtaaaagctctagatgtaaaaaccagaactctttctgctgacttctgcatgctcaatcccacagcacacaacattaagaattaaacatgtggtaaataagccatatagaaaacagcagtttttaagtaaaagcagaaaactttcctgctgtttaaccatttggggccttctactctgaataacaaccactgtaaactggcactatgtattcatggaataagtttttatggttaatatgaaaatgagattttaatttcagtgctcaaagtttaactccaaataaaacataaataactgtaaaataacacagcattcattttagcattcagtaggagcaaataaggtatcttatgtttatgctatgaaatggtgatatctacagaatttaaattttccaaacctcataatacatctacctataaagctttggtctctgaatttaaacatatattagcaaagacatatacactttatgttacagtaacttcttatggttgtcaagagtcacaacctaaagccagtcatagtatgcttaatgactttcctggtgtacagaaataagacctttcaatccagaacgactcagtaactcttatcaaatatttatcaatgttctcaatgagacaatagctgataccaactatatatatatacatatatatacacgtatatatatatatatgtgtatatatatacgtgtgtgtgtgtatatatatatatgcataccaagtataatacaaagtcctaatacatattatgcataaacatcatgatataagccagcagtccccaacctttttggcaccagggaccagtttcatggaagacaatttttccacagacaagggggtgaggggggggaatggtttcaggatgattcaagcacattacatttatcgtgcattttattttatttatttatttatttattttgagacggagtctcgctctgtcacccaggctggagtgcagtggcaccagctcggctcactgcaagcttcacctcccgggttcatgccattttcctgcctcagcctctcgagtagctgggactacaggcgcccaccaccacgcctggctaattttttgtatttttagtagagacagggtttcgccatgttagccaggatggtctcgatctcctgacctcatgatccgcctgcctcggcctcccagagtgctgggattacaggcgtgagccaccacgcccggccgtgcattttatttttattactacattgtactatgtagcaaaataattatataatgaaccataatgtagaatcagtgggagcactcagcttgttttcctgcaactagacagtcccatctgggggtgatgggagacagtgacagattatcaggcattagattctcataaggagcacacaacttagatcagctgcacgcacagttcacaacagggttcatgctctgatgagattctaatgccgctgctgatctgacaggaggcggagctcaggcagtaatgccagtgatagggagcggctataaatacagatgaagcttggctggctcacctgccgctcacctcctgcatggcctggtttctaacagtccacagactggtactgtggcccaggagttggggacgtctgttttaaaccattgtttgatctacaacataactgaaataataaatgatgaaatacttgataacttggttttgccccagaaataaaacaggactgataaacaatcaacagtgcatctctctagtggtattttattcctattaatttcacctccattagaaatcaatacaatattaatttattttgcacctttttttctgagtcaaaatcatcacaaatctgtctcctcaaccctcctactttaaaagtagggacctctaccctccttaagtcctcaacagtgcctaattcaattttccatacaacaaacatttgaatacttgtttttatttttttaatttttttgagaacagggtcttgttctgtcactcactgaaatgcagcggtgctatcacaattcactgcagccttgacccccctgggttcaagcgatcctcccatctcagcatcccagtagctaggactgcaggtgcacaccatcgtgcccagctaatttttgcatattttgtagaaacagggttttaccatgttgcccaggctggtctcaaactcctggactcaagcaattctcccacctcagcctcccaaagtgctgggatttcaggcgtgagccactgcacctggtcttgcttgttaaataaatcataacttaacactgttactgaaagagggagaaacacttcattaagaatactcagagactttcaaagcattactggatatattagtttcttgtagctgctgtaacaaattgccacaaacttggtggcttaaagtactataaatttgttttctcataattctaaaggccagaagtctgaaatcagttttactgagccaaaataaaagtatcagtagagccattctccttctggagactccaggggagactctgttccttgcttcttccagcttctggtggctgtcagcattccttggcttgtggccaaagaaaacagggtctctctgctccattttcacattgccttgtcctccatttctctgtctgtagcctcccactaacgatctctaataatgatacatacgataacatttagggtgtacccacataatccaaaattatcttttcatctcaaaatctttatcttaataagatctggaaagacatttttccaaataaactaacattcacaggttccagggatttgtcatggctatttgttggggagccatgtctcagtcaatcacgctgaagaaaccaaatgagaacagaaagagcaagcagacgaaaagtgaaccttaccagcaagtgcaaattcaaaatatgcaaaggaaacaaaaacttttttttttaaatttagtgctgtgtggcaagaactggaaaaaaaaattaaacaaatcaagtcaccttatgctccaagtgttggttctaataatgactgcattgtgactggttttgttttcaatgtcagaaattcagcttaatttgttaagtataaagcctatcaggctgcaataaactgaaaggtgggcagctgagcttcttgtgacaagctgatatcacaccgagcaatctaactgcctaatgccagagtacttaaggcagcagtccagatttgctaaggagactggttaagcaacagaaagcttcttaaaagttctccctcattattttactttctcactgcccctaaccaacttctttttccctttttaacttacaatactagcaaatagaatcctgttctcacgaattagtagcacttcacaaacaattataggataatagcgtaccgttccaatggatagaaatacaagacaagtctgaaagatcaagcaactttctaagtgctctcaagtaaagaaataggtaagcttttctgagaaaaagaaataaaaagaaaccaaaattaaatttaacttcaattttgtagtatctgatacactgcaacaagaataaactgacaagccagccagcaaacaaggcagtactgatgtttcaattaaatgcctaattataatctgagcttctaaatgaagaatttacagaaataaataattactaccaaaaagaatgcactgtgttgtatccagtattcaggaccttggtaaacagtttcacactcactatctataaaagcccactgtggaagagaaagtgtcaggagaatgtggggaacagatttagggtcacacagtttggggtttctggttaactacctagaagatagtgtgatatgcttaacacatatgtctcatatatggatactatttgtaagtcagcatggaaataagtataaatgaaaataaaacagctattaagaggccttgaaaataaggcagagaagtttgaatttgacaaaacagtaaacaactacagcttctcctggaaagaaaatataaagacactctactaggaaagtaaatttgttagtatgtactcagagataaaatcaggagaaaggaaaaagggcatttcactaattcaggaataaattggaccagaatctaattcttttatctcactctctgcccaagttttattaaggtataactgagaaaaagaaattgtatatatttatatatccaaggtgatttgatacgtgcataaattgtaaaataattaaatcaagctaattaacatatctatagcctcatatacttatcactttgtggtgatgctgtaggagttattaagaaattattttaggcagatagagaggaaaaggggtcctcgggaagttttcatttttaaagctgcttcagaaacgtttcttgtaaaagtcctggctctttgagcctgatggcaacctttgatatgcaaatttaggccatttgaaactgggtccacccaaacttggtgattatcgctgcctttttgcccttgccccacatgatcctggcaacacagctgcccccacatatccccatgtgtgtagaacatcatggtgccctgtatttgcatattaaaaggctagggtgggaggcccagcctttttgccctacgtgaatgacatgcctggtcaaaccaatcccctgagccctatgcaaatcagacaccacctcctccagcctctacatatacctgactggtatccactgcatttggggttccctctcttggctttggagccccgctccctctgtctctgtacaggggagctccttccttctttctttcccctttctatcttgcctattaaactctctgctccttaaaaccactccacgtgtgtcagtgtcattttatctaaactggcatgaggatcaagaaccctggtgttcctccactcatcggagtcatatcagtgagaacatttaagatctacactcttagccagaatctgattctttacagagggcttttgaaaatgatatttccttttatttctccccaatttgtaaccacccaatgggctcaccttgcccgctgcctagacagagccgatttatcaagacagggaaattgcaatagagaaaaaatcgttcatgcagaacctgctgtgcgtgagataagagttttattatcactcaaatcagtctccccaaaacctgggggtttgtttttcaggataatttggtggggaggaggccagttagtcaggagtgctgattgtttggattggggatgaaatcatagggagtcaaagttgtcctcttatgctgagttagttcggggcgggggcgtggggacagaactggttggcaagttcaggtggggccatctggttgtcagaaatgcaaaaacccgaaaagacatcttaaaggccaatcataggttcacagtagtgatgttattttcgagagtatttggagaagttgcaatcttatgacctctggaaaaatgtctggtaatatttagaattccagcccctctcatcctaacttggtggctggtggcctttcattcattttacaagaacagtctagcttttgggaagggctactatttaaactataaatgaaattccttgtcaaggctagtttggcctacgcctaggaatgaacaaggacagcttggaggttaaaagcaagatggagttggttaggtctgatatatttcagtgtcataatttccttagttataattttgcaaaggaggtttcaaattctactaggactcaggaatcatcataatgaacaactgttaatgataataatgtacttgaccagaaaaaaaaggtggattatcacagaactagattaactactataaaagtatttctcaactacggtaaaacaggaggtacgttgaaagtaacatagtataaacaaaaagcactaaagttgacaaaaggggcacttaaaaacaattagagtagtaatacaagtaacacgacatcagtgttacttgtattttggtacattttgtttagtatcccagaaagggcagtcattaatagctagcacataaaaaccacggaatcatctttgggagcctattgaaaaagtgaatgttatccattatccttgtctacatggaaatgaaggccagaaatggctaatctatgagacctcgtctagctccaccaggttaggaggatgagaagtgcctgaattctgttaagatgtaggcatagttatcagccattgttccagaggtcacaacatttgcaacttccctaattactcccgtaaataacatcactgttgtagaccctaaggttggccaccttttgagatgtcttttaagacttttgcattttgcatttcttttttttttttttttgagatggagtcgcctgggctggagtgccaatggcatgatctcagctcaccgcaagttccgcctcctgggttcaagctattctcctgcctcagcctcccgagcagctgggactacaggcacccgccaccacgcccagctaatttttgcatttttagtagagacggggttttgccatgttgtccaggctggtctcaaactcctgacctcagatgatccacccagctcagcctcccaaagtgctgagattacaggcatgagccactgctcctggcctagacttttgtatttctgatgaccagatcactccagccagactcaagattcatgactcaagggtcctgtagccctcacccagaagtggactcagcaaaagaggaccattttccaccatccaatgattttatccccaaactatcagcagcactctgaccaaaaaaatatgtttaaaaaaccctagtctccaaatttttagggaggctgatctgagtactaataaaactccacagtcttctatttagccagctgtatgtgtattaaactttttccctattgcaattccccagtattcataaattggctctaccttggcagcaggcaagaagaacctattgggcaattacattggaaataccgaataaatgaagaggattttgagtgctgttaaaaaatactcagattcggccaggtgtggtggctgacgcctctaatcccagcactttgggaggcaaaggtgagcaaatcacctgaagtagagagttcaagaccagcctggccaacatggtgaaaccttgtctttacaaaaataaaaaaaagtcgccaggcatgatggtgggtgcctgtaatcccagctactggggaggctgaggcgggaagatcaccgcggaggttgcagggagccaagattgcgccactgcactccagcgtgggtgacacagacagactccatctcaaaaaaaaaaaaaacactgattcagaattcagtaactttaatttacaacctactttgctctgtaaacagtactgcatagttttacatgcactgcctaataagatccttttttaaaattgtttcgagaaagtagtgttagaattatatgtggatcgtaaaaatgtaatttttaacacgagatatagaaatattaatttaaacattaaatttataacaaaggatatgatacgtttaattttgtttaacaccttttactagttaaaaacttcctagcatcttctatctcaatactttttgtttttttctttttaatctttctgggtacataggagtatatatttatggggtacatgagatgttttgatacaggcatgcaatgcataataatcacatcctgtaaaatggggtatccatcccctcaagcgtttatcctttgtgttacaaacaatctaattatacttttttcattgttgtaaaaatgtacaattgaattattattgaccatagtcacactcttgtgctatcaaatactattattttatttataccattaaccatccccacctctcctccatcctcccactacctttcccagcctctggtaaccatccttctctactatctctgagttcaactgttgcttccaaattttgcctattgtgaacagtgctgcaacaaacacggaagcgcaaatatctctttgatatgctgatttcctttcttttggatatatacccagcagtcagattgctggatcatatggtagctgtatttttagttttttgaggaactaaaaaccattctacatagtggttgtactaatttagattcccaccaacagtgtctgattaaatctttttgttgttgttttgagacagagtctcattctgtcacccaggctggagctcagtggcatggtcttggctcactgcaacctccgtctctcaggttcaagcaattctcatgccccagcctcccaagtggctgggactacaggcacacactaccacacccggttaattttttttttttttttttttttttttttttggtatttttagtagagatagggtttcgccatgttagccaggctggtctcaaactcctgcctgtgataatccatccacctactcctcccaaagtgctggtattacaggcatgagccacgatgcctggcgctaataagatcttaatatacccatttcacttaataagaaactgagactcaagaaaggaaagtaatttgccaaggttacacagtaaataagtaatagaataaaaaacatttattaaaattcaaaatctaagagacgggcaaatcacctgaggtcaggagttcaagaccatcctggccaacatggtgaaaccccgtttctacaaaaatacaaaaattagccgggcatgatggcaggtgtctattaatcccagctacttgggaagctgaggccagagaatcacttgaacctgggaggcagaggttgcagtgagcagagatcatgccattgcactccagcctgggcaacagagtgagacttcgtctccaaaaaaaaaaaaaaagaaaattcaaaatctaggtcaggcacagtggctcacgcctataatcccagcacattgggaggctgaggccagtggatcacctgaggtcaagagttcgagacctgcctggccaacatggtgaaaccccatctccactaaaattcaaaaatgtgccagacatggtggcgtgtgcctgtaatcccagctactcggaaggctgaggcaggagaatcacttgaacctgggaggcagagattgcagtgagccgagatcatgccactgcactctagcctgggtgacagagtgagactctgtctcaaaaaaatatatatatatattcaaaatctatcatcacagtattttcctggcctcagccttttcttaaaaacccacctaaggcatctttttccttcttcctgttatgacccatgacagagacaagagccacctgtacatagttgacctcaaacagctgaggaattcagtactagaaaaccaaataaattgcatcaagattctgattcttttattcaggcctaaatcaaagttcaagcctcaaattttgctaaaactgtatatatatttctgaattttcatattataaaataacagcttgaataaaaataggtgcctgactaaaaaatgtacaatagatggaatgtttgtgcaattactcaaataatcattccctcctaaattatactatgtcctattatgtatgtcaaggtatgtaaattactaaataataattttatcgcagcactaagttaaacactgcaaataccataaacatacagcaagatttaaatctggatcctgagaagctgggatgcctaatatgaactctgactactctgactaaaatccattaaattatatactattcatcaaaaactatatagtatgagaatatagctaaaacttctaaaagttatcagagagtttggtattaaacaaaggcaatctcaaaatttacacttttaacctagcctctctataattccttaacttcagtagattgattagaataggaaaaaaaagtactaagtaaaagcaagcaatgatagctgagaaacagagacactgatctgtattctttttttttatacttcaagttctagggtacatgtgcacaacatcattaaaaccaaagaaaaatgttatgctcagaatattcccatttgtgtatttctcccttttcctaactctcttcttaatcccaaatttaaaagactagttgtaaaacagtagggtgccaaattaaaacacattttattttcagatgtctccacactcacaggctgacttcctgtcaggaagagttccatttcattgaataccccaatcagcagggaacttgcagaattaagtgccagttgatattactttgttttgcatttaccacccttgagaataatgttcaaagatctagttatatagtcagcatggtatcatccttctgactagactgccaagccacagggtgtactgccagttccacaaaatttacctcaaaggttgtgttttctaaatcctagtgtgctggtgaatccataggacgcctgtatttcaggtcaaatcctgaatctaaagttaaattatgtttttctttggttgtaacagcacttttaaatcaatattatggaaactcaaataaagatcaattaatgctcaccaacccatcaacctattttatttttgaaaagaaaaaaaaagtactttactccgatttattttgtattaatgtttttgctattgtttcaagacaaatgtttccaccttataatagaaagttatctgttataaaattttgaatcaataaagcatgtttgcatatcagcaataaagtacagttattgagctgattttaaatattttaaaatagttcatgcatctaagtttttcatgaccaatttatatagcttgaatcttcacctaacctctccaactaccatagacttcctatccagtcctcacaagtctatacttccttcttttaaggtcaactgtttttactgcgcacaaaatgaattctgagcatttcagcaaagaatacctactttctcgggctttgtatattataagaacaaagcattcacagcagctctaaagcaaaacaatatgagtgtattagaagcctaccctattgattctcattccatctgcaatcaaaaggtcataggtagtaacaataacaaagctcagggacaatcaatttatatccactaattttttataagtacgttctaaggataagttacaaacacatcaagaaggaattaaaaattcctttttgaaattgaaattaaaatgtactgaaaccaacattttccaaacttatttaacactgtatattcttttcatggaacaatttcttttgagactgggtctgctcatgttgttgcccaggctggtctcaaactcctggcctcaggcaattctatgcttcagccccagtagcggggattacagttgcaaaccaccacactgggcagaacacctactattattatcacaaggtactcactgtggaatttgctgtattgaaaaagtcagatagtgagagttgatcaaacaagcacatggctaccacaatttcaaccaaggaaaattgttaatgtccgtttaaaattattatcttatattacaattatttgtctcgctcactaattgtctcttctactgcttaaggaataatagatgatagtttccttaaaggaaggggcttgtcttaaaagcatacgacacatgtttgctaaataaatgaataaataataccagaagcagacataaagaaaaggacttgggcaaggcagatatattcacacaaagctctgtagaagagacagcatttgaactgagcctgattgaccataaaactgaaaattctaaatgtacagaataatggcctcctcaaactgctatacaaaacttcgtatcataggatttccttataggtgaaagaaatgcataatgaagttaagaaggcttggccgggcgcggtggctcatgcctgtaatcccagcactttgggaggccgaggcaggtggatcacgagctcaggagatcgagaccatcctggctaacacagtgaaaccccgtctctactaaaaatacaaaaaaattagccaggtgtggtggtgggcgcctgtagtcccagctgctcgggaggctgaggcaggagaatggcatgaacccgggagatggaggttgcagtgagcagaaatcgcgccactgcactccagcctgggcgacagagcaaggctccatctcaaaaaaaaaaaaaaaaaaaaaaagaaggcttatttctattttgattaagcaaagcaactcatagtcaaaatttctattttttggttggcaaaaaataatcctttatttcattacctcaattatttctttgaaataaatacataattttcctaataccggatagtaagttttagttaaaaaaaaaaaaaaggttgaagcgtaccctaaacacagcacactatgaatagctaaccactccacttaaaagaaataaatttctatttatattaagttcagcagtaagtaaaactaatccacagtaatagaaatcaaatcactggcaacttgaggtgacagaggaggggattgattgaaaagaggcacagggaaatttgaggattaaaatggttgggtatatgtcaaaattcactgaacagtacacttaaaatgtgtgggtatttactgtatataaattatacctcaataaagttgacgttttttatttatttatttatttttgagacagggtcttcctctgtcacccagactggagtgcaccagtgcgaccctagctcactgtaacctcgaatctttgggctcaagcgatcctgctgcagcatccagagtagctaggtctacaggcacatgctaccaagttcagttaaatgtttttctttttggtagagatagggtcttgctatgttgcccaggctggtatcgaactcctggcctcaagcaatcctcccacctgggctaaattgttttttttaaaaaaagaggtctaggctaggggccgggcacagtggctcaggcctgtaatcccagcactttgggaggcctaggcgggcgaatcacctgaggtcaggagttcaagaccagcctggccaacatggtgaaaccccgtctctaataaaaatacaaaattagccaggcatggtggcaggcatctgtaatcccagctactcaggtggctgaggcaggagaatagcttgaacccaggaggcggaggttgcagtgagccaagaccacgccattgcactccagcctgggcgacaagagcgaaactccatctcaaacaaaaaaaaaaaagaaagaggtccaggctgacaaacataaggagaccctatctcaacaaaaaaatcaaaaaattagccatgtatgctggcatgtgcctgtagtcccagctacttgggaggctgaagcaggaggatcacttgagcctgggaggtcaaatgcagtggaccatgattgcaccactgaactccagcctgggcaacagagcaagaccccgtcttaaaaaaatgaggtgaatctgattaagtcacaagaaaatgaaaaaccaaaggccctgctcataaatgaacataactacactatttggtaatgataaaattagttgtcttaatgaaaatgaagatttaatataaaaactaattaatacaggaaagtatggaggtatttcctaatgaaaaagaccaaaagacaaagtccaaaatatggtgacttatgatccatgttaccattgatttatcaattatacaagtacataaacatttatatggttgaacagtactatactggacgctggggatacaatagaaaaaaaacacagtgcttgtcttcaagaaatttgcagtctacatggaagagaaaggaaaacaacaggcaacttaaatatagaatgaaattaactatgggtgagtgttctgcacaatacctcatttaggcgtagagttgtagggaagagagggtaaaggaaatctttccaaaagagattgtaatttatctaggagctagctaactgattcattttttccataaatattcactaagccataatgtgctaggtaccagaaatactttaatggacaaagcagaaatagctgttaccttcatagcatctagaaaacaaagaggaatactaacagtaaacaagtaaaccaattagcatatttatacttacaatttgtggtaaattctataattggtgctaagattaagacaaaaagataccaattatagatatgatcctcgaagaatgagataattaagctgagctctgaatgataagcagcagctaacaaaagtcaccaagttagaaagaggggcagcttagggaaagaaaaagcatgtaccaagacacagaaatataatggcatatttgggtatctttaaatagttcagcatggcttgagaataagtggtaagaaatgaggttcaggcattaagagagacctaaatggtaaaggacaccttgtgccatgtatggagctggtttgccttttttgggggtggtggaagagaggtattttaataatcttctcatactgaaaatattcatctataaaatcataactatagaaaagaatattaatatcatatattcagaaaaaataaactcaaaatggagaagaaacttgggattagagaaaagaaagtacagaagaacaaaaaataaagaaacgttttactgaagattcaggaaaaaaattcaaacataaaactgacataaaataatcataagaactatctcattcttattataaattattataattttaaaattaataattcagaggtacagaaagaaatacaagtcaaaaatgaccaaaccttatatcattaccttcatgtaaagaaaatatttcccaaaacagcaacaatctacatattttgttgaaaaattttttaaagaataatcagcctaaaatagtattttaaattaacttttgctgctaattaattactcagacaggatgccagtccagactacatggtgcttctagtttttctatatactgtatgcatttctgataaatgggaaaagaatagatgacctggcagaaggctcagacaataatatgtgatttacaggacaagaatgcagctaccacaagatttatctgacagccctctccgatagtggactgttgagtatccgaaggaatgatttctagtctacaaagtctactactgagtagccatacacattatttatttattagatgttttgggttgaaaccatttttaaatgatgcacttcacaatgcacagtcataaatttagctttaaacccaagaagggaggtagtgttattggaatgtatgtcagactgaattaggactagcaacacaacgcttttataaagtggccttgaatgcaacgtcaagtctttcaaaaatgatattaatgtcaaatgaacaagatacaaacactttatataatgctggagtaatattacttgaaacatttgcttaacattttctttaaattcatatatatttaaaacaggtttatacacatatacaacaaatttggcacacaagtaagttgcatgtttgtgaaaaaccacctgaaacacagttgagaacttgttcaatttttgtgtatttgcaacagagaacatacagtttcctgaagaatgtaagcagtcttattttaagaaataaagaggatttaaattgatctttggaacttcagtcattcttgaattattctacatgggattcaacagatgaataaatctatttttacaaacctcatattttaattatactcaaaaatataatgctgagtattatgagaggtttccaactctaattaataacattttgcctaaacaatattaacatttaaatagactaaaatatgaaatggtgcctaatcaactattatatatagcctaatcaactattggtaaatgagtggacattgaaaatgacaatcttagtcaaaacaaatatatagtgatctgtttggttttattgtcagctaaccaaatgtgatcatttcctcatttcttaaatttaggctctaaattctcttttacaaataaaatgcagttaaacaccttattaaaaataacacaaaaagaatataagttttgaatggattcaagaaaaataatcagagcatggctgattgtcatgaaattaacaccaactaatttgtaaagttctaaatcaaatttgcagatgttaagttcataagcatatcccattatttacgtgattaaaaagtagtttttgacctgatctttcgatctttggcactccgtcctctccatctcctcttaaaaaattaattaaaattttagcaagatggtagcttttgcttcccaccctatctcagaccaaaaaaaattatcaatcaaactcaagccatccccacccaggatctgtaaaatgtcgacttgaaattcaatttcatatctcttaagctttcatgtagaaaaagacagttcacttcttaacaaaataaatcacttttgtgattgccaagttgacctctttgaattaggaaaattcaaagtgaaaaatgtaattatcaccccagaacaatctgtatacatctggagctaattctagcttcatttttcacatcatttttcacactgtgctacatcttgtagagatgccatggaacttttgaagaactcacaaaaaatgttaaggacttcaaatacccaataatgtattttattcaaacaaaaaccttgacaatttctgacttgaaacttactgtactatatgatcttcatatcccatttgattgcattagtattaaacagtactgtgacatacatgataaataggcatattaaaacatgtcattctttatctttgcagctcctaacattaaaatatgcaatatactatattggaaatagcttccatgtaccaaaaatacattcgattcttctaaactagaaagtaaaacttcattgtgaaaattcacctatgaaataattatatcactatgaacaataaatttatattcttgtaaggaaacatccaaaaccataagaatgctcttttaaagtgagggcaatttcatgtagacataagaatgctatatggcaatttctatccaagaaagaaacaattatttctaatcaaatggcttaatgagaaattttatctagtcagcttttgaagaaatggagttttctaaatgagatgattaaattatagaacatgattctcagtaaatctaagaatcacaagcctactaagtaactacttctcacaagttcattacaaaaatccattaggtgtaatctctagaagtaattgttcttatcgcaccttattgacaatgcatagtattgatttttcacaccttctatgattctttaatttatattcatgaaatgtccatcagcacagtctaaataaatttggcatataggcactaaaacaaataaatcgatgcaaagaaacattaattttgcattatccttattcgttaggcaagtaaaccatgagagttgtaaatgaaggtcaaaggttttgaaatgggtcaaaacccttgacctctagaccaatacctttcctattaaaaaaggctattttaaagttttaagtgggggaatttactaccaccaagatatcactttaaaagactacaaagaaaactctcaataaaaacattcatctgtttaattgcaaaacagaaaagaaaacctcacaggatacatgatttttatataagttttttttaaaaaaatcattaaagtttaccacatgaggtacaaggttttggaacacctaaaataattttgctcttaggaatttattttctacatcttattatgatagctgccacatttttgttaatgttttcccaaatctactgtgcatgtcaaaaataattaccaatgacaaggattcaaaatcatttatcgctcattttataacctctgcacaaaatggaagtaaacccataattcccagtggagtcagcgtggcactccacaagatatagaaataaatctgtttttataaccttaatatatacagcaaagaaattatcaagatcatttgatctggacatttttaaagtgactctaaaaacttttgtttctcacttcctctcatgcttgcttcaaaattatctgcaagtatcaaaaataagaagtaatccttttgcaatacaaacaaaattattttaaaacagcaaactcacaattttattataccaaaaatttcagtaatgcaaatataaaatcccccatgaaaacaaattcatgtgataatctacttttaattcaacatttattcttgccactcacctgagaacacagtagcataaccaattccacaactgaactactcgacttcatgcaaaccagacctattttaaagagaattttaaaaaagaagttataaagaaaacaaatgaggatttgttacaatttcatccaaactgtttcttcaaattattttttcagactattaatagtgcacatttaatcacatgatcaaataaggtacactatagttagttcaaagctggcttcaaaactaccaccatttttgtaaagtatttcatttcagctttcaaaatactaaaacatttattacaacttcatatataatgacaattcacaatactcatagaaatgtgcacaacatatgccatattgatcaatatcatctacattttgttttggagagagttgatcgttatacatgcagagaagggaaatggctccctgacctttgctttctccactacactctctcccttcaaccctctagctatcaatcaagtttccattttgtttcatggcagcagacatcccaaacactcttattagtaccttgacctctgacctcacactaaaccttaacagaaatgcaagccgttgtctgttatatattcttgatttcttataaattaattcatttacttttatgtttcattttggttcaccaaaaatatctttagaatggatattttatataattaatacctatttaaagaagtctttggttttaattaccaataaaatataaagtagttcattagtatcttaacaaagcaatgccaataattaaagggactaaattattaaattgcattactagtaatcaaaaaaattacaatttttttattcgacatttttctaagcaaacacaggcttaggttccagggtataacatctaaaataattcctgatggctcttaaacatcctattgccttcttttttctcccgaagaaaactcttccaggtaccctatccattccctttgtctttttattctttagttctttctccttccccgtttaaatacgaatgcttccaacctaatgatagcgcatgttggcattttttagctttataaatagcattcaagttaaaagggctgttcacccccttcgttttttaaaaaatgttagaaccatttttctcaatgtctgaaaaaatatgtaacatagaaatgatggtaacagtgtcagcactggcaagaaaattagctatagaatgtctctatattgtattaggaagcaaattattaactacagtgtgatttctgtagggcgaagatgaacatggctcttcaggctaatgctgtcaaggccaaaagaaaaggcaagcaatactccctctcttactgcaggtgtagccctctgctggtctgaaaccttgccatttttccttaaatttaacccagataataaaagaagttcagttttgctccaacttcaaaacccattatttccagaaagtaaattcagatctttctattattaggtcattaatccttattgctttattcgagagaaactagaattcctgccattgggccctgatgggcccttttattatacatctcttcagataatgaaaaatagtaattttaaaaaagaccttaagctatccaaaattagggagatttataggtgctcctttgtccctcttaccacacttatcatatttcatacatatacatatatatatattttttgagacgttgtctcgctctgtcacccaggctggagtgcaatggcacgatctcagctcaccacaacctccacctcccaggttcaatcaattctcctgcctcagccacccgagtagctggaattacaggcgcccaccaccacacttggctaatttctgtagttttagtagagacggagtttcaccatgttggccacgctggtctcgaactcctgacctcaggtgattcgccaaccttggcctcccaaagtgctgggattacaggcgtgagccaccatacctggcccatatacctatatagtcttaagaaaaatttcacacatacacatttctgtttatttatttcagtcttattttccaataataaaggctaacaaaccagaagaaggttcatagctactttctagttggatatgaatattcaggaaaaaatatattcactgacaaagctagtaaaaggtcaaataacatttcatagttcggtttgaacaattaaggtggaggagagtgatggtagatgtattgcaggggcagggtggaaagtatgttcaattcgaatgagtaagggcttcagaaaacaagagagacctgataacagaccttaagttccctgtctaaaggacactggtactgtaaacacaaaaataacattgggagcaaagaaatagaggatagccccaataaggaacttaacatcaaaatgtagaacttacgtcacttctatttttgacctaaatttttgccaatggatgacactcatcacatgtgcaaaaaaacaaataataaacctgtaaatctctcttcagatttagtcatactctaagaacatccaaaggaaggccctaaaaccttaaagtcaagttgtaagttactgccagaactatcattttcattttatacacccacaaacacacacaccctattactgtctcaatcaaaagaaacgaagtactgcaagcttacagatttgaaccagctcacaatctgacctctctaaaactctcagtagaatagtagaataatagggtttggtttgattattttttggttggcttttcaaaggtagaaaatgttagtcttttcaaaaggacaaactcaggataccaagccaagagttttatatctgcactaatctggaattttatgatcaaagaccactgtaatttcttcagtggagactcacccagatatatcacttcagtgaaaggattaaatgactcaccagacagtaagccagtgccacctaaacccatcgatctatctaaatcctcaagtatacaatgaaaaaatagtcatgactatttactatctggaatataagagccctcttgttttttgtatttaagtcaccttaaataatttattttttaaaataggatggcaataaacattatgagaaactttaataagaatttaaggataataaactcaagaagttttactccatattttcctggttttgaaggtatatacatatactccaaatgagcattatcttttagataaaactaaatgctcatgatgaatctgaaacacaaccatcttgaaaacactaagtcgaaatttcaaatacatgtttaataggctctagcttatcataaattctggttttccttcctgaatttatatcatccaatccaacattttggaaaaattggatgactaaaaattttgttaaagaggacagacatcttctttgcttgagacttgcaaaatattttcttgtacagatttgcaaacatttagaataatcaatccactgaattttttatttccatataaacttttccttctagtcatcattgtatgcacacctgcctttagcatttatctacttagaaactgtatcaagtaaactgtggtacataatcatcccacaagacggaagaacaccgccacacgtctttttagaaaaatgggatggcccaggttcttgtctcaagttatcacacaaactaagcacaatgaagtccttcctgctaaataacatgctcatagagtgtacagagatactgtgaccctttggagggtcacaaaccattgtaatatctaagatattttttgcctaccccaaaaaaagtttttgccccattgagactgcaagtttatactttcttaaaacacagtgcaggcagagtgcagtggctcatgcctgtaatcccaacatcttgggaggccaaggcgggtggatcacttgaggccagaagttcaagaacagcctgggcaacgcagcaaaacccatctctataaataaataaataaataaataaataaataaataaataaataaatcaataaaattttttaaaacattagacgagcatggtgacatgcgcctgtagtcccaactacttgagaggctaaggtgggaggatcaactgagcccaggaagacaaggctgcagtgagccatgatcacaccattgcactccagtctgggtgtaggagtgagactcagtctcaaaaaaaaaaaaaaaaaaccacagtgcaaaattttgggtaaagcaatacaacgacagaggctaataaacaagagtaattatttcttttcctattgcaccatcactccaagtgcaattctagcattcgtgggttttttttttttaattttagtccacagcatagtaaagaatagctgatgtgtaatagtgaaatagcaaaatgtttcaagatacagaaaaaataagatcactaagactataattaatcatatttataaaaaggatccagtgaactcacatataataattgtaagacataatttaaaattttcaagcttgtgttctctttgttctttggaaaatctctttagaaaaattaatccttacaaagggttataactacttgaaaaagagggttaattaacatcattacaattgagacaatcaggctacaggtgattccaggcatgatgtaatatgaaatattacatctaatttaacttttagctttaacttcaagtcttcaaaatatacagggcatatggccagacgcagtggctcaggcctgtaatcccagcactttgggaggcaaggccggaggactgctcggggtcaggagtttgagatcagcctgggcaatgtggcgaaaccccatctctacaaaatatacaaaatttagccagcttggtggcacatgcctgtagtcacagctactagggagactgaggcacaagaattgcttgaactcgggaggcagaggttgcagtgagccaagatcgcaccactgcactccagcctgggtggcacggtgagactctgtctccaaaaaaaaaaaaaaaaaaaactaaaaacaaaaacaaaaacaaacaaaaaaaaaatatatatacacacacacacacacacacacacacatatatacacacacaaatatatatatgtctatataaacatatatatttcttaaagataaatatgggctgggtattagacgacattaagaaactattactattattaggtgtaatagcagcattgtgattatgtaagaaaatgtctttttttacatgctattaagtattcaagggttgaatgacatgacatctaagatagttttaaatatctaagatagttttaaatattaaagcaaaataaagggaagtagagatatcaaataattatggaaaaatgaatatggtttggatagctggtaataagttcatagatactatacttactacttttgtgaaaatttgaaattttcattaaaatatttttaatactaaaaaactcataagcatttttttaaaaattaagaagctttgtaatgtttggtcacacagctagtcactggcaaggacagaatgaaaaccaaagtctcctgccttttatattaatgctttttgtacagtattatgctgcttatacagtactatggcacaatcacctctttttaaatcctttctgttttacagtacatgaaaccacaatccaaaacattcctcacaacataaaatacataagttacataagaactcttagatttgtttgctatttttatgaacatcatcaatgaataggcactgctcaaatttatacatgagcaatagtacaccttcttccttcttacaattttaccaaaatttattggtaaaaaatcattctaaattaaattttgttcagggatatagaagtgtccattgctaatgcttctgggtatttaacatgatcctatcttgttatctgctataaaattcaaagaccaataagcaacaatgtcttgcaatactgagaggctgtatttaatacatacatcttactcactgtaataaaattaaacatagttcataagttgttacaccatttaaaaaaaaagtttcatatatgaaacataaattagggaaaagccctgaaatatagactcttcaatttttaaaattcaatttttttccaattatattacttcataagtaaaagtcattcattacttcatcaaatagttcatagctaaataaattatatccttcaatagatctaaggaaattgctattccaaacttaagtacttctaaaatctgaactttctttttcaaataaactcattgttactttttgactgcatgaaaataatatcgctcatcaccaactccatttacatctatagaagagatgaaattcctaactaaagcttcatatgtacctactgatattgtaagggtcaaacgaagtgctcatattgcacagttaatactcaaatatagatatcttaaactattagcctacctataaccttgcatttccattatatccttattgctacaagagagatgctttttcacaggtttttaaaaaattcctcagaccatctcctagctactgttagtcaacaaaagattacaataactaaagctgccagttgatacttaaagacactggaatacagatgggagtgtcattcccatgatttttcagtttgaggagaatacaagtatattatcctaaaccatcaatcacgggcccaaaaaaagccagatttagcaaccacctaatccaagcacttttgaatgcaaaaattaattctatatcatcatttataaaaagccctgtagcttcaccttaaaaaatcctagttatgaggtcaggtgcagtggctcacacctgtaatcccagcaactcagaaggccaaggtagggttcaatcttgccagtacactgcactccagcctacacaacaaagcaagactctgtctcttcaaaaacaaaataaaataaaaaataaatcctaggtacgaagatgaagattggtattttgaagtcagtctgataaactcttcaactcattatttaagaaattatcctctattgaactgcaatctgttttctgaggaaatttacggtaaatctactttcacttggttaagtcactctctctaatattcgaaggcactcactacatggcaatgctccatgcgcaaaaagaaaaaaaaaaggaaggaaggaaggcagaaggaaggaaggaaggaaggaaaggaaaggaaaggaaaaggagaaggaaaggagaaggaaacgagaaggaaaggaaaggaaaggagaaggaaaggaaaggaaaggaaaggaaaggaaaggaaaggaaaggaaaggaaaggagaaggagaaggaaagaaaaggaaaggaaaggaagggaagggaaaaggaaaggaaaggaagggaaaaggaaaggaagggaaaggaaaggaaaggaaaggaaggaaagggaaaggaaaggaaaggaaaggaaaggaaaggaaaggaaaggaaaggagaaggaggagaaagagaaggaaaggaaaaggaaaggaaaggaagggagaaggaaaggaaaggaaaggaaaggaaaggaaaggaaaggaaaggaaaggaaaggaaaggaaaagaaaggaaaggaaaggaaaggagaaggagaaggaaaggaaaggaaaggaagggagaaggaaaggaaaagaaacgaaaggaaaggaaaggagaaggagaaggaaaggacccattattcctcatccactccataaatagcatggtttccaatcccctcagcaacctacctcagcatgctatctagtttgacaatctcaaagtacactacctagaagagacccaggaatctatgaatgacgtaagcagtatagagtaaaatgctgttatctctatttgtaaaacagaattctacaaataacaatgcattccttatctgtgtggcaatacattgttgttcatatggatctaagttcaagtaaaatcctgtgacactagtctctccaattctttgctctcaaaattaattttaatgtatcaaaaaaaaaaaaaagtcttagttctttggttcaacacataattctacgctccatccaaatcactgataaaaatcttgaagattacaacataatagacatgtgacacagtcttcaaaagatagcctatgagaaaccttgtcaaaggctgacaacacttaaacaatgaaactccatgttatttcattatccatgtaagtttttaatcctgaaatataaatacatacaaataaaataaagaaaaaccacttacttgttccttctataagcagttcttgtccatggctacccaaaagtgtccgagaaagaaaaggtgcaaaatccacaaaaatctcacgaaggagaggagctgccttttccaaagcgtgttcaagcctctctgtaatactaaggaaaagacattaagttacttgaactattcaacagattgtatcaattttctagttttgaaaataaagatgtatttccatatatatatataattatttaaaaaaattaaaaatcacctaaagagacattactgctatgcatagcagtccttctgccaaaaatattcgtttttatcctgatctatcttgcccctacaatctccaacaaacaacctggttaacaaccactccaagcatcagtacttactacaagtctcacctggccagttaagagcagtttgtttttaggcccattataatctaaacaaactctcatcaagtcttcaacaaatttttctatttaccactaaaccattagcacactgagttcaagaaccatgacttcattttaaaattcacagttatagcatatagtatagactcaacagacgttgagtgcttataaattataaaaagcagttcttttttattgaagtcaattattcctttctaatgcaatgtgaatgatttttctcctgaaaataatatactttataggcacattataacaaaactatcatttggttgatagttatatttattaataaactgagatagttgtaaatgtacctataaatatataaaaatatattaatatatatttgtgattatatatacatgtattcatgtatacatacacagatacatttaatgagggttttttttttaaggtccccagcatttcagataattcacagatatccacagctttagtttctaacttacaaattaaacatatacataaagagccactagttatctactattaacactaggagtacttcctattcatactaccaagaagacagttgctactgaaactatcaacacaaacatatataaatttttgctgtgaataaccatctcctcacaggcactgctctaaatactattttcttccacacaactcatagaacttgttatccctgaagagtatcacaaatactagctatactcgaagcactcaagtacctacatttgtagtgtctaatggatttcccaattgtggtaaagaaaatcaaggactctctggacactaagtctccagtggtggaaaatacactcaaagcattcgaaattaaactctgaaacccaattaaacaaggtaagtaacaataaaaatctatctacaattcagtattattgtggctttggctgactggctatcacttatatcagcattttgttgttgttgttgttgttgttgttgttgttgttgagatggagtctcactctgtctcccaggctggagtgcagtggtgcgatctcggctcactgcagcctctgcctcccgggttcaagtgattctcctgcctcagcatcccgagtagctgggactaaaggtgtgcaccaccacacctagctaattttttttaatatttttagtagagatgagttttcaccatgttggccaggctgatcttgaactcctgacttcaagtaatccgcctgcctcagcctctcaaagtgctgggattacaggcgtgagccaccgcacctggcctatatcagtattttatagaggagaaacaacaaattccacactttcaatttgcaatcatttgaaagaaagtcataagcttatgtaaatatttgttatgcatgcagcaattatttttttaccacaaatagtcacttctcatgaagtgacttgtacatcatgaaatgacttgtacatcatcaaatgacttgtacatcttataatctttcaaaagaaaatgaacttctaaaatgttcccaagcctctaaatgtcatatatgttgaaagaaagaaatgaaatgaaatgaaatgaaacgaagtaaaataaacctagatagcttaaaaagtcatcaaaaggtataaatcacaatattcaagttagtagcttaaatacctcatatttgaaaccggatcttgtgaaactgaatcaactgttggaactgagggcaattttgcattagatgatctactgcctataaaagaaaaataaccatctataggaattttctgcttttagatatgaagatttaaataaaaagaatgtcattataccagtcaataaaagcattataacgtatttttatgtccattactatttggataacattaaaatctaacaattaacaactaaatgctttcatatataaacctcagctacaagctcaattatcatgccagagcaatctttctatccatgagctgaagaagcaagagaaaagtaaattctgactccctaaataaggttcacaattccttctactcaacaccaagtgtcaacagaaagttacaagtaaaagcattttcttaacatagcaaaaacacagaaacagctacattccaaatttagctttaaacctccattaccatgaaaactatccgtattcagttatcaaatcactactaaaggactaaattgtagcaataaatgtaatcagggttagaagcctagatctctgagaatctgtaatcttgtatcacaactattatcagttattttccccttatgccccaaatacaaaaacactatgctttaaagagaataagggccctctttcccaaagattgttgaatctttcagtccaaaagtgattagaaacacatcaaggaaagcatctgcatcaggctggaggttgtgttggcccagagaaagttattggagccagtgtgaggaggaaatccaaggaaaagagaaaactgagaattgtagaattcatatctatatgaattcatggttccaataaaggatggaaataatatgtgaatgacagtatatatttttatagacttttatatacaaacatacacacacacaaacacacacactgcctctagctctgtccactaagaggacacggaagcagcagcatcttaacacttggtgtccagatcttggtttctaaatactatactccactaaaagaaagaaatggctgattcaagatctgtgtaagaaaagcacaaaatgagtttgaaacatctagttatgctttgtagaaagcaaggaatgataagatatatacaaggaataaggttatgtcaaaggacaatgaagccagcttgaaggggctcccactgatcaaataccattgtactccatcctgggtaagaaagtgaaactccgtctcaaaaaaaagaattgccatttttggccaggtgcagtggctcacgccagtaatcccaacactttgggaggccaagacaggaggactgcttgagctcaggagttcaagattagcctgtgaaacacagcaatgcccgtctctactaaaaatacaacaaagtggccaggaatggttgtgtgtgcctgtggtcccagctaggtcccagctcaaggatcacttgagcctagagggcagaggttgcagtgtgccaagactgcactactgcattctagcctgagtgacaaagcaagaccctgtcttaaaatacgatacgatacgatacgatacgatacgatacgatacgatacgatacgatacgatacgatacgatacgatacgatacgatacttccctctgcttcacaccactcccagaacttcctcaagctcacttcaattgtatctaggaattctgattcaatgtgctctttttggtaaggcaaataaggttaattctggatatagataagcatagccaggacctaatcagaagatttgtggatataactgaataaaaaacagcaaggatctgaggcaattttgaactttcctgaaacatgcttggtttttaggcagtacttgatcaataaccctcagttctgattaccaggtctcagtcaaatctaaggatccaaaaatctagacaatttggccccccaacaagcttggttccttttggaaagcaggcaatgcagcaatcttccacaattaacctctggataattactgagcccaccccttagagtgagcacatacctagtacaaaatgaacttaactgtagttaatctttcttttccacaacatatttcctttcccattcccttgataatcaaagttgactttcctttatataccggaagttttgtattgcttacagtcctgccttcctcaccatcctgctcaactgagatctaactgtacctaaaaactctaaccaagtgactgttggtcaggacgcataggattcgtttaaaaatgaagctaaagcacacacttcatcatgctgacaattattttttatttttctttttttgagagagggtcttgctctctcacccaggctggagtgcagtggtgtgatcagagctcactgcagccttgaactcctggactcaagccgtcttcctgcctcagcctcccaagtagctgggaatataggtggatgccaccacacctggctattttctattttttttgtagagacagggtctcattatgttgcccaggcgggtctcgaactcttggtctcaagcaatcctttggccttggcctcccaaagtgcgagggttataggtgtgagtcaccatgcccagcccattgtgacaatttttaaaagcataaatatcaattcacatttcatcataaaaatattgctatttttgtgtttttcacaataaaatttcaaattagagggcaagaccagggaagttcaaaaacattttttcaccctttggtatctggcacttctaagagtcaggtccaatcctaaaatcatatacaacactcagtaaagtacttcacagacccaatggctttattaaactcagtaaatgacacctgcaattttctaagttcttgacaactatatgatcactgaatcacagtgggtcattgactgttaccagtgattaattaaatagttctgttttcttaattggtgatagtttttgaagaccatttttattgcaatgtatcagacattttctctattaggattattgatggattttcttgagcttttctgaagctaatacaaaggaacacataaggacccatttacttaaaagtagaaatggaaaaaataaatccctccccagaaaacatatgcatgaggctttaggaaaaaaaaaaaaagggggtgtgcatgaggctttaggcaaaattagtctttactgtgttaactggtttattgggttttttgttttttgttttaagagacgaggtcttgctctattgcccaggctggagtgtactggtgtgatcatagctcaccacagccctgagttcctggactcaagtaatcctcctgtctcagccttctgagtaggtgagattacaggcatgtaccaccacgttcagctaattttttttaatttcttgtagagataaggtctcactttgttgtccaggctagtcttgaactcctggcttcaggtgattcttccaccccagcctctcaaagtgctgggactacaggtgtaaatcaccacaccctgcccactgtgctaaatgatactaattttaatgagaaatgcatattagaaatgtgaaaaagaaaagcaacattgttacttctaaataaagcagtaacaaaaattatttcctcacactaccctagaagtaatgccaattttcaattctaaaagagaatatagcagaaagagattttttacagtgtcttaagtcataagaagacactttaccaacacggataataaattaaccagcaatagttataagaaaaaaatcacatgaaagaataaactaaatacaccagtaatttcacactaggttgtcctccattcctgctgtggaaaaaaatgtaatatccaaacacattctgtattttttcaactcaggtaaaaatataaactttcaatcaatttgttttaaattatcattaaatatttccagcaaatgatcacaaatacataaatgcagaagctacctcctacatgtggaatgatactcacttatcttttccttatcctagcactgataaactggctccttctaactgacagttttccagacattcaaaagaacaaaaaggaaaatgcaaatatatcatctgtctagcatctatctggggagtaggcaattgtttatttaaggtccctgcgggtctaaataactaatgtcccttgcaataaagaatcattaaaacaaatgccaatttttaacccctaaacactttagcactgcatttctctctctcttttctgaaccagttaattcagcctgggatagtctacatgcccagtaaaaactaattaaacaaatcctattgaatgaataaaaataagcctattggcctaaatcttacacaaagcaaagatggttatgactcaaatatttccctaatattaaaaaagtactaattaataatgtatatggctctgataaacagatactgtctaatattctagtaagtggtagaattactaaattttgcaaaatagcaaacaccaggcatataaattagtgaacagtatacttagttccactattgagctagtttcaattttgatttattcatttatgctttgcaatatagagaaacagcatattggaaaaagaataatgatattttaacatacaagaagggatatgggtgaaagtggaaggatcacttgaagccaggacttcaaggcttgtctgggcaatagaacaagactctgtctctacaaaaattttaaaattagccaggaatggtgacacacacctgtagttctggctacttgggaagctgaagcaggaggatcactcaagcccaggagttcaaggctgcagttgagctatgattgtgccactgcactccagcctgggaaacaaagacagaccctgtctcaattaaaaaaaaaaaaaaagaaagaaagaaagaaagaaaagaaaaaagaaaggatactgtattctaggtaatcagatctttgctgatgactataaaatttctagattttgatatatttactaaaatcactttcgcttttctttgaaaacatgcatatacaaggatatgccttatcctctgatgaatatcttttaatacttattaattagaagatacaattgttgctcttagactagtccttttggttgataaaatgctgcataagctaaggtatactattcaaattaaaatttgaaatttgaaatttgtacaccaaaaaagttttgtatgttaattacagtcttaataatgtatactatttcaaaatgcaaacaaattctcaatttttatgggttataaaatttttcagtgataatattttcatagaaaaagcttggacctcatataaagctggcaagttttaactctgtttctgtgattattatctatctagtactagtttctctttaattgtaccacatgtaaaatgtgtctcattttgatatcaaaatttccaaatatccacaaatgggaatttccttgaagatatcatgtgaatatataacagaaaatatgaatgtcacagaagaaacttcatattttctatcaagtaaattttttgcccaactgtaggataatgtaagtgttctgagcacatttaagatagggtagattaagctatgttgtttggtaagttaggtgcattaaatgcattttcaattttcaatattttcaccttacaatggtttatcatgatgtaaccccatcataagtcaaggagcatctatattctaagtcacaaatgcatttaacagagcctattttataagaaggtattggatatatcacataatttactaaatattgtattgaaagtgaaaaatagaatggtcatacggatacttgaggtacagtttttactgaatgtgtattgctttcacaccattataaagtcaaaaaattgttaagatggaaccatctatatatttatctacttattttaatggcagataacttaaatcgagagacccaccaaaaagaaaacaaaaatttaacagttaaaaaaatactgacaagggaaagagaactatttgggaggttggggtagtttccatgtgaaaatgagtactaacaagtacaagggcaagtatagtaggcaaaagcatgtaaagtggggcggcagaagagtaagaagcaggacaaccaaaaacactagattaggttagatttttcttatcaaggcagtaatgttcatggcatcaattaacggaataaaatagaagcaatacactgaaatagagaacccatatgacagtaacaagaacacagtgaaagaggaaaaagaagagtcagatgtggaaaccaaaacaaatggtaaacagaaagaccatcatcacaaggaagacttgaaataactgaaaaagcaataactgtttttttaaaaatggggggggctaaggaggggaaaaaagtttaaaattctagctcaagatggaaaaaaaaattggtaactatttgagaaactccatcacaaattatacaaaatttaaacaatagaaaaataagatacattatgagctggatcaatggtatagggttttgtagattttgccaataaatgtaacagtcttcaagatagcaaattgttttataattctgcatacagtttttcaaagtgaatattttaaattacaatgaatttattggaaaaaatacaatggtttcagagagaaatgtataatactgttacatgtaaaatattacccatatgtctcagctgtttcttatctcttctgaaaactccaagacttaaattttaaagaatagacttaaaagcaatcaaagggtcctatttcctctgttcctaaactgaaactagagggcagtataagaaaatattttactcaatgtactttgaatttctgaaactacatttgattttggatgttaatgaaaaatttactatacctgaatttaaaagacggcaggtaaatcatttcatagatattaataactattgcatttttcacaaaagggactactctagaaaaaccacagttgattctttttttttaaaggactttggatgggggtggagaagcggaaatgtgcatacccagctccaaatgaattaccaaattatttcttctccaaaggaaaaaaaaaaaagaggcatcagagtataatggaacaataaagatgaaaaatttgctagagtttcatgcccattttcctttgtaattctcactgggccaggggaaaccagcgagggagagaatgacagggtatttgagaattctctgtacttcaaactcaattttcctgtaaacttaaaactgatctaaaaaataaagtctattaatttttggaaaaaattataaaataaaaagcaaggcagacaaaactctgctaccatcgcagcttttggtttcaaactagaaaaaaaattctaatcactatttttcctaagaataaaaataatacaagactattaattaaatgttagaaatgccacctaaagtaaatttcgaaaatcaaaattgccagtagcccaacttcatggagatccaaatgacttcataatacactttcttgcttttaccatgtaaagaaggtagataagtcacttggttgtaattatacagtacgtaaagaattgcatataactttcttttacttaacctactggaacattttctctattcactaaatactataaaatttgtaaaaaaattaaatacatttaaaacttcttataaaatgtatttttgttaacacaagcacaataacaaataaaagagaagacaaaagaaataaacatagtatttgtttctaggatacatgattacatagtacacatcaaggaaaaaaattcccagctactggccagtagcaatatcaagtttggaacaaaactctccaagatatgctaatttgccaaataaaggtggaacagcagaatagaaggcaaaccctggcctgagatatcccaaaagaagtaacggcattatttctgatctcaatataatccaccaggccattccttcaaaattcctttattttccgtcaatctcaacctagaatcataagatgagtgttttggtaggtacaatatcttgttattaactttaagaaacagcaaaatatccagaagaaaaccactgatacagtaacatcccttttgttatacttggtcattttaatactgcacattcttcacattattcaagtttacccagtatcaccattaagcttcccatcaatgtataggatcttgcatccatatatatgcttttatacatggaaataattttttatccatatatatgcttttaaacatggaaagaatgtagaaggagagatggacaaaaataaaagtgctataggaggaaatgaaccagtatgaccattgttagaatgatgctacacttcagagcagcattcctttccaagcctctaattcaaaaaaatatgccaaaaaaaacaaagtattggacactatataaatattttttttttgtacagtccaaaatatttgacaaccagtaaccacattaaaagattacatgtcaacaagactttcttatttaggccactatctatatacatcttcttaagtgcagggaaagaaaataaaggaaaaaaatatttttatgaatctatcattcatccatgcactcatctacccaactagcagcatctaatctaccacacactactaggtttgagtggagaaaatagtgaaatccttgacttaatttcttttaattttactcaaatttattcagaaaagtagtaaacaatcaacagtataaaagtacaatggtttctaatgtgcccccaaattttaagttaatcaaaaatcttaagcgttgctaaaatgagatctaaaaacatttttgttgaaatcactgataactaactcacctggtgattctcctcccatatctgaggcttgggctgaatctactgaggaaaccacactgacagcattggtaggtatgcttgtattaaaggtggaaggtgagactgctgacttttttgctgcaacaatgacacttctgtaataaagaaagtaaacagactgaaagatacaaattgatctcttgaattaattacatgaatttcaaaacagaaactaggtagctaacttatttttctaattttctttcttatttctatttgatgtacaatttagacttttcacccaacatgaaatatcttcaatactgtccatatttatctgcatttcactatgaaaatataataatctatttaacatttaagcttatatttaccacatagtatttttaaaatttaggatcatcttaattatctaacaaataaaatataaccaaaagtattaaagcagaaaattcaacgtttccacaagaattgtaaagcactgctaatctgaaataataaaaccttagaaatcttataagcttaaaaaaaaaaagcagatataagcaatttgctaacatgtatacaacccagtttttcatttttaaaccccaaagactatatcttttgataatatataaaaaagcaatgcataggaataaaaaccatacgcaaaaatatcaaatagtcaaagttctttatcttgtatattattcaaacacaggtatttatgatataccaatttcaattaaaatgtaatactttataccaaacagtaagtaaaagaccttgttaggcataacttaaaaggcatttttaattgaagttggctccataaacatgcaaaaactcagttaatgaggtaaagaggacagctgatatataatgcactcccacagcagtgcttacttttaattacctggtgttaaccataagcccaaagtcttcaacattcaatttatttaatcacatcttttgttgacagtactataactgcgagcttcaagtattcccttaatagctttaaagtattcagcttctaaacaaagtaacttaggtatttgatccctatacatgcattcaaaagtgaaaattatgtaattccaatattttaataatacatttttgtagttatttttaaaaacacacacacaaagcaaaataggtttcgttttacctcagtgcctatcatgtgagggcaaacactgttgccaattaaatcaaggtctcttgtgctaggcatggcttattcaatgtacttcagggtagctggtgtcacatcattataagggtgactgccaatgttaactatacactaaaaaatagaagcaacagccacctgagcccccaatccaaaatggtgtgcttaaatcacagcagcttatatcagatgaagattattgacttaagggggagtagatatgacgaatgtctgtgtgtgtgtgtgtgtgtgtgtgtgtgtgtgcgtgcacgaatgtgtgtgtgtacgtatgtattagtggtaccttcaaaaacaacgcaaaatgtaatttttgtatttcctactggagggagaaatttaaaacccattgcttaagaaaatcactgtcttctaccaatgtttttgcaggggagggaggagaaatatgaagaatttactttcacatttgttcacaaaagaaagaaccagcaagatctagtttactcatactgtaagtagggactgaattgagcaatagaaaagaatacttagaaaagtgcaattgctttttctataatcaaaatgtaagatatatacccatctatgctatgactcaacaattccacttctaggaatttcctcaagaaagcttatgtccacaaaacatgtatacagtaatggtcatacaggctttatttataatagtcaaaaactggaaatagcccaaatgtcctttatgcagatatagtaaatttttaatggtgctatgcttctagaatggaatattattcagcaataaaaggtaacaaactactgatgaatgaaatgaaaaggtaacaaacaacatggatgaatctcaaaagcattatgttgaatgaagtcttatactaaggagtatatactttatgggttttttttttttaacatgcatgtctagaacagacaaaactaatttatggtagaaaaaaatcagaataattgcctctgggggataggaacaggaattggctgggaaagagaactttcaagaccaatgatatcatgatggggacttaaggttacacaagtgtataaatttgtcaaaactcatcaaatggtacacttaagacctgtgtctttcattgtatgtaaattttagctcaaaaaaaaaaactgtattcatctccagttagagagctgcatgctggctgaaatatttaagagtgaagtgaactgatgtctacaactttgaagtacattacaaaaataagattgattgatggatacatggtgaagcaaacagagctaaaagctaattgttgaatctcagtgatgggtctacaggtgttcactgtgcaattctttcaacttttctgtatgcctgaacattttcataataaaacactggaaaactggtaacagaacagaatttactacagctgttccaaatatgcacaatccctatttattcaagatgacatagctaattaaacacaacaaaagaactcaacttcatttctaatcctctagcctcttgctgttaatgtttcagtcacaaataagatcttattcttttattcagttcagtaaatatttattgtccaagatctttcacctattgtcaggaatgatagatcagaagtacggctttctacatgaatttacattttacatgttcctcacacacttcttcaacatgctcttatggttgctaagcgtgttgtgtcatttcacaactccaacccttcgtatatatgcctcctctgccaagatgctttcttcttaatcctgcttgcttgttaggtaatataaaattataaattctaatagcagctaagataaatgcactgacaatatgccaacaattattattcaattctcaaaacaatcctaaggtacatattaattcaatttttagaaattttaaataaaaacctcagaaaggtaaagtaataaccaaagtaaatggtagaactaccatggaaatctaggtttatctaacagcagagccttgaatttgaaccgtttccccatgttgacctttcttaaaacttcagagatataattcacataccatttaattcactaaaaatatacagttaagagatttttggtatgctcacaaagttgtatatttatcaccacaatcatattaacatttaaacataattttagaatcatctataatcaacagcaataaagatctctaacatataaaattatttatatactaccataaaatcacaaaaatacatctgctcataaatttttaaaagctgaattatttcatatagctacataattagtatataatagagaaataaaatcaatttccaaattcgctgactgattcaaatcaattctaaggaattaacataacattgcttcagcttaaggctacacaaaatcaaagaaaaatcaaagttacaatgatccaattaaaaggacactaagcagtaggtagattttgaaatattttcattgtctttaccaatcattgtcattattactataaagtttcagtgtaaaagactaaaatcttcaacagagatctttaacctatcgtgtttatgttgttaaatataagtataaatctaaattagtaaagcatgttccacagttaacaaaaataatctagaattttaaacttaccaatagttaagattgatcatgcaaaaactaagcatttaatattacctttttatacaatgcattggaaaacacagaggaaaatgcaatatgcatttgacaaaactgagactttacatgacagacaatgtgctagggatatttctggcatctttctcaggctacagcttaagtttctatttaagaaacaaattgaaatcttttttaatgtttaagaacaattattggaactttttatatctacatcaattttagcagaaagtgcttcaaactttttagcataaggaatctgaaagatagacaaccaattatgcaagctggtttcccaaattgtcaattataaaccaaatattaaaagagataaaaattgttcttattatcatttttttctttatgaactcactatgaatacttaatatttgtggggcaccgtgcttaagaacatacacaaattatcatatttaatttatgacaacccttgagattagtagtacatattattatgctaattttacaaatgagaaagaagtaattttcctaaagtaccacacagaacaaatgaaaatactgttgctggattttttttttcccctgaacaagggatactcatttcaaagtttcttttaatttactggcaataggcaaatagcaacaatgccttcccgatcaataaagttgagaacttccatttcagtattatatcagtttcaaatatcacaaaccctcacacaaatgctattttacttaacatgcaaatagttcactaaaggaaaaaagagcatttcagcctaccacttcagtccctaaggatccagttgaaaagccaaaccagtccttgaactttatcaagataaatccctggcattcactaatcatcagagaggatcttcaaattagataagaacaagaattttggcatgggaatgaacacaaacacctttgcattcacaaaggcccacaacctggcagcctttcagcaaggttttattcatgtagctgttactctaaactttccagctattccttggaagttgataatacttaagatatgaggagagttgtgatttctgacatagcattcctgagataaatacatgatcagagggatgctttgaaattcccaaagatattccactagcccaaggcagcatgaaagtttttacaaaggggtctctaaataagaaaaaaaaagagggtaaaaaacagagcagtttccttgccatcagagactgttaaatgaatactagacatgttaaattctacagaacatcctggaaaatgctaccatcaaaattatctgttgttttctatttcaataaaccccttaaaatgtattacacctaagcatgatttcctaaatatgttcatgatctactcactgaagacatcagtaaggcacaaatttaatttctacactattttaaaaagaaataaatgctaaaatacataaaattttgatcattagtaaacaatgtaactatattaacatatattaaatttaaaagtatagcctcacatatttctgggtactcaatctaacactaacaaatctaaataaattataaaaattgagaatagacagggcacagtggctcacgcctggaatcccaatgctttgggaggacaatgcagcaggatcgcttgaggtcaggagttcagcaccagcctgggcaacagagcaacacctcatctctacaaaaaattttttaaatagctggacatgttggtcccagctactcaggggactgaggaagaacgatcccttgatcccatgagtttgaggctgcagtgagctatgactgccactgcactccagcctgggtggcagagcaagacaccgtctcaaaaataaaataaataaataaaaattgaagccaggcgcagtggctgatgcctgtaatctcaacactttggatcacttgaggccaggagtttgagaccagcctggccaacatggtgaaacctcatctctactaaaaatacaaagactagctgggcatggtggcacacatcagtaatcacagcttaaaccggtaagcacagtgttataaacacaaactagttctatttttagttgcctcgggaacctccaaactgtttcccatagtggttgtagtaattacactcccaccaacagtatatgaaggttcccttatctccacatccttgccaacatttgttactgcttatcttttggatataagcgattttaactggagtgagatgatatctcattgttttgatttgcatttttctgatcaatgatgttgagcatcttgtcataaaatcatttgacatttctatgtcttctttgagaaatgtctattgagatctttagcccattttaaggttatcatttcgtttaaaatgtagtaatatttttaaattattattaatacatttcttcctatagagttggttgagtcccttatatattctgattattagaacccttgtcagttaaccagaattataagtttattatataatccccagtctgtgggttgtctcttcaatttgttgattgttttctctgctatgcataagttctgtagcttgatgtgatctcatctgtccatgtttgctttgactgcctgtgcttttggggtattactcgagaaatctccccagattaatgtcctggagagtttttccaatgattttttttcagtagtttcatagtttcaggtcatagatttaagtctttaatccattttgaactgatttttgtatatagtaagagataaaggtattcattcttctgcatatggatatacactttactcagtaccactgagaagactgtcctttccccattgcatgttcttggcacctttgtcaaaaatgagttcacttgtagacgtgtggatttatttgagttctctattctattccattggtctatgtatctgtttttatgacagtatcatgctgttttggttaccatagctctgtagtataatttgaagttttgttctctttgctcaggatagctttggctattctgagtctctgtggttccatatagtttctaggaatattttttctatttctgtgaagaatgtcactggtattttgatatggattgcactgaatctgtagattgctttgggtagcatgaacattttaacactattaattcttccaatccatgaatatgaaatatctttcattttgggggtcctttttagtttttgcatcaatgttttatagttgtcactgagggatctttcacttctttggctgtttattcctaggtattttacttatagctattgtaaattggattactttcttgatctctttttcagattgttcactgttagcatatagaaatgatactaatttttgtatgctaatttttgtcatgcaactgtactgaatttatcagttataatagttttttatggactctttaggtttttctaaatactctaaatacaagatcatatcatctgcaaacaactgacatcttcctttccaatttaaatgccatttctttctcttgtctgattgctttacctaggacctccagtactgtgttgagtaacagtaatgaaagtgggcatcgttgtctcattccagattttagagaaaaggctttcagtttttctctgttccatatgatactagctgtggatctgttctttatggctttttattgtgttatgttccctctatatgcagttttttaagggtttttatcatgaaggaatagtgaattttatcaaatgcttttcagcagcaattgaaatgatcatatggcttttgtcttccatcctgttgatatgatgtatcacactgatagtttgtgtatgctcagacattcttgcatccccagaataaatcccactcattatgcatcaatttttaaaaagtttctttgagacaagttctccctctgtcacccaggctggagtgcagtggcatgaacacagctcactgtagtgtcaaactcctgggctccagtgatcctcccgcctcagcctcctgagtagctgagactacaggcacacatcaccatgcccagctaatctttttgttttaaaatctcaccgtgttgcccaggctagtctcaaattcctggactcaagcaatcctcccacctcagcccacaaaatgctggaattgcaggtgtgagtcactgcacccagacaaaaaaaaaaaattcataaaatgaaaaatctcagaagacacaaaaataagttaaaatatatcaaaacttacaaacacaaacacttagaaatagtacatggtaccatctacagttaaaagaaatgtaaacaatgtaaatttcaattattaaagcataactgtataaaattaacattaatgcatactgtactactgtaataatttcatagctacttcctgccacaattgcattgagcattggtattgttagcatcacttaaaatgctgtgtgacactagtcatctcagagcacgcagttcatctctttttatggggcagggggggaaggagttttgctcttgttgcccaggctggagtgcaatgctgcagttttggctcactgcaacctccacctcccaggttcaagcgattctcctgcctctgcctcccaaatagctgggattacaggcacccgccaccacgcgtagataatttttttgtatttttagtagaggtggggtttcaccatgttggccgggctggtcttgaactgctgatctcaaatgatccacccgcctcagcctcccaaagtactgggaagtttgtctctccagtaaactgtgtatcacggtaaaagtgctctctcccagttctcatatatttttcatcatgtttactgcaatattataaacctttgataacataatgggacccatacaaagtgccactagcaatactggacatgctcccaagcagcagggaaaagtcatgacattataagaaaaagttgaattgcttgatatgtactgtagattgaggtctgtagctatggttgcctgccatttccaaagaaattaatcccgcataagaactattgtaaagaaaaggaagttggcaaagttgtcactgcagtgacaccaggaggcaaaaaaacaaacaaacaaaaaaacaaaacaaaaaaaacttgcactttttgtgaaatatctttatcttgcactgaaaatgcagcttttatgtgggtacaggattgttataagaaaggcatacctatagactctaacatgatttgagaaaaactgaagtcattatatgtcaaatttaagtaaaaaagaatctaaggctagatttaatgccagcaaaggatgatcaagataacaggagaagcagcttctgccaaccaagaggcaacagatgagttcctagacatcaagaaaatcatttagaagaaaggaccagcccagtcaggtttttaatgcagacaaacgtaacctatttgggatgggggggaagccacaaaggatatttattagcaaggaagagaagtgagcactaggatttatggcaggaagagataggctaactctactgttttgtgcaaatgcagttgggtttatgatcatgactgcccttatctattaatataaagctgctaacccctgagccttgaaaggaaaacacaaacaccagctgcaagtctgttggttgtacaagaaggcctggacaaaaagaatcctttttctggattggttctattgatactttgtccctaaagtcaggaagtaccttatcagtaagagattaacttttaaagttcttttacaattggacaatgctcctgaccacccagagcttcatgagttcaacactgagggtgttgaagtggtctaactgccctcaaacgcaacttctctaattcagcctctagaacaggaggtcacaaggacctttatggttcattacacatggcattcttaggaaacaactgtcaacactatggaagagaacccaacagaacatcgtgaaagtctagaaggattataccactgaggatcactgttacagaaaaagctgtggaaaccatcaagtttgaaacaataaattcctcctagagaagactgtgtttctaggtgttgtgcatgactccacaggatttctgacagaactaatcaaggaaatcatgagagactatagatatgacaaaaaggtgaggggtgaagggtttcaagatatgaatctcagagaaattcaagaactaacagataccacaagaacagaaggatcaacagagggaaaacaatttgacggagacaagaacatccaaaccactattagatgaggaagacatagaagaagcagtaccagaaaatgaactgacattagacaatctggcagaagggttctaatgattcaagactgcttttaacttcttttatgacattcacccttctatgatacaggcactgaaactaaagcaaatggtgaaagaagggtttgtaccacatagaaacatttttagacaaataaaaaagcaaaaaggtcagaaagaaattccagtgcatttctgtaaatttacaccaagtgtgtctgcctctcctgcttcccctttcactttctccaactctgctacctcaactgcccctgagatactaaaatcaacctcttctcttcctcctcctcagcatactcaacatgaagacaagaaagatgaagatctttatgatgattcgcttcacctgatgaacagtaatatatttttttcttccttatgatttctttttttttctttttttttttttagacagagtttcgctcttcttgcccaggctggagtgcaatggtgcgatctcagctcattgcaaccactgcccctcctgggttcaagcgattctcctgcctcagcctctggagtagcctggattacaggcacaccccaccatgcccagctaatttttgtatttttagtagagactgggtttcaccatgttggtcaggctggtctcgaactcctgacctcaggtgatccacacacttcaacctcccaaaatgctgggattacagatgtgagccactgcacctggccttccttatgattttcttaataacatgttctttttttctagcttaccttactgtaagattacagtatataatacatataacaatcaaaatatgtgtgaatcaactgtttatgttatcagtaaagtttctgatcaacataagctattggtagttaagttctgagggagtgaaaagttatatgtggattttcggctacacagggcgtcatcatccctaacccccatgttgttcaagggtcagatgtagaaacataccaaaacgaaaaactattatcagtacctgtcaaaagatctgaactgcacgggttgttccacagatagatcaccaagggctccaaggcaggctggtggcagaagggcaggatccactgtgactccatctgctggtatgttaaccaagcttcggagaatgtctttcacattgacgttttttgaaactgaaactgacggtgtagccttagtgtccaagtcatttcctctatcatttttggtttccggagacttattgacttctaaagaaagagtagatagcacctcgctgattgcatctgggcctgcactgacaccaggaggtgctgtgtgaggagttacttccacatggcttcctaaaccagtggctgtttcttccccaatgcctgagtccctccttcgagcagatgatgtgctttcagattcttccactgatgccgtagttaaagtgctgaatgctgctggtgtgatttctatatcatacccagaaacacaagaaataaacaaacaaaagtttagaactaatttttaaaaggtatattctgttttaatagctatctactgttttgaattatgaaatacatcatgttctaaaaaagcaaaaactaattacgtattctacagaatgtactgagtgggtgcacctattatcaagacagatggtataataaaataaataataaaatacttgcaaaaatgatctaaagtaatgggtagcaacacaaggttgaaagtcattggcctgtaagaaaaagtctataatcttttttgggggtgtgtgtgtgtgtgtgtgtgtgtgtgtgtgtgtgtgtgtgtcagtctgttgcccaggctgaagtgcagtggtgtgacctaggctcactgcagccttgacctcctgggctcaggcgatcctcccacctaagcctctcaagtagctgagactacaggtatgtgctaccacgtctggctaatttttctatttttttgtagagatgaggtttcaccatgttgcccaggctggtctcaaactcctgagctcaagcaatctacctgcctcggcctcccaaagtgctaggattataggcatgcaccaccatgcctggcccaagtccgcaatctttaggataaaataaaaagctctacctcaaacatggttactgcagctggaaaacttgttaccccttctacgtgcataaataattcaatgatccttaaaatccagttcaacaaggaacacctccttttctctcttttaattctcactccctttaatcagggtttcaacccattctagcaaaaatagtcttatcaaggtcaccaaaaaatctgcatcttgctaactccaatggtcagtgttcagtcctaataggacttcacataacagcaacagctgattattccctccaactagacaatgcttcctttcctcggctttcaggacaccattctctttttgttttccttgtactacttcactgactgttccttcttaacatccttcacctctttttctccctgatttcttaagttggagggacacaaggttcagtccttgttcctcttatgttctctgtctgcatttagtcccttcgtggtatcattcattctccaagttttaaataccactatatttccccaccaaaaaactcaaactattaaatataactgctaccctacaacttatcttacatgtctaaaaaaacctctcaaactcaacatgctgaaaactgaatttcttctctttttatctttccctgaaaatctctttcacctttaatctactccactgtaccttgtaatcatttttgactacctttttcattcacaaaatgcacacctaatgttttaaaattctgttttttctaccactaaaacatattcagaatctgactgcctctcaccatctctagttaccaacctaatccaacccaccataacctcttgcctggattactgattactgcaatatcctccttcctaactgttgtggaagagggttgttttaataatcctactgccccatgtctcctggtatgcatcccttgacaagcccttgaatctggactaggcttgactgacaataacccacaggatctggcaaaagcagcagtgggccagtatttggcccacgttttaaggtctggcagctcttgcattcccagaatctctgaacatctctgtaagaagtgtggcttatttctgatctaccttgctggaaagaacatgtagagagacgatatggagacagagatgctctccaaactaatgaaggaaaccaggaactcagttgagaacaagtatcaaggctgcagacacacaaccccagctcagctgttttagtcagtcagtctcagctcttggagccatcccacctgaggcactatatatactattagaaaagtcatcttagattttccagacccagcaaacatcatctgaaacagggataaaccatgcccaccgtgccctatccaaatctaactcaagaaatcatgaaggaaagattaaaatggttatggtcttaggacactaagtgcagggtaaggtattaaacagcagtacccagccaaaaacactgattatccttgccctctacgctatatcctctacacagaatacagagttacttttttttttttttttttttttggaaacggagtctcactctgtcacccaggctggagttgttgtggtgggatctctgctcactgcaacctctgcctcccaagttcaagcgattctcctgcctcagcttcctaagtagctgggattacaggcacccaccaccatgcctggctaattttttgtatttttagtagagatagggttttaccatgttggccaggatggtctccaactcctgacctcaagtgatccagctgcctcggcttcccaaagtgctgggattactggcgtgaactaccaagcccagcccagaggtactttttaaaacataaattgtaactcctgtactcaagaccctccaatgagttctcatttccctcaaagagaaatccatacccaattactcctggtcattcctgatatttttaccatctttattactttctttttttttttttttagcactttcaccaccttctaaaatactacacaatctacttatagcatgtagatattttctatctcctcccattagaatataagctccataaggaaacagattttttgttttgttttagtcatgaatatatacccaagtatccagtagatattgaatgaatatcgagtgaataataaattgcctcctttgggtggtagctacttctataattgcaacagctacttaactaactatacttttataactggaagctacttttaatactccaattattgcagttacttgttaacaagtctgtctcttagaatatgagttagtgattcttcacagcaaatgaagtcaataaaatttttcaactctttttgtataacattttctgacttacatttaattagttcatttaaagaacaaaaaatatcccaattgcaattaattacattatatttaagccacaacttttagttaataataaaaatatatgtatgctctcccttaatttgcacagaaatggatttaaattccaatatcaatattttaaccatcaaaagtaagtaacatttatttgaactttggtacaaaggaatagaaaatgcaaacttaccagagagtgatacattctcattttcactgccagtttctgtacatgactggctatgcctttcattttggggttccaaaatgtctctgtacttggagaccataagaacagagataaagtatactactgccaaggctaaaaattgagcttgtttgctatcctcctgggaaaaaaaattaaaggagttgattatgtaaccataaaataacatcattatattttacatcacaatgtttaaatacaaaacatgttcacaaatctttcaatatacacagaaaatacattacctacgtaaataataaatttattaataaacttacttgagcaaacattaggcaaagactcttagaaaaatgtctttaaatgagaagctttatacttgcaaaacatggaaagagagaagttagctcatttttttaaattattcaatctaaagacgtatgtcctaatatacattataatgttaatcaaacaaacagtaattataattatatgaaaacaggtcagatgcagtggctcacacctgtaatcccagtactttgggggccaaaccaggcggatcacttgaggtcaggaatttgagaccagcctggccaacatagtgaaaccccatctctactaaaaatacaaaaattagccaggtgtggtggcacatgcctgtaatcccagctactcaggagcctgaggtgggagaatggcttgaacccaggaggcagaggttgcagtgagctgagatcgcatcactgcactcaagcctgggcgacagagtgagtgagactctatctcaatcaagcaatcaatcaataaataaataaacaatgatatgaggataactggttatttttatctgtaatcataaaaactaaaatacataaaatatcacaataaaagtgccaaaaaataaacatgcagaagaaaaaaactgaagctattagatacagaataggatgccaaaggaattccttcttttttttgagacagggccccactccattgctcaggctggagtacaatgacacaatcatagctcactgtacccttgaactcccatgctcaagagatcttcctgcctcagcctcacaagtagctaggactacaagaatacaccaccacatccagctaatttttgttttttaatttcttgaagagacagggtcttgttatgtagctcaggctggtctcgaactcttggcctcgagcaatcctcctgccttagcctcccaaagcactgggattataggtgtgagctcccacacctgaccacaaaggaattcttgagagtatttaaaatagtacaaacaattatatatcaagatttaaaaaaaaaggatctatgagaaagaagacaaactagactgacctcttgaagggcctaggctccattctagctctacaggtcacctatatatcactgacctctttatcttgtcaaattccccatcttcaaggagaacctacacacaccactattctactaactttcccaaatatgtttgaacttgttaatttaaagaaaaaactcaaatttatctatcaaattctgaaaaccaaaggctcaagcagaaggtaaatttaaaataagaacatgaagaacactgttccctatcagataaatccaggcataccatggagataccacaggtttagttccggaccactgcaataaagtggctatcacaataaagtgagtcacacaaatattttagtttccgagtgtatataaaagttacgtttacactatactgtaatctattaattgtacaacagcattgtatctaaaaaaaacgcacataatttaaaaatattttatagcttaaaaatgctaacaattatctgaactttcagtgagtcacaatctttttgctagtggaaggttgcatctccacattcatggatgtcgactgatgggtgagggtggtaactgtagcaatctcttaaaataagacaagaaactttgccacattaactgaatctttctttcacaaaagatttttctgtagcaagcaacgctgtttcatagcattttactcacaggattggagtcattcctctgaaaccctacaaaggttttatcaaatacatttaggtaatattctaaatcctttgttatcatttcaacaatgttcacagtatcttcatcatgaatggattccattgtaggaaaccaatttctttgattatccataggaagcaactcttcattcgttggagtattatcatgacattgtaggaattcaatcacatgtttaggctctgcttctcattctgattctcttgctatttccaccacatcagcagtgacttcctccatggaaatcatgaactcctaaaagtcatccatgagaattgtaatcaatttcttccaaactcctattaacattgatatgttgatttcttcccatgaatcacatgggtacttcatggtatctacaatagtgaatcaattccagaagattttccatttactttgcccagatccatcaaaggaattactatctatagcagctacagcctgataaaatgtatgtcttaaataataagaagtatttcttaaatagtaagtcaaaatgactcttaatccatgaactgcagaatgaatatttcactaaaaagcatgaaaataacatgaatctccttgtatatctgatcagagctgttgggtgaccaggttgattatcaatgagcagtaataatttgaaaagactcttttcttctgaacagcaggtctcactagtggccttaaaacattcagtaagccatgtcgtaagcagatgcgctcttatctaggctttgtccttccttttatagagcacaggcagagtagatttataataattcttaagggtccgaggattttcagaatgataattgtgcattggctttaacttaaagtcaccagctgtattagtccctaacaagagaatcagcctgtcctttgtaacactgaagccaggcattgacttcctggtagctaggaacattgtaggatggtatcttcttccaataaaaggtgttttggcttttgttgccattgcttttggtgttttagacatgaagtccttgcccatgcctgtgtcctgaatggtactgcctaggttttcttctagggtttttatggttttaggtcttacatttaagtctttgatccatcttgaattaatgcttgtataaggtgtaaggaagggatccagtttcagctttctacatatggctagctagttttcccagcaccatttattaaatagggaatcctttccccatttcttgtttttgtcaggtttgtcgaagatcagatagttgtagatgtgtggtgttatttctgaggcctctgttctgttccgttggtctatatctctgttttcataccagtaccatgctgttttggttactgtagccttatagtatagcttgaagtcaggtagtgtgatgcctccagctttgttcttttggcttaagattacattggaaatgcaggctcttttttggttccatatgaactttaaagtagttttatccaattctgtgaagaaagtcattggtagcctgatggggatggcaatgaatctataaattaccttgggcagtatggccattttcatgatattgattcttcctatccatgagcatggaatgtttttccatttgtttgtgtcctcttttatttcgctgagcagtgatttgtagttctccttgaagaggtccttcacatctcttgtaagttggattcctaggtattttattttttttgaagcaattgtgaatgggagttcactcatgatttggctgtttgtctgttattggtgtataggaatgtttgtgatttttgcacattgattttgtatcctgagactttgctgaagttgcttatcagcttaaggagattttgggctgagatgatggggttttctaaatatacaatcatgtcatctgcaaacagggacaatttgacttcctcttttcctaattgaataccctttctttctttctcctgacggattgccctggccagaacttccaacactatgttgaataagagtggtgagagagggcatcgctttcttgtgccagttttcaaagggaatgcttccagttttgcccattcagtatgatattggctgtgagtttgtcataaatagctcttattattttgagatacgtcccatcaatacctaatttatacagagtttttagcatgaagcgctgttgaattttgtcaatggccttttctgcatctattgagacaatcacgtagtttttgtcgttggttctgtttatatgctggattacgtttattgatttccatatgttgaaccagccttgcatcccagggatgaagcccacttgatcatggtggataagctttttgatgtgctgctggattcggtttgccagtattttagtgaggatttttgcatcgatgttcatcagggatattggtctaaaattctctttttttgttgtgtctctgccaggctttggtaacaggatgatgctggcctcataaaatgagttagggaggattccctctttttctattgattggaatagtttcagaaggaatggtaccagctcctccttgcacctcgggtggaattcagctgtgaatccatctggtcctggactttttttggttgttaggctattaattattgcctcaatttcagagcctgctattggtctcttcagggattcaacttcttcctggtttagtcttgggagggtgtccaggaatttatccatttcttctagattttctaatttatttgcatagaggtgtttatagtattctctgatggtaatttgtatttctgtgggattggtggtgatatcccctttatcattttatattgagtcattcgattcttctctcttttcttctttattagtcttgctagtggcctatcaattttgttgatctttccaaaaaaccagctcctggattcattgattttttgaagggttttttgtgtctctatctccttcagttctactctgatcttagttatttcttgccttctgctagcttttgaatctgtttgctcttgcttctctaattattttaattgtgatgttagggtgtcaattttagatctttcctgctttctcttgtgggcatttagtgctataaatttccctctacacactgctttaaatgtgtcccagagattctggtatgttgtgtctttgttctcattggtttcaaagaacatctttatttctgccttcattttgttatgtacccagtagtcattcaggagcaggttgctcagtttccatgtagttgagtggttttgagtgagtttcttaatcctgagttctagtttgattgcactgtggtcggagagatggtttgttataatttctgttcttttacatttgctgaggagtgctttacttccaactatgtggtcaattttggaataagtgcgacgtggtgctgagaagaatgattattctgttgatttggggtggagagttctgtagatgtctattaggtccacttggtgcagagctgagttcaattcctgggtatccttgttaaccttctgtctcgttgatctgtctaatgttgacggtggggtgtgaaagtctcccattattattgtgtgggagtctaagtctctttctaggtctctaaggacttgctttatgaacctgggtactcctgtattgggtgcatatatatttaggatagttagctcttcttgttgaattgatccctttaccattatgtaatggccttgtctcttttgatctttgttggtttaaagtctgttttatcagagactaggattgcaacccctgcctttttttgttttccatttgcttggtagatcttcctccatctctttattttcagcctatgtgtgtctctgcatgtgagatgggtctcctgaatacagcacactgatgggtcttgactctttacccaatttgccagtctgtgtcttttaattggagcatttagcccatttacatttaaagttaatattgttatgtgtgaatttgatcctgtcattatgatgttagctggttattttgctcattagttgatgcagtttcttcctagcatcgatggtctttacaatttggcatgtttttgcagtggctggtactggttgttcctttccatgtttagtgcttccttcaggagctcttgtagggcaggcctggtggtgacaaatctctcagcatttacttgtctgtaaaggattttatttctccttcacttatgaagcttagtttggctggatatgaaattctgggttgaaaattcgtttctttaagaatgttgaatattggcccccactctcttctggcttgtagagtttctgccaagagatccgctcttagtctgatgagcttccctttgtgggtaacccgatctttctctctggctgcccttaacattttttccttcatttcaactttggtgaatttcacaattatgtgtcttggagttgctcttctcgaggagtatgtttgtgatgttctctgtatttccttaatttgaatgttggcctgccttgctaggttgggcaagtcctcctggataatatactgcagagtgttttccagcttggtaccactctccccatcactttcaggtacaccaatcagacgtagatttggtcttttcacatagtcccatatttcttggaggcttcgttcatttctctttactcttttttctctaaacttctcttctcacttcatttcattcatttgatcttcaatcactgacaccctttcttccagttgatcaaattggctactgaagcttgtgcatttgtcacgtagtacttgtgccatggttttcagctccatcaggtcctttaaggacttctctacactggttattctagtttgccattcgtctaatcttttttcaaggttttcatagcttcttttggatgggttcaaacttcctcctttagctcagagaagtctgaccatctgaagctttcttctctcaactcgtcaaagtcattctctgtacagctttgttccattgctggcaaggagtggcgttcctttggagggggagaggtgctctgattttttgaattttcaaatgggatctatttaaactgaagagcttctgtacagcaaaagaaactatcatcagagtgaacaggcaacctacagaatgggagaaaatttttgctatctactcatctgacaaagggctaatatccagaatctacaaataactcaaacaaatttacaagaaaaaaacaaccccatcaaaaagtgggcgaaggagatgaacagacaattctcaaaagaagatatttatgcagccaacagacacatgaaaaaatgctcatcatcactggccatcagagaaatgcaaatcaagaccacaatgagataccatctcacaccggtttgaatggcgatcattaaaaagtcaggaaacaacaggtgctggagaggatgtggagaaaaaggaacacttttacagtgttggtgggactgtaaactagttcaaccattgtgaagacagtgtggcgattcctcagggatctagaactacaaataccatttggcccagccatcccattactgggtatatactcaaaggattataaatcatgctgctataaagacacatgcacacgtatgttcactgcaggactattcacaatagcaaagacttggaaccaatccaaatgtccatcaatgatagactggattaagaaaatgtggcacatatacaccatggaatactatgcagccataaaaaaggatgagtttatatcctttgtagggacatggatgaagctggaaaccatcattctcagcaaactattgcaaggacaaaaaaccaaacactgcatcttctcactcataggtgggaattgaacaatgagaacacttggacacaggaaggggaacatcacacaccagggcctgtcatggggcggggttaggggagagggatagcattagaagatatacctaatgtaaatgacaagttaatgggtgcagcacaccaacatggcacatggatacatatgtaacaaacctgcacgttgtgcacatgtaccctagaacttaaagtattaaaaaaaaaaaaaggtgttttgtccacattgaaaatctgttgcctagtgtagacaccttcatcaatttcttagctagctcttctgcacctattgcttcaccttgtacttttctgttatggagacagcttcttttcttaaattttatgaaccaacctctggtagcttcacttttcttctgcagcttcctcacttctctcggcctttacagaattgaagagcgttggagccttatctgaaataggctttggcctaagtgtgcctggttggatcttttatacagaccactaaaactttcttcaaatcaacagtataaagccgttttacttcttatcagtcatttgctcactggagtaatcgtttacttttaatttcctttaagaactttgcatttgccttcacaacttggctaaatgtttggcacaagaagcccagcttttggcctgtatcagcttttgatatatcatcttcactaagcttaatcatttctagctttttatttaaagtgagagacatgcaacttttcctttctcttgaacccttagaggccactgtagggctgtaattggtctcatttcaatattgttgtgtttcaggaaatagagagacagggtaaaggcccctcccaaggagatggggagagacaggaatggccagtttgtagcacagtcagacatttattaagttcactgtcttaaatgggtgtggtttgtggtgccccaagacaattacaatagtaataccaaagatcactgatgacagatcagcatgacagataaataataataatgaaaaggtttgaaatattgtaagaattaccaatatatgacataaagacataaagtacatgctgttggataaatggcatggatagactagttcaacacagagttgccaaaaaccatcaatttgtaaaaaatccagtaatcggcaacatgcaatagcaaagcacagtaaaatgaggcatgcctgtaaatagaaactaatggtaaaaatgagactaattgttaatacttaatgtcaaaaattttggatataatcagtttcagaaaaatagaagataggctcaatttgaacatatccacttgatgcaattctttgacatatttgtgatccgtgatctgacaaaatctatgatattttgcaggttcatatgtaatgacttcttagtctgttggaaaaaacaaaggtacatttgtcttttttataaaccaccccttttctctagacatacccatgttcttctgccacacaattctgccatgttataataactgctgctaatgatattaatattcaaaatgcaagcaaataatttacttgttcttaacttcttagtctgttataaattagttatgccaatctaaatccttatttagcccattaatatgttcaatgtttactaactaccacatgaagtttacagtatatgcctgatttttggcctcaaataaaaaatatcccataaatcgtttacatttaaatcctaactcaagaaatagatttgctttccattgtagctgtcatttattgaatacttaccgtaggccaggcactgtgctatgtatttcatacatatttttattagcaaacttgaacaagataaggcttagagaagcaacttacttaaggacatatagtatgtaaaaaagcaaatctgaactcagattatggtgattaaaaaccttagctctttacctcaaggtagaaatttatttatgtcgtcgatcttaggtcatttccctttttttttctttttattttttaaatttttttattttattttttgagacagagtcttgctctgtcgcccaggctggactgcagtggtgtgacctgggctcactgcaagctccgcctcccgagttcacgccattctcccgcctcagcctcccgagtagctgggactacaggcacccacaaccatgcccagctaattctgcttttgtatttttagtagagatggggattcaccatgttagccaggatggtctccatctcctggccttgtgatccacctgcctcagcctcccaaagtgctgggattacaggtgtgagccaccgcacccacccagtgatttcctttttcatcataggttccttttgttccctaaagagactaaactctagcatgtaaaatatagtgttttcttttttctaaaactcctataaggtgattatataacttttataattacaaaacacttaaaattatttatgactttcagtaatcatatagtaaaggagatattctaattgtttgcagaatattgtaatataataactggttagaaggttcttcaagagccagatcatccagaggcactgtgaagagtttggattccatttaaccactaaaagatgatattagagaattctgaaagaaaaagagtaacatcatctattctagtttatttgtttgtttatgagacagggtcttgctgtgtcacacaggctgtagtgacacaatcatagctcacggtaaccttgacctcctaggctcaagcgatcctccccacctcagcctcccaagtagctaggactagaggcgtgtgctaccacatgtggctaattctattctagatttttaaggatcattctaggaaatataaagttatggacaatagactcagaacctgcccaatggaaaaaaagtgaacagaggagaaaacagcaacatttggtcctcaaactgaccacattcaaaggattccagggagaaaaaaagttgatggcttcttaattaaaggaataataacagctactagagaactatgatctaagaaggtagtatagccttttagttaagatcaaaatttcaagaatcagattccctaagtcctaaactcactttcacctcttactaattgtataatcttaagcacattacttaaatattgctaactccctcatagaattattgtgagaattaaacacacatatacagcattggtccccaacctttttggcacaagggactagtttcatagaagacaatttttcaatggacctgtagggggtaagaggcggggtgggggtagggggcatggtttcaggatgattcaagtgcattacatttataattagattttcataaggagcgcacaaccaagatccatcgcatgcacagttcacaatagggttcgtgctcctatgagagtctaatgctcctgcccatctgaccaggaggcggagcttggcttcactcctcaccctttgctcacctcacctcctgctgtgcagcctaagtgcaggtcagtggtctgggggttggggacccctgataagagcatccagtatcatgtttaatacacagtaagtattcaatactattaagtagtgataatactccaaattctacatatgcataaaaacctagtcaagaactaaagagaataaaactattgaaaaaaagggaggggaaaaagaaaaattgaggttagaaagtttgtaagaaatatatatgtaaaacatacagtaagtgttcaacaaatatttactaatgataatattccaaatgctgatgagtgcaattataaattatttttactttcatctttatactttctatatgactttaaattgtctacataagaattagcaatgttttctatcaaaatcagctgaaacaaaactgtttttcaactttaaaaaattagaaacaccaaactgagagcaacatttcatcatgcacctttttatcacattagtgtacctttgaggaaaaaatatccaatattcagtaaaataatatgccattcagaagttgaacattttattacattcagagcatcaattttagaattaagactgctgggtttgaatcctgattttatcattgtttatcaacactagcttggagatgttactcaagctttatgtgccttagattattcatctataaaatggaaattacaatagtacagctcaataagttgttggacttaattaatacatgtatatcacttagactgcttactatgtaataatgcattattccttttaatatcactatgctgatctgctagctcgctttatataaactatcttttctaatattctgtttctaaaatcattgtcaaaagaagtcgtttctagacctttctatctctgctccactatttgatatcacaaagaatttttaatctcaatacattaggcctaagaggaaatatgcatcagttaagagagtatgtgaaagacatattgtaacttactatgtctctgaaaacaactgccctaagccgattaatatccatgtcctgtagaagcctgtcaagatctcttactggagatataccgccagtcacaatgtccactgggctctatttaagattaaaaaaaaattgtatatatatatattcatatatacattacacagatattctttaaaaataaacacagtattcccagaaccagaaaagcaaagctatagcattcctttccccactttttttgtgtgtatgcttccttcttctttgaggggttggggagagaggtggagaaagatggcatgcaggaaaaaatgacatatttgaaggaaaaggcatcacagaaacaatcaaagtaaacactgggaaaagcagagaggtttaaatataaacaaatctttattgtgtatttaaacacaaatatttgaatgttatatgcaggcctaaagtaactattttaatctctgccagatttatttaactttatgttgaaatgaacaaataaaaatcttaattgtaaaataggagtatgctttttgaaaattaattaatctgtatacttaccttcgctgcagatttccctaaaggaataaggctatgcattggtttcaaggctttatctcccctagttttcagttgtgaatgctgttgacactccaagcaattccttactgcgactgcacaaactgtaatttattttaaggaaaagatagggaaagaaaagttaatatttaagattatggaagtgaaaaacatcaactacacaatatgatttacataagattttattcaaaacagacgacattcagcttattcctaaaatgtccctagactttatcgcctagtgttggttgtctgatattgttagcttccatgctgtggcccagttaagatttagggaggcagtatggcctagtggtctaaacgtttagggtttgctgaaaggaaatcagttcaggaatcttaacaataggctactatttcttagatctcaactaagctagctgggacaatctttagttaagaaaaggatagggaagaaaagaattgaaagaaatggaagaaaacagggaacaaagtacattaccatgaactagtcgaggtaacaatcttctattaccatcattaaagtaaattagttaaactggaaactttgatgttcttcttatattgcatcattacagcatgatattaattgagactaatagaggatatagcttttgaaagaagctttatagggtccagcatttactagctttcattaaaactgcttagaaaatgggagacaggaaagggaatttgattaatatacagtctaaaattacctaaggctcccacgaatcaggcagttagattacttagaaattaattttggattttaaatgatgaattacattatgtacccttcactatgaattgcttgataccatgtaatcatctaaattccctccaaatctgtagcactcaaggtacttgaactgagcaaaggagggagagcaaattaggaacaaaatagcaaacttaaggggggacttcacaaagaatcactggcctatcacatggctagcaggcatgagaatttagaaagaaagtgttctgaaaggtgcccaaagagagcaataaaagttgaaagaaaggaaggagggaacaagaggagggaagagagaatatggaatacagctttgtcaaatttgctatcagacccaagaaatattttactttatcaaatttgctatcagacccaggaaatacttttcatacaaactttttcacaagttgcataaaatcaaatttgagtctgtattacaaagttaaaaatcacacctcatttcctggtttcaatcagttactcttactgctgtcatcctaacttctaactccaacctcaggaaacaagaatgaggacaccagtgtccatcaacagataactagataaagaaactgtggtacatatacgcaatgaaataatattcagccgtaaaaaagaaagaaatcatgtcttttgcagcaatatagatggaactggagatcattatcttaagtgaaacaagtcagacacagagagacaaatattgtatgttctcacttataagtgggagctaaatagtgtgtacacatggaagtagagtgcgtaatgattgaaaatggagactcaggccagcggtgggggctcacatctgtaatcccagcactttgggaggccgaggcggggggatcacaaggtcaggagatcgagaccatgctggtcaacatggtgaaaccccgtctctactaaaaatgcaaagaattagccgggtgtggtggggcacacctgtagtcccagctactcaggaggctgagatagggcaattgcttgaacccggaagaaagaggttgcagtgagcccagatcttgccactgcactccagcctggcgacagagtaaggctccatctccaaaaaaaaaaaaagaaagaaaatggagactcagaactcagaaggatgagggggtgaggggggtctgatgatgagaaattatttaatggtacaatgtgtgttattcatgtgatgaataccctaaaagctctaacttcaccactaagcaatccatgtatgtaacaaaattgcacttgtaccccataaatttacacaaatacaatttaaaaaaaagatatcacacatttggactgttactttgtttaccatactctattaaatgatcttggacaagtcattttttaagtcccatttccatatataagaacagatggtactggggtggattaaattatctcttaattcttttccgtggctatgaaaaactaggaacatagagtatttccctagcctctgaatctgatgattcttgagtaaggctttgctagtatagccttgcacttttacttctagaaatgtactctttctaggaaagtgaaaagccttcgaaaatggcacacataaagcaataaagtctaaatattttaattataatactaatagattaaagaagtatactacaatagaaagagtaggagcactagttagacaaaagtatagtattcaaattctaccttcaccaattatagctttttagctatagataagtttcccaatttcttttatcttcaatttcctcatgaataaaaagaacaaaattgtcaccgtgaaaatcaacaatgacaaatgacaatagtcaataaatgataacttttattttgttatgcttacaattagaatgtctcttaaattttaaaacaactgtctataaattgttattccaagttacttagaatagcaagatataccattgattattaaatataaaatacttggaattttacatttaaactaatactattaaatactttgaatagcattttgagtaaaaattatacttgtggcaaaaagcacaggtatacattagtttatgtaacagacattcttgctaaatatgaaaaaatatgtcattaactacattttccacttccatgttatgttttcataggtgctttatctcttcatatgaccatggctcctaatggtttgcttccatttcttgtgccttctctcctcaccaccttctcttcacttaataatcaaatcatttaacaaagtctcgatatttacaactatatagaaggaaaattatgcaaaaaagggtttttttgttttgttttttgcttcacctaagaagtccagttaacattaaaaagtcatttcatgtatttttacttttacttagggaagaagtgtttccaggagaagaacagagatttcatgattttattaactgcattaacaaattaccacagcttttttgaataaaggctgtacttgaatgatgctagtttagaacgttgttattccagtgtgtttgtaagaaaagcagcatcaacatcacctgggacttggtagtcaattttaggccttaccctagacctctataaccctttttttttttgagacagagtcccgctcaattgcccaggctgcagtgcagtggtgtgatcttggctcactgcaatctccaacttccaggttcaagcgattctgctgcctcagcctcccaagtagctgggattataagcgtgcaccaccacacctggttaatttttgtatttttagtaaagacggggtttcaccatgttggccaggctggtcttgaactcctgacctcaggggatccacccactttggcctcccaaagagctgggattacaggtgtgagccaccaccccagcctagacctatataatctaatctgcattttaacaagatcatcaaatttatgaatcaccttgtgttttttaatcaccttaagtttatgtatctccttaaaatttcagaagcactactttagagcaaaaagagataggggagcacctctaattccagctactaggaaggataaggaggcgggatcacttgagcccaggattttgacaccagccttggcaagaaagcagaaccaccatttcagggagaaaaaagaaaaaaaaaaaaaaaaaagataggggagagtggaaactcctgaccaaaatcaccttagtaaatttttcaaaatacatcctccttcttgcccatccaacttaccaactactactatgtacattaaaaaaagtaaccatatgacaaattagctaacatatattttctcaccaacagaagacggataattttcaatgtcatctctgaattactgaaaaattttttttagtaaattcccaacggtttttagcagctcacctagtcggagacactgccgcaaaattcctccagatgacatacttttttcagcttcaatttcagtaaagccaagagaacttgcaaatataagcacatccacaaggctaattagcctctgcaaaaatgtcacagaggcttctattgaaaggccttgagtaggttcaatattttccagttcatgctgtaaagaataaagtttgacatttatatatatatattctgaaaaaaaaattttaccagatatagtcctaaaatttataaattgcataagtagtcagactttcagaaacctagtaacacagagtgatttatacttattatttcatctaaaaagggtgggggatgaggaggagcaacagaaccatacaggtgaaacatcatgaaccacattcttcactagctgactcatacttagggaatcaacattcttttaagttctttcattactagaacagattctaaggtcctctcaagtaaaagatcctattgttttttatttatagcacctacgatgcatagtaaccaccacatttaagttttagtcaataaagttgcataacactcatgttttcacaccaattttctatagtaattaagtccttactgtagccgatgtagcagctgaaagcaatggcagtatacccccacaagccatgaccatattgtccatcacttgagagatgagatgaattgtgttgtgtacaaagatgacattatcactgctattcacgaagtccataactgtctttgttgaatggctgtccaaagataaatgatatttactgataaagctaaagaaaggaaatcacagtttgcctacttgaggggaggaaagataagaaggtgcttttgcttcatcttgaaaactgaaggaagatgatgcagcaggcatttggagggtgtatacttcttcagaagaaacagaccattccatatcagtagttactatccatgccctccttcagtgctgaaacataaatactattcattttacactggatataaaaagttgaagaaaattatccttactgggaacaaaactaagaaatcatgtgacaaaaattaggaggtaaatactggtaaatgtgctattaaaaatgaattttcttctgtaatgcctataaaatgcttttaaacataacaagaatcttacacaaataaaaaaaaataaattaggtcactttaaaatcataaatcatacaatgggggataacttgaagtacacagattttttttaatgctaaaaatacattggaaatattgataatgttataacaattttttttttttttttgagacagagtctcgctctgtcgcccaggccggagtgcagtggcgtggtctcagctcactgcaagcgccacctcccgggttcacaccattctcctacctcagcctcctgagtagctgggactacagacgcccgccaccactcccagctaatttttttgtatttttagtagagacagggtttcaccgtgttagccaggatggtctcgacctcctgaccttatgatccgcctgcatcggcctcccaaagtgctgggattacaggcttgagcaactgcgcccggcctataccaattattttttaatacttctagtaataaaccaacttgataaacctaccttctggtgaattccgtgccataaaattgctacaggaaatctactacaaatttttttaaaagagaaacctctgcttttcacatttttgtaatccagataaggattccattcttataatggagaataaaagtgaattcagtaaaaccctaccatagaataatttctattctactttttaaccaaatgtctgaaattaattacaaactgtttctatggatttctttgaaaataaagactaggtttatacacatcttccataataaacatatagacaaaccttctccacatctgtatatctgtttctattgaaaataatagatcagtgagcaaacgttgatgcatctgagaccagttgaactcaggaatacgaaacacagtagatctggaatccctcctttgtccattaactgcatctggtgctattccttgccctggctgctcatgttgccttgatatctaatacagaaatttaaaaagtaataaaataggttcaacttcagcaggaggctttagcaaagtaaataatttagtagcttctatgcaattcatctaacacgtttttaagacactataagaaccaaattagagaaagaaaaattatcaatgagtaataacattaacattttagtacatgtaagcaaagctatcaaaagtgcaaaactaccacaatttaaaagtaattaacttggaaccatgttaagtattaccactatgtagcattttataaaagaatcaagtaacagttcttagtttttagccttagcctaaaagaaaggcagtatttagaatctaagtggcatttggattatgaagtggctagaatgaagaataaaaacagagataacataatgaagaaccaaccaacaaaaacaaaaaaaaggagggtgggacagaggataagaattgaataaagtggaaaatgacaacatgctaccaagcactgtctcatgggtcactctgagatatggacagaggagaaggctgtgcctctagatctcacaaagcctcctctctcttatagacttcataatacaattttaaatcacatgcttagtaactaaaattatacactggcaggtaggtagccctagagtttgttggaaaactaatgtactaggattgggttagtcaaataaaaggtaaaatgcaagtgtttccaatatttgttttataaactaaaattataccaatccttcaaagtggtaacttctggtgatactatggtaaaaatagtaataaaaactgtcatttaatgaactcacattaactgccaaacactgtgctaatgatctgaaatacaatcttcacattcattgcatttatttagttgtgaatagcatgtgaaccaaattcaaaataaaataaaatttaagtatatacacttgctcttttttaactcagtgcaaaagtacttgaataagacaatatataaaatcacctcaagcacatgtcgatgaggttgaggtgcttccacgttgggactggccttcaactccagcctctcagtatctgtagcaacattggaaacatccaacttcgcaatcttttgctcagaagaagcctcagagacactaccatgacaatcattaattaatttggtttctctagtgaggttagttgctttcttcccttcctccagcatctgaccaaggtctgattctacagctatttgggaaacagtagtttctggtgacatagctgaagaccctgatgctgtcatagtctgaattccagaatctttagaatcttgagtttcagtatcagtttgcttttcagtaacaggttttccttcttgaaatattaatttgtcatcattaccaaacatgtccagtttttcaccggcttcagatgcagctggagacaaactgttatcttggagctctgtgggtagattagcttcctcagtaggactgccttctactttcagttccacataatcatcatcttcctcttcctctactatagatttatccaagaattctggcatctctgaggcatcctcttctgaaggagaacttatagaagcagttacttcactgacagtcattgaatctttgccagttgttataaaagaattagaggaaatagccacagcttctattatgtcagaagatacttctaaatcatctgcattccttgtctcatttgtcagtgtttcttccaaagtgccttcatctggtaactcctgattttcttgctcagctttcatttcttcataagatgtattagtagtttgcagttcaatattagatgcagattctagtgaacttgtcttctctatacttgaattttcattaccatttgtggtgaaatgaggacagacaggagaatccttcgtatctggttgctgggatcctactgaaacattaatatcccttctaatgccagaggctgcttgaactgaagttgaagaacacagccctatttcttcatcaacttttccttgctgttccctaaatatattggcaaggttttctttgtgtatttcaaaagtgacctaggtgaaaaatgtacaatcagttaaaatatgcatgagaaatgaagacagaatacaaaatataaaactaaataattttcaaatacatagtttatataatacaataaaacttaattttcctatattttattttagtagaatgataaatgtaagtcaatcacagaaatctaaatattcattaaaaactacagccaattttaatgttaacaagtaacacagcatgaaaccacaagaagaacataattatttagcctattattaaacatgtataggaaaaggatacactattctactggccaccataacttgtaccagaatttaagtatgtaccattgggaagtgctttatgcactggataacacttgtttcaaccgctatgaataccaatttccccaggacttgtccgcaggagagattaaaaatatcaattaattatgctcaccattacagtagctctacagatatctattaagctacaaaaccattatctcactaagccaatgaatacaaattcttttagcaatgggagaaaaaagatccagcccttcccccaaaggttaaccataatttccaaagtttgaactggtcgaaaatagtctgaatgtttcagttgatccatccatacatccattcattccatttatatctgagtgactacaatatattaggcaccgtgaacattcctatatcatgctttgccttttacccaaatgggaaaaaactgaaaaagtaaatttttttttaaagagagtgctgtacttgttaatgtcacaagatttagaatttttaaaatctaaggattatcttatagccaccatcatatgatttccattggtgtttcaatggtaacccccatcaccccttgcaacaaaaatgccagaaaaacctataacacatgcagaaagtattagcctaattatagtttattaatcccaaaagtgtttgtttctgtaatctacattattatatagagtaaactgaacattcattcaataaatctttattgagccatagtataagaggatgataggacaatcaaggaagaaaagctgatttttttatccacaaaaatcaataggccttattgaatcacaagagtatacacacagatgaaaagcaaacaaaagtaaaaatgactctcaatgcaaaaatttccttctatcgacattaactcgcctttactcatgacatatacagaacattcatgccatgtgatatacctaaaaataaaaatgttcagggaatgaatattttcctgtgaatatttgtatttttcctaattgtaactatttccacattgtaactatgttcttaattctaaaacttagaaatctttttataatatttcaacaataaatgcatgtattcctcactaaacagtaaaatgacataatcacattaacaaaatatcaatttcttttacattcacaatgccaatattttatttgacatgggttctgtattttaattgaccaattcctcatattcattcaacaaaaatttactgaacatcggtagcaggccaggcattgtgtgatgaacacattgttcctgacttcatggagcttatattctaaagaaggtgtcagaaaataaacacacgaatatgtaagataatgtcaaatagtaataagagctttgaagggagggggaagtacagagtgaagaactgttctgaaagtctaggcgagaaggtgtatttactagtgtaactgcagtaggcctctctgttctatttgaacaaaggcaagaataaaagagagagcaagccatgtaaaaagaaaagagtttcaggcagagaagaacaaatgcaaaggccttggagctgaaataagcttggtatgtatgatgaataacaataaagcaataaactgagaactaaagaaaatgaggtcaaagatgtggccacgagctagattatgattgtagaacattatagactgtattaaagactgtattttattctgagagagccatttgagaattaagagtgtagggaagacaatctgatttccctttttaaaagatcagtggctgggcacggtggctcacgcctgtaatcccagcactttaggagtccaaggtgggcagatcacctgaggtcaggagtttgagatcagcctggccaacatggtgaaacattgtctctactaaaaacacaaacattagctgggcatggtggcacacacctgtaatcccagctactcaggaagctgaggcaggaaaattgcttgaacccaacccaggaggcagaggttgcagtgagccaaaatagcaccactgcactccaccctgggtgacagagtgagactctgtctccaaaaaaataagactggttagcctactttttggaaaactgactttagagagagcatttctccaccaacaaacaattatcattgtcaaaagaaagcaagttacatattaccaacctcacagtcattttgaaaataggccatttatttctacaatagcctgtgttatagaatgactttagttttcaataatcatttgctttgattttatttatattaaaggtttttagaatttgtattatacaatggatcaataaacatgagtatatgtaatttatatgtacaggttaagaaacaattttttttaatctcacatgcctaccacccatgtcaagaagtaaaacgttaccagtacctcacaattcccctatgtgccctgcccaaactgtactccctatttctccactacaatcagaaaaaaatcactatcctggtatttctatcgttcactgtttataaatagttttacctggaggtcagagctttgggagataattttaaaagatagttttactatctatatactaaacatacccattatgtttagtttaaaaaactaagtctaacacaaacctagccaattgtattttaaagagcaatactgccacacctgagctcccaagaaaagacaagatacacagaatctgtgagttgcagcagggcttcagcttatttgagagaatatgtaaagccatttctgggaagtcttataggcaagtcattaggaaatacaggaaatatagaggtcaagagaactggagaacctatcagaggcagtgtgtgccaggtagagtgtattggcatgaaatactttatatttttcaattctaagctcaccatggtgaacctctaccctaagaagtaggtcgaagcacagcatgtctttgtggagtgaagtgagaatcttcaggtgattcacattagacaggaaaacaggaatttaatcagcacatgatgaaggcaagcaagctaagtactcctaataagaatacaggtccacctctcctgagtgaaactgctccagtccagatggactgtcatctgcctactacatagctgctattgggatctccctttctacagtcctggagatccccttcatctctcttctatgttgtctcttgtttcttatatttcatttcttcctctttgtattattctctccttttgtgcaatatcctgcagtgccttcttaagaaaggatgtatataaatgttttgagatctcaaatcctgaaaaggtatttattctcgcttcatacttgattaatagtcagagtataaaaccacagatagaaaagcatttaccttcagaatctgaaatgcttttaaaattctaaagtcatttggtttttaaatttgcccttaatttaattcatccaatggtctaaaagctaaattgcaattgaacaactatcagtattatctttttggatgctgttttccttaagatatttgtgactttaaaactgataatttccaattaattgccagatattgttctaaattacccagctaaaagactagtcattaatcttcacaatcatttgatagctaatctatagctgtttgtaatgtttggaaagcacttctataaactactagttaaagatacttgtgagctaatgactataacatttcttttgccattattttcaacttaattggcactcaaatttactaattagtagataaaagataaacacaatacatccagatgttaatattatctttttaatctatacattaaaaccgtataacctgtaaaatttagacattttaaactgttaggcaatgtttagcaactgactttgtttttaagcaaaggcatctttttcagtgtctgttttcatatgaaaataccagctaaatatgatgttaacttctgattaagttaccaacctttgataaataagatatatctttaaaaacaggtggatcttcccatatgtattatcaatgagcataagtcaaaatgattgccaccacattaatgagatcttttataaagactctgatgtataacaatggtataggtaacagatataatggtaaaatcaagcattactgacataattaagagcaattctaaaggttggtagtacaatccccatttataaagataggaagaacactgacaaaagaatattgcagcaaataacttctaatcttttcatttttaaaacagtcattttgatcaattttaatttcttaaaaacagtctaaacagatgctttcatgcaaatctagcgtataaactggtacaaatttttagagggcaatttagcaatatctactaaaaactttttaaaacatgtacagactccttcctctggaaattccacttacaggaatttatcctacaaaataagggttacagtattgaaccaggctcatcattggtcaatgataaggaacagataaagtatgattataatataaatcaatagattttttaaatctctcttccatcaatttttctaaatacaattttggagaatgccagaatataaaaagaaaacttgaatcatttacacggtcactccttcctagaattttaagtggtctgataacattcaaatgttatatcaaagctgaatcttatgctctttacttctccataatgtcatataatatgcaggcattaaaattcatgtaagaagcatatcattaaataatactctaaaatagtaaaaatacgatcacattttgttagcaaataattatatgttatgtatagattcatgtatagaagagaagactaaaaggtctcgcactaaaatgttaataagttatacataggtgtttggataatggataatttttgttttctgtgtgtatgcatttctgctgggttcaagatttcctgtaatgaaaacttattattattttaaattttttaaagtaataaatgctatttggtttcaaaatgttaaagctaagaatacttttagccaggaacaaaggtacatgcctgcagtcccagctactggagaggctgaagggagaggatcacttgagccaaggagtatgaagctgtagtgtgttatatataatggcacctgtaaagaaccaccgcactctagcctgggaagcacagcaacagtctgtctctctctctttttcttttttttttttaagtgccatttaaatttgataaaaacacacacacaaacactcacacagaaatcaggtatttttaaagaattatttagcaattaaataaggtgcaaagtgctgataatccatgaaatgcggacattttgtaacttttttatttttgtaatttttgtgagatatctcctttcatcacccagactgaagtgcagtggcacaatctcagctcactgcagcttcagcatcccgtattcaagtgattttcatgccttagtccccagtagctgggaccacaggcatgcaccaccactcctggctaatttttgtatttttagtagagacagggtttcaccacgttgaccaggctggtctcaaactctggcctcaagtgatccacctgcctcagcctcccaaagtgctgggaggcatgagccaccatgtccagccaattttgtaacttttgaaatttcttcaaacaagtcgcttttaatcttatcatacagccaccataaacacatatacatttttgtatatgccagttcatatcttatgatttaaaaaataattttaataaaccaattagagaattctttaaaaaaaaatcttatttccacatgcttttacccaatctaaatggtagttttttcttatgtacagtgactgaaatgtatacttcagatatttcatttcttatgtacagtgactgaaatttatacttcagatatttcatcagtaaacagcaagtaaaatcttcagatatttcaaaaaatccaagataattaaggactttatcctcaaattcactatttaggaggaaatccaattcatattatacttttaactctaacatgactaatctttattcattttaagtcataaacccattctaacttatggcaatatgagtctagacaaaatacagtatctaaggtgttagttttatgtgtttagaaaagaatgtgtttacaaaattctcataattcagaatagtttaaatgccttaatttaaattttaattaatgagtaaaagcattttatcataccaagtgaaaaaaagtattacttaagcacagaaaaatgttcaatttgaagccaaaaacaaacaaaaaaaaatgaaaacctagacaacaaataagacaatgaaatcacaaacgttactaggtgcactctttaaaaccctgagatcaaagtaaccaacatagtgcagttatactagaagagcctattactgcttataaaacccagttcagctgctggaggagaggcatatagtgacaaacagcttccctgctacaaaggtggcaggaaatctatcaaactggacaataaaactgcaattgagtttctttggctttttatagcagcagcatgtatcctgatgtaactctgcaaaagctatccaattctgcaacattagttctttacacatcagttctttatcaagaaccatgttataaatttgggatattgagattcaaaatgactgcaaaaaggaaaaagcatcactttaacactgtatgtataaaagtattataaaatcttcagaacttatatttttagagaaaagaaaattttgttccaataattccagtggaatttttaatagctgctaaaaattgttcacctacttactgaatcactacagctctattctaagctttattaaataatgacttgaagagccttagggtataagtttctgtcttattttaaaaatagctataaagatttaaaattccaaaaaacttaacagcattcaaataaattactttgtataagcctcatgaaacagaaaagccttttaaaaatgaagaaaatccacacgaaggaataaaagacatgtatgaaacactaaaataaaaggtgaacaaatgtaagaaccaacttacaactttaaacttttgttttccctctcataagtaatgttttagcatgtatttttaaaagtatactttgacagcaaaaagtggtaggtctagttttactcagataaaaagactccatgattaacttagcattatcccatcttataaatgaatactaaaacttaagtcagtgtggttcttggtcaaaagtaggcactagagacctctccttaaagcaactattttcttcagaaaaattttaagatctgtttaaagccataagtcactggactaaagaaacatataggccgggcgcggtggttcacacctgtaatcccagcattttgggaggctgaggcgcgtggatcacgaggtcaggagatcgagaccatcctggctaacatggtgaaacctcttctctactaaaaatacaaaaaattagccaggcatggtggcaggcgcctgtagtcccagctactcagggaggctgaggcagaagaatggcgtgaacccaggaggcagagcttgcagtgagccaagatcgtgccacagggcgacagagcgagactccgtctcaaaaaaaaaaaagaaatatataaactaaacaaaactatagtcatgcatcacttaatcatgaagatatgttctgagaaatgcatcattaagcaatttcatcatgtgaacaccatagagtgtacttaagcaaacctagattgtatcacctactatatacctagactctatggtatagcttattactcctaggctacaaacctgtatagcttattactgtacagaagactgcagacaactgtaacacaatatatgtatttgtgttatctattttttttaatgttttaatttttgttttaacaaaagactgagtctcgctctgtgacccaggctggagtccagtggcacaatcatagttcactgttacgttacttcaaactcctgggctcaagtgatcctcccacctcagcctcctgagtagctagaaatacaggtgcatgccaccatcccagctaatggtgtgtgtgtgtgtgtgtgtgtgtgtgtgtgtgtgtgtgtagattgagactcactatgttgcccaggctggtctcaaattcctggcctcaagccatctttcagacttggcctcccaaagtgctgggattagaggtgtgagccaccattcccagcccttatattgtgtgtacgtaaggtttagaaatgtgtatctaaacaaatataaacatagaaaaggtatagtaaaaatccaatataaaagatttaaaatggtacctacataaggcatttaccatgaatggagcttataaaactagaagttgccctgggtcaatcagtgagtaagtggtgagtaaatgtgcaggtctagtacactacagaagactttataaacactgtaaatataggctacactaaatttatttttaaaaactacttttctttgttcaataagaaattaacctcagcttactgtaacattttaactttttaaacattttaatttttaaaactttttgactcttttgaaatcaaatttagcttaaaacacaaacacattgtacagttgtaaaaagatattttctgacaggcacagtggctcacaactgtaatcccagctacttgggaggctgaggcatgagaattgcttgaacctgggaggtggaggttgcagtgggccaagattacaccactgcactccagcctgggcaacagagcaagactctgactccaaaaaaaaaaaaaagttagaatggtgatcattaaaaaataaggaaacaacaggtactggagaggatgtggagaaataggaacacttttacactgttggtgggactgtaaactagttcaaccattgtggaagacagtgtggcaattcctcaaggttctagaactagaaataccatttgacccagccatcccattactgggtatatacccaaaggattataaatcatgctgttataaagcacatgcacacgtatgtttattgcagcactattcacaatagcaaacacttgcagccaacccaaatgtccaacaatgatagactggattaagaaaatgtggcacatgcacaccatggaatactatgcagccataaaaaaggatgagttcatgtcctttgtagggacatggatgaaactggaaaccatcattctcagcaaactatcacaaggacagaaaaccaaacactgcatgttctcactcataggtgggaattgaacaatgagaacacttggacacaggaaagggaacatcacacactggggcctgtcatggggtgggggagagggaagggtagcattaggagatatacctaatgtaaatgacaagttaatgggtgcagcacaccaacatggcacaggtatacatatgtaacaaacctgcacgttgtgtacatgtaccctagaacttaaagtataatttaaaaaaaaaaaaaaaagtccaggtgcagtcacgcacgcctgtaatcctaacactttaggaggtggaggtgggtggatcccctgagctccggaattcaagactagcctgggcaacgtggtgaaaccctgtctctactaaaaatacaaaaaaattagctgagtgtggaggtgcacacctgttgtcccagctactcgccaggctgaggcaggagaatcgcttgaacccaggaggtggaggtttcagtgagccaagattgcaccactgcattccagccagggtgacagagcaagactctgtctcatttaaaaaagacacacacacacacacacacacattctaaccgggtgtgtggctcatgcttataatcccagcactttcagaggcccaggcggggggccacttgagtccaggagttgaagaccagcctgagcaacacagtaagacctcgtctctacaaaaaaactaaaaaagtagccaggtgtggtagcacaagtctgtagtcccagctactcaggaggttgaggtgagaggatcacttgagcccaggagtttgaagttgcagtgagctatgagcacaccactacacttcacctgtctcaaaaaatattttttttcctttctctatatccttattctaaaagcttttttctctttttaaaattatatatttttcaaacttttttgttagaaactaagacacaagccagtcccggtggctcacccctgtaatcccagcactttgggaggctgagtcaggcagatcacctgaggtcaggagttcgagaccagcctggccaatatggcgaaacaccgtctctactaaaaatacaaaaattagccagttgcagtggcaggcaactgtaatcccagatactcgggaggctgaggcataacaatcatttgagcctgggaggcggagtttacagtgagccaagattgcgccactgcactctagcctgggtgacagggagactctttttcctgagcttacacagctaataattactataaatcaggattcacaccctgtctccaaagtccacattctttcattacttacacaaacggatttgaaaactggatataaatacttagtcataaatgctcacaagctcaaaacacctgagatatcacctaatccaactcctttattttgtatatagggaactcaaaaagactaatctattcatcctaaatatcctattattttctaagatagcagttctcaaactttttggtctcatgacactttatttatttatttatttattttattttttgagacagagtctcgctctgttgcaggctggagtgcagtggtacgatctcggctcactgcaactccacctcctgggttcaagcgattcttctgtctcaccctcacaagtagctgggactacaggcactcaccaccacgcccagctaatttttgtatttttagtagagacagggtttcaccatgttggccaggatgatctcaatctcttggcctcatgatccacccacctcaacctcccaaagtgctgggattacaggcgtgagccaccgtgcccgggcaacactttacattcttaaaaagtattaaggtccccaaagactctttatctatgtggattatatctactactgcttattatattaggaattaaaactgagaccttttagaactattaacccacttaaaaataataaactcaatatataatataaataacattttttgaaaatgattatttttcaaaaccaaacaataacaagaagagtgccattatttcatatttttgtcaatctctttaaagtttggcttcatagaagacaactgcattctcatatttgcttttgcattcaatctgttgcatatattggtttggctgaagtatataaagaaaatccaccctcatacagctatgcagtaggaaaggaggactgcacagaccccatgaaaagctctcatgggcccacgttcttttttttttttttttttttgagacagagtctcactctgtcacccaggctggagtatagtggtatgatcttggctcaatgcaacctctgcctcctgggttcaggcaattctcctgcctcagtctcccaagtacctgggattacaggcatgcaccaccgtgcccagctaatttttgtatttttagcagagatggggtttcaccatgttggccaggctggtcctgaactcctgacctcaagtgatccagccgcctcagcctgtgattacatgcatgtgccatcgtgcctggcctccctcccaaggtctttaggttatacttttaacaacgattgctttaaagtttatactcctccagccatctttcctaaggacttgaagaaactaaggtgaactgacatagatctgttagaaacgtgaaaaatctgctttatactgggcacttccctaacctataatctcccctagaaatctctgaaatctactccagatgtatatggggcacaaagtcaaccctatttttcttataatcttttgtaaatggcaacatagtatgagaaaaaaaatcagtctagattgcagcagcctactgcaatagaaatgagaatatctgggcatcagcacaaactaaagttacagaaaggatggcaaacagttcctgtaatgagccaaatagtaaatattttagattttaggggccatgtcgttgatgtaacatgtatgattatccttatagtgtgaaagtagccatatacaatatataaaggaatggtagtggatacattctagcacaattttatttagatctgacacttaggccatggctagctgaattctgttttaaacaaaactgatcaacctcaacaatacagtgactaaaacaaagccattttataaaatcagatctcttttcttatttacaaatggattttactccttgtaaacccttgtagaagcatactttctctcaatgaagaaagaggaggaacaatgaataatttgtaggaactttcaatcaataattaaaagctattcaaatacctagaaacatgtaattaggaaagggcaatatattcttttttttttttttttttagatggagtctcactgtctcaccaggctagagtacaatggctctatctctgctcactgcaacctctgcctcccaggttcaagcaattctcctgcctcggccccccaagtagctgggattacaggtgcacgccaccacgcctggctaatgtttgtatttttagtagagatggcgtttcaccatgttggccaggctagtctccaacttttgacctcaggtgatccacccgccttggcctcccaaagtgctgggattacaggcgtgagccaccacacctggccagaaatggcaatatattctacagaatgacaaaatatcttagaataataactttgatagtcagtaaaatgtaacacttaaagatatagagaaattatcattcttggtatttattccttctagtcaattttttattaaataaatagctatataattatacagtattccttctgagtaatgaaaaagttcttaaaattcaaaaaacatacaccgtaaatgaaactaatagattttaatgcattaattacttgaaatgtaaattttcctcagaaggtacaaacataaaactccaaaaatagttagataatccacatattggcagaagatgttcataaacaacatagctagcaaaggattaagaatgagactacataaagaactcccacaaaacaacaagaaaacacagatcaagattatggtgatgtagcattttaaattcatcaaagtgacaaatttttaaactccagccataccacgtgattaggtgatgtgaagcaatgagaacttaaacactgctggtgatatgtaaactgatacactactttagaatactgtattgtattggaatacgatactttggaaaagaatttgcattatcttgtaaagttcaacattttcaccttataagtcagcaattctacttctaggaatatatgcagaaaattcttgaacaagcacaaaatgtatacgaaaatgctaattaattggtaaataaatagtcatgtcatgcaatacattacaattgagaaaatgaacaaaactatatgggtcaatgtggatgaatctcaaacagtaataagcacaaacagtaattaacaaaaaaatgcattcagtatgccacatttaccttaagtgcaaacataaaaaataaaactctttattgtttagagttatatacacgtagtaaaggtatagaaaagacaaaagacaacaccaaataaaagctagtggtgttgggggtcaggcgaagaagaggagacaaagcaattatagaggagtaacccaatttcataaacagtgatcctttttgtatgcttagagtatttcaaaaaagaatttaagctatatataaataactaaacttactttggcttaatttaaaaaaaaaaaaaaaaaaaaactacattcttccaaacccagtttttagctacctgtaagattagcacagggcagacatcacccagagcttttctgtttactcatccaccttacgttgctaaaacaactgttcatctttgaatatagtgcgccaccttgtgttcaaaagcttttaactcatataaaattctgagacccatgtttgtaaacagggcttcctcgaaaaaaaatattaggttggtgcaaaaataattgcagtttttgccgcaactactttttcagcaccctagtataaattcctttatgctgtggcaatagatttaccattataaagataagtacatgtaaaaacaacattagaaaaaattattttgattctaaagaaattacaaatgctttatttctattgataatctttttgagctttcattttgctgtactttcagaagataacttgccttttttccttgattttaagtatcgaaattttttaaatgactaaaattcaaaaattatagatatttaaaatgctacaatacgctttcataaagaaacttacctttgaatgagtgattgataaagtgtctacccatacacgccagccaccccactcatatttgactgcatggtaaagcaggattctgaatatggcgtataccatttctgttatcttttgctcatctgaattcttaggattaaaatagcagagagaaagcatccattcttgccacacagagcattgtagcaagctcctgaaaattatgagagggtactaaattactgaagaaaaaaaaattatctaaaataaatctaaaggtttaaaacaaaataaccctgcccctccctttccccccgaaaaagaaacacatttagttatacattaagaacaattcgacaatgtggtactaaaaattctaacttaactatgtggtacattatttacatactcttaataaaaaaaatagaaaaatcatttcacagtatttttaaagcaatttttcttagataaaatgggcttatacaaaagtacatttgaatactgcaaataaatgctttctgattcagcttacctcctgttttctctactgttattaaaaagtttaatcatgtcagaaagaaaggctctgcgaacctccatgctctctgggcactggggagaatttcgaagtagggtcgcaattacttttagtatctctgtaagacagtttataaataagtaaaaaccaaactcaacaaaaaactcatgatagaaggtcatccatctattgcaatttctttagtttccctaacacaaatgtctaccaaaaacatcctcttctgttattaaaaaaaatcacctctggaaagaaatgacaatacattcattagaaagcatttataaatatgaaaggaaatttctttcatgattcaaatgtgcaaaaataaagctgaactttaaaaggttaaaataaaacaagttaaattataaatgaattaaatgtcagtgaaactgcttactctctctgagatataccaaatagtaaagttgatcttaaaaacaagcaggccgggcgaggtggctcacgcctgtaattccaacattttgggaagctgaggtgggtggatcacttgaggtcaggagttcgagagcggcctggccaacatggcaaaaccccatctctactaaaaatataaaaattagccaggtgtggtggcgtgtgcctgtaatcccagctactcaggagggtgagacaggtgaatcgcttgaacccaggaggcagaggctgcagtgagccaagatcgtgccactgcaccccagcctaagcgacacagcaagactctgtctcaaaaaaaaataatgaaataaaataaaaaatactataatcaaaatctcagaaaaatataataaattcttagattcctcatcataatttatggtatgcacacacagtctttcatagctgggattataggcacctgccaccacgcctagctaatttttgtatttttagtagagacagcgtttctccgtcttggtcagggtggtcttgaactcctgacctcgtgatccacctgccttggcgtcccaaagtgctgggattacaggcatgagccaccacggccggcctaccatagagaatttttaaaggtgtgaagattttctttcataatcttaaaagtaaaattagacacaaaaaacccaaaggaaattaaaacctattcaacatcccatctccccagaaaatgcaaactaaactactattgtaatggtcttagcataaagctatttaaatctccagaatttagcttaaattaggccaggcacagcggctcatgcctgtaatcccagaactttgggaggctgaggcagttggataatttgaggtcaagagttcaagaccaccctggccaacatggcgaaatcccatctccacaaaaaatacaaaaattagccaggcctggtagcaggcacctgtaatcccagctaccagggaggctgaggcaggagaatcacttgaaccaggaggcagaggttacagtggctgagatcctggcactctactctagtctgggcaacagagcacaagactcggtctctaaataaataaataatctccagaacttagcttcttagcttaaattaaaacaaaaaaaaaaattcttttaaaaatatgcacttagaccaggtgcagtaggctcatgcctgtaataccagcactttgggaggttgaggtgggaagattgcttgagcccaggagttttagaccagcctgggcaacataggcaaaataatgacatcacgtttctctgaaagctgaggaaaattaaacctcaaagccacgtgctttgaaaattagcactggagtaccaaacacacaaatacacctaaccacataaaatgtaattaaattttaaaactctacaaactaataattttaataacatgatcttaaaaagcaagatgaaaaaggtatactttatacaagtgcttaagaattctaaatatcaaaagaaaagactgtttaacaagactatcttcataaacaataaagaagacatattgttctattccaaatttggtatttttatattcacagtaatttaagataaaactaccccaatggttcttgtaattctgcctgacatcactaaatagcacaatcaaaattttgctgaaagtctgaacatatattacatcaagaccttaagcaaacaattcttcaaaacctttatataagaatttccacataacttaaggttgattcgaaggaatactcaatataaaacccaaacaaaactagtataatatcatcacccttaatgaaacattcatctaacaatctgtttcaacaacatcaattttaggttgttcacagtgactttctttttaagtagcaaaaggtagtttttgttaaagtatataaaatacatacgagggttttgtatcttcactgaagaatcaggatctggatgctgtttatgtatcacctgagtaccaatctgttctataagaatctacagaagtaaaacaatggattacattagcaaatcactggattagcatcactattaatgaactttaagtgcatcactattaattaactttaagtacaacactaatcaaaatatagtatatttttagtccaatattgtcatgctaaataatatacttctaaaataactacagcattattactctatgttttcttaattataaaatgagacatcaaatagttaataaaatggagggaacatttaaacagaaataacgatactgtttagaaattcacagattaattatagatttctaaaaatgcagccacatctccttatatcatttcaaagctgtacattacaaacttaaatggtctggtcagcatggtggctcatgcctgtaatcccagcactttgggaggctgaagtgggtagatcgcctgaggtcaggagttcgagaccagcctagccaacacagcaaaacccgtcactactaaaaatacaaaaattagccgggttaggtggtgtgcacctgtaatcccagctactggggaggctgagacaggagaatcacttgaacccgggaggtggaggttgcagtgagccaagactgtaccactgcactccagcctgggtgacagagtgagactctgtctcaaaaaataaaataaaaataaatgatcttatttacctacacaatgttaagaggcatttttataataagaaatttagaggagtaaatcctaagtacattcctacctcaaacagcacattatatgtggtcattgtgattaaatttgtctgaagcatgagcctttcagctagcaatgaaaacaatccatgtccaagcatgacttctgctttcctcctgcaattacacaaaaagaaatcatcaaatgtagagcttttctgtgctctacttaatatgcatgctggatgaaggaaacacaaaatactttttcacattacaaacaattcccaactcaattactctcccaactatcttcaatctagaacttttaaggccacaaaacctttaagcagagaaatgctaactatataagcatagccgaagttaaaaattaaaaaaaaaaaagacaagtgtgcctatgctacagcacagcaaaaacctcctccaaaatcttcagagcagttatttatttaacgaagttgctacaatctaccagcactaacttagtctcccctggggatgatcatctaaagcacaataaatacttaagtagaaaaacaatgtggagaaaaagtagaagaaatgtaatataattttttaaaataaatactatgaaaacatatataccaaaattaaccttccaagcataaattcagaaactaaaggatcacaaactttaattttacccttggggtcagcaaagcttttctgcaaatggccagggggtaaatattttagaatttgtggaccaggtgatttctgtcacaactcaacactgtccttgtatcatgaaagcagccacagatgatacacaaataaattattgtggctgttttccaataaaactttatttacaggtggctaactggattcctaaagacttcagtttaccaacacttgttctacccccaaaattttctttttaaaataaactacttctggtacaaagaacaagaggtagaacatgaatatctgtattcagctaagaaaataagcgtggaagtttcagttttgagttacgcatacagcagaacacactatgtgacaaacatccaggttatgtattactttataatacagataaagcaaaaatggtgtgagtcacctgaaatcaagtctccatagcttcttgaatgcaagctgtccaaactaattctcataattcacattaaatacatgaataatttaaataattttatgtacaaaaaaattaatcctgttcacttaatttttaaaatatgtactagtgggattacatttatacagcaatttatgaataaaaataaaagaaaaactagaggactatagaacaaaattactactgcaaagatttataaaataaataagtagaatacaacagtccatcttagatttcggcatacttactttggggccagatgttttaaaaaataacccattgccttaagagcttgtaccctgattccttcacttttcgatgccagaagtttgtagataacactgaatgaataaaaatttaaaacaaactattttgagtataatttttaaatggaaaggtttaaaatatatacttttcatattattataaatctatttcaaataatatggaaggaaatttaatatagatttctgtatataaaaaatctgcttatctcaggctagagttcctttcaatgaaaactaagaaatgagaagaaattggaatataagaaatgaggtgacttttccatgcacatacttatatgtaacgtgtgtatcaagctagctttcagatacttttttccttctgctacaggcttgtaaatgttctgaaggttaccaacttgttattttaagtcagtagaaagaaagcatttctaatggtagcacatatttaaatttctaaataattgtcgccatgaaaaacaagacagtaggctaataataaatgattatcagaaataattacaaaagtaaaaagatttacaaccaaagaactgctaaaaataaatttctcattcaattctcaaaaattatatagtaatctaatttaatttttaaagatctatgaggcagctggatgcagtggctcacgtctgtaatcccagcagtttgggaggccaaggcaggcagatcacctgaagtcaggagttcgagaccagcctagccaacatggtgagaccccatctctactaaaaatacaaaaattagctgggtgtggtggcatgtgcctctaatccagcttctcgggaggctgaggcaggagaatcgcttgaacctgggaggtggaggttgcagggagccgagatcatgccactgcactccagcctgagcaacacagtgagactctgtctcaaaaaaaaaaacaaacaaacaaagatctaggaaggccttctgattttagtataagtaaagtataatgcaactgaaattaaactgattcattacagcattcccttcctcataaacatttagaacaagaacagtaattagaaactcttataattacttataaaaattaaggatatcagtatcctcctagatcaaaattttggtgtttagtaagttagaaaacattctgaacaaaaaggaaatatcttcaacctctagtgatcaatagaaaagcaggtatataaaaaagaagtttgattccttttaaaacatgaactaaaggcatccaggtccatatcacattgtaactgcataattttaattcaaatcttagtacaaaaacttaacagtcaatcattaggaaaatactaatatgttgtatgtttcttttcttcaaggatttaaattcagccaaataaaaattaaaccttttaaaagaaatattaatataataccagtttaaaatcacaatagttttttgagtttttttccccaaagatggcagatttgagggctttagcatttctcagccacttagaaatagcaagatagtatataaaaatcaactgtgagctttaattcaggaagaaaagcaggactccaccagaatcatgaaaggcaccctagttcccgagagcactttgtttctcccaagacctggagctaactgggaaagaggtatggagatactgtgagggaaagacaccaggaaaagttgcagggaccaacagcaggatgccattttgaattcaagcacacacaattcaaactggaaatctggcagtgtggctgtgcaggcatgccagagattagagtccctgctttggagccagaattgtgaaaactgcctcagcagtaggtgttataattgtactctaccccgtcgcaggcctggggtgggaggaaagctgctacagctgcaatatctcctggacaacaagacttggcaggcagaggcagcttggtgacctggaaccagtctgcatgtgtcattgctgggtgctccagcctgctaccctgacactgtggtgcagcagggccctctctgctccactctcaggcagaaatccagacattcaagccaccccacccttcgtagacacagatcatagcactggaccctctttgctccatgcccaggcagatctccaggcaactgacgcacccactcccacggactagcaacctgagccctattccacgtggtgcagcaagatgcacaggcagatctccaggcattaaatgcacttgcttgcccagattggcagcctgagccaccccactcttcctttgcagagatccaggttcagaggggtcctctatgcttcatgctcagggagatctccaggcattcagagcagctgcttggctactccagcagcctgagtcacctcacccctctgtgcaaagatcttggtgcaagggggaacctctctgctccatggccaggcagatttccaggcattcagactactcagtcacctggaacagcaccctctgcaccattcctatgtagagatcctggtacagggggccctctctgtttcacacccaagcctatctccagggattcaaaataactgcttgcctggttcagtaccctgaggtgtcccaccattccggtgcagaaatcctggtgtaggagaccctctccatttcacagccagtagatctccaggaatctggaaaacccatttttcctggattaggagtttaggccatccccattcccatgcagagaacttggggctgaggtttcccatcactattttttgtgcccttctccagagcatagaagggagctcagaccaccatgcactacacacatcagcttattgcctgaggcaacagagaacttctcccactaaacaagggtcaagtatatacccagccacattggccaaagcccactcttactcataactgccatccaatggcttgtaggttgaactgcacagcccaatataaaacctgctgacggaagtgtataaagctacagaagcaaagccaaaaggccctacccagcattctctatagccacaccccctatgaagacagggaaagagaaagaagacaaaaaaataataataacattacagagaaagaaaaaaatcttaaaagcatgaaaattattacaaaagttacaagtgtcagcatctccaaagaaggaaccaccacaaaacttcagacaccatgaaaaatctgagtgtggtgacaccatcaaaggatcacactggctctccaaccatggtccataaccaaaatggaaactcagaagaattgacaaataaataattcaaagcatggactgcaaggaagctcaatgatatccaagacaatgttgaaaattaaaagaaacttctaaagcaatccaggagatgaatgggattaaacatcttaaaaagaaatcaatcagagatcctggaattgaaaaactcacttaagaaattacaaaacaagactgaaagttttatcagcagactggacaaaccaaaagaaagaatttcaaagcctgaagaccgatctttcaaatttacctgaacaaaaattttcaaaaacaggttgaaaaatgaaaaaaagtcttcaagaaatataagactatgcaaagcagccaaacctataaattactggcattactgagagagatggataaaaagaaaacaacctggaaaatatatgtgaggaaataattcaagttgctagagatatagacatccaaatacaagaaatctagagaacatcacaagataccatacaaaatgaacatcaccacagcatatagtcaccagactgcccaagatcaatattaaagaaaaaatcttaaaggtagccagagaaaaaggtcagatcacatacaaacagaaccccatcagcctaacagcagacttcttggcagaaaccacacaagccaggagacattgagggcttattttcagtatccttaaaagaaaataaatttagccaagaaatttcatatccacccaaactaagcttaataagcaaaggagaaataaatgtttttcaggcaagcaagcatcaagggaatttgttacctacagaccaaccttacaagagatccttaagggagttctaaacacggaaatgtaagaacaacacttactaccacaaaaatacatgtacgtagcttgcaaaccttataaaacaaccacacaaaagaaattacaaagcaaccagctaacaacttcatgataggatcaaaatctcacatatcaatattaactatgagtgtaaatggtctaaatgcccccactcaaaagacacagaatggcatattggataaaaaaaacaaaactcatccatctactgtctttaagagacctatttcagctgggcgcagtggctcacgcctgtaatcccagcactttgggaggccgaggcaggaggatcacgaggtcaggagatcgagaccatcctggctaacacagtgaaaccccgtctttactaaaaacacacaaaaaaaaattagccaaccatggtggcgggcgcctgtattcccagctactcaggaggctaaggcaggagaatggcatgaacctgggaggcagagcttgcagtgagcagagatcgcgccactgcactccagcctgaatgacagagcaagactccgtatcaaaaaaaaaaaaaaaaaagagagacctatttcacatataacaccactcataggctcatagtacagggttggggaaagatctaccacacagagagaacagagaaaaagagcaggtgtcactattcttatatcagataaaacaaacgataaactatcaagagttaaaaaggacaaaaaatggcattgcataatgaaaaatagttcaattcaacaagaaaacttaattaccttaaatatatatgcacccaatagtagagcaatcagatatataaaacaacgactacgagacgtaggaacagacttagacagtcacacaatattagtggtggatttcaacaccccactgacaggcattagacatgccatggaggcagaaaactaacaaataaattctggacataaattcaacacttgactaattggacctaatagacatctatgggatactccacccatcagccacaggatacacattcttctcatctgcacacaaaacatactccaagatcaaccacatgcttcgccataaagaaagtctcaataaattcaaaaaattgaaatcatgccaaccatattctcagaccacagtgaaataaaaatagaaatcaataccaagatgatctctcaaaaccatacaattacatggaagttgaacaacttgctcctgaatgacttttgggtaaacaatgaaatgaaggcagaaatttaaaaattttttgaaataaatgaaaacaaagccacaacataaccaaaactctaggatacagccaaagcagtgttaagacgaaactttaggccaggcacagtggctcatgcctgtaatcccaacactttaggaggtcaaggtgggcagatcacttgagagcaggagttctggaccagcctggccaacatggtgaaaccctgtcttttccaaaaatacaaaaaaaaaaaatagctaggcatgatggtgggcacctgtaatcccagctactcaggaggctgaggcaggagagtcacttgaacctgggaggcagaggttgtagtgagctgagactgagccactgcactccagcctgggtgacagagcaggactgtctcaaaaaaaaaggaaattttatagcacatagcactaatggcctaagtcaaaaagctagaaagatctaaaattaacaatctaacatcacacctagaggaactagaaaaacacaaactattaaccccaaagctaccagaagaaaataaaaaataacaaaaatcagagcagaactaaacaaaactgagaccaaaaaaaatccatacaaagaaccagcaaaacgaaaagctggttatttgaatggataaagaagactgatagaccactagctagattaaaaaaaaaaaatccacatacaagcacaatcagaaatgacaaagttgatgatacaaccaatctcatagaaatacaaaagatcctcagagacaattatgaacacctctatgcacacaaactagaaaatctataggaaatggataaattcatagaaacacaaaatcaggaagaaattaaaaccctgaacagaccaggattgagctccgaaactgtatacctgcttaaatttggcagtgaatttttctggtccaggaattttttttttttttttggttacctactaaccaaaaaaatcctagatgaggtaaattcactgccaaattctagcagatatacaaagaagaggtggtagcaatcctactaaaaatattcaaaaaacttgagtacaaggaactccaccctaacttattttacaaagccggcatcaccctgataccaaaacccagcagagacacaacgaaaaagaaaactacaggccaatatccctgatgaacacagctgcaaaagtccccaacaaaatactagcaaaccaaatccagcaacacatcaaaaagttaattcacgatgatcaagtaggcttcatttctggaatgcgaggttggttcaacatacacaaatcaataaatatgattcaatacaaacagaattaaaaacaaaaccatacatttatcccaatagatgtggaaaaaactttcaataaaatccagcatctcttcatcataaaaatcctcaagaaaccaggcatagaaggaacatacatcaaaataatgagagccatctagggtaaacccacagctaacatcatattaaacagacaaaaacaggaagcattcctttgagaactggagcaagaaaagggtgcctactcttaccactcttattcaacatagcactggaagtccttgccagagcaatcaggcaagaaaagggaacaaaaggcatccaaataggacaaaaaaaattcaaactctctctcttcatgacaatataattctacaactagaaaaccctaaagactcctccaaaaggctcctgtgactgattaaatgacttcagtacagtttcgggatataaaattgatgtataaaaatcagtagcatttccaaacaacaaccttcaagttcatatccaaatcaagaaagcaattccttttacaatatccatgctcaaggattggaagaatcaatattattttaatggccatactgcccaaagcaatccacagattccatactattcctacaaaactacgaatgtgatttttcacagaactagaaaaaaactatactaaaatacatacggaaccaaaacaagagcccaaataggcaaagcaatcctaaacaaaaagaacaaagctggagtcatcacaatacccaacttcaaactatactataaggctacagtgaccaaaacagcatggtactggtataaaaacagacacatgtgtcaatggaacaaaatagagaacccagaaacaaagccacctacctacagccctctgatctttgacaaagtagagaaaaataagcaatggggaaaggactccctattcaataaatagtattggaatagctggttagccatatgcagaagaatgaaactggacccttacctttcaccatacaaaacttggccaagtgtggtggttgacacctgtatcccaacactttgggagtctgaggtgggtggatcacgtgagcccaggaatttgagaccagcctaggcaacgtggtgaaactctgtctctacaaaaaacgcaaaaatcatctgggcatggtggcacatgcctgtaatcccagctacctgggaggccaaggtgggaagatcgcttcagatgcagaggcagaggctgtagtgagctgtgatcgtgccactgcactccaacctgggaaacagagcaataccctgtctccaaaaaaaaaaaaaaaaaccttttagctcaagatggattaaaggtttaaatgtaagccatcgaattagaacaatcctagaagaaaaacgagaaaacaccattctggacatcagccttgggaaagaatttatcactaagtcctcaaaagcaattgcaatacaaacaaaaattgacaagtgggacccaattaaactaagcgcttaggtacaaagaaactgtcaagagagtaaacagacaatctacagaatgggaaaatactgacaaactgtgcatttgacaaaggtctaatatccagaatctataaggaacttaaacaattatacaagctaaaaacaatcccattaaaaaatgggaaacgccacaaacagacacttcttaaaagaagacatacaagcaggcaacaaacatatgaaaaaatgcttaattaacatcgctaatcatcagcaaaatgcaaatcaaaataatgagataccatctcagaccagtcagaatagctattactaaaaagtcaaaaaacaactgattctggcaaagctgcagagaaaaggttggtgggaatgtaagttagttcagcctctgtggaaagcagcttggagatttctcaaaaaactttgaactaccattcaactcagcaattttattaccgggtacatatccaaaataaaataaatcattctaccaacaacacatgcactcgtatgtgtattacagcactaatcacaacagcaaagacatgaaatcaacctaggtttctatcaacggtagattggatagagaaaatgtaatacatatacaccaaagaatactacacagccataaaaataaaccaaaatcatgtcctttgcagaaacatggatgcagctggaggtcattatcctaagtgaattaatgcaggaacaaaatgccaaatatcacatcttctcagttataactaggagctaaataatgggcactcatagacataaaaatggcaataatagacaatgaggactacaagaaggagagaaggaagggggaaaaggttgaaaaacttaactattgagtgctatactcagtacttgggtgacaggatcaatcatacctcaaacctcagcatcatacaatatacccatgtaacaaacctgcacatgtaccccctgaatctaagataaaggtgggaattattaacataaatacataataaataaaaataaaaactgtaacacactaagatattttaacgtatcaaaaaactatccttgctatagcttaactcacaaatatctacggttaaaaatcacaatagggctgggcgcggtggctcacacctgtaatcccagcattttgggaggccgaggtgggcggatcacctgaggtcaggagctcgagaccagccagaccaacatggcaaaaccctgtctctattaaaaatacaaaattagttgggtgtggtggcacatgcctgtaatcccagctactctggaggctgaggcaggagaatcgcttcaacccgagaggcagaagttgcagtgagctgagatggagccattgcactccagcctgggcaacaagagcaaaactctgtctcaaaaaaaaaaaaatcacaataattttttcaaaagataaactctagacattgtctatgtactttcaaataatgttttattaggattaataacacaagaagatcaaaagaacctgaaattattctatgaacctaatagttatcctacaaaaaatttttaaattttgaacacttctaaccaaagcagaatcaaactagtttatctgctaaacatcagcagtaaattttgtaaaagttaaatgggcctattttgctttttgaccatagttttgttcttatttaatgcacaaaaaaatactttacacattaaagggaggaaaaatcctgtagtgcttcaatgaaatttatatatttatctaatcataaaacaataaataaatgtttattctctatttggaaataaagaaaagtgtaagggagataacaaaaataacccatgaagaacaatattcaaatctggaaatattttcatgcaatctatttgactatgcttacatgtttaaagaaatagatatggatatttttgaattgaaatatactatggtatgtacagtatattttcaatgcagaaaatataattcaggcaagagaaacgcccaaaaagataatctgaatagtaacatgatttcaatctgctcacagatattaaaaatatgataacagatcattaactagactcaaatattaaaaatttataacaatttaagcagggcatatgatgagactgacactgagtcagaaaacacagtcacttctaaggaaggataagtcttccaagctgttgacctaagttcaatatcagagctaatgtttaaatgatttcatggtagagaaaaatttatattaaataactgaatgtgaaaatttctgtcatttgatgaaaattaaattgtcattccaatttggaaatgttactgatgactatgacacagtttggcatgcctatattatctgtcaccaataaagaccatcccccctccaattttctccacttgagactgtgcttacacccccatttaactttcagttaatatgaaaccttttcttaattcacctctgtttttttcatggtggccttcaaaaattatggttctaggccgggagtggtggctcacgcatgtaatcccagcactttgggaggccaagatgggcagatcacttgaggtcaggagatcaagaccagcctgggcaacatggtgaaacgtgtctctactaaaaatacaaaaattagccaggcatgggggtgggcgcctgtaataccagctactcaggaggctgaggcaggacaatcacttgaacctgggaggtggaggttgaagtgagccgagattgcaccactgcactccagcctgggcgacagagtgagacgctgtctcaaaaaacaaaaaaattatgttactgtatactaagtaccaaggtaatcataaacaggtactgaaattatgtatcaatgtctagtttgaattttctgtctctccccgaccttccaccatctctctttttaaatcatcgaaaacaaaaatccataatttaaaaaatgtaaatactgaatttttggacccaaagaatactttcaaagaactccaattagattgaagggaactatccatcattcaaaaatcattttaaactacataactaatataaacatttaataaatatttctacccagtttaagtaactgaactgaatttaaatgggactaaatcttcacatttctatatactagtccaaattagaaattttttatttcttcacagtaataaataaaagactgagaaagtagcaaaaattaaaacatactataaaagcaaaatagggggaataatgatgctaacatggaagtcagcattttccctccatgaaaaaagacaggaataaaaccgaaaaaaattttcactgaaaaatatttattgttgagaaattgctagaaattcaggtaagaatatcaggagtcagtggccttattaatgagactactcctgtcattaccaccccagtttagttggtaagaactgtagttttaccatttgggggctggcagtaaaaagtagcactgttgctttcaaacagggcaaacctattcagggtaagaaatgaaaactgcagttctccagctaaaagtggcagacttggttacgaatcaatgggagaaaccagcagctttgctagatcagagatacaggcacaattcagggggaacagcagaccagttagatatttactagggagatattaaaagagaaccatagaaagattgagataagtactccacacagacatagctgattgagaaagtacctatatccaggagacacctgggtcactaactgaaaaagggaaggcaagagagactagataagtagccacaactttgaatgcaatccctaaaaatatacagatcaacacagtgggcctaagggctgaaggaattttatcagaacctgtagctaaatcattgactgaactctaagatatatagaaacatggaaaaccctaagagtgctatggaaagaaaaagggaaaaagtaaaaatactgggcagagaaaagtcagagctgtagaccgtggagaaaacacaatctgcaaactaaatgaggcaaattatttaaaaccaaacaaaaaccaacaaccatagaaaaacaaaaaaagtctagagttgcccagttttcaacaaaaattactatatatgcaaaaaaacaaaaaagagtataacccataatcagtaaaagagcaataatcaaaaataacttgtaaggtccaaatgttagattcagcaaatatttttaaggacttgtaataaattatattcaataaatgaaaaaatagtatgttcaaataattgaatgaaacagattaacaatgagttctcaaaaaagtataaaaagaccaaatggaaattctagagataaaaaagtaccatttaaaaatcaaggaattcactataggcattcaacaggagactcagatggcaaataaagaatctgtgaattcaaagataaatcaatataaattatatagtctaaaaaacagagaaaaaaatgggaacacaaattattcaacctttagacactgtaggacaatacagtgttccaacatagatgtaacaagagttccaaaaaaaaaaaaaaaaggcacagaaaagaaacatctgaagaaatagggataaaatcttccaaaatttaatgacgaaacatttacttacagattcaaactcaataaaccaccgaagtgaaagtaacaaagtgagtcaccactaggccgggcacagtggctcatgcctgtaatcccagcacttaggctgagatgggcgggtaatttgaggccaggcattcgagaccagcctgacccacacagtgaaaccccatctctactaaaaatacaaaaattagctgagcacagtggtacatgcctgtagtcccagctacttgggaggctgaggcacgagaatcacctgaacccaggagacagaggttgtagtgagccaagaccatgccactgtactccatcctgggtgacagagggagactctgtctcaaaaaaaaaagtgaatcacaactaaacaaaccacagtcaaattgctgaaatccaaagacaatgaaaaaaaccttaaaagcatcaagagaaaaatgactgatgacatacagagcaacaacaatgcaattcattgctgtcatctcatcagaaacaatggagtccacaggtcagggagatgacagtcaagtgctaacagaaagaaaactgcaatttaagttcttatatccaggataagtatcctctaaaaatggaagcaaataaaagtattctgagatgaacaaagactgagaaaattcattgctagcaaatatgccttgtaagaaataataaagcccaccaagatgaaagaatatactgtaaaaccactaataaaagataacctttaagaagaaaactaaaatcaacaggggaattttgatccaaccaaatggagtcagcccaataaagcctctctgtcccaaatattaataaaattataggggaaaaaaacacaaaaatcaacttcccaagtactctgaagactaaacaaaagcaggtgcattgtgtaggggagttaaaacttggagaattactcatatggatagaagaatcatttttttcctttctctcttctgaatctgcccctgtttcagggctggatgtcagaagctcgggtggcaaaattctaagaaaaactatgcttccagttagagaaatctagaaattaggtcctagataggagaagtgtggggaagaatcctaaatagcagagagtaagagaaaagggttctctaaatctgtgtaaaaacctgtgataaccccaaactcacccaagagacgcatgggtgtgggacaaacccaaatcagaatagacacctttctaaatttaattaccatccaattctcagcctaattcctgaatgaagcatatgtatgtgaggaaaatacaaggcaaactagtctgtctccctggatcgaaggggaaaaaccaaagaatgaaagaaaacccaaagtagggtaagagaggtttgaaaaatgaagggacactggaaacatcatgcacagagaagaggtggaacttgcagccccacccttaccaggttgtctatttgctaaacaacaacaacaaaacatgtgttagaggattataacagggcccagagttatgctctaatgcatccaggacccacaatattcaagacacattagaagattacgcaacatacaaagagccaagaaaatgtgactgtttctcataggaaaacacaaacaacagatgtcaatgagatgagcaaaatgttggacttatcacacaaagactttaaaggagatactataattatgctttagaaaataaaggttaacaaagtctaaatgaattgaaaaagttctccaaaaagaaataataaatgtttgaggtgatggagatgctaactaccctgatttgaatattatatgttatatgcatgtattaatatatcacaatattgcatataatatgtacaattattgtcaatttaaaatattaaagaaaatagagttctcatccaaaaatgaaagcataaaagtgaaccatattgaaattttagacttgaaatgcatactatctgaaacaaaatatgcaagagatgggttcaatatcaaaatgtaaaacacaaagaaaaagtccataaatttgaagatcaagtttattatacatatcaagtttctatgcacaaactacaatctgaaaaaaaacaagactgaaacaaactaaacaaatgcttaaggagttgcctgactctatcagaagatctaatacttatttctttggagacccaaagtgaaaggagaaagatataagtgaagcaaaaattgaaaaaataagaaccggccgggagcagtggctcacgggccgggtgtggtggctcacgtctgtaatcccagcactttgggaggccgaggcaggcagatggtcaggagatcgagaccatcctggctaatacggtgaaaccctgtctctactaaaaatacaaaaaaattagtcaggcatgctggcgggcgcctgtagtcacagctactcaggaggctgaggcaggagaatggcatgaacccaggaggcggagcttacagtgagccaagatcgggccactgcactccagtctgggcaacagagcacgactccgtctcaaaaaaaaaaaaaaaaaagaaagaaaaaaaaaagaacctacaacttctcaaatttggtagtaatcacaaagaaaaccataatgaacctatgaaaggaggaagagagagatggatgcagtcaagtgtgcctgtagtcccagctactgaggagactgaggcaagagaactgcttaagcccaggagttcctgggcaacatagtaagaccccaattctaaaaaacaaaaacctaaagaaaatgtcttgaaagcaagtgcagaaatctagaacattatatttaacaaagaaagatttcaataaccacagatttctcattggaaaccatggacaccagccaacagaagaaaaacacaggaaagaaaggaaaggaaaaaggtaaggaaaaaggaaaggaaaaaaatgattacaaacacagaattctacatacaacaaaaatatccttggagagtgaaggtcaaataaatatattttcagaagaaataattaaaaattgtttctgtcaaaactgctcaacaagttctttttcagcagaagttcttctaaaggaagttcttcaagaataaacagcaaaagaaactgtaaatacctggataaaagtagaaacttttttctctcttcaattctttaagctatatataactagtgaaagtaaaactttaagctatatataactagtaaaagtaaaacttattaactgtctggaggcgcttatgtatatacagacataataaggacaattgaggcagttaaagggatctgagcagttccaagggttctatactttatttgaagaggtaaaatattaacactaggtagactgtgaaattacatacactggcatctctagagcaaccaccaaaaaagttacacaaagagataaactccaaactcaaaatataaattttgagaatatttttaaaattcaaataaaaacaacatagaaaaagagaaacaaggaatatattacactgggataaatagaaaacaaataaaatggtagatgaaaataattacaatatcaataattacattaaacataaatggtctaaacatactgtaaaaaacctgactttgtcagactggattaaaataaataaaacctacaactattctgtgtgtattagctaggtttttccagagaaacagaaccaagaggatgtgcagatagagagagagacagagattgatttcaagaagtttattcatgcaattatggaggcttggtatgtctcaactcagaagagtagaccagcaagctgaagatgtaggaaagaactgtattctcagtacaaaggcagtcagccagcctaatttccttcatccctggggcaggtcagactttgttttattaaggccttcaactgattagatgaggtccagacatattacagtggataatctgttttactcaaagtccaccaatttaacctatttatgtctagtgttccattattggaacactaagcttgtgggagttatttatatcctactgctcaaggtcattgccaagatttgattttccacaaaaaaaaaaaaaattgcaacctctggcataaatggcttaaatgttaatctcatcaaaaaaacactttcaggccaggtgcagtggctcctgcctataatcccctcactttaggaggccaaggcgggcagatcatgaggtcaggtgatcgagaccatcctggccaacaaaaattagttgggaaccaggccacacagcaggcggtgagcaccaggccagcaagcattactgcctgagctctgcctcctgtcatatcagctgtggcattagattctcataggagtagaaccctattgtaaactgtgcatacgaggtatctaggttacatgttccctatgagaatcaaatgataaatataatgcacttcaatcatcctgaaaccacccccaaccccagtttgtggaaaaactgtcttccacaaaaccagtccctggtgccaaaaaggctggggacctctgttttagaatttatgggccatatcatctctgttacaactctttgactctgttgttatagcaggaaactaaccataggcaatatttaagagaatgagagtggctgtggttatagcaggaaagtaaccacagacaatatttaaaataatgagaatgacagtgccacaacaaaattttatttataaagacaaatcattatagaagagtcagccaaagaaagcaataaaaataaaatagaaaaaataaaaatgaatatgatcgagagcaataatggaagggcagccataaacgggaagaagaccttatctactactactgtactagaagtaagtaaacaagaacgtgctctaaaatacacctttggggaaaaaagatggaagttgaaataattccctcctaataggtctaatgaagtagatgaggctgtcactgctgacaggaagagttgtaaaaatttagaattgtatctgaaggaacaaagaaatgtttaacaatgatagaagtatagatcatgaatttataataatttcaacatacaacactgcatgacatttccccaccagccaaggtttagcttagagtgtgcctacctagactaatctaggatcagaattctcaaaagcaaatctaacaggacaagggcagacgggagtttttgttagaaaccacttccagcaaatagccaggctaagaaggaagtaaacaatggcagatatagtatgacacactaggattaaaaaaaagcaagatcacaggacagaaggtaactatgaggctgaagagcattggaaagggcgatattagaaaaagaggagatagatggttttgattaaagagtaagattggaatttaaaatttatgatgtgaaaacatgccagtgataaaaaggtctaggtttttaaaacaggaatggataaattacaaagaatggcagtaagggtagcaaagttaaggaattaaaaaattacaaaatgtgaatgttaagatgagttagtcacaaggacaatgaagttattcacatgtagtgaaactgagataagactgtgaaccaaaaattcacacactaagactaaaagtataaagtatagactttccttgcccagactttcaatagaataattcttcttactagtttttaaatgtctatgatactatcttgcaattatttttttttttaaaagtggtaaaatcctatacagtaaatcacaaaatacactaaagcacatccacacaaatacaggttatatccacagaaaataaggttataaaattagatactctggcaccaaaaagaaaaaaatctgccaagcctttacataaacccttaaatcttttttctgaaattcagttattagataggaaatgtgtacaaagaaacaaacaagtatttataagcctcgtttgttttgtgttaatatggctatcatacgacctatccattacattcctaagtatggtatatactcaagataaatgaaaacatatgtccatacaaatacttgtacatgaatgttcatagcaagcttgttcaaagtaataattattagacagtggtgagggaaaataaagagtactttgtttgacagcaaaactataaataaataacaaactgtaaatttacctcttacaatgcttaactttatgtgtcaactgggctaggccatggtatcaagatagttggtcaaatatttttctagatgtttctttgaaggtattttttggatgagattaacatttaaataagcagattttttgtatgtggaccttatccagctgaaagcctaacagaaaaaagcctaactgccttggagaaagagaaaattcactcagcagactgcctttggacttgaactgcaacatcaacccttccctgggtctccagtcagcctgcctatcctatggattttggatttgccagcttccacaattgtgtaaaacagttgcttaaaataaatctctctcgtgagtgtgtgcatggacacccacgcacacactattggttctgtttccctggagaactctgaaaataaaccccttaagtataatgaataaagacactttttatcttatagagaatgaacattaaaaaataccaaataaagaatctgttatagaagatcaatgtgtgtttgagcctaggagttcaagaccagcctaggcaacatggtgagactttgtctctacaaaaaacttttaaaataagctgggcatggtggcacacgcctgtagtcccagctactcaggagactgaggaaggaggatcccttgagcccaggaggtcaaggctgcagtgacccgtgatcataccactgcactccagtctgggtgacagagtgagaactgtctcaaaaacaaacaaaaatccctgtgtgaatttattataactagataattaaattagtttctgtagctgatgattaagcaaaactagttgctaaacttttcttgcccactttctcattaaacaaaagattttaaacttccttatacgtaaaatagaggtattctgtttttgttgttgatgactgtaatggaccaaatgtttgcatacacccaaaattcttatgttgaagccctatcattagtatttggagagggagcctctaaggaagtaattaaggttaaatgcggtcctaagagtgggtccctaatccaataggagtaacgtcattgtaagaagagacacgagagagctcactcatgctctctttctctctctgctacatgacaacacagcaaggaagaggatgtaggcaacccaagaggagagtcttcaccaaacaccaacccgactggcatcttgatcttagacttcccacctccagaactgtgagaaaccaatttttgttgtgtaagccatccaatctacggtatttgattatggcagcctaagcacacaaatacaatgttgagtcagaagtgggaggtggaggaagtgacattttaaaggaaggatagagagcttgtcttggatttcaattgaacactatttaatactatctaggacctaaagataattctgctaaagaagtcaacaatacagtagctctataatagcactcaccatacaaaatattggaatcatttatctgtcttcacaaatcaaatagtaacaaatagtaacacagcctctataattaaagattcattgaaaaaaaatgcatgattataaatgggtcttaaatcttaactcatttcatgctataaactcatttcatatgtaagtttaaataatccttttcatatttaagaagctttcaaatatttccaaactaatcccttatatgaaatagattaaaaactcttaccgtaacccattcctttggtcaaaagcaggaatcatagagttagggtgttctgacattaatgcaacaagcagctgtaggacatccattagattgtcatcctataatcattttagaaattttttttaaaaaatgaggaaaaaacaacttagttgaataatgaatacttctgaaatagaaatttcaacattagaaatataagtagacatatgtgtgatatatacttatttttaacaaattatgttctttaaatgtaaacattcacctctgtaactccaaatatacataaaatagcaaaccaatttctttttttgtgcgggggggcagagtctcgctctctcactcaggctggagcacagtggtgtgatctcagctcactgcaacctctgcctcccaggttgaagcaattcttgtgcatagcctccctagtagctgggactacaggagtgcaccaccacatctggctaatttttgtatttttggtagagacaaggtttcaccatgttggccaggctggtctcgaactcttggccttaagtgatctgcctacctcagcctcccaaagtgctgggattacaagttgagccaccgcacctgacctcaaaacaatttctttgtttttttgttttttgttttttgttttttgagacagagtcttgctgtgtcgcccaggctggagttcagtggcacaatctcggctcactgcaagctctgcatcccgggttcatgccattctcctgcctcagcttcccaagtagctgggactacaggtggccaccaccacgcccggctaattttttgtatttttattagagacggggtttcaccatattagccaggatggtctcgatctcctgacctcgtgatccacccgccttggccttccaaagtgctgggattacaggcgtgagtgagccaccgcgcccggcctcgaaacaatttcttcatcaaagaaataaaataccttttatgttatattgaatcaagattttgtaaaacataacctttagaaacagtatatccaacatgacttttttttaaggaaggcttatatatcaagaaattgtggggaagggttattctctattacagaaaaatatattagagcttctaaaatgctactaaatgttgcaaatctggtggtagtggtagggctaagatattatgtatcatttcttaaacttatctgatctggaatgttttattcactgtgcctctccagaaactagttctaaaagaacactttgtgggaaatgataaccggatcattttcatatacggtattatctattgtccctataaagataaagataaccaataaatgtttactcggtcaacataccactaatatgtggtagtatttgataacatttacagaataccagcacaagaaacgagttctagacccccaaaaaaacttcatgaaaatccttcactacctttgttgcatataccaatatgtatgcatatcattagagccaacttggacaatactgacccaaaaaggaaaaggcaaacagctaacagagtttagttaacttggttgccctgactctagttttccttcactgctttggaatttttgctgtggaagctacttgtataccgaattttcattaagttaaacagatgatctggagctaggacactgaatcattgaaagtgttatttagaggacctgaaactttcctaacaataaggaatcactgtgacttccagtttatctcatataaagtactttattcagtcccttagggttaataaaaacaaaatcacatatatagatcactatgaaattcacctgaaaacttcaaatattatatttggtcagaaaaatctaaaaattaatagaattgcctattcaagaggaaaaaatatcataatcattaatgattttaagtcaaatattactcaatcacaaaatttaagccattcttttatacctgaattaacaaagagatccaatcattatccctcatttaaaaattaaagaaggcactactccattctaaaatatatttattaattcacaaggtattaattataatataggagtataaattatcatttaaaatgctgtgatgtattatattccatcaattcctaagttttactaattataggtaaaaatctaactaaaaatagatgatttagttagattgcaactgacatatattgcattttcctggtgctaaaaaataaaaacagatatttcaacctatttaattttctttttatttttttttaattacacttcaagttttagggtacatgtgcacaatgtgcaggtttgttacatatgtatacatgtgccatgttggtgtgctgcacccattaactcgtcatttaacattaggtatatctccaaatgctatccctccccgctacccccaccccacaacaggccccggtgtgtgatgttccccttcctgtgtccatgtgttctcattgttcaattcccacctatgagtgagaacatgtggtgtttggttttttgtccttgcaatagtttgctgagaatgatggtttccagcttcatccatgtccctacaaaggacatgaactcatccttttttatggctgcatagtattccatggtgtatatgtgccacattttcttaatccagtctatcactgttggacatttgggttggttccaagtgtttgctattgtgaatagtgccgcaataaacatacgtgtgcatgtgtctttatggtagcatgatttataatcctttgggtatatacccagtaatgggatggctgggtcaaatggtatttctagttctagatccctgaggaatcgccacaccgacttccacaatggttgaactactttacagtcccaccaacagtgtaaaagtgttcctatttctccacatcctctccagcacctatttaattttcaacctccttttcaaacacataattttaaataccattataaatgagctgtttaatatctgaacatgtaaagtcagtaggaagattgtgttatgaatttttaaaacctaatcatttttagtcattttcgtaatctattttttcatttgttacactggtttctggaaatacactgaaagtatgctttggtatactttattattaattcaatgaaatctaatgttagtactttttaaagcctttcatgatgattctcaagattcatcttgtggtaataaaggatatttaaataaagattgctagggcttagttcctaagtagacacatttactccccattacagttacataattactgaagatttctttaaatttttacttttaaaaaagtctaatgtagcttcaaaaattaaaatttcaaaatataaaattcatatattacctcatgcatagtcagtaggtaattaagaatggcctgtaattcatcttcctttactccagaatccttcaaaaacataatacaggtatcttacgtttacatgtaaaaaaatgtttaaagagaaattatacacatagatttgtcaagttggtcagctactataaatataaaaatataatgtaatagacaatctaaatttaaaacaaaaatttggggaagcactaaagacatcagtactccagaacatgtagaggtcaattaacatcagcttcctgttttcaacaccttatataatatgacagcctacttactaaagctacagaatcctgaagtcagcaaaaataataagtaatgataacttaaaaagtaatatccacacctactactcctctaaatacagaagacatcttttcgactgaaattaaatgtggagaatacaatgaacagtttctgaaattatcaagttaaaatgtcaagtacctaaaaattaaatagtaatctcactcgggaaaagaaaaacacactgcacttctaaatatgagctcgttatgaaaattttcaacctactctatcagtatattaatcactaaaaaagctgcaatctaaaaaaaaaaaaacaccacaagaagaaaagaaattggaaaacaaaaaacagtatgcatcaggaacgagcaacaaaacaaagacaattcaaaggacactttttttaatacatggaaataaggtatctgaatctgaaaggtatactaaaagttaggttcacttgccataatcttatgtgacaactaataaagcattataaaatcatataggaaaatactgaaaaaatattggtaacaattacatttatatattgctatcttataaaaccaaaatgccttttttagaatattaaattttactttacctgtaatagaatgaaaagggacaaaatgtgaccacttctaaaggctcatacacctacctggtacatttatacagaaatactatttctcaaaatctgaatgtcagttacaaggagcctgctaaaaatgaaacctccttcaggagtttagtgccaaatactaacagaaacatagtaaatatttgctgaatgagtgaacacacttgagctactatacaaatttatataacataaaatacaactaccaatccctaattctgcaataatttacatccatataggctccaaaaaagaaccaaaacaaacatggaaatatctttcaaagtattttccaatgtgtaaccacagtaaccaagcaaagaataaaaaaaccaagattgtatttcatgtgaaattataaccttcaatacacggtatgctatggaataagcaacgtgaactcaccttcatcactaattgcttaatgaacatcaacaagaatgctcgtagagaaagcatttctttttgattaggtcgcggtccatcttttaaaaaaatatacacatacacatttagtatttaaaggacctcaaagctgtcaaagtataaaattctcattcccaacagcttttccatgtgtttgtaagaaatataaaggtaggtctcctacagaatgaccttttatgcctctagaaagacaagtgtttaatcttacatgcactgtatacacaatatttcaaacatacaaacaggttatgttgaaactactatgaagaagtttgtactttgaataggtcaaagaatgtccaaaacataaaaatgaggtaacaaataaaatttgtattcaataataatatacgtattttaagactctgagagtattagtaaggtaacagaagtttacaaagaaaaaaacaaaggaaaatctaaactttcaacattattattatatgtgaattcagtatgacaaaatttttctactgttatcattatataagctaatacagaaatctcaaaaagaatgcctcactacacgatatcattcatgaagaagggaaatattatgttaactgcctctgacatctccttctctgcttagaaaagtccttggtcacacatggctcacattaaatcaattttcatgtctcaaacatataattcccaagtagaaagcttttgaaaccaaacactcattgttctaagatcctaagttagggacctgttttctcatatattttataatttttccaccactaatcactatttatagatagttcttagaccaccaaagcataggaccaccatgactttgaacagatcaatgaaaataggaagaaaattgtttaaaatttgttccatgtgattcctagacaaaaaaaaataataagactagagttagaagaggatcacaaaatttgtccagctctctcatttgaagaatgagactttcccaaggtcactaatcagttataaaaggcaggcgagaatacaaaactagcacctaggacagtacatgatacacctacagcaccatgaaatagtcatgagaaaattctgacccggttctggatctgccacaaccttgccagcttaaaaagttcatagcttgctaaattataggtaccagattctctgaggctaaaccaagcttattttgaaagtgatataaaaagtagtatgcaaattgaaaatctttgtaaatcactaaacaaccaaagcctcttactgcaatcagaatgtatgttattgactccccagcatctatttcttaatttcaagcaacagctcttaatttttaccaagtgactgaagtcatcttcactttcagacaatgtctttcaacttaggggatgcctccatttctaagcaatcagggcaactacaaccacaaaaatgggcacatgatacaatcaaagccaatgagcaacagagagactaaaagagactttcactggaaatacattatataggcagatgctcttacactgaatttaagttgttacggatgtgaaaggggaccggctgcttgctactacaaaggaagcgaatatgtgaaaacagccaacacagaagaattggcaagtgcagtgagacaaattcagtcctatggtcatactcagaatacctttatcaagttgtatctggaactgccagtttatatgagctgattacctccctttttgatgtaagccagttccaaggagactgttatagttacaaccaaaagagccactatatgtcaaaagttttattttgaccccttatatgaactgctagacatgatgaatgaatattaccctttcagcaagttagtcctcattatgtaagaaaataattgctaacattttgtaatttcattatctctttaagagaagcagataactcctacttctgcaagaaaccaccatattcccaaaacaccattttcaaggaatctcattgtgacaatccatctcagcatcaattactaaaaactaattaagaatttcttggcattttcagtgtcttacaacaaccatcctagtcatattagctccccaaacaactcacaccagcacaagtagtattcttccacacaagtagcaagttattaaactctagaaaccacaatttaggacaaactattaacattatcaatgagattaaaataaaattttgccataatggaatatagaaaaactgcccaaatatatgatagtactggttaaaacaaaaagaaaaattaaatcctgatttgcatttgtgtaaagtaatatacagacagaaattatatacctaatccttttggggtgataccacttcgatcctgaggattcactgcccagtagtagtacttcagcgtgtgcatgatgagaagcactgttccaactctccgaatggtgttatatatgttgactgtaccaatgaattccgtggacagataagtatagagcatcagttgaacctacagaataaaaatgaagaacttagagaaccccaccagcattttatctgtttccagtaacacttccaggctgttttattttcaccacgcttcttccaaaaagtaagatgctgagcctgataataatatccatattagacaacacatactcactgacacacaagcacatgcacacacactccttataaaaccaaaccaggtaatttcttcttttatagcagcattatcaaatatggaaactttttgctgcattattccatgaaaataactttgtgattcctatttagcaatcagcaattattcctaagcatgtgtaacttctttataatagacttattacttatgctatctatgcatagttgtttgaaaaagctagaatttctttcaaatacaacatttgcagaaaatcaggagctaaaatgactcaaaagaaaaagtactagtaactcaaaaggaaaaaataaatagaacaaaaccaaaagaaagaaaaccacagaaaaagatatagagtttaccttgaagaatattagaaaaacagaattctattacagtagctcattacaagaaacattccaatctagcattttaatcataacattataatctctcaacatgtatatcatgtcccccaattaggaaaggattctactaatctcattgaaagtaaatagtctaaaaaaatacataagaagttatatatgtttatattaacttcgaaatatctcctcttcatatgtaagagaaagaaataatacaagtgctaccccaccactgcacatttcatcttaacaaaaaattggcccaccccagtgattcacgcctgtaatttcagcatgttaggaggctgaggcgggcagatcacttgaggtcaggagtttaaaaccagcctggccaacatcgtgaaacttcgtctctaccaaaaaatacaaaaattagccgggcgtgatggtacacacctgtagtcccaggtactcaggagactgaggcaagagaatcgcttgaacccaggaggtagagagtgcagtaagccgagagagcaccactgcactccagcctgggcaacagagaccctgcctcaaaaaaaacaaattttttttcagtgaaattatgggtctgaaactcatcaactataatccattacttaaagcagcaaaaataacgactgcttttgctctactctcatgttgaaatcaattcattttattgctagagggtatattttataagctgaacaactgtaagtataggatatatattcttcccttgaccatagaccaaactactgatcatttataactgaacctttatgttaccttcctggacaatgagggcattttccttttcaaacctgcaaggtacctcagtgtcacctagggatttctttagagagcaaaaagtaggtacctatcttccaggtgccctgcaaataaacaatcaaggctaaatgaattagagtgtcagtgaataaatctaacatgctaaaaagtggcaggttctgaaccacttaaaagcagggcttggaagatcattataattcacaaaaccatatatgtatctatacacatacaatacattgtgatctactgacctgccgcaaaatgttattttgatgtagctactgctgttcaaattgataggcccaatccacttgtcattgagacaatacgacatgcctcaaattcttaaccatgttatttcagtctcttagcaaatatttacatctaactatatgcataacactgtatcatggaaatacagtggcacatatgctgtccctaagtagctgaaatacagttgaaaagattaaaaaaacacttatatttaagcaaaacaaatcaaagacaataaatatgcctaccaaaacatgaaaaaagtcatgaagcaatatgtaattgagtgacatagagctatgaaatattattaattcagaggacagataaattattataggataaactgaaatagtaaagaaaagcttcactaataaagtaggcattaagataggctttgaagatgagtagtagaatagacagacagaatacaagaggaaatttcaagctagaaaaatgatggttgaaataaaggtttccctagagttagaacaacagttctcaatcttgactgcacattaaaataactgaaaaacttttctttttttttaatactgatgcctgagtcccatcccagtgaggcaggagaatagggtctggaggcagcgaacctaaggacttcctagaactaaatcaaatggaaatgctacagctatgacaggaaatatcctctccatttacatagggcatacaccgagtaaatgactttgtaactttactgtatcctcttcatttacatagggcatacaccaagcaaccaatggaaacctctaaaggttatttaaaccccagaaaattctgtaacagggctcttgagcccctacgctcaggcctgctcccacagtgtggagtgtactttcattttcaataaacttctgcttttgttccttcattcttcccttgctttgtgcattttgtccaatcctttgttcaagacaccaagaacctggacactctccacggataacaccagattgatgaaatcagaatctgcagtggaagtggtgggattctatttttgcttgtttttaaaaacctaccccaactgattctatcagcagtcaagactgagaaccaccactgtagggaaaccttttggtacctccctatccactgaggatatttccatttttaagctagaaaatctagaaataagaattgacatgaaatccttagataaaggactaactacttcgttctgagaacaatgggaaaccattaaaactgctggggctaagaaattataagagtcatatgttaggaaaatattggcgttgggcatggtagctcaagactgtaatcccaacactttctggggctgagagaggaggattgcttgaggccggaagttcgagaccagcctaaacaacaaagcaagaccctagtctctacaaaaaaatttaaagagttagctgggaatggtggcgcacacctgcagtatcagctactcaggaggctgaggcaggaggactgattgagcccaggagtttaaggtcgcactgagccatggccatgaaaagaacatgttggaattctggcagaatagttataagttagacaaagaaatggaaaactggagaaagtcagtctattgagaatgatactgtggtaaaagaaaaatgaacagaggctgggcctgatggctcacacctgtgatcccagcactcttggggggctgaggcaggtagatcacttgagcccaggagttcgagaccagcctgggcaacatggcaaaacatcatctctacaaaaaaatacaaaaattagctgtgtgtggtggtacacagctacagtcccaactactcaggaggctgagatgggaggatcacctgagctggggaggcagaagttacagtgagctgagatcccaccttagtgacacagtgagaccctgcgtcaaaaaaataagtaaacagaatttagtagcaacgtatagagatgaatgaaagacctcaagattactcatatgctaattatgaataaaccttccctcattcactcattatgtactccaatagccacacaaattgtgtgttaacatctgtctttcccactaaatctaaattctatgagggcaagtatcaagtctatcttgttcatcaccatatccacagtgcccaccataaagtagtcactcaacaaatatttgttgagtaaatgaaggaccatggtagacaagaaaattcatctctcctgctaggtcattaaaaagatgttctctgaacagatctaagataaatggaaattataaatcgctggtagctcccttttccaaaagcaaagcttttcacatccacacatccagaccttcaacttttaaccagaggtggattgaccacgaagctgataaagcttcaactttatgaccactgatctataaatgtttcttccaagaccctaaacctaattttgtatgcattatattgtattcttcttcttaaaaaatttcccacatgataaacatttgaccttcaagtcaaacaaaatttggatctgcccttttttatgactgtctttacaataaaataaaagcagataaaaccccttgtggatacataaagcagatggctaaaacaggagaaaatgctaatattatcaactcaactgcaaattctaaaaaggaaattgagaaaagttattaaaaagtagaagataagaaatagagtataataatactaggaaactaagaaaatcataagatgaattttttttaattcccctccaactaagtatctaataagaggctttctgaccacatcaaaagagacacaaagccttacaaatatgctgattagtaagacaaaaaagtatctagtaaaagattttaaaagtaacttgaaacaatcctcaaaaagaagtaagactgagggtcatggaagaaaatgaggtcaaatttgacctggagataaaaagctacaacctccaactgcctgtttcgattatttccaaatggcaatcagagtcagcagctgtttttctctttaacatttgaaaagaccagctgaaaataaaatattaagactctagaaaagcaaaaaagtctgcagacttttttctgacaactagaataagtaggtgctattccaacttaaacaatgataaacactgcaagtgggccaaaaggcagaaggggagagaggaaaactgggcttgaaataacacgacttctaacaaaaattgtagataagacggatacaattatgcaatttaataaaatgatctgtttcaagttatgcttaatactgccactactgaatttttaggacaatgtattacaacactaggatttattaaagattttgttcatataccttaccacaaattcatttacattcacatagaactaattggtttgttgttacaaaactgaaaaaaaaaatttgtacaaatgttttcataatttgaattaacgtgaaattaaaatgattacgagactagtatatcatgccttcaaagaaaaagtgacatttcagtggtacctataagaatgaaactcagtagttcatcatgttggaaggcaaaagtgtgaagtaaaaaagagagagagcaggagcagggtgagttcttaagaaataaaaaaaaaagaaaaaatatatatggatatttacaatggaacaaagctacagttactaggaaacattaataattacattaaaactgtctaactttgatttatatttagtaaatgaagtctctcccaaataaaactttatttcatttaatttcagaaaacaaagactatacctgtatcttttaaaataatgatattgtttacaaagaatatattctttgtatgtatgtatatattatttgtatatattcatacacacacacacacaatttgcaatttttcctgaagagtaaaaaaggatgcttagtcaaaaaaagcaatccactgaagtcttgcataatagtacataaaaaaaagaaaatcctcttaattatcactctcctcacgcacaaaaacagcaaagatagtaaaacaatatcaatatatagatatatattaccttggctggggtatgaatccatatggcaggattaagaagaacgtgatcacacaattgcttgagcaggggcatcccattctgcagattactcagatattttgaaaatgcaaggcaaagttcaagtactgctctgctaacatgagatttggaagactgcaaaaaaagtagttcaaatgttaccacaaattcaagtcaaagtaagtgaattacaggctgtccctaccaggaaaaaaactggcccacaaattatgctcaaagttaaagatgccatgaagctcactatcacatttgtttgatagaggaatggaggcaaggtaaaacaacaaaatgttattttagtttaggtaattttctgtaaccaaggagacattcttgcagacagaattccttagccacttagagaacaaatgtatggcctgtaaattaagaatcaaaaacataaaatatttcatactttaccttttcaaggctatatcctattaccaagaagcccttacaggcaagcatctgttcctgcatagcaattgagttcttcaacaattccatgataaaggccagcaaggttgaactagaattttttaaaaaggcgatgattaaaaaaacatattctattttttttaaattaggttagatagatgtaacccttccattcaccttaataaaaagttctccatttcaaagaaattgaagctccactaaaactgcttccaacattacatcagaactagatttttaatgtaggattaggagttactcagatatttatttcatatactttatctcaaacacattgataggtgaattacttagaaacaatgacaaatgttcatgatatagagaaaaatgagcaacttccaaaaacaaccaataacaaatacttattaaaaatacactaaggccttaaagaacagatataacttagataagcaagtatattcaactttgaagcgttaggggccaaaaggtgagaaaagacagtggagcaaacagagtaaggtgtaaatcctcaaaatgtgttagggctccagacttgcatagtctgaatggagcagagggcacatgaagagaaagatgagacagttaacttggaggcaaacttgagctccttgaacactaatttaagaagtttgttcattatcccaacaacaaaattgtaattctccagtcagtctcgaacacttttaaaactgaataggggctacagccatgctctactacctacaatttttaaagatccccggaaaggaaaggaaaaagatcagttgttactgccttctcagagagaagtcccacaaaacaaaaaaaaagagagagagagagaaagcatgaccagcagccaatctcctcctccacatcagtgctttcactgccagcaatttcaatacggggggaggggggagggagagggagaggggagggagggaagagagaagggggggagaggggagggagggaggagagaagtgggggagagggggaagggagggagggggcagagaggggaggaaggggaagggggagggaaggaagggagggagggaggaaaactgtaagtaaaccctgttagaacacagcacaaaacaattccataaagtattaatatgtcagggtaatttaattttatattttttaaaatataagttgacaaatactagatttgataactttttatttttaaaaaaattgttgcctgaaaataatgaggacaattaccattattatacacactggtggcagacatcaagttatgtataaaagcaaaaatcaaagggagaatttcaaaatgagagaatgtaaaagtatttaaatttctcaagtaacaaatgaaacaataatttcaatacaaatgaaacaataatttcactatacattgtttcactagaatatatagccatgagaaattgagactcctttcctacattttatgacttaccctataacttatatccctttcttttttagactcaggactacaacacaagagacaaaaatgtgctaaatgtacaatctaatttttttcaaaaagactaattcacttcgataacactattaaaattttgacttccaattacataaatgcaatcagtaataaataattaaaatatgaaaagttaagttccataataaatcattaccaaataattttaaatatttcagaaattaaaaatttcttattgcattctgagtaatgggtagtaaaaaaaatttttaatttagacaaaaaaatgtatttatttttgagtaacccattattgccatttataatgttattctaaaaccaatttattgtgtttcttacagcttccatatttcctactgataaacaagaacttaagttaatactgacataattaatatggacttgtaatacagtttatagttcacaagtttaaattattttgacacaacaaaacctgaaaggcaaaatattgtatagctcaacagtgatgaaattaaccctcacagccaattaaagaaacaaataaaggcactcaccatatagtcaaatcaatctcatcagacaaatattgcctgtaatccaactgtgcaaaaagtggaaatagtacttgtactcctccaattgaatgcattgcactttggatggaatgtgttaaaactgcctttacatccttgtaagatcaaaaacacagtaaagagttcaatgattttttttccaaaacaattaaaaataaggcacaacaataaatgcagaaacactataaacgtgacattccatgtgtttaacagaagctaccaaatacatctcaataacacatcaaaaattaccattataaatgttcttaaaagatcacagttagtacctggagcatgagtgcatgtggtgaatgaacaaaaattgaagggttgtccttaggagatgattcaagacaaagctgggcatctgtagcccgtggattgtacgtgaatgcaatggcactagagagtttcccatcgtacaataaaagtttgtgatgctcagcaaggaaaaggtcgctttctgctttgaatttaaatgtaccctaagaattaattaaaaacagttaaatagtatgccacaaagagaatctaagtacaaatcaacacaggtgtaaaactttaaggagacagaccattgataatcttttaacagtattatataagaggacccctcgtttacttctaaaattggctgaatttaaagatataatggaaatcaagtcaacttgacattaaaaccttaccttaaaaatgtagaagtgaccaatagatcatattttatcttttttcgtatattctttttttaaaattgtgatcaaaagcatataatatacaacttaccatcttaagtatttttaagtgtataattgagaaacattaactgtattcatattgttcaacagcaaatctctagaacttttatatcttgcaaaactgaaactctgtagccatttaacaactccccatttcctgctccccaccagcccgactatcacaattctactttctgtttctatgagttggactcttagatacctcgtataagtggaatcatacagtatttgtctttttgtgacccaagcatttcatttagcacaatgtcttcacagttcctccatgttttagctgatgacaggatttccttgttttttaaggttgaatatggtcccgtgtgtttatgtgtgttgtctgtcacattttctttatccattcatctgctactggacatgtgggttacttctatctctgggttatcgagaatattactatgaacatggatgggcaaatatctccttgtgaccctattttttgtgtgcaaatacgtctctgtgatcctcttttcaattattttgtatatatcccataagtgagattactggatcacatggaagttctatttttaattttttgaggaacctcatattgttgtccatagcagctgcaccatttttcattcccctcaacagtgcacaaaggtaccaatttctccacattctcaccaacacttgttattttgttttcttttttaagtagtcatcctaaatgatgaggcaatagctcgctgtagtttaaattagcatttttctaatgtctagtgatattgagcatcttttcatatgttcattggctatttttatatcttctttaaagaaatgtctactcaactcttttatgcatttttaattgttttgttattgttgttgttgttgagttacaggattcatatattctggatattaactccttatcagatatatgattgctaaatattttctctcactctgtaggttacctttccactctgctggatatttcctctgatgcgcagaactttataactttgacaacatcttatttgtctgttttggctttggttgcctgtactttcggtatcacagtcaagaaatcactgccaaattcaatgtcgtaaagcttttcccttgtgtattcttttaggagttttatagttttacatcttacttttaggtctttaatccattttcagctcatttttatatacaatgtacaatatgaattaagtataaaacttttctttcttatttttcgcatctggatatccagttttcccaacatcatgtgttgaacacattgtcctttccccagtatgtggccttgcctcacttgtcaaagatcatttgaccgtatatgcaaaagtttatttccggacactctattgtgttcccttggcctatgtgtctaagcaagtctaacgttgttttcattatgtatcatagccttgtaataaattttgaaaccctgaagtgtaaagcctgcaactttgttcccctttttaaatactgttttggcttctgagaatcccttgagattccacattaattttagaattgtgcttctatttatgcaaaaaatgccattgggattttgataagaactgtactgaatctgtagattgctttaggtagtatggatttttagcatattaaatcttccaagggatgtctttacatttgtttcggtctcttaaattttgtcagcaacattttgtacttttcaatgtacaactcttttgcctccttggtggagtcagggtacagctcttttgccaccttggttgagtttatttctaagtattttatccttgttgatgctattgtaaaagaaattgtttgcgtaattttcaaactgttcattactacttcattattactaatagaaacacaattgatttgtgtgtattgattttgtgccttggaactctgcagaattcatttactagtcctaacagttttcagtgaaatctttaaggatttttagatataaggtcatgccatacgccaacagatgattttacctcttcccttccaatttagatgccttttctttttcttgccaaattgctctaactggatttccaaatactatgttgaatagaaatggaaagaataagcatccttgctttgttcctgattttagaggaaaaactgtcagtttttcactgttcagtattgtgtcagtcatgggcttttcatatacaatattttattatgttgaggtagtttccttctattcatagattgttgagtgttttaggttttttttaaatcaagaaagagtgttgaattttgtcaaatccttttctgtatcagttgatatatgatcatatggattttgtaattcactgttagtgtggtacattgcattgactgatttccatgttgaaccatctttgcattccagaaataaatcgtaatttgacattgtgtataattcttttaatgtgctgttaaattcaatttcttagtattttattgaagatttttccatcaatattcatcagggatattagtctatagttttctttcttgtactatcttgatctggctttggtatcagggtaacactggcctcataaaatcagtttgaaaatgttccctactcttaaaatttttgtaaatttgaggagaattggcattaattcttctttagatgactgagagcattctccagtgaagccatctagtccctggctttctttgttgaaaagttttttattattgattcaatctccttactagctataggtcttttcggattttttaaatttatttttgattcagtctcagtaggatgtatatttctagaaaattgtccatttcttctaaattatccgatttgttggcatatacttttcatagcattctcttataattctttctatttctgtggcaagttataatgcctcctccttaatttctgattttacttatttatgtgctcttcttttttccttagcctatgtaagaatttgtcaattttgctgatgtttaattaaaaaaaaaactgttagtttcactgatttttttctcactgcttttctattttctattccaggggtccctaaccaggtatatgacctgttaggaacaacagcaagaagtgagcggtgggcaagcaagcaaagcttcatctgtatttacagccactccctaccactcacattactgcctgagctccacctcctgtcagatcagatttttatagaagggtgaaccctattgtgaactgcacatgcaagggatctagattgtgtgctccttatgagaatataatacctgataatctgtcactgtctcccatcacccccggatggaaccgtctagttgcagaaaacaagctctgctttgtttcccactgattctacattatggtgagtcgtataattatttcattatatattacaatgtaataataacagaaataaagtgcacaataaatgtaatgcacttgaatcatcccgaaaccatccctgctgcgcccccaccacccgtggtccatggaaaaactgtcttccatgaaactggtccctgggaccaaaaaggttggggactgctgctctatttcatttatttctgctcggatttttatcatttccttctatctgctaacgttaactttatttgttgttctttttccagttccatgttgtataaattaggttgctgatctgagatctttcttttggtgataatgatcagtcattatcaccataatcttctctcttagactgaggtcactgaatctcgtaagttttggtaggttgtgcttacattttgatttctctcaagatattttctaattttccttgtgatttatctttgacccaaaggctgttttaagtgtgttgtttaatttctacattaaacattttctacattaaaaacttggtggactttccagtttttctttggcaactggtttctagtttcattttattgtggtcaaaaaagatacttggtataatttcaatcttaactttgttgacacttgttttgtggcataacacatgtctatcctggagaatgttctgtgtgtgcttaagaaaaatgcaggtcaggtgcagtggctcacgcctgtaatcccagcactttgggaagccgaggcgggcggatcacctgaggtcaggagtttgagaccagcctgaccaaaatggcaaaaccccatctctattaaaattacaaaattagctgggtgcagtgccacatgcctgtaatcccaggtacttgggaggctgaggcaggagaattgcttgaacccaggaggtggaggttgcaatgagccaagatcatgccattgcactccagcctgggcaacaagagcaaaactccacctcaaaaaaaagaagaagaagaagaacaatgcacattctactgttgtttcatcgagtgttatgtatactactgctaaatacattgggctgcattgctgttcaagtcttctgtttacttattgatcttctgtctggttgttctattcattattgaaagctgaatactgaagtgtcctactataatggtgttgctatctacttcttttaattctatcaaagtttgcttcatatatttgagagctctgatgttaagtacatatatttgttctatctttctggtgaactgaccctatcatcataaaatgtccttctttgtctcttttgacagtttttgacttaaagtctattttgtctaatttaagtaagctactcctactcttctctggttaccatttgcacacatctctttatttgtgggtacattttaggtgtatatatttatggggcccataaaatgttttaatacagtcatgcaacgtgaaataagcacatcatggagaacagatatccatcccttcaagcatttaccaatttagttgaaaaccatccaattacactatttcaaaatgtacagttattattgactatagtcaccctgctgtggtatcaaatagtaggtctcatttttcttttttttttttgtatccattaaccaaactctccatgtataacccaccttcaaatcaagctgaactaacattggttaagcacaaaacagtaagcaaactaccttgtatcccaggcccaactgataaatagcaaatatctgagctgcatttagagcttcactgaaaaggtaaactgcagtcatctgaccacagaatactctattagcatctgctgtttctgatgagcccaggaaacatttgtcaaaggtctgtaaaagaaaaaaaaaaaggaattaggaaaaaacaaaaaaaaactccagaaataataaaaacctatattatcataaatgttttgtccattctaaactgtatctaaatagactaacataatttataccataaaaccattagaaagaatgttgaaaaatgtgtatgtaatgacattaggggatatagaaaagtttgaaacacatgtgttctcaagccaaacaacctagatcaaatccctgcatcctatgccactgagtatggcaagttacttaacctctttgtacttcacctatctgtaaaatgaagattataataatgcttatcttgcaaggttgctggagctttttgaaaataaagctatttattacaatgcctggaatacaaaaagcactcagtaaaagttaatgtaagaaaaaacaggttacaaaacaatacttacatatgagcccttttttgtactaaaaaagagctaacattgagcactcattctgtataaggcgcgctgctaatagatttatggatattatctcatttaatcagatgacaactttctgaggtatgaatattttatgtccattttcaggaggaaaaatgctaaggcctaatagattaggtaaggtcatgcagtcaataaatgacagagctgagattcaaacctaagtctgtctgattcaagaccctgatctcttgaggttagcattacaaaatatgtatatatgtgtagcaaaggatatgaaaagaggagttaatggtgtgtgggtagtgtactttatgttcattttcctggtatttttcaagtttttataaaaagaacataattacaggaaaaacattttaaatttcattctaacctatagatttatttttgaaacctgtaaacgttaacaacatactagttaactatagcagttagaattatatgcaagatttataagcatgcatcatttaactcattcagaaaaatgatcagaaccctatagtggagctcttgttcattttgataaatgaaccaatgacccactccccagatatagccactgttagctataaatccttatttctacctatatggaatgattttataacaaggactaatatttcagtgacatattaagttctattaacatgctagccaaattatgtttataaaaatctaccattgtaatactttgaattttatattcaagttgtaaaactttttcttgtttaaaaagctcatgcttttaaaatcacttttttcattgcaacattttgaaactacttacatcgctagtgttgacaaaccatgttatctctccataggaagccagctcaccattcacataacatcgaagttcactattcttccatcggttatagatgtgtactatggtaaccatataccactgcagaagcaaaaaacagttaaaaatacaaagataacaattatcccaataacgcaaccatactgatgagtaaaagttaaatgataagttgtaattcaacctaaaaataaaacaagactacctttgttaaattcaatatttactttctggaacaatatctattcatgggcctttcaactgataagaacttaatcactagatcatttttccagctttttattatggaaattttcaaacataccccaaaaatctgaaaatcaagtacaaacaccccctttttccaccaactagattccataattgtcaattttttgccatatttgcttaatctatctgactacctatctacttatacattttgttgatgaaccatttattaacctctaaattttaaggtacaaaagcaaacacatattaaatttgcaatactaaaataaatgccgtagatatttcctacttgtatctcccttaatctccataaataactaaatttgcaatctttttcatatccaaatcagagaggtcaattattcagtgatttacgcttcatctttttaaacagtaaaaacgaagttgtgctttagcatgttattatatgaataacattaaaacaaagcattttgatgactagcatagcttgttaacataactatgactcaagaagatcatgtaccttttgtggcttgaaatcaaatttcacacagtgttgaaagccttttccttttgactttattgatgttacaatcaaacagcctccaacaaaatgagcagaatagccaagacctttgctggttctgaaactataaagaatagttttcattttacctctaaatattcttctcagtttcaaagtaaggttttaacactaatcagttacagaaatacataccaatacaaatatggtttatccttatctacattgatgttatttacaggatccattctaagccatgtatgaaatgtaaaaccattctggtatggccatttggctataggaggtaatgcaatagcctaaaggaaagaaactttgagttattaactcacgtgaaaacctgtcttattaaaatcatgaaaataagactttgcaatgctacatatatttgtactacatcacattactttatgtcacaattaaaatatctgaggccgggcgcggtggctcacgcctgtaatcccagcactttgggaggccgaggcaggtgcatcacaaggtcaggagattgagaccatcctggctaacacggtgaaaccccgtctctactaaaaatacaaaaaattagccgggtacggtggtgggtgcctgtagtcccagctactcgggaggctgagacaggagaacggcgtgaacccaggaggcagagtttgcagtgagccgagaccacaccactgcactacagcctgggcgaaagagcaagactccatctcaaaaaaaaaaatatatatatatctgaaagaagactctttatctggaagaagactctttatcaggaagaagacttttagtaactttttaattttccctaatacatagtaatgttaattaaatgaaaaaaaaattcagtgtaacctggacacatgaatcttgtattcttcatttcttaaaatgaacgtatccacagagattctaattaaaagagataggaagtgataacaaattggaaatttgatgaaattttaaggtattagaatagagaaagatggacaggaatggaaagagagaagagaaaaactgggtatatgctgcttttataaaactacaaatataaaactgaagaggattagttcataatatttttaaattatattcagaagtcaatatacaaatggctttaccgcttggtttagatttttatttaaaagatcatactacataataaaaggatcttgtatagccaaaacaatcttttaaaaagaacaggccagatacggtggctcacacctgtaatcccagcactttgggaggccaaggcaggcagatcatctgcggtcaggagttcgagaccagcctggccaacatggtgaaaccctgcctctactaaaaaaatacaaaaattagccatgcgtggtggtgggtgcctgtaatcccagctactcaggagggtgaggcaggagaattgcttgaacccaggaggcagaggttgcagtgagccgagatcatgccattgcactccagccagggtgacaagaacaaaaatctgtctcaaaaaaaaaaatgaagaagaacaaagttagaagactcatactaccatttcaaaacctaccattaatataaagcaacagtgatgaagactgtggtattagcataaggccctggtgtcctttggttaggcaaatccttcttattatgtcaccaaaaggacaagtgacaaaagaaaaaaatatatacattggactttattaaaattaaaacctgtgctttaaggaacaccatcaaaaaagtgaaaagacaagccacaagaatggaagtaaacatctgcaaactgaatacctgataaaggacttgtaaccaaaatatataaagtactcttataactcaataataaaaggacaagtaaaattttaaaatgggcaaaagatctaaatatacatatctccaaagaagatatacaaatagccaataaaaatataaaaagatgctcaatatcattagtcataaaggaaatgcaaatcaaaactacaatgagatatcacttcataccaactaggatagctactaatacaatcacaaagacagatactggccgggcacggtggctcacgcctataatcccagcactttgggaggctgaggcaggtggatcacttcaggtcaggagttgaagaccagcctggccaacatggtgaaaccctgtctctactaaaaaatacaaaagttagctgggcatggtggtacacatctgtaatcccagctactcaggaagctgagacacaagaatcgcttgaaccgggaggcagaggttgcagggagccaagatcacaccactgcattccagcctgggtgacagagcaagacttcatctcaaaaacaaacaaacaaaaatagacattaaccatcttagcaaggatgtagagaaatttgacccttatacattgctgtgggatcgtaaaatgttacagctactttggaaaacagtctggaagttcatcaaaatgttaaacaaagaccatatgacctaatctagagattgggacaaattaaaacatatgtccacacataaaattgtacactaatgtccataacagcattattcatactagcccaagaagtgaaaatcccaaatattcactagttgacaaatgattaaataaagtatggtatatccatacaatataataccagccataaaaaggaatgaagtactgatacatgctgtaccatggatggaccttgaaaacattatgataagtgaaaaaagccagtcacaaaagaccagatgttgtatgattccactaatatgaatggtccagaatagggctggggaatatggggagtggctgctaatcagtatggggtttcttttgggtgtgatgagaatgtcccaaaattgactgtggtgatggttgacaactctgtgaacacatttacctactatactatatactttaaatgagttaattgtgtggtatgtggattatatctcaataaagctgttttgtaaaaaattcaaactgcacaagtgtctgttttattgtaacttacatatgcatttatgtatacatattatacatatattcttttatatgtattagataagacataaaacatgaaagacatcatagagccaaacttcagtaataacactattgagacttcaagagtgaacgttgcattaaacgttgcattaatgcaaaaatgaacgttgcattaagaaaaaaggaaaagaataattacaactcacagactgacaaaaaaaaattttaggagaaaaacatatattcagtgcgtacacatgttctctctcaccaaaaacgatagcaaagatgtaaaagctttgcaaaaatactttattcatgactactttaaattcccagtaaaagctatgtttaaggaaaggaagtcactaaacatatttaaaacatctattctcttcaagtttcaaaagctgttcagctcacctgccctactttcaagataaatgcatgcactgcaatctcagaactgtaaataataaaattataacatgaggcatgaaaaaggttaatctcataagaacactttttttaatgttagaggcaatgataggctatgataagaaagtaaaattattctgaaaagctacaaatctaaaatcgactgtaaggaaaaactgtaaaggaaaaaattgggcaataaaacttttcaaagaaagttgtatattgtgtatataacatttaaatatcacaaatgtcatattaaaacatattcttatctttctgcagatactgccaggctacacagggcctaatataagattttatgagaactaacataaaaaaaagaatgaaagataagctcaggaaaagaatagactgaaatatcttttttaaaagtttgtcttgggccgggcgtggtgactcatgcctgtaatcccagcacttcgggaggctgaggtgggtggatcacctgaggtcaggaattcgagacaagcctggccaacatggcaaaaccccgtctctactaaaaatacaaaaattagtcaggcgtggtcgtgggcacttgtaatcgcagctactcaggaggctgaggcagaagaatcgcttgaaaccaggaggcagaggttgcagtgagccgagatcgcaccactgcactccagcctgggcaacaagagcaaaactccatctcaaaataaaaaaaaagtttgttttgcttgtaacagactgaccaatgtaataatgaggagattttagaaacttccataaataacatatatacattatagaatgtgcttctataacattacgaaacattacagatatcactattatacataattgtcttatgtataaactgattaacggcttacaggaacactgagaccaacataatttggaaactcacaagtcaaggaaaacttgcgtagtaagtttcagagcctctatttcttcactatcattctatacacaaggtacaaaaaaaaagacaggtagagtaatgaaaggcaagagaaagatgttcacaaagatagacatgaaggtgttacacacaaatagctacttaagacaacatggctatgtttaaaagaatgaggttcttattccattgctgacccaagctgtgactgggcattttctcaactaatttaagcctctatttcttcacctctaaagcaattacaaaaaagtaacatgcacgactatcataaggattaaagtatgttgagcagaagtttctacctagcacagaacctgtcaggggtgttcacagggctgtactttcagggagcaaaggaaagaagaactgggagtgatttcctcattaatatttacttactgcagcactctttcctggaaagttaaaaaaggcatcaggaccatacttctgaggcatatgctttaacacagacagcaacttcccagcatgtggaggctatgaagataattaacaattcattaaccacattatttaccataagataaaaaaaacacatctttaatatagtcttgctgtaatatatacaggaataatgctataaggttaaaagcatagaaaataatttctaagttattttcaaatatcttaaagaaataatgtactctacaccagtttttgtaatgctgtagggcctattaggtattcaataaatatgagccagtatcattagacacctgaaactcttctccaagctgcagcaaaaatgatcttttttttttcttttttgagatggagtctcactctgccacccaggctggagtccatgtgcagtggcgccatctcggctcaccataaactctgcctcccagattcaagtgattcaccagctgagtagctgggattacaggtgtgtgccaccacacccagctaatttttttttctttcgagatggagtctcgctctgtcactcaggctagagtgcaatggcatgatctcggctcaccgcaacctccgcctcccaggttcaagcgattctcctgcctcaccctcccaagtagctgggattacaggtgcacgccaccacacccggctaacttttgtacttttagtagagacggggtttctccatgttggtcaggctggtctcgaaccaacctcaggtgatccacctgcctgggcctcccaaagtggtgggattacaggcgtaagccactgtgcccggcctatattttttgtatttttagtagagacagggtttcaccacgttggccagactggtctcaaactcctgacttcaagtgatccacctgcctcagcctcacaaagtgctgggattacaggcatgagccaccacacctggccaaaaacgatcttttaaaaatataaactacatcaatcccccacccacccttctttaaaattaaaaatacttaataatttaacaaatacttaaataatgcttactatattccactgttaaaggtacttcaaaaagatacttgcacatgcatgtttatagcagcacaattcacaattgcaaaatcatggaacctacccaaatgcccatcaatcaacgagtggataaagaaactgtggtatatatatatatatatatatatgatggaatactactcagccattaaaagaaataaattatcagcatttgcagtgacctggataagactggaaactattattctaagtgaagtaactcaggaatggaaaaccaaacagtgtatgttctcactgatatgtgggagctaagctatgaggacacaaaggaaaaagaaagatacaatggactttggggacttggggtaagagtgggaggcgggtgagagataaaagtctacaaatatggtgtggtgtatactgctcaggtgacgggtgcaccaaaatctcacaaatcaccactaaagaacttactcatgtaaccaaatactacctgtaccccaataacttatggaaaaataaaattaaaaaataaaaataaacatttcaaaaaatggtacttcaaaaacactaaaatattttaacctcataaccaccctatgggatggtattattatgattatccgcagtttacagaagaagaatctgaggcaggggaacatttccaaagtcacatgggtaataactgtcaaggtcaggatgagaactcaatcttgactccagagtccatgcttttaaacaactatacagatgctcctcaacttacgatagggttacatcctgataaacccacagtaagttgaaaagaatgtaaatcgaaagtatgtttttgatccaaaatattgtcaacttaagatgggtttagccggaggtagccccatcctaagtgaaggagtatactgaatgcatatcactttcacaccatcgtaaagtcaaaaaaaaaaaaaaacaactatactttcaccattaaaatagggaccaaaacctttaacatggactataagatactttatctacttctttagcctcattttgcttcttactctccccttctccctgcactccatccttttttcagtcttcttcccacaacagggcctcagcaaaagctattccttatgcttaaaatgttctcaaaaggacccctgtactcccctcttatccaagtcaatcttacccagcctttagagctcatcttaacagtcacttcctcagggtagccttccttgaaactgagagtggattaaacttccctatcatatttcattctacaatatacctttaccgcatagcatataaatatatgtatacgcatagcatatacatataaaagctgcaacgctgagtttatttgattaatgtttccttggtccacaagtctctaatacatgaaacaaccaacaataaaaatgaaaaatctcatttgcagttacaaggaaaaacaaaagataatcagacatactatctcattttaatcagtttataaccaaataagaaaagtgtggggcattcctccttgttaaaaatgtaaaagttcaaaacagggtcaaactacaaatgaaatcattggtttgccttcatcttatttttatagatgatataaattataattactacctgtgtaaaagagtttggcaacctttcacctaaatattaagtggaagcttcattcttaagtgaacaagaaattttcaattaaccatactgctcaattgtaaaagcataataacaagtaactacaatcacagtgattttttaaaataaattccaaagtaaaataaagtaaccaaaaataactctgcagttaaaaataaaaatacagtattatagcatgtccatctagaaacatcattcctccaaatttcctttcctataaatcagtcaacaaaagaatacattaagataagcactttacttgacagacattgctgggggagtgtatactgtactggtaaagcctttcagaaaaaaatttagtagaccaggcacagtggttcacatctgtaatctcaacactttaggaggccaaggtggagggatcgcttgagcctaggggtttgagaccagcctgggcaacatggagaaactccatctctagaaaacaatacaaaaattagccaagaatggtggcaagtgcctgtggtcccagctgcttggaaagctgaggtgggaggattgcttgacccaggaggcagaggttgcaggcagccgagatagcaccactgtactccaacctgggtaacagagcaagactctgtctgaaaaagaaaaagaaagaggaaaagaaaaagatgtagtagtcatatttcaagagtccgtaaagacgttcatgtccaccaatgcaatatttccacatgtaaaaatctatgctaaagtaatcaccacaagggcagacagagatttagatatagggattttttcactgcactgctataacagcaaacgatagaaataatatgcctaatattaaataactaaataaacgtaatgagtatctgagcaaggccttgctctcattttataaatagttcattattttttccctttatcatctaaaactattctcattctcctccccctccccataggcaactatattaacatgtttaatcttttttatgtagattattccttcaaaaataatgtttggggctgagtgtggtggctcatgcctgtaatcctagcactctgggaggactgcttgagctcaggagtttgacaccagcttggacaacatggcaaaacccagcctctaaaagaaatgcaaaaattagcctggcatggtggcacatgtccgtggtcccagctacttgggaggctgaggtggatctcttgataccaggaagctgagaatgcagtgagccatgatcacaccattgcactccagcctggatgagagtgagaccctgtctttaaaaaaaaaaaaaagaaaagaaaaaaaggtttttatgtgcttacacttatcattgctttctttcctatatattttacatctattcctattactccatgtactgattctgttatagaacaatctaccttctatacattttaccaatccactctcttaatgatgaacatccatgttaacattcactgccatcaaaaataatgcttcagtgaacatcctcatgtattttatggatctatgtgagaatttcttggaatacgcactcagaagtgaattattaaatcactggatacaggtaaaattaacatgactaagtagcactagactcctcttgaggttggctccactggtgttcattctaatgaaaagcgcaccaagtataaaataaccctatatcccaaactatacttgccattttccaactttaaaattcttgagaaactacagatggaaggtgacaatatcaatactgttttaatgtgaatgtctctaattattaatgattttgtgttcatttggttgtggggtttctacctctgtaaataaatattagttcatattatttgctattttcttacctataattttctatgcttatgaatataataaaaatacattacatattcagaataaataatgtgaatataaataaaaaccaaaatcaaatatatactttctcttctggacacgacatattaataggacctggacttaccaacctaccataaacaactagaaaagtgggcaaaatgtatcaaacaaaaacagttttcagtatgcaggaagaggtagctcaagactgtgttccctgagaaaacaaaatgacttaaacctggagtcaatttccatatcattgcacagggaaaccaaacagaacccgaaagtctcagtgagttggaaagaaagtggagtccacagaagatagaagtttcagagaagaatactagggaggaaagaactgaacagacaagaagctccagaaatctgcattgactctttgacttaataccagactgatcatgcttatgataaaactcaacatggtggggctaagatagtaagagctttaagttaaagaattcccaaaactaatacagagctaggaattgttgagaccctactagacacttcggagagaccacagtcttgctacctcctgtcctatgtctgagacttgagagttattcaatagagaccctctaagagacacgcctgaatagtaaaactaaactagccgtagcgtaacagccactctaaaccttactggaaaaaaaacttttaaactagttttgaaggataaagttgatccacaaataacttatctgcctacaaaaccagtctaacaatcttaaaaggaatatgacaaaatccaacactcagcaacataaaatttgctatgtctgatatattgtctaaattcagtagccataagcagcagaaaaatgtgacctacataaaggagcaaaatcaatgagtaaaaaactgacctagaaaatgacattctagaatgaaaaaccaagagcattaaagcaactattcatatgctaaatattgtcaaggatttaaaggaattaaatgagggaaaaaatggaaaatatttaaaagaaccaaatagaatttacagaaagagaccaggcatggtggcttatgcctgtaatcccagcactttgggaggccaagacgggtggatcacaaggtcaggagttcgagaccatcctgaccaacactgtgaaaccctgtctctactaaaaatagaaaagttagccaggcgtggtggtgtgcgcctgtaatcccagcaactcaggaggctgaggtaggagaattgcttgaacccaggaggtggaggttgcagtgagcagagatcgcaccactggacgttagcctggcgacagagcaagactccgtctcaaaagaaagaaaaaaaaaaaaaaggccaggcgcggtggctcacacctgtaatctcagcactctgggaggccaaggcgggcagatcacaaggttaggagatcgagaccatcctggctaacatggcaaaaccccgtctctactaaaaatacaaaaattagccgcacttggtggcatacgcctgtagtcccagctacttgggaggctgaggcaggaggatggcatgaacccgggaggcagagcttgcagtgagccgagatcatggcactgcactccaggctgggcaacagagcgagactctgccttaaaaaaaaaaaaaaaaaaatttacagaaagaaaaatatactatctgaaatttcagtggatggaattaacacactgctgaagaaaagatcagttaacttgagactacagcaataaaaactatctaaaataaagcacaaaaagattaaaaaaagagttaacagatcccagtaacctgtgagaaaatatcaagaggtctaatatatctgtaattggagtcccagaaaagacaggaagcggggacaagaagacagtatttgaagaaacaatgactaaaatgtttccaaattttgtgacaattatcttatacccccacagaagcaaaaactctaagaagataaacacaaggtaagctagaaccagaaatataatcaaattcaatgaaaattagtaaaaaaaactaaaattagacagtaaactggagtttgagagaaatatgctaaagaatctaaattttaacataatgaaaaagagtaattgtagggcacagttttagatacatttaatgaaagctagattaaggatcagctggctgagctgttgctgtgggcaatgatctctaaagggcactaaaataagattggaaatgcaacaaaaatggagaaaatatttactactcctcttcaatgggacagataactatatggtggaagaaacagtttgataaggcacctggggttcaaaataagttcacccccatcactacccattgcaaatgactcctaagttgcatctcaagagggtagatccaattaactgcagaggttttgttcacggagtgagttactcaagtttaagccactcagataaaactagatcaaaaagaagaaaaggtaggtactactacctaatacttttctttctctacatttatctttttttctaataaatattgaatgtacatttaaagaacaacattttgaagaagaattaaattaccagtttgcctgaaacaccattatcttagtgcatactcttagtgtccaagtatggcacgagtagccacagggatctcaatgctattttaattaatctattcaatttgacaattatcccatgtataataatatcagttactttacaagctacgaatgtgtttgggaggagcatactttaaaataccaaagagtacttaagtttttttacccatcgtcctttatctccttgaagtttactgaagaaaagctttagctcgcgaactgtcaaattatagctagccagcactcccaacatgtcaaccaaaagatctggaaacaaaagaaaacgataaaataactcagctagttatatttctcgaatatttaaaataaactgtgcttatttaagggcttggacactaaagttctaggtgcatgctacatgctcaaatatttcttaaatattgctaaatggaataagaaaaatatgtatttgaaaatcaaactttatttctttgcatatattgtactatagaaaaaatcatacctgctatcatattgtcaactttttcaattttcccaagcactttttcaacaaggcctacttcagtgcagacttgaagattccgtatgcttttcttcagaatggctgtaaacatgctccagacttctgcttggcacgtaatgtcacatttttccagtaggtccaccatgcagttaatactctcaccttcttggataatgaaattcatttccagatcaaactgtcctcctaccaacttacaaggaaaaaaaaaaaacacattaaaagcattagtatcctcaatatcactatagcatgttcctaaacattagattaacaataactactcacattcttcctccacatcaaaaggttcattaaaaaacatgcagctcaaaaaactgaagtttctgaagtaatctccaaatttagacagcaaagtaagagaatataaaaattaaaatatttttcaacaaaaacaaatataggatgtcttaggtaaattgctatctactaacctgttaccaataaagatctaaatcaactctacaattgcttctcatccagtctttcatttatgaagtatcaaatctgtgaactacactgaataatctaaaggtcctttgttacccaaacaacttatgagctcacggtaaaactgaaaagctgaaaaaggctcagagtggtcacacattggagtttatattagtcaaatttttggtttattaagcctattcattttacctctcctctgtagataatcagtataacttacatataattagtcacatatccaaagtcagtaaccaagaaaatgtatttcactgatattactatcagaacgctatagctatacaggccttgtcatctcacccagagcctccccatacagagggaaggttcgtaaattttaaataaatcgtaattgtgtaaaggaattaaaatacttttagaattacctttgtagagctatctcatttaactagattttttaaataaatttttttaaatttaaatttttttaatttaaaaatacatatatttaaggtatacaataatgctatcaactagattttttaaagatctctgtcagaaatagctacacacatgattcacctacgcttctttctgaatacttcttgatttttcattatgcatttccaaactgcatacccaaaaggtatgcaataattagaagaaagtgaactttaaaaaacaaatccggcagggcgtggtggctcatgcctgtaatcccagcactttgggagaccgaggcaggcggaccacctgaggtcaggagttcaagaccagcctggccaacacggtgaaaccccatctctactaaaaatacaaaaattagctgggcgtggtggcatgcgcctgtaatcccagctactcaggaggttgaggtaggagaatcacttgaacctgagtggcagagattgcagtgagctgagattgtgccactgcactgtagcctgggcaactgagcgagactccgtctcaaaaaaaaaaaacaaaaaaatacaaaaacttagccaggcatggtggcatgtgcctgtagtcccagttacttgggaggctgaggcaggagaatcacttaaacctgggaggcagaggttgcaatgagtcaagatcatgccattgagctccagcctaggcaacagaccaagactccatctcaaaaaaaaataaaaataaaaataaatccaatggctcttataaagaataacagacatgaccaagtggagtttagtccaggaaagcaaggaaggttcaaaactaggaaataaattaaaattccattcagcaggatcaacaacatgtatcccaggttctgacaaaaatatacacaggcatgagactgaaaaaaatggaaatgaacaatgtgaggatctgtacctgcatgcagagagacaagaactcctggcaagcacagtgataaagacatttcatctttctcagaaagctctggtagagatctcagcatacaatgctttgtatcatcactaccaagcagtgttaggagatgacagctgggattttgctaaaacagtctctccttgtgatggagtcaattctcctagttacatggccgtagctaaaaagtatacgtgcttggttccctagtcctcctggataaacgctataagctatctattatactatgaaatattccattctacttgaactggttgaattagattatattgtctgtaaatatgttgtttgtaaattttaaaaatacacaattcaaataagaactttaatatagctgttttggttttgtttgtattatttcctaatattgtctgtaactttttattttgaaataatttcgaacattcaaaaaaagtacagaattcctttatactcttcatccagcttccccaatgtatatatattacataatcatagtacagttatttaaaccaggaaattaacatttacaataccattaaccaatctacagatatcactcataaaaagatttaaaaaaaggcatgtatatgaataaggtgcttattattaataatgcttggctgacggtggtggttattgttattataagttttataattttataattacatatctatatttatatattattatatgataaaagtgacatgcaaatagaacaaagatcatttcatcaaaaggttagtggctgggcatggtggttcacacctataatcccaaaactttgggaggctaagacaggaggatcacttgaggcctggagtttgagaccagtctggcaacacagccagactctgtctccatattcaaaaaaaaaaaaaaaaaattacccaggtatggtggtgggtacatgcagccctagtactcaggaggctgaggtgggaagattgcttgagcccaggagttcaagactaaagtgagatcacaccactgcactccagcctgggtgacagtgcaagatcctgtctaaaaaaaaaataagtttagggatagctatattcaaatatctgggggaaaaaaaatcatcaatcaatccctcataccataaaaaaatttccaaatgagtctaagatttaaatgtaaaactgaagtcataaaatgagtctaaaataaaacttataaaagcactaaatgggttaggcgtggtggctcatgcctgtaatcccagcacttctgggagaccaaggcgggagagtcatgtgagtgcaggacttcaaggctacagtgagctatgatcatgccactgagccctagcctgggtgacagagcaggacatgtctctaaaaataaaaattaattaaataaaagcactgaatgaaatgatacaaaaaacattttatcacttcaagtggtaaaagcttttctaactaagagtttttaagatttctggacttcatattgacatatttaactacataataatcagaaactctatatgcaaaaaaaaatcaaaaagtaaattaaacacttagaaaaatcatttgcaacccatatcattacataagcacaaatagcttcctgaaaaaaaatttttaaaagaaaatatatctgcttgtgggaactagggtgttaaaaaaaaaaaaaagaaaatttaggcaaaggcaatgaacaaaaaggtaaataaaagtggcactaaaacatgaaacccaactttgcttacaaaatgaatattaaaaatacactaatataccatttttacatatttgattgacaaattccaaatctctaacaacatataaaaataatacatagtatgtgcaagaacatgaggaaacaggtactgtcatacattactgttgttgaggaaacaggtacaatatgacttattaagagcaatttggggctgggtacgttggcgcacacctgtaatcccgggactttgggaggccgaggcaggtggatcccttgagcgcaggagtttaagatgagccaaggcaacatagcaaaatcccatctctactaaaaatacaaaaattagccaggcgtggtggcagacacctttagccccatctacttgggaggctgagacacaagaatcacttgaacccacgaggcagaggttgcagttagccaagatcgcatcactgcactctagactgggtgacagagtgagaccttgtctcaaaacaaaaaaaagaaaaacaaaaaaatagcaatttggtaatatctatcaaaattttttatttttgaaacagcaatcaaactactagaaatgtatattatagacacatttatgtatctaacataatgatgttagatacaagaacttcattgtattgactctttttaaattacaagataaaggttaatgacagcctggcatgatggatcactcctgtaatcccagcactctgggaggccaaggtgggtggatcacttgaggtcaggagttcaagaccagcctggtcaacatggtgaaaccccgtctctactaaaaatacaaaaattagccaggcatggtgacacgtgcctgtaatcccaactacttgggaggctgaggcacaagaattgcttgatcccaggaagcggaggttgcagtgagtcacctgggcaacagagcaagactctgtctcaaaaaaaaaaaaaaaaagttaatgaagttgtatacaactatacaatgaaatatgatgtacatatagaaaagaatgaggccactccacatgatatgaaaagatctctaagatactgtgagaaaatcaaggtggagaaaagtgtgaacagtaggctacaatttgagtgtaaatcatttacacatagacctatgcatgtgctaaatatgtctaagaatgaactaaatatcgattgtctctggaaaagatctattgcatagaaggcaaaaaaaagattttagtacatacacttttgaacaatttgaattttgtgccatgaacacatattacttatttcaaaaaaaacaatttaaaaagaagcaaatgcagccaggtagggtggcttatgcctgtaatcccagcactttgggaaaccgagagagcagatcagttgcactcagagagttcaagaccagcctggggtcttgaaccaacatggcgagaccccatctctaccaaaaataaaacaaaaaattagctgggtgtggtggcatgtggctgtagtcccagctgcttggaggctgaggtgggagaatggcttgagtccgaaaggcagaggttgcagcagcccaagattgtgccactgcactccagcctgggcgacagggcaagaccctgtctcaaaaaaaaaaaagcaaatgcacaaaacaccactgatgtgaactgtagagcttatgaaatcatcataaatacaaatggtattaatacaaacgtttgggatttctcaagtaacctatttctaacaaattactcactgagtcaaaaataattcagcacaatataacaatgacattgcagaggcattattcaaatatttaacaactggcacagtgcaggcaccatgcaatcagaacacatacaaaacctatcaagatgggctcaagctgtaaaaatctcatacttacatattgaggcacattggctagctattggccttcatagaacatacttaagtaaaaaataacagatacaacacatctgcagaaaacaatcacaaaatacaaacctctactatataataaatttataaactcattcaacacacttttactgaatgcctacagtatgccaggccctgaggaaatagtggaacagtgatcaataagacagaaatagcctacccgtatttgcaggaacactgtgtcttatatcctacagaaatcttttttaattgcttatttagaaaatggctgggtgcggtggctcacatctgtaatcccagcactttgggaggcaaaggtgggtggatcacctgaggtcagtagttccgagaccagtgtggccaacatggtgaaaccccagctccgttaaaaatacaaaaattaggccgggcacagtggctcacgcctgtaatcccagcactttgggaggccgaggcgggcaaattacctgaggtcaggagtttgagatcagcctgggcaacacggcgaaaccccgtctctactaaaaatacaaaattagccgggcatggtgacacatgcctgtaatcccagctactcgggaagctgaggcaggagaatcgcttgaacctgggaggtggaggatgcggtgagccgagatcgcgccattgcactctagcctgggcaacaagagtaaatctccatctcagaaaaaaaaaaaaaaaattagccaggtgtggtggtgcatgtctgtggttccagctactcaggaggttgaggcaggagaatcgcttgaacccaggaggtggaagctgcagtgagccgagattgccccattgcactccagcctggtcaacaaagcaaaactccgtctcacgaaaaaaaaaaaaaagaagaaaagaaaatactagacttctggtttccaaactggaaatctctttctccatgaaaatatataatataggaatgacaccaagtagtaacttcagctcaaaatgtcattttgtataaatataaaatatataacattcataagttttcctaaatacctataatatctaacagaaaatacaagagttttaaaacaacatttctgataccaactataagtataaagtatctaggagtgtattaaaacatacacaagacttgaaagtaaagaaatttttttccacttttgataaatgaacagacctgtttctggatgggaatattaaatcagttcaagttgttaacttttcacaaattaatctataaattcagcacattaccattaaaattccaatatgatttttttctgaaacttatagtgattctaatttctatctgggaattaaatatatgaaaaaagtgaagggaaattctatacaaaaagaatactagaatcattaaacaaatggtataacataattattaaaactgtatggtactagacagaaaataatctaattaaaataaaaggttggtacaaataacttcaatataggattagagtgtcatcacaagcattaaatggagctatgaaattttcattttaaaaaattaagactgaatccttatcttacaaaatatgccaaaataaattctagataacttaaaatatcaaaagttaaattagaagccacaaatataagaaattctcaaagagtacaaaactcattaagctgtagaaataaaaagtggtacagaaataaagtattttcaatttggtgaaaaaaatgtttaggaagacatgaacagtcaattcacaaaaaaaaaatccaaatgacacttgcaaaaaaaaaatactaaatgaatttaactttgtttgaaattattaatgctcaaagtaggtgagaacaagattaaacagatactttcatacactcctgttgaaatatttccagaaagcaatatggtaatactaactaaacatataattgtgttaagtcaagacaatcttttattaaatgtgaggaataacaatcagcagcagatgccaatgattaagaaaaattaagaggaaaaattcaaaactgagaaaattaattccatgaacttcaacctgtaaatttggtaaagataatttttaatcaattttagcagtagaaaggtctggtccaggtccaagaacaccagtattctcaggaagataatttaaaagaatccacacagaagaatgtaaaattaaggagtgacagaatcttcagacacaagaaaaccttcttgtggaaaagaattgcagtgattcagaaaagtagcagaaaaaaacaaaaatctctaaggccatacaaaactagtaattccataattatataatgattataacttcaaaataactttttagtgaaaggaaagctcaaagagaaaatattttatgaaaatcatctagatacaacaataaaaaagacaaactcttcaacagtattttctagaagacagaaactaaaccttgtccactgaatacaataaagtacttcttacaacacccacatacaattgtacatcatttcatataagggaaaccaaccaataaatctgaaacaatttactgccaagaagataatgtctggagagagttttaatagtgtgaaattttcttctaacaattacatatcctccatgcgatctaaattggtcaaaaacctcgttacaactaacataagagaccttaccttcatcttaatattacttacatcaatcattcctataagtaaccaccctttcaagaagctatagatttttgaaagtaatttccaaaaaaagccccaaatatttcaccagcttttaaactgagattataatggtgagagcaatatccagacaggtgttttaaatattcctccattgctttaaatactataaaatatgcctttcaaggagaaattgatggcagaaatttgtacatacaaatgtgtggcatatttgatatactatatgtatgcatatctattatacctaaaaaacatgcacagggtctacagtatgtcatgttaaccctttctaatagttatttgaagctgatcaaccttcaaaacacaaatttgtttccaatgacagggatcataatccaggtacaggcattggctagttattatctgagctgtagtaatggctctgcactacaaaatgtaatcttcccaaatgtcacagtaagttatgaatatctgagcagcctaatgcactttactagccatgaaatgtgaaaatgtaatcttattaccttttttatggttgtatttttttgaataatgtagcatggaaactgatgtatagtctttttctacattttagcatgatttggtctcctttgctatatagaacatttttcaaaactctccatttcaacatattttagtcttggcctgaacttcataaacaatttttatagcagccttcagggtggcataacatgctttctataggttatactttaatgcataaggttatagaaattttaaagcaacttattcgaagaattcaaataaacctttataagttttgtatgaggactttaattgagcatgattatttttcttctcaatagtgatactaataaaatactttaagctgacattagtcactaatctaaattacctgtatattcggaaaatctaaagaccaaacatggagatcaaaaataattatcttctcttcaaaagattaatacaactggaatactgtgtgactcacagaaaattcaaatacttcaaagtaaagctctgttctccctggacaactcactggaaacttgctaaatttttcctcaaaggtggggcaggagtatggtatagtttaaaaaaaaaaaaaaaaaggacagggtgtaatcacagcttctgaccctaactagatactttcttgtgacctatctattatgacaggtgtagttaacacctgtctaaaaatgtcaaaattgcttttttctctgaacctatttatttataaaattaactaagagtaagcttcttttatttatctgcatccttcagaaacatattcaggttttaaaagtgtcaacctcaagatatccaatttttctccaggaatcctttcctaagtgaatgttaccttgtatatgtttacagccactggaaacttactaataaggagaagttgagggaaaattacaaagctgtgacacagactgcactgactcccaggttatatttccttcttccataataataaagagtttctagtttggcacacagagcccaggaaaaagatctcactctccagcttttcttgaatgaaaagcattcctgatcagccatgtgaccaagttctgaccaacaggcagtaaatacgtgcaacctctaggtattattctttaaagaaagaaacctgacccctttttccagctacgctccttcctactgcttaagatgcagaatagtggcaagagctacagtagccatcctggaattgaaggtgtcttatgttgaagataaaagagcaaatcgatctatggatcctggcaatcatagaactgccacactagcccgctacccagactttcacctgaaggacaaatacatttctgttttgcagaaaccactgttaatttgggcctctctgttctatcagttaaaagcctatattctgactaatatagatgctattcactgcattttctcagaaattaaaaaatatatattatctataactatctcaaatgatgtatccttattccccattcttataccatagcaggtgttagttcaccaaaagtgtcttttttgacctacttttgatagttggttatgtgccctggtaagttgagaaaccacagaacagcctattccctgactatattcttactggatagcttcatatatgctctacactactgtgccactatgacactttgccagatgccccattacaggttgaattgtgttctccaagaggacatatgttcaattcttaacctccagtgcttcaaaatgtgatcttatttggaaataggattgctacagatgtaattagttaagatgaggtcattagggtgggtcttaatccaatatgactgttacccttataaagagggaaaatttgtgctcgacacatgtacacagagaaaatatcatgtgaaaatgaagatagagattacagtgatacttctatatgccaaagaatgtcaaagattgccagcaaatcaccagaagtcaggaaagaaacatgaaacagattctcacaattctcagaaccaaccatgccaacacacttatcttagacttctagcccacagaactgagggaataaatttccattgtttcagcaacctaatttctagtactttattacacagccctaacaaactaatacatcccaacatctcccaaggtttatttttgatgttacccactaaattccccagtaagcattgtcaagaactcttagaaaagccaaaccacgacccagagactctgttcagcttatcttcacccagaccttcctacaacaccgtactctccttagagaaagaggtttgcggaatggatacacacagacatacagagtgaaataatagacactggagactccaaataatggaaaggaggtgagggtgaaatatcacctattgggtacaatgtgcactattcaggtgatgggtacactaacaggccagacttcaccataactcaatatatcaaggtaacacactgaacttatacccctaaatccataaaaataaaaacttcaatgtcaaaaaataggtttgtgattggtactcagtttttccaaaaagaacaatatattgctgaggaatatatacgtagataataaacttaaaaaaaaaaacaaacaaaggaatgactcacatcaaagttagcaaaagagctgggcatagtggcttatgcctgtaatctcagtactttgggaggctgaggcaggaggactgcttgagcccaggagttcaagaccaggctgggcaacatagcaagacctggtctcttaaaaaaaaaaaaaaatagcctggcaggtggcacatgccaatagtccaagctactcaggaagctgaggcaagaggactgcctgagcccaggagttcaaagctgcagtgagctatgatcatgccacagcaccccagtctgggtgacagggcaagatgctttctcaaaaaaacaaaacaaaacaaagttagaataaagataattgttttagcaaagaaaaagagattccaagtaaaaatattgttctattgttaacctggtattggatatatgcaggtacattttaatggtttttaagtacttttatatactttacacatatctttttaagtactttttaatacttttaagtacttttatatattttacacatacatttttaaaatacaacttattttgtatttgctatctccttgcctctctctgctatcttttggaaatttccccagtgtttcagttaccacattctttattcaattctttctaatctacttttcaatctgtctgttgagttaatttctatgtctttttatttaaaagttctatttgttgttatttttcaaatctgcttagtaatcttctctctttcctacataatcttttaagtgccttttttgttttccttctttttgttttctttctttcatgactttttgacatgaaagggcctctatttcataatttattataattttctaaattttatagtttgaaagtcttgaagatctaatcttgctttcagtgtatctactgactcctcatgctgtgctgcttttttaacgggtttttaaattttagattgtaaatttattttcaatggggctttatctgagagactctcgtgcagcctgtgcctctctaggttgaattaggtattctgctacctgccctagggatgtcttcagcatggaatgacttaaaaatatatatatatattttgagatggagtctcactctgctgcccaggctggagttcagcagcatcggcttactgcaacctccacctcctgggttcaagcgattctcctgcctcagcctcccgagtagctgggattacaggcgcccaccaacacgcccagctaatttttgtatttttagtagagacagggtttcaccattttggccaggctggtctcaaactcctgaccttgtgatccacccaccttggcctcccaaaatgctgggattacaggcgtgagccaccgcacctggccttaaaaaatattttttattgtgaaatgtttcactgcacccagctgccaagctattcttagacaaaatttaacattacagatatcgtggtaatacaatccagactttttttggaaatatcatattttctttcggaacaaacatttcttatatagtgtctggctacaatggctcatgtctgtaatcccagcactttgggaggcagaggcaggtggatcacctgaggtcagaagttcaagaccagcctggccaacatgggggaaccccgtctctaataaaaatacaaaaattagccaggtgtggtggcaggcacctgtaatcccagctacttcagaaactgaggcaggagaatcacttgagcctgggaggcggaggttgcagtgagcagaaatcaagccattgcactccagcctgggcaagactctgtctcaaaaaaaaaaaaaaaattcttagtaatatttgtctctactgggattctaaatctctgtaggtaaagacagtaaagtgtttttcttgcaggtaaagaaaattatgagttcgatactatataaaagaaaaagagtaagtttaatatgatttacagttaagtgtaaatgtagaatgtcactagaaacaaatataaattttcaacatatcccacccaaagaacttcacacaaatatgagtccaaaatatttcctaattatcaggtactagaaatcaaatctgctgttttaggacccaatttgaattctaaaatgttttcaccgaatacaacaatatgggttgggtagacaaaatttcagctcactctggttttcccctgtcccttctctaagatcataattgtaaaaaactatgtccatgtcccaggaatcacagaacatttagtctcgtataagaaatttctcatttcagaaaattaggttaaatttggtattctctacaattgcctttcctctttcttgcttcttttaaagaactataccttaacgttttcttaaggcccagctcaagaaatatctctctgagaaccattttgacctctccagccgacagtaaactagaatgatacacatcatattaccaatacaatatagtcatttaatatgctgaactgaaaatattccctttgaagtttttgttctccttctacttactatattctgggtctttcactatttcttagaatgcacagaagccctagcagtttcagcaatattatcaacaaactcacaatcatataagatttccatttctactatcataactaatccttacaagaaccctgtaagtcatacagattagtcaattatcacatctagctgataaaggaacaaaaaaaaaatgtgtccattcatagccaagactacaaatcagactatctgactcatagtctcatgtttccttacaccttcactaataatctattatttaagttagatttttttttctttaaatagtgagctaagtatttgaaaaatttgtgaactttactatctatacaaaaattagtcaaagtatatgttactgaaaataaattagaagtatcatctttatatttatttaaatccccaaacatactacaaaatagtcgaaatctcctctcattgtttattgtacccttcataagagttagaaattttcacagaataatggtatgtctacaaaagtgttaagaaaaaaggttccatgatcaaataagtctaagaaataatgaattaaacaatggtaaagagatgtttatatgatagaattaccagagctttaatatgcaactgtgcagtagacatcttgaaaggaagatatacaaccaatgcatggacttcccaaaagttatttcacaatggaacctcttttcctttttatttgatttagagatagggtctcactatgttggccaggctggacttgaacttctgtgctcaagcaatcctcctgcctcagcctcccaggtttctgtttgaacaagagattttttcataaatagcattcttcaacagctttttcaaaaaacatttgatgatgtaacatatttatgttcttgaagcttattattgtaagcttcacccagacccctaaatccataaaaataaaagtgcttgaagtcttagataggcagctggatgaataaatatcacagaattaactatgttttaagcaaacatttagtaggcacttcagaagtttttcaggtaagtagtttaactcaacctgtttgttttttcacagatttccttttatgacttattgaagttagtaagtaaacaaaaaagacatcttcaattaagattactttaggaaaaaagaaaatatgagcaaataaaatcacactaacccctcatccctttctgaaccagtcagtccaaaagtcaagcaacatagatatcctcccacatttggctggtctgtgtgcccacagaagtaatgtgtgacttacgaagttaggtcattagagcttcatggctccctttacatcattcattctaaggaaaatcagtcaccacaaatgaggatattcaagcagctcagtgagaggctcacttagagaggaacagtcctccagccagcagccagcaccaacttgccagtcatgtaagtaaccctgaaagcaagtcctctagtcccagttaagtctttagatgactacagctccagccaacattttgaatgcaacctcgtgacagaccctgagtcaaaactatctagccaacctactcccaaattcctgacccagaaaaactgagctgataaatgtttatcactgttttacactgtaaggtttgggggtaatttgtaacacagcaatacataactagtacagttacaaatcagtaattggggaaaactttattatgctatttattcctgtatcataaattttttaattcaaatattctaataataaaaatgcacagaataagtgattgctgtcagctacataggcactttacataagcactttacatggattatcatatttaattacctcttgtaaacatgaaacataagtaacttctgaacatgggtttcaacactacataatacttgtatttaattatttgtgacagttactgcagactggcttacccaacaccaattcctcaaagtctatcagacaaaactgaaaagaaagtataaatgagaaaaaaaaaatagttcatatggcaagaagacagttttggcaatgagaaaaatgaaacaaaaagatatagccaggctttaaaatcatactctatacctatgtattaagaagagaaaaagcagtgaaaaaaattcgagtggctaacagtttgtactctggcatgactctatacatctgaatactggtgatatggtttgtctgtgtctccacccaaatctcatcttgaattgcagctcccataatccctacatgtcgtgggaaggacccagtggtgggtaactgaatcatggggtggggggttctcatgatagtgaataagtctcacaagatctgatggttttataaagggcagttaccctgcacatgctctcttgcctgccgcatataagacgtgcctttgttcctccttcgccttccactacgactgtggggcctccccagcaatgtggaactgtgagtccattaaaactcactttctttataaattacccagtctcggttatttcttcacagcagtatgaaaatggactaatacaactggaaagttctttttttccatctcaaatatccaagtcagtctgaaatgtggaaggtatttagagttcaaggaaaaaaaggcagaatcaaataattcgagtacctatataaatatcttctataaaattacgtatagaaaataagatataaagatatctattgcagcactatttgtgaaactgaaacattagatatagcctaaatatccagcaatagagagatacttataaccagctgatggccatgtaatggaatattgtacagcctttaaaaagaatataaatcaatatgtgctggcatgccacgatgttcaagacacaatactaaatttttttaaaggtgcaggacagtatttacagtatgaccacatttccttaaaagatacaattatatttaaatcagagataagtgaaactgcagtttcagcctaggtagttgccaaaacatattgcttggtttcagctaagtgcccacttatgcactgcttctgacattcctaaagtgtaggtgataaataattgtattatcaagtatattaacatcatatataatcagtatgacaatgtcagtaatatagataaggcaagtcattcggatatagtatctgaatattcactttcaaatgcagacaaatttttgaggaaaaatctccttatgtgctttatatggtaaaagtgaggaattaaggcatatttctttttttttttttagatggagtctcgctttgttgcccaggctggagtacagtggcacaatctcagctcactgcaacctccgcctcccaggttcaagcgattctcctgcctcggcctcccaagtagctgggactacaggtgtacgccaccaagcatggctaatttttgtatttttagtagagacggggtttcaccgtgttagccaggatggtctcaaactcctgaccttgtgatccacccacctcagcctccctaagtgctgggattataggcgtgagccaccatgcccagccggcatatttcttattataagaataaaatgctacaatatttatttattatgaaataaacagtattatgaaagctactaattttatcttacaaaagtaactgtgccttcctcaataattggtagaaataaacagaaaatcagaaaggattaaaagaactcaataacactatcaacaaagaagaactaattgacatttatataagactccacccaattatagaacaataaatattgtttacaagggcctatggactagagattatattctgggacataatacaaactcaacaaatttaaagatattgaaagtatatggagtgggttctctgaccacaatgaaatcaaactaggaatcaataacagaaagataaagatcacagaaaaatgtgcgaacacttggaaactattacactcctaaatagtttatgtgtcaaaagaggaagtctcaaataaattttttaaatacgatgaactgaatcaaaataaaaatataatatatcaaaatttgtgggccatacctgagagggaaatttgtagcactaaaaccagaagtctcaaatcaataatctaagtttccattttaaagaacctagtagaaaagcaaaataagcccaaaacaagcagaaagaaggaaataataaagacaaaagcagaagtcagtgaagtagaaagtaggaaaacaataatcaatgaagagctagttctttgaaaagatcaataaaattgacaaaccttggcaggacttaaaaagcagcaagaaataagacacaaattactagtatcagggagaaaacactatcactacaggccttagaggcagcaaaaaaaaaaaaaatagggaatactgcaaacaactctaaacatataatgtgacaacttagaggaaatggaccaattcctcaaaactggaagctaccactacttgcccaatatgaaataatttgaataatcctataattattaaggaaattaagttcataattttaaaattcaaaaaagaaatctcaaagttcacatggtttctctggagaattcttctaaatattttttaaaaaattaatgccaattttaaatttctcaatccattttacgaagctactattttactaaaaccagacaaagacagtaccaaaaaaaaaaaaagcctatacaccaatatccctcatgaatataaacaccaaaattcttaacaaaaaattagcaagtagaattcggcaataaataagaattttacaccatggccaagtagattttattccaggaatgcaacactgttttaatatttaaaaatcaattaatgtaatccaccatattaataggataaggtaggacaatcacacgatcatatcaactgatgcagaaaaagtatttgacaaaaattcaataacactattgaggataaaaactcagaaaaatggaaacaaaaaaaaacttcaacttgataagcaacatttacataaaacctacgactaacattatactcaatgataaaagaccgagtattttctctcctaaagatcaggaacatggctaagacatgcactctcactacttttattcaaattagtgctgaaagttccagccatggcaattcagcaagaagaaataaaaggtatgcaggtgagaaaggaagaaattaagctgtccctatttgcaccaaagacatttccaaaaacagaaacctcctagaaataatgagttcagcaaggtaacgggttaccagataaacatttaaaaatcaattatacttccatatactaccaaggaacatgtgggcaatgacatttaaaatataccatctataattgctcaaaaatatgaagttcttagatgtaaatctaacaaaatatatacaggacttgaatgctgaaaacaataatatgatgatgaaagaaatcaaagaagatctaaataaatggagaggcacactgcattcatagtacagctgtcaattcctccaaaactgatatatagatctaacatagttcccatcaaaatcccagcaagacttttgcagatatagaaaagattattgtatgatttatatggaaaagcaaaggaactagaataccaaaaacaatcttgaaagagaaagataaagtagaaagaatccatctacccaatttcaaaacttattatgtagctacagcaatcaacactgtgaggaactggtggaggggcagacacataaatcaatgagacagaataaagaacccagaactagacccacacaaatattctgaacagttttaacaaaagtacaaaaagcaattcaagggagaaagaagagtctttaaaacaaatggtactggaacaattacaaatgaacttttctttacctaagtattacaccttacacaaaaactaactcaatattgatcacggatttaaatgtaaaatataaaacttttttaaaaacataggagaaaatcttcagaatttagggttaagcaagaagtttttagacttgacacaaaagcaagatccatacagggaaaactgataaattaggctttattaaaattaaaaattctgctcaccaaaaaaccttttcaggaggatgaaatggcaagctacaaactaggagaaaatatctgcaaaccaaatatctgacaaaagaataatatctaaaaaatatagtctctcaaaagtcaagagtaaaaaaaatccaattagaaaatgtgcagaagaacgtttcaccaaagaagacataaagaagacacataaacacacacacacaaaaagtctaacatcattaggcattaaagaaatgcaaattaagaccacagtggatatcactatacatcaatcaaaacaactaaaaaaataatgacaacaccaaatgctggtgaggatgtggagaaactggataattcgtatgttgttggtgggaatgtaaaatgacacagccactatgaaaaagtttggtaatttctatttaaaaaaaaaaaactaaatatgcacctactattcaatctagcaagtgcactcctgccatttttcccaaataaataaaaacttatgttcacacaaaaacctgtatataaatatttacagtagttttgttggtaatagccaaaaagtggaaatcactcggatgtccttcaacagctaaatggttaaacaaactgtagtacatccataccataaaatactattcaacaataaaaaggaacaaactattgacacacacagcaatctagaagaatctccagagaaccaattggtttttttctcaagttcgtacagtcttctggagattcttcaactgacaaaaatatagaaattgagaacagattggtggttgccaggggttaagatggggtagaggaaagtgggtatagctgtaagagggtaacaggaggaaactttctgcacctcgattataccaatatcaatattgttctagttttgcaagattttcccattgggggaaaccggataaagagtacaaaggatttctctgcattatgtcttcaactgcatgtgaatcagcaattatctcaaaatagaagacctagttttaaaaaataagtaattctatgtgaggtataaattgtcacaggattaattttccaccaattatttcccattgaaaagaaaactatattaacctaaatgaatcttcaattggtagaaaaatgagagccaaattaagcggcaaggaaactcgtaagttcaaattctgaagccacctacagacatacataatcccagcttctttacttatccctccctccctactccagccaaaaaaaaatcagtatatttaattacttgccctacacctgaaaaaatgtttgccatatactatacaaaaaagatgaagcatatattgatatcacacagagtttaactatatatcctactgactcacatctaatacttgcattatagaataaatatgcaaatttgaaccttcaaacaggaaatgaaattttctaaatccattacataacttcagattcatgtgtgcactgaaggctaataaatcatctaaaccttcatacagagaacctttttaaatttgcatttatctacagtaaattctgtcatgttctttaatagcttgctggttcaatctagcaaactagtgatttatagcagtgacatatttcaaaaatcagaaatctctcactatgtgacaaccagtcaaagtccactgaacttacattacttgaactcaaacatcataggatatgaaagagatagcaaaatgtcatgaatttcatattcaaatcaatttgagtttatgtttataagtgtttaaaactatagcatcacatacattacttaatacttcagtaccccaaatattttatgtcatgattccctcaatgtgtccaaactacctgtattttaaaatacatttttaaatttgatagttcataatttgaagactctacaaatcttactttgaagaacaccaaaatttagggtacatgaaagaaagatctatatattaggttttctccaccaaaaaaaaaaaatgtacttttagatctttataataatttcataccaatatccttatgtagggagatttatcagatgtgaaaatggagattatattaacaatagggaaataaactggaaattaccaaaatgttcactgtaatagacaatgttgtttttgtctgtattgtatttactcttccttccatcctcttccatttatggaattctgacaagaaagtctcagtacctcacacccaggtcacagagaggtcacttaagtcaggcctggctaaatatatacttcccccttctactggccacagtgattaatacaagactgagaatgtgagctaagtcaggccaatcaaaatcattaccaagactgttttttaatttataaggtgaaaaagaagggctcttggtctttgggtcaaaagtaggagaaatatgtaaactgaaggcttccagcagatatgttccctgccatgtggacagaggaggcctagctgcaccataaatggaagaagaatattctggtgacatcaattccctgtttccagggtttccctggttcttgcagcttcattcaatgatgtagcctggtcctatgaaccaatcattcccttttatacttaagctactttgatgtaagattctatctcttacaatgagaaaatcccggattaattccaaaaaaagaaggaactagctgaattatggcacatacgtatagttgtatataacacagcaattttttaaatcattttcattcatagttctccactgacagtctacgttagactcaacatcatctttttacaaaaaaaaaaaaaattctttgtgacacccctatactaacctgaaataaaagtgacacattccattttatcaattattttaaaaagatcagagatcagaatgtgtcttataatcaatggcatctaaaattacaattgcagggttttttcctaatgctgcataaaaataatgacaaatcttacaacttggcatcttagacttgaggaaacacaatagataataagacctacctataaacaacaacaaaaatctacaaagtactctaaccataataaaagaaaaataattaaaatacttttcagtattttttccatatataaatccttgtaaataaccaaataataaagtagttaggtcctggtaactatatacagaatctacattaatgtatgttacagaaacaaggcacagtgattcaggtgtgtattagatattcaaatactattatattccaattagacgtgatttttaattcttcataaagttccaaataaaacaaagtatgatttttttcttctttaaagcttacttatgtttctaaaaaaactcagcatatgttaaaagtattcaaaaagtttatgctgatatggaaaatgaaattaaagtctaataagttcaggagaacagaggatatcacaccttgctgtttgcaaatgtatcttccattgcaaggtccttagcagccttagtccagaacactaagtgtccactaccaactccaaatcattctaagaaccaaaaatactcaccaaatttcctaaacacctccaaggagcagtactggtctcactgagaactactcatgattggacaaggaaagatgtttaagatacatgattaaaggaaaaaaagcagatatgtacaaaataacctgttgtatatgtgtgtgtgtgtgtgtgtgtatgtctatagagagagagataggtagagacaaatgaagacagatgctgatacatataaaaatgtgtaggatgtatatgggtgtgtgtgctgcaagaagggcagacaataaactattaacaatggctacctcaaagaagtgggttgaggagagggaaattagacagtcagtctttcattttcacttcatacttttttaaatgagcatatactgctttaaacaataaaaaaaaggactttaaaaaatccaagtagtaaaggccatgtccaacatcattcccaagagcctgtctctttgcctgtgtctgtcaatgtctgcctgagcctcatcctgaccgtctataaggccgtctgtttctctctctctttctctctgtgcgtggggtgggcggggtggagagggtttctgtacctatctctctctggttcttggtatctgcatatctcttctttgagtgtgtctctcttgaaattatgtgtatctgtgctttactctctgagtatctgtctctctgtgtatgcatgaatgtcttcctcccggagcacagacggaagcatgggccttgacctcctcccagtcttaatgcattcatctttatatctctgtgtatgtgtccatcttccactttctcacttacaattattttgcttcctttcctcttctgtttccctgacccctcatctccctccatcaagcccttcgcccatcttgtcttcctctactacctccccaactgtttccatataagcaaagttcacactgctagagtgttaatgtgttcatagccctgataaactctcttcaactggatcacaaatgatcatttctatctgaagagcgtatctgaagagttctgttagttacaaaataacatgctaactaaattaaaattagggtaactaatccttattttaataatagaacaactcagcagaagatcaacatgaaaaacagaagaggtgaacaacactataaaccaactaacctcacgaacatctataggatatttattctccaggatagaccatgttactcatccataaaacaaatctcaataaatttaaaagaatagctccctctccctctctccctccccctccccctcccccccctctttgcacggtctccctctgatgccgagccaaggctggactgtactgccgccatctcggctcactgcaacctccctgcctgattctcctgcctcagcctgggagtgcctgggattgcaggtgcgcaccgccacacctgactggttttcgtattttttggtggagacagggtttcgccgtgttggctgggctggtctccagctcctaccgcgagtgatctgccagcccgggcctcccgaggtgccgggattgcagacagagtctcactcactgagtgctcaatgttgcccaggctggagtgcagtggtgtgatctcggctcactacaacctccacctcccagccgcctgccttggcctcccaaagtgccaagattgcagcctctgcccggccgccaccccgtctaggaagtgagaagcgtctctgcccggccgcccatcatctgggatgtgaggagcccctctgcctggctgcccagtctgggaagtgaggagcgcctcttcccggccgtcatcccgtctaggaagtgaggagcatctctgcccggccacccatcttctgggatgtggggagcgcctctgccccgccaccccgtctgggaggtaaggagcgtctctgaccggccaccccgtctgagaagtgaggagcctctccgcccggcagccaccccgtctgggaagtgagaagcccctccacccagcagccgccccgtctgggaagtgaggagcatctctgcccggcagccgccccgtcggggaggtggggggcagcccccgcccggccagccgccccgtccagaaggtggggggcccctctgcccggccaccccgtctgggaagtgaggagcccctctgcccggccgccaccccgtctgggaggtgtacccaacagctcattgagaacgggccatgatgacgatggcggttttgtcaaatagaaaagggggaaatgtggggaaaagaaagagggatcagattgttactgtgtctgtatagaaagaagtagacataggagactccattttgttctgtactaggaaaaattcttctgccttgggatgctgttaatctataaccttacccccaaccccgtgctctctgaaacatgtgctgtgtccactaagggttaaatggattaagggcggtgcaagatgtgctttgttaaacagatgcttgaaggcagcatactcgttaagagtcatcaccactccctaatctcaagtacccagggacacaaacactgcagaaggcggcagggccctctgcctaggaaaaccagagacctttgttcacatgtttatctgctgaccttccctccactattgtcctatgaccctgccaaatcctcctctctgagaaacacccaagaatgatcaataaatactaaaaaattttttaaaaattaaaaaaaaaagaacctagactcagaaatcaaaaaaaaaaaaaaaaaaaaagaataaaaggaacaccaagtatatcatttgaccataagggaataaaactagaaatcataacagaaagaaattttggaaactcaacaaatatatggaaattaaacaacacactcctaaatagcctatataaaagaataagtgaagaaaaaaaattaggctaggcacagtggctcacacctgtaatcccagcacttcaggaggccaaggcaggtgcatcacttgagcccagagttcgagaatggcctgagaaacatggtgaaaccctgtctctacaaaaaacagaaaaatgagccaggtgtggtggcacatgcctgtagtcccagtgtctcaggacacctgtgaggatcacctgagcctgagaggtagaatctgcagtgagccaccatcacaccactgcactccagcctgactgaaagagtgacacactatctcataaaagaaaaaggaaaggaaaaaaagaaaatagaaaatacactgagatgaatgaaaatgaagatacaacatgacaaaatgtatggaatgtataaagcagtgttcagagggaatttatagctgtaaatgcctactttaaaatagaagaaagatactaaatcaacaatataacctttgaacatgcataaaaagaaggagccaagccatgtccggtggcacccacctgtggtctagctactcaggaggctgacgcaggaagattgcttgagcccaggagttcgaggtcagcctgggcaacacaaggcaaacccccatctcaataataataataatgacgtaggccgggcgccgtggctcacacctgtaatcccagcactttgaaaggccaaggcatgcagatctcctgaggtcaggagttcaagaccagcctggccaacatggtgaaaccccatctctactaaaaatacaaaaattacccaggtggggtggtgggcgcctgtaatcccagctacttgggaggctgagacaggagaatcacttgaacccgggaggcagaggttgtggtgagccgagattgtgccactgcactccagcctgggcaacagagagagactccatctcaaaaataataataataatgtagccttccatcttaaaccctacaaaagaagcgcatagtaaacctaaagcaagcaaaaggaataaaataataaagattacagaagaaatgaatgaaacaaatgagaataaaatgaaattaacaatataaaattagtggtatttttaaaaataaaatcaatacaacctggcttctttggtccttcaacaacaacaacaaaaaaatgaaattgacagatttttagttagactaaccaagaagaaaagagaagactcaaattactaaaatcagaaatgagagtgcattactaccaaccttacataaatgagattataaagacacactatgaacaattgtatgccaataattagacaacttagataaaaggagcaaattcctcagagggatacaaactacagaaactgactcaaaaagaaatacaaaatacaaacagacctacaacaagaattaaattagtaataaaaaaatcaactcacaaaaaacaaaacaaaaaaaaaacttaggcccaggtggcttcactggtgaattctacctaacatttaaagacaaattaatacaattcttcacaaactcttccaaaacactgaggaggagagaacacatcccagctaaatctatgaggccggtactaaccttatgccaagatcagacaaaaccatcacaaaaaagaaaactacagaccaatatatcttatgaatatgaacacaaaaatcctcaacaaaatactagcaaaccaaatccaggaacatataaaaacagttatacactatgactaaatgagatttattccaggaatgcaagctcagtttaacattcaaaaattaataaatgtgatacaccataaaatgaaaaaccacatgatcatctcaatagacaaaaaaagcatctgacaaaatctaatacctttcattattaaaacacttaacagactaagaatagaaagaaacttcttcaacctgacaaagggcatctatgaaaatcccacagctaacatcatacttaatggaagtatcactatgaaccaattaggtattttatcttaaaatacatatacacacacatatacacatacacactcacacataaatatgtaatgtgtgtgagtgtgtgcgtgtgtgtgtatgtgtagttttatcaactggaaaggggtacaaacaatgaccaacacaataacaatgaacatgcttactgcccagattgtggtcttgaaataccatttctcactaaaaatcagggcttcttgaaggagtagcttgtattagtctgttctcacactgctaataaagacatacctgagactgggtaatttataaaggaaagaggtttaactgactcacagttccactccccagtggaactggggaggcctcacaatcatggctgaaggtgaaggtggagcaaagacatgtctttgcaggcaagtgagcatgtgcaggggaactcccctttataaaaccaccagatctcatgagacttattcactatcaagagaacagcacggaaagacctgcccccatgattcaattacctcccactgggtccctcccacaacatgtgggaattgtgggagctagaattcaagatgagattttggtggggacacagccaaaccatatcattctgcccacggcccctcccaaatctcatatcctcacatttcaaaaccaatcatgccttcccaacagtccccccagtcttaacccattttagcattaactccaaagtccacagtccaaagtctcatccaagacaaggcaagtcccttctgcctatgaatctgtaaaatcaaaagaagctagttactgcctggatacaatgggggtacaggcattgggtaaatacactcattccaaataggagaaattggccaaaacaaaggggctacaggtcccgtgcaagtccaaagccagtgggacagtcaaatcttaaagctccaaaatgatctcctttgacttcatgtctcacatccaggtcacactgatgcaagaggtgggttcccacggtcttgggcagctccgcccctgtggctttgcagggtacagacccactccttgctgctttcacggctggcgttgagcatctgcagcttttcgaggtgcacagtgcaagctgtcagtggatctaccattctggggtctggaagattgtggccctcttctcacagctccactaggcagtgccccagtggaaactctgtggaggcgcttgtaccccacatttcccttccacagtgtcttagcagaggttctctgtgagggctccacccctgcagcacacctctgcctggacatccaggtattttcatacatcctctgcaatctaggtggaggttcccaaacctcagttcttgacttctgtgcacccaaaggcccgacaccacacataggccatcaaggcttagggctttcaccctctgaagcaatggtgtgagctgtatattgcccccttttagccacagctgggatgcagggcacaatgtccccagactgcacaaagctgcaagtcccggaggccagcccacaaaaccactttttcctcccaggactccaggcctgtgatgggaggggcttctgtgaagacctctgacatgccctggagacatttccctattgtcttggcaattaacatttggctcctctttacttatgcaaatttctgcagctggcttgaatttctcctcagaaaatgggtttttcttttctattgcatcattaggctacaaattttccaaacttttacactttgcttcctcttgaatgctttagcacttagaaatttcttccaccagataccctaaataacctctctcaagttcaaaattccacagacctctagggcaagggtaaactgccgcaagtctctttgcatggcaagaatgatctttactccagttcccaacaagttcctcatctccatctgagatcacctcagcctggactttatcgtccatttcaccatcagcatcttggtcaaagccattcaacaagtctctaggaagtttcaaactttcccacatttccctatcttcttctaagccctccaaactgttccaacctcttcctgttacccacttccaaagtaacttccacattttcaggtatctttacagcagcaccccaccctaccattaccaatttactgtccgagtctgttctcacactgctaataaagacatacctgagactgggtaatttacaaaggcaagaggattaacggactcacagttctacatgcctggagaggcctcatagtcaaggctgaaggcaaaggaggagcaaagacacatcttacatggcagcagccaagagtgtgtgcaggggaactcccctttataaaaccatcagatctcgtgagacttatccactatcaagagaagagcaggggaaaaacccacccccatgattcaattacctcccactgggtccctcccacatgagacctacaattcaagaaagattttggtggggacacagccaagccattatgatagctggttcaaggtctggaactagaaatgaaaatatgagcctgaaatatcttgccataaaaatagcagaaacatgatcaaagtctagtagggttgtaccaaaaggactcaggaatcaacctgaagaagtgcctactggccaaaaataaaagtttgaggttcaataaagtaataataattgccatcaaatatgtttaaatcctttaattcataatatttcaaaaagacaataacaacgaattggtctcctgtagaggataagaagagaaatggctgttacttacaaaattaatgaataaaaggaatgaaactgttccaattacatatttatataatatttatataatatgtaacatagtgtaaatctaatatacttattatattatctataattatatataaagaacatataaaaagtatataaatatataaaagaatgtaaatacacaaagaatatatttataaatctatataaagtatacataaatatataaagtgtgtgtgtgcatgtacgtatacatacttttttttttttttaagaaacagggtcttcccatgttgcccaagctggccttgaactactgtgttcaaggaatcctcctgccccagcctcccaactagctggggctaccggtgtgtaccaccatgcctggcttatctatgtattaactgtgccactggataactaaatacaactggataattaaatacatcttttcatagaactattccatttaatacatgaaaaaatatatataatatcatcattattcagactccagtgatttaatggatctagatgttgagaatcaacagctgataacattataaaaagagacaacctgacataagagcctccggatgacagaacacagcaccacctagagtctagccaaaggtatggaagccaaatcttctggaatcaacttccaatttgcaggaaatacggaggacacaagaacatgttaaactacaccatgaatatgcacttaacaaaatccagaccatgggaaatgctaaatgtcaaaaggtccaggttttttaaaaggtccaggtttttttaacagatagaatgacctgagacttaaaaaacgtgttttttaaaactaagaaaaactaaattatagataagggatgtattattagattacataattacaaataaataaaagaaagtgattactgtaaaagtcaagatagaggttccatttgagggagagaggcagttgtaattagagggattctaagatgactggcaaaattctatttcttgacctacatggtggtttaaaggtaattatttgccctttagttttatatttgttttggtttggtttttcaatagttacagttttacaataaaaatttttatgagaaagttctgtcaatggttaatttcatattttaaaacatctatattcaggcaatgcaattccatcataaaattagtagtttcagtttttgtaaacttgtaactcacagcctgtattaaatacatataacacatttctttcagtgactcctaagaagcttctgatgcataactaacctccatatgtaagtcacctcaaaacagtaacagtgctctcaagctgcctcagggaacatggcgccacctctctgctgagttatgtatagccactttggccgcccactgcatcctgatggtgatgggggagacaggctttgattgccagtcacacccctctatcctcaccccatattggctgtggctgtagatgagattcagctgtgggtggcctcagctcaccaaccactgccttggttttgagggtcaaacccaggctcaaacaggtgggggaggaggataaacagccatattcacaaatgcattcttgaatcactgaatctatgtgaaataattaaacaaaagagaatgtccttaaaaagaactcatatttgcaggcctaatcttcacccaagagatcttaaaatgctatcaccttatgcataagagctaaagagaaatactgcaaggcatcatgatatcctgagaaaacttaaagctaagacagaagaaacagagattagccagaaaaaaacaaagtctagaaaaatcaacattgatatatttcaaaagatttaacagctgcagaaaatgagtttcaaaaacaaaaaatactatttttaaaaataccagtcttattatttttattagaaaggttaggaggatagaagagaagcaagtagacaagctgactctaaatttctctaggaaaagtaagcaaacaggaatagccaggaagctgtgaaaaagaagtgcaacaatgggaagctagctccatcagagattaaaacataatatgaaataaaataacttttttaaaaagcggtagcagtagatgaatgtctgctagatgaagaagagaacagaaagtccacacatagtgccaaagacaacaggaaattatcacaccataataatagcaatttttagagcacttacttgtgccaggcactaagaatcttatgtatattaaatgtctgactactccatgagataggtacaattattgtatttttatttgaggaaactgaggcatagacatatgaagtaacttgcccaagatctcagaggcaagaagtggtgctgctagaatttcaacctaggtaatctagctacaaagtccacactcttaacctgtacgcactatggtttttctgtttttcattcaggtgacatctcaaatcatggaggaataataaacaattcaataaacagcattaaattggaattcaatttttttctacatatgttcaaatggacatttgtagaaaaaataaattggcccatatttcaaatcaggaaaaatttcaggccagacacagtggctcacacctgtaatcccaacactttgggaggctgagataggaggattgcttcagtccaggtgtgcaaaactggtctgggtaacatggggaaaccccatttctacaaaaaaatgcaaaattagctgggcatggtggtgctcacctatgatctcagctactcaggcagctgaggtggaaggatcacttgagcccgggaagtcccagctacagtaagctgtgatcacaccactgcaatccagcctgggtgacagagtgagatggataaataccagagtgataaataccatcaaaataatacaggaaagcatagaactttaaggaagttctgagtaagaaaagcctttctatgtatgattcaaaacccactaactataaaagaatagcacaataaattcaagctacataaaaataaaaagcttttggctgggcacagtggctcgtgcctgtaatcccagcactttgggaggctgaggtggacagatcacttgaggtcaggagttcgacaccagcctgaccaacatggtagaaccctgtctctactaaaaatataaaaattagccgggcgtggtggcatgtgcctataatcccagctacttgggaggctgaggcagaagaattgcttgaacccaggaagcagaggttgcagtgagccgatatcacaccactgcactccagcctgggtgacagagccagactctgtctgaaaaaaataataaataaaatttaaaagaaataaaaataaataaaataaaataaaaagctttttattaaaaaaaaaaacaccactagtcaagtcaaatcaatccctttaaaataagaagcttctagaaaataacaaaaacatcaactcaatataaaaaggggcaaagtaacatgttatttaacaatgaatttaatccctctccctctcactctgcctctccccctccccctcccctttgcacggtcctcgtctcccctttgcacggtctccctctgatgccgagccgaggctggactgtactgctgccatcttggctcactgcagcctccctgcctgattctcctgcctcagcctgccgagtgcctgggattgcaggcatgcgccaccacacctgactggttttcgtattttttggtggagacggggtttcgccctgttggccgggctggtctccagctcctgactgcgagtggtctgccggcctcggcctcctgaggtgccgggattgcagacagagtctcgttcactcagtgctcaatggtgcccaggctggagtgcagtggcgtgatctcgaatcgctacaacctccacctcccagccgcctgccttggcctcccaaagtgccgagattgcagcctctgcccggctgccaccccatataggaagtgaggagcgtctctgcctggccgcccatcgtctgggatgcgaggagcccctctgcctggccgcccagtccgggaagtgaggagtgcctcttcccggccgccaccccgtctaggaagtgaggagcatctctgcctggccgcccatcgtctgggatgtgaggagcccctccgcccggccccccagtctgggaagtgaggagcgcctcttcccggcagtcatcccgtctaggaagtgaggagcgtctctgcctggccgcccatcatctgggatgtggggagcgcctgtgccccgccgccccgtctgggatgtgaagagtgcctctgccctgccgcgaccccgtctgggaactgaggagtgtctctgccctgccgccaccccttctgggaggtgaggagcgtctctgaccggccgccccatctgagaagtgatgagcccctccgcccggcagcctccccgtccgggaagtgaggagcgtctccgcccggcagccgccccgtccaggaggtggggggcagcccccgcccggccagctgccccgtctgggaggtggggggcccctctgcccagccaccccatctgggaagtgagaagcccctctgcccggccgccaccctgtctgggagatgggggggcccctctgcccagcagccccgtctgggaagtgaggagcccctctgcccggccgccaccccgtctgggaggtgtacccaacagctcattgagaacgggccatgatgacgatggcggttttgtcgaatagaaaagggggaaatgtggggaaaagaaggagaggtcggattgttattgtgtctgtgtggaaagaagtagacataggagactccatttcattctgtactaggaaaaattcttctgccttgggatgctgttaatctataaccttacccccaaccccgtgctctctgaaacatgtgctgtgtccactaagggttaaatggattaagggcggtgcaagatgtgctttgttaaacagatgcttgaaggcagcatactcgttaagagtcatcaccactccctaatctcaagtacccagggacacaaacactgcagaaggcggcagggccctctgcctaggaaaaccagagacctttgttcacatgtttatctgctgaccttccctccactattgtcctatgaccctgccaaatccccctctctgagaaacacccaagaatgatcaataaatactaaaataaaaaaattaaaaaaaatgaatttaaaaatgagcaaaggatacaaatggataattcaaagaaaatatggtcaaccttagtcataagggaaatgtaaatttaaattctgattaatcatcactttttcacctattagactggcaaaaaccacagctgctaatactgttggagatgctacagaggcactttcatagagttctggagggagaataaattaatataatccctgggaaggcagtttggcaatataaaccaaaattataaaggaataaaacctttgacccagcaattatatctctaagaatctatcctatagatacaattacattaagtatgaaatagtatatgtaaagattatttattgaagtattattagtaataacaaaatactggaaacaacccagtaaacaggggtcaagacaaccatggttcatctatgcaatagaatacttatatagctcttttaaaaatacagaagctctgtataaaatgctttagaaagacaaataagaaaaattatcagcaaagaaaaagcaagatgtagaacaaggggtacagcatgccaccttctgtacaatgaacaagtgaaacatacaagtatttacattagtttataaaagcctaagaaaatttagaaggatacatgagctgctaataatacttttcaggttttctctctatcgtctatatatcaatcattcatccatctacctatctatttatttgagacagggtctcactctgttgtccaggtggcagactgcagtggcgtgaacacagctcactgtagccacaacctcctgggctcaagggatcctcccgcctcagcctcctaagtagctgggactataggcacatacgaccatgcccggctaatttttttttttttttttaatacagatggggtttcaccaagttgtccaggttggtctcaaactcctgggcttaaacagtccttccacctcggccttgcaaagtgttgatgttacaggtgtgagccactgggcctgacctaggttttcttaagcagtgactaaattaactgaaggagagagatgagcaagggataatgtatgctggaaacaaggagaaaagaggtcatagagagagatttcattaaatacattcctatttttgacctgtgttaaaatgtttcaaagtcatatatttgacagaccagaaacaataccatcccacaggtactggatgagataccccaaataatatgttaatatcaataaagatagtgttttgtacatgatccatcttcattttcgtttttgactatggtattatgtgaaattttgcccctggagaaagggaagtacatattggagactgcagtggaagatggtagaaaagaagtgaatcagcaacttatgaggcaaatgcattaaaagcaaaatacccaagtggtatatttgtagctcattctcttaagtgctacatcttactgcttgttttgtattgctagttcattcttttttttttttttgagacggagtctcgttctgtcacccaggctggagtgcagtggcatgatcttgacatactgcaagctctgcctcccaggttcaaagccattctcctgcctcagcctcccaggtagctgggactacaggtgcccgccaccacacccagctaattttttttttttttttttttttggtaatttttggtagagacggggtttcaccatgttagccaggatgatcttgatctcccaacctcgtgatccgcccgcttcggcctcccagagtgctgggattacaggcgtgagccaccgcgcccggccgctagttcattcttaattattcaaattaactaaaaggcaaatcaggatgctttctagataattttttgtattataaaaccaagaaggtaaacagtgctagtttaagcatttggctgagttaacagatttttcccaaacaagagcacactgcagcctgtatttctcaaaacatctattactattgcatgtcatccatcagcataaacaaatggaagttcaaaaaatagggctgaaacaagacagctttggtaagaattaatatttaaatgtcttcctcagtgtcgtgtcatcaggaatcccaggctgaggcccagagacaacctcatggccttgaaatctaaacaacatagaaacataagccttcactatctcttattagttatttgagatctactatttactccataaacttaaaatatcaagtaaacactggtttttaataaaagtctaatttaatttgttttaaatagtagttaaaaaaccattaacacattaaggacataaaaaaaattcctccttgaaaaataactccaatttaattcagaactctaatgatagcacattattaccaccacctcaagcttctcaagaccattttaactatgtaataacccctgaacaaaaatcatcatggcttctcatcacctacagaataaaattttaatcacttgggcaacaacgcaaaatgtcaaaaagtctcacttcccatgttgtccctatacaatccagtccagactatttattatatccagaaggagttttaatattctactcccttgcctttgctctccctccctaaaattcaaagtttagctctagccccacttctacaaaacgacatttccagataaaacttgtccattgcaaaatatgctcagttcatagatactgctttgaatttttagtctcccatccaagtacagacatacatcattttatggcacttcatgttattgttctttgcagatacagcattttttacaaattgaaggtttgtggcagccctgcatccagcaggtccattggcaccatttttccaacagcatgtgcttgctttgtgtttctgtgtcacattttggtaaatctcacaatatctccaactttttcattattattatatttgttatgatgatctggaatcagtgatctttgatgttactactgtaactgttctggggtatcataaaccatgtccatataagatagtgaacttaataaatgtggtatgtgttctatagctctaccaagagactattcccccatctctcttcctctttttgggccaccctattatctgagacataacattgaaattaggccaattaataaacctacaatggcctctaagtgttcaagtgaaaggaagatttgcacatcttttttttttttttttttttgagacagagtctcactctgtcgcccaggctggagagcagtggcgcgatttcggtttactgcaacctccacctcccaggttcaagcgattctcctgcctcagccgcccgagtagctgggattccaggcatctgccaccatgtctggctaatttttgtattttagtagggatggggtttcaccatgttggccaggctagtctcgaactcctgacctcaagtgatcacccacctcggccttccaaagtgctgggatcacaggcatgagccactgtgcccggccgcacatctctcattttaagtaaaaaactagaaatgattaagcacagaaaggcctacgtcaaaggttgaaataggccaaaagctaggcctcttgtgccaaaatccaagtgtgaatgcaaagggaaagttcttgaaggaaattaaacgtaagcaaaacagcttcatggctgatatggagaaagttttagtggtctggatagatcaaatcagtcacaacgttcccttaggccaaagcctaatccagtgcaaggccctaactctcttcaattttatgaagtctgggagaggtgagtaagctgtagaagaaaaagtggaagccagcagaggcttaaggaaagaaacagtctccataacacaaaatgcaagataaagcttcaggtactaatggagaaggtacagcaaattatccagaagatctacctgagataactgataaaggtggctacacaatagatttttaatgtagacaaaacagccttctattgcaagaagatgccatctaggactttcctagatacagatatgaaatcaatgcctggtttcaaagcttcatagaacaggcagactctactgttaggggctaatgcagctggtgactaagttgaaggcaatgctcacaaaccattctgaaaatcgtaagatccttcagaattatgttaaatgtactctgcctatgctctataaatggaacaacaaagcctggatgactgcatatctgttcacagcacagtgtactgaatattttaagccaactgttgagactcactgctcggaaaaaaagatttcctttcaaaatattattgaccatttacaatgcacctggtcacctaagagctctgatgcagatatacaaggagattcacgttgttttcgtgcctgttaacataacatccattttgcagcccatagttcaaaatgtaatttcaactttcaaatcttattatctaggaaatacattttgtaaggctatcactgccatagatagtgattcctctgatagagctgagcaaagtaaacagaaaaccttctgaaaatgattcaccattgtagatgccatgaggaacatttttgattcatgggaggaggagtttggaagaaatggattccagaccccatggatgactttgagaggttcaagacttccatggaggaagtcacagcacatgtggtggaaatagcaagagaactagattgagaagtggagcacccaggctggagtgcagtggtgcaatcacaactcactatagccttgacctcccagactcaggtaatcctcccacctcagccacccaggtagctaggactacagatgaacgccacaacacccagctaatttctttttatttttggtagagacaaggtctcaccatgttgcccaggctagtctcgaactcctgggctcaagttatccacccacctcagcctcccaaagtgctgagattacaggcgtgagccaccacacctggccaaagcggtttcttgagatggaaatctacaactggtgaagatgccatgagtattgttgagataacaaaggatttagaatcttacataaatttagttgataacgcagtagcagaatttgagaggactgactccaattctgaaagaagttctactgttcatagaacactactgaacagcattgcatgctacagagaaatttttcaagacaagaaaacaaagatcagtcaatggggcaaaacttcattgtggtctgattttaacaacttttcacagccactgagcaaccaccaccctgatcgaggcaaaaccctccaccaccaaaaagattaggacactctgaatgctcagatgatcgttagcatttttaagcaataaagcatttttttaatgaaggtgtgtgcattgtttttttagacataatggtattacacacttaacagactaaagtaggctgggtgtgatggctcacatctgtaatcccagcacttagggaggctgaggcagacagatcacttgagcccaggagtttaagaccagcctgggcaacttagggagaccccatctctacaaaaaagtaaaaacttagctgggcatggtggcctacacctgtagtcccagctacttgggaggttgaggtgggaggatcgcttaagcccaagaggttgaggctgcagtaagccttgatcacactactgcacttcagcctgggcagcaaagcaagaccctgtctcaaaaaaataataataatatatacttgtgtgtgtgtgtgtgtgtgtgtgtgtgtgtgtacacacacacacacacacacacacacacacaaaagtatactgtaaatgtaactcatatgcattggaaaaccaaaaaatgtgtgactcatattcactactttattgcagtgctctcaaacaaaatctgcaatatctccaaggtatgcctgtactaatcaggcctaactccgcttagcttcaaagatcagacaacactgggtgtgctcagggtggtataactgtgtctagagtattagttatctttatatgagtcttgtttccatcagactgtaagcttctgagaaggaaaactgcatttggtgagcacctactatgtgctgggcattattttcaaatattccaagagccctatgaaactggtactgttattctcattttaaagatacagaaactaggtcagaaagattacacagcttgaccaagatcataagcccaagaactgacagacctgagtcaaaccaaaagtctacctgattccatgcaagatactgcctctcaaaaagaaaagaaaaattcaaaacaaaactattagaaagctatacagtatatagaatatgtcgaagtgtgctcactcatttcatttttgttgcaacccttagaggcaatgtattagttatggttgctactacttttctctggcaagcataatttcacatttccctttctctggttcctttgaggaactttttccttacttcaaagtagtcctggcagggacatgaatcatggtgcccaatttcatacagagtggcacacaacaaagataaggcaatcagacacatactgtcacatataatgattgttttagctataaggtcatcatgtaagccagcccagtcaaaatccttcaggggtctaggcattttcattatgttattttgaataattctgcttctaaccttcatcccagccaccttctctttcctcaactcaacacaacagaaatttgataaaagttcaataattgcaaaaggaatatttggcataagggtgaaaatacacagatatacttggttcctcatgtcttaataaaatctatagtgaaataaagtcaaagaacaatgctttcagtacagagtacttagataacaaaatatcattctctttctaatcataagatatatttaatactaaattttatgtaacaaatagctataaacaaatgaaacattaagagctctgatttttatttactatttcacaagggttccaagcttggcccaaagaggaagggaaaaagaattcacatgctataaaaaacaggtatgcaatctgaagcttgtgttaaagaaagaaggtaaaaatggagatgcctttaatgtatcatcatttgaaaacttacagcaaattaatgtagtatattagccaacacacagattagggagaaaaaatgcataaatgtatgccagtataatgtacctccattccataactactgagaaaataattagaaatttacagcacaatatatttatagattctcttataagtaccttaccaaaaaaatcaatgctacaaaaatgaaactaatgagcaccatctcatgggcatttgaagtaatatatgtaaaaccagcctttgcaagagctttaaaaagccaagttacttagtaaaggattaatcataaaactttcttttaaaatttcaaattttgtacatatatcctaaaaagttaacaagggttttaaacaaacagatatactatttaagccagtatttaaatagcttcaacaaatataaggggaggagatgtaaaatgattctcacaaaacaaactctgtagaagagttaaatagaagcaaaatccaaaactgttaaaaaataaaataaaataaaatagtacttaacaagaaaaaacaggattttagatagatttggcaaatctgaaagtaacataaatcaactctttctcatagtgactaacagattttccattttaaaaaccctgacttgatcattatacattctacgcatgtaacaaaataccatatgtaccccataaatatgtaaaatattacatatcaatttttaaaagtcagaagaaatgcttaaaaaacgtatttcacatttcctctaatggtgtacatttaaaaggaaatgcatttcccattcaaagaaaaacatgtactactttaagactaaagcaatctttgtcagcttcctggctcttcatttaagtttattttctaaaggcaatcaagtggaatatattaactagactatctgatactaaacaaagcagttatttcctgcctgaaatttcatccagtagcaacatacactcactgaagcacttcagtgtcacattctctcttggttcagattacatgaactcactttctgtaaattaatagtcagatcaagtatcttcttacagtgttagaagaaatggcaaactttgagaacaaaaattgtcctttaaaaaaaaactatcaataattagtcttggccgggactggtgatgggcacctataatcctagcactttgggaagccaaggaaggaggatcacttgaggccaggagttcaagaccagcctgggcaacagaatgagaccctgtctctatttttaaaattaaatattttgtctgtctgtttgtttgtttgtttgtttgtttgtttgtttttggagacaaagttttgctcttgttgcccaggctggagtgcaatggcatgatctcagctcactgcaacctccgcctcctgggttcaagcaattctcctgcctccgcctcccgagtagctgggattacaggcatgcgccaccacgcccagctaattttgtatttttagtagagacggggtttctccatattggtcaggctggtctcaaactcccgacctcaggtgatctgcccgcctcagcctcccaaagtgctggtattacaggcgtgagctaccatgcttggcctaaaattaaaattttttaaatgatattaatcagtctagttatcaagtccaatcttgttctacattaatatttcaaaagaggcataatgtatagaatcaaatgtgtacaatatagagtaaaatcttctaataattctgttctaataactgtgtgattacatataagataaaaggatgtctaaataaaaacttgtgtggatttttgccagttaggctattgattctgtttaaagaaaccaactcatgaccagacatggtggcttgtgcctgtaaccccagcacttcacgaggctgaagcgagaagatcacttcagcccaggaattcaagaccagcctgggcaaaatagcgagaccctgtctccacaaaaagtaaaaagcaaaagaaacttgagcatcagcagtgcagtaaagtttaaaagagcacaacacaagaatgcatcactgcaaatgaatctatcaacacacattaatcaagcagctattacataaaagatcaaatataagacgcactcgctgattcacaaaaatattcatgttcagcaggcaaaataacaatgagtacggtatgcaaagtactgccactggctataaaagggtaatggacaccagatttaatctctcaccataaagtggaaaactaaacaaaatacataaaacaattctttggactgtgatcactgaaagcacaaaaacaaacaaggtctcaactcagtgacaccttgagacaatgaaaccattgagttgagacaaccatcattctaatgagttgaagagacacagatcagagttcagagagaatgagatggctggaattcaaggagaagagtaccagagaagaaggttacctgagaaattgctctagaaatcttagtagtggtccctttgagtatttggatgaatactaaactgcatgggcattgggtgagaatcagaacaccatcaagagaagaacaactaccgagattgttgtaagctgaaaaattctacaggtcacacagggctgagagaagtctgaattctattcaaagtggaaagatctcaaacatccaaggctttggactaagctttagttgtacaactaaacaaggactagaataaaggctacactatatctaccattgcaatatttaaaaacaagctttgagtctgccttgaaagaactgtatagcagataaatagaagcgctggctacagtgctgacagaaaccttgtctttcaagccagacaaactggaaaaaggcaggagagggtaggaaagtcatggagagaagaaaagttctctatgaaccaatacaagactcatccctgtgcaaagcatatgacagacccaaaccagaaaagtaaaagctttgagaatcgaactcaaatctcagactagcccctgagtggcatatacacaggacaaacccaaaaaaaaagcaaggcaaagcttttgaaaactgaactgatattgaaaccactacatatagaaagcaggccaaaacttgtggtctgaccctaataaaggttgattgcctgctaaacaaacaaaataaatcagccttctccaagaaatataacacagctcagagtctaccaacataactttcacaaaatcaggaatacaatccagaaattacttggcatacaaaaaatcaaaaaactatgaatttcaagagaaacaacaataaacagataaaaacaaatctctactaatcagatgttggaattaccatggaaagagtttaaagcagctattaatattataactatgcttcaggaggtaaagataaaggtaaagtagccaggcacagtggctcacgcctgtaatcccaacattttgagaagccaaggcgggtgggatcacttgaggccaagagttagagaccagcctggccaacgtggtgaaaccccatcttaaaaatacaaaaattagctgggtgtggtggtgcatgcctgtaattccagctactcaggaggctgaggcaggagaatcccttgaacccgggagacggaggttgcagtgagcccagatcgcaccactgcacttcagcctaagtgacagagtgagactgtgagactctatctcaaaaaaaaaaaaaagaaagaaagaaaacaaaaaagaaaaggtaaagaaaaatgaaatgaatggaaagacagaatagaagtattcaatggagaaaactgagaagtaaaaaatctattaagaaattatttaagaagtaaaaacctattaagcctagatgggcacattagcagaatggagatgacagaaaaaataatcaatgaatataaaaataaatcaatataaattatttaacctgaaaaacaaagaaagaggtaagattgaaaaaaatgaataatctaatggaaatatgggacagtatccaaaagtctaacatacatgtcactggagttccaaaaaggagagtagaggccgggcgcagtggctcacgcctgtaatcccaacactttgggaggccaaggtgggcagatcacttgatgtaaggagtttgagaccagcctggccaacatagtgaaaccccatctctattaaaaattaaaaaaataaaataaaaacttagctgggcgtggcagcacacacctgtaatcccagctactcagaaggctgaggcaggagaatcgtctgaacctgggaggcagaggttgcagtgagccaagattgtgccactgcactccagcttgggtgacagagtgaaactccgtcttgaaaaaaaaaaaaaaaaaaagaacaaaaaggagagtagaaagagactgaggcagaaaaatatttgactgactagacaaatttgttgaaatatataaattacttctaatatagcctcaccataaactcacacgtcatacaagctaacagaagagctgtcccccaaacaaatacatttcactaatgatgcagagctcaaatagcacaaaagaagtaattcatcctctggataaatgatttccaaacagttgattacatactcctactggcaaaaaattaagtagtcagatcacagatatattaacgtataaattatatatgggttactgaatactaatctgttatttaatctaatatgttatatatgttactaatctttattaagttattttttaaaagaaattagaggacagagaaagatggccaaatacaagccttcaccgatcatcgccgcgacagaaacaacaaatttaacaaccatgtccacaaaaaagcaccttcataaaaaccaaaaataaggtgagcaatcacttcgtatcacagaaaggggcactgaagaaggtaagcaagacagtcttgaattgctattccccccaaaagcagctgtgtgtcatggagcacctacgcgcctgggagtgggagagtgcagcgactgtgggatcctgcattgaacagtgctgccctgtcacagcggaaagcagaacaagactaaaattagccaacgtccacctacagagagagtattaagaccagccctagccagaagagaactgcacatcccagtggctggaaacagtattgacaagcctcaccaccgtggcttaaagtgcttggggcctctaaataaacttgaagggcagtctaggccacaaggactgaaattcctaggcaagtcctagcactgtgctctgagtccactggctctgaacatgaggggcatgtgacctggtaagaccccagctggggcagctaaggaagtacttgcgccactcctctccaacccctggcagcgcagcttgcaacaacaaaagtgactccttccatcagcttgaggagaggagagtgaaaagttaaaaggactttgtcttgcatcttggatactagctcagccacaatcgaataggaaaccaggcagtcatgaggaccccattccaggtcccagctcagtcatgaggaccccattccaggtcgtagctcgggcaacatatatacacacacgctgggccagaagggaacccgctgccttgaagggaatgacccaatcctggcaggattgattacttgctgactaaagagcccttggaccctgcagaaccagaagcaacatccaagtagtaagccatgggccttgggtgagactctgaaacgtgccggcttcaggaatcacctcggacacagtggtgtaaagcaccaaaagggctcctgagatccccgattctaggctttggctcttggacagcatttctggacatgccctgggccagaagagagcctgctgcccaaaagggtgagtcccaggcctggaagcattcaccacaagctaactgaagagtccttgggccttaagcgaacattggcagtaacctggcagtattccccatgggtctgtggtggtggtggctagtgggagatgctcctctacctatgtaaacaggagggaagagtgggaaagactttgagcaacatcttagccacagaatagagcaccagtcagatttctaagagtttttattccactccttggctcctggatggcctctctagacctgccaagggcctcaggaaacacgctaccctgaagggaaggacataagccttactggcttcgccaactgctgatggtagagccctagggccttgagtgaatatagagagtagccaggtagtggttatagcaggccttgggtgagacccagtgctgtgctggcttcagatctgacccagcacagtcccaatggtggtggccacataggtgcttgtgtctccctacacccagctccaggtggttcagcacagagagagagagagcaacataccatttgtttgggacaaagtaatggaagaaaacaagagtctccacctggtaaccaacagaattcttccagatcttatccaagaccaccaaggcagtacctctatgagtctacaagaaccaaagcattatgggcttgggatgccccctaatccagatacagcttagatcacaatagccagtcccttcaaatacctggaaagccttcccaagacagatgggcacaaataagcccagactgtgaagactataataacagtccagacactgacaaacatccacaagcatcaacacttcctaggaaaacatgacctcaccaaaaaactacataaagaaccagagaccaatcctggagaaacagagatatgtggccttttaggcacagaattcaaaatagctattttgaggaaactcaaagaaattgaagataacacaaagaaggaattcagaattctatcggataaatttaacaaaaaagatgaaatattaaaaaagaatcaagcagaaatttgagaattgaaaaatgaaactgatatattaaagaatgcatcagagtctcttaacagaattgatcaaacagaagaaagaattagtaagcttgaagacagcctatttgaaaatacacacttagaggagacaaaaacaaagaaaagaatacaaaagaatgaagcatgcctacaagatctagaaaacagcctcaaaaggacaaatctgagagttattgtccttaaagaggaagtggagaaagaaataggggtagaaagtctattcaaagggataataacagagaactttgcaaacctagagaaagatatcaatactcaagtacaagaaggatacagaacaccaagcagatttaacccaaagactacctcaaggcatttaataatcaaactcccaaagatcaataataaggaaaggatcctaaaaggggcaggagaaaagaaacaaataacgtacaatggagctccaatacatccggcagctgacttttcagtggaaaccttaaagccacatgagagtggcatgaatatatttaaggtgcagacggaaaaaaactcttaccctagaatattatatccagtgaaaatatccttcaaacatgaagaagaaattaagacttccaagacaaacaaaagctgaggtgtttcatcaccatacctgtcctacaagaaatgctaaaggaagttagttcctcaatcaaaaagaaacagatgttagtaagcaacaagaaaagaaatcatctgaaagtacaaaattaattggcaacagtaagcatacagaaaaacacaataacaccataacttgggcatataaattactcttaagtagaatgactaaaagatgaacacagacactacaataaaatataaacagaaacaacaaaaagttaaaaagcagggagataaaggtaaagtgtagagcttttattagttttctttttgcttctttgtttaagcaatcagtgttaaactgtcaccagtttaaaataataagttataagatagtatttgcaagcttcatggtaacctcaaatcagaaaacatacaacctaccaatattgaaccaggaagaaatccaaagtctaaacagaccaataacaagtaatgagattgaagccataataaagtgtctcacagtaaagaaaagtccaggacctgatggctttactgctggattctaacaaacatttgaagaactaataccaatcctactcaaattattccgaaaaataggggagggaatacttccaaactcattcaacatggccagtattaccctgataccaaaagagacaaagacatatcaaaaaaaggaaaactgtacaccactatctctgatgaatattcacatgaaaatcctcaacaaaatactataatagcaagctgaatttaacaacacatgaaaaagatcatttatcatgaccaagtgagatttatcccagggatgcaaagatggttcaacatatgcaaatcaatcaatatgatacatcatattaacagaatggagaacaaaaacaacaagatcatttcaactgatgctgaaaaagcatttgacaaaattcaatgtctcaccgtgacaaaaaaaaccctcaaaaaactagggagagaagaggcatacctcaacataataaaagccatatatgacaaccacagatagtatcatactgatgggggaaaaactgaaagtctttcctctagatctggaacacaacaaagatgcccactatcaccactgttattaaacatagtactggaagccatagctagagcaatcagacaagagaaagaaataaagagtggtggcacttgcctgtggtcccagctgcccaggggagagggggctgaggcaggagaatcgcttgaacctgggaggcggaggttgcagtgagacgagatcacgccactgcacttgggtgacagagtgaaattcggagagaaaaggaaggggaaggggaaggggaatccaaattggaaaggaagaagttaaatttcccttgtttgcatatgatatgatcttatatttggaaaaacctagagagtccaccaaaaaactattagaagtgattaattcagtaaagttgtagaatacaaaatcaacatttgaatatcagtagcatttctatatgccaacagcaaacaatctgaacatgaaatgaaaaaaagtaatcctatttaaaatagctacaaataaatacctaggaattaaccaaagaattaaaagatctctacaatgaaaacaataaaatactggtgaaaaaaagtgaagaggacaccaaaaaatggaaagatattccatgttcacggattgcaagaatcaatactgttaaaatgtccatagtacccaaagcaatctacagattcaatgcaatccctatcaaaatactaatgacattcttcagagaaattaaaaaaaaaaaaaacattagctcggcgcagtggctcacgcctgtaatcccagcactttgggaggccgcggtgggcagatcacaaggtccgaagttcgagaccagcctggccaacatagtgaaaccttgtctctactaaaaatacaaaaaattagccaggtgtgctggcatgcacctgtagtcccagctactctggaggctgaggtgggagaatcgcctgaacctgggaagtggaggttgtggtgagctgagatcacaccattgcactccagcctcggcgacggagtgagactgtctcaaaaaaaaaaaaaaaaaaaattataaaatttatatggaaccacaaaagacccagaatagccaaagctatcctgagcaaaagaacaaaactggaagaatcacactatctgacttcaatttataccacacagctatagtaaccaaaacagcatggtactagcacaaaaacagacacacagaccagaagaacagaacagacaactcagaaacaaatccatacaactacagtgaactcaattccaacaaaggtgccaagaacacacattgggggccggacacggtggctcacacctgtaatcccagcactttgggaggccgaggcaggtggatcacgaggtcaggagatcaagaccatcctggctaacacggcgaaaccctgtgtctactaaaaatacaaaaaattagccgggcgtggtggtggcgggtgcctgtagtcccagctacttgggaggctgaggcaggagaacggtgtgaacccgggaggcggaggttgcagggagctgagatcatgccactgcactccagccagggagacagagcaagactccatctcaaaaaaaaaaaaaaaaaagtaacctgtttcatagtttaataaataatgttttctgtttcttagttgtacaaaaaatgatgcatcttacaatagcatcttatggagtcaatgaaaaataataaatgtacaggccaaaacacatcaagttttcttcatccaactaactagaaaaatagaagacccaccatacacactagattaaggctacttagagatgagagacagtagtatgatcgatctggtcttcaagtaattgggacttcagttattaattgttccttaagtctcattctataataaatgtgcttaattataattttaaaagtacttacgtacattgtgaggaaatcaatatatagctattaaaatatgtaatgttttaaatgggctttaaagcttcaaaaactaaaatgccccttgaaaactaggtttagagggaactaaaaactactaaattatttaataggtgatcatccaaaataaaatgtgtaacaaaaggaaacaatgtaaggttacagtaaatatgggatttaaatacagtaagaagacaattcaactgtcagtaaactccctgtaatgctaggaaaatgaatgctaggattatcagagattttttaattttgtttcatttgtatttgccaaaaaaaaaaaaaacacccatagaataaaaaataccagtttctcttgtaatttgcattttttaccaccacatttccccttctggaaggaattaaaggaagattactaagatgggtcaagtaacaacagaggacaacaagtaaacaaagaagccacagaatgtagggcaatgcttatcagtttaaccaagtgaatcaggagactatgaatgtaatggaacaaatttagccataaattcactgagctgggacaaccatctgaaaacctacactgtgatctatggatttacacaaaaggtgcagaactggaaagtgggagaagaaaactgtataccaaattatttcctaggaattatccagtctgatgatttttccactttaaaactttctgatcacctgagcccaggaggtcaaggttgcagtaagcagtgactgtgccactgtactccagcctgggcaacagagcaagaccctgtctcaaagaaaaaaacaaaaagaaaaagaaaaaacaacattataaaactcaaatatttctaccacaaaattaaataagagattagaaaagtgaagtttttagccaggtgcagtggctcatacctgtagtcccagcatttgggaggctgaggcaagcggaacacttgaagccagaagttcaagactggcctgggcaacatggcaaaaaccatctctacaaaaaatcaaaaattagccaggtatgatggaacatgcctgtagtcccagttactgaggaagttgaggcagaaggaatgcttgaccccaggaggttgaggctgcagtgagctgtgttcatgccactgcaagccagcctgggtgatgaagcaagcactcttttttttttttttttttttttgagatggagtctcgctctgtcacctaggctgtagtgcagtggcacgatctcagctcactgcaacctctgcctctgggttcaagtgattctcctgcctcagcctcccgagtagctgggattacaggtgcccgccaccatacctggctaactttttgtattttttagtagataaagggtttcaccatgttggccaggctggtctcgaactcctgtcctcaggtgatccgcctgcctcagcctcccaaactgctgggattacaggtgtgagccaccacgccaggctggcgagtactccgtcttaaaaaaaaaaaaaaactacaatggctgataaggtaagaattagagaccagttaccatctgaactctcaagatacttacatgtaaaagaagagttgtatggtcatactcacctttctaccagaaatacttctgggatgtttttattcatgtatgcattcatttattcatttatttaacaaatatttattcagttcctatgatgccaggctgtttccaacctctgaaggcacttgattcaagccacaagcccaatttcctctactgcccacccccaactccaacagctcaagggcagttagttcaaatctttctgaataagaagataagggtagtaaaccacaaagaaccacactacggcctgccaataaaactagctaatttcattcaacctgttaaaatccaatcagaaagaaaaataaaccaaacataagaaaatttttgcgatctacagaactttagggctgggcgcagtggcccacgcctgtaatcccagcactttgggaggccaaggcgggcggatcacctgaggtcaggagttcgagaccagcctcaacatggagaaaccccatctctactaaaaatacaaaattagccgggcatggtggtgcatgcctgtaattccagctactctggaggctgagacaggagaattgcttgaacccggaaggcggaggttgtggtgagtggagattgcgccattgcactccagcctgggcaacaagagcgaaagtccgtctcaaaaaaaaaaagaactttaggatttgatagcatatctaatattccaaaataaatacatataatttcttaattgacatgccatctgtcaataaaagatttaaaaggtaatctgctacaagtcttcattcttatcactaacctttcttcatgtgctaacatgtacatttccttctttactgtgccttgactttccaaataaatttgtgtgtgtgtctgtaacagaatgagagacagacaaacagagacgcatttgggttttattataacgtattcacaccttaaggaaggagaaaggctgaggtagcaaaggaaaggaaaaaagtaaatggaattataaaagtgatggcttaaaaaaaacatacatatcacaaaactgttcttcctagcagcaattctctaacactcaaatttgtctatctagctatctaactcttaagaaagtaattaagcatttttaaataagtcttaaaaagcacggtggctcatgcccgtaatcccagtactttgggaggccaaggcgggtggatcacctaaggtagggagttcaagaccagcctggccaacatggcgaaaccccgtctctactaaaaatacaaaaaattaaccaggcatggtgacaggcgcctgtaatcccagctactcgagaagctgaggcaggagaatcacttgaacctgggggtggaggttgcagtgagccaagatcgcatcactgcactccagcctgggtgacagagctagactccatctcaaaaaaaaaaaaaaagcttatattttaaattaaaaaataaaacaaaagctcatgttcccttctaaaataagacctatgagaaaagttccaccatggaactagtaaaatcaaaataactattttatgttagttcagtctatgtaaattgtactgtaaagtttttgtatttagcattttagccaagataaaaatttaataaatacaggttgaaatctagaattgcacttttttttaatatatagtttttttttttttaattgagatggagtctcgctctattgcccaggctggagtgcagtggcaccatctcggctcactgcaagttccgcctcccgggttcacgccgttctcctgcctcagcctcccgagtagccaggactacaggcacccaccaccacacccagctaattttttatatttttattagagacgggatttcatcgtgttagccaggatagtcttgatctcctgacctcgtgatccgcccgcctcggcctcccaaagtgctgggattacaggcgtgagccaccgcgcccagttgaattgcacgtttttaatggtcatatttttatatcatgttgttaggaggaaaaaataaaatacctaagaatgatagttaaaaatccaaatgattctttactatcctactactctaattttaaatcaacattaaatttttcccagtatatttaatacatattataactaaaacattttaaatgtataaaagtgctttttttttggtagagatgggggtctcactttgttgaccaggctggtcttgaactccttaaaagtacattttttacagtcacacaggcaaattcacctaaataatttacaatgtagaattgaacatagtctgttaagggtgctttcaggtcatcagaatctgaaaattatacattaaaatagcagtccccaacctttatggcactagggaccagtttcacaaaagacaatttttccacagaacgggggtcagaggtgggtggatggtttcaagatgaaactgttccacctcagcgggagatgaacggcaggcaagcgagcattaccacctgagcttcacctcctgtcagatcagtggtagcattagattctcataggagcacaaaggagggatctgggttgcttgctccttatgagaatatgtacatagacctgaggtacatagacctgaggtactacagacttggtcaacttttggcctccttcttaaccatcagaggatgctaaaacatggtctgaaacagaatgtagacaaatctgacaaaatctgtcaatctggtaagatggttaaaataaagggaaggaagtagactgctatcccaactgtttccaaaccaatcactgaaatctccaatacacaaatcaaagccatcatgctaatttttgtcattccataaagggtagcaaacgtaccataaaaacaaaacagagatctactcatgttgtggtgactgaaaacaaagattttacaggcctttttacttgacacaggatgccaaggaagcttctaactgcagaagaacagaatacagatcccaaggaaaagcaacagcccaaggggcaaggaagtgagggggaaggcagtaaagaaaatgatactcgtgcgataggtgaaaggagagaaagggaatctgtggaaacttccaccttctgctaaagaacagaaaaaaatcataggatattccattcgaccaacaatataccctctggggccagggagtagagaagctagctgaaaacagcctcattagagtcaaaatttgacatgtctcaggcaaaatcattcttaaagttttgttccatatcaagttttcatgtcttcagatttacataagaagggttttcctcatctataaccaattaattggcatttccagctagaaataagaacttaaattacacagtggtcccaatgattaaaagctcccaggattgtaaacagactttgatttgcaattaagaatattttactcctactccagtaatgacaagagcaaaacaaaaatacatcaagtctttctcaaagccaatacagtaagtactgaagaaattgtgctaatgccttaaaggttactgaaaataaggtacttacagaagtatgcatataaatctctactagaaaggataaaagtgccagtcagcaagttcattcaggccagatgtggtggctcacctgtaatcccagcactttgggggactgaggcgggcagaccacttagtccagtcaggagctcgaaaacagctgggccaacatggcaaaaccccgtctctactaaaaacacaaaaattagccaggcatggtggcaggcacctgtaatcccagctactctgcaggctgagacaggagaatcgcttgaacctgggagacagaggtggcagtgagctgagatcgcaccactgcactccagcctgggcgacagagtgagtctctgtatccaaaaaaaaaaacaggccaggcgcggtggctcacacctgtaatcccagcactgtgagaggccgaggcaggcagatcacctgaggtcaggagctcgagaccagcctggccaacatggggaaaccctgtctctactaaaaatacaaaaaattgccgggtgtcctggtgagcggctgtaataccagctacccaggaggctgaggcaggagaatcgcttgaacccaggaggcagaggttgcagttagcagagatcacacaacttcactacagcctgggtgacagagcaagactccgtctcaaaaaaaaaaaaaaaaaagtgcattcgccttattgaaaactcttcttataatatcaaacccaaatcagcatccatcatcatagattattagacttctatctcaaatacacaagaaaaaaataataaagtcaaaccctatgtataaacccatggtgacctcaggcaattttaaatccaaaattattcaaaattatttgaagggataaagaatcaaattgccagcaccctcaaaatagaacagtacaggacacactggatcccattattgagcatggtactactacattcaacacaccatggatattatttcatcaatttcatataaactttggcagcagactttaagttcctagaaaattgttccccaaagttttgtaaccttaattaaagtataataattccaagaaacaaatcacagagaggcaaagaaaacaaacatatagaggccatgatgtcattagttaaaatgacatatgaaaaaatgcaagaatgttgataatgattaaagctggctgatgagttcataggttttcttttcgcttttgtgtatgtctaaaattttctatgagaaacagaatatcaaattttttttttttgagacacagtctcgctctgtcaccaggctggagtgcagtggtgcaatctcggctcactgcaacctctgtctcccgggttcaagctattctcttgcctcagtctcccgagtagctggaactacagctgcgtaccaccatgcccagctaatttttgtattttcagtagagacagggttttcccatgttggccaggatggtctcgatctcttgaccttgtgatccacccacctgggcctcccaaagtgctgggattacaggtgtgaaccaccgtgcccagccatcagattttatgaacagtatatcaaactcaccaaaatgagtttttattggctgtttataaattgggggtgggggggacacggtaattatcattaattaagtgcctataaagtgtttgtttttttgttgttgtttttttgttttgagacagagtctcactctgtcacccaggctggagtacaatggcacaatctgggatcactggaacctctgcctccagggtttaagcaattctcctgcctcagcctcccaagtagctaggactacaggcacgcaccaccaccccgcctcactaatttctgtattgttagtagagatggggtttcgccatgttggccaggctggtctcaaactcccgatctgaagtgatccacccaccacggcctcccaaagagctgaaattacaggtgcgagccacagcccccaagtaggtgttttaatatataagaactctgtggccaggcatggtggttcacacctgtaatcccagcactttgggaggccgaggcaggcagatcacgaggtcaggtgttcgagaccagcctggccaatatggtgaaacctcgactctactaaaaatacaaaaagtagccaggcatggtgacacacacctgtagtcccagctactcaggaggctgaggtgagagaatcgcttgaacccggaaggcacaggctgcagtgagccgagatcacgccactgcactccagcccgggcgacagagcgagactccatctcaaaaaaaagaactctatgagatagaatcagcccaattttacataaaagaaaattaagaatcaagagggtaaacttaatcttcctcaagatcatataggagctgaactgagacccacagccaaagaaagaaagaaggaaataaaaaaggaagacaatgactggtaaagggggtaaaaaaaaaaacctttttggcactaatatacaaaagaaacaatcagagaaataagccaggcatgcatggtggctcatgcctgtaatcacagaactttggaaggctaaggtgggataatggcttaaggccaggagttcgagaccagcctgggcaacatagcaagacccccatctctatgaaaaaaaatttttaattagaatttaattttttttaattagagaaatacaatttccagaaaatatcactaggtaaaatattcttatagaagtatgcaataacaaatattcaagcaaaatgaaagaaaaaatagaactgtatttagaaatctacactgtaagggtggatatcttgaggattagaatccagaggagaaatcccatttcagccatgatgttaaccagttgtgtgtgtgtatatatttacatatatatgtaaattcacatatacatatccatatcaaaacttccctaaacctgaatttaacatacaacttagaatagattaagaaaatgttctaaaaagtgtcattacatatttaacgtggtagtctatatttatcatccagaagaatttagcatataatcctcatatttgaagttcactgtacaaatacattactccaacactccagtgttaaggcaagcatctaaaagtaatattttgctgggtatcgtgactcatgcctgtaatcccagcactttaggagaccaaagtgggagaactgcttgaggccaggagtttcagaccagcctaggcaagacaacaaaaccccgtctctacaaaaaaaaacaaaacaaaagaattagccaggtgtggtggcatgtgcctatagtcccagctacttgggaggctgaggttggaggatcacttgagcccaggaggttgaggctacagtgaactgggatcacaccagtgtacttcagcctgggtgacagagcaagaccctatcacatggccaggcacagtagctcatgcctataatatcagcattttaggtggccgaggtgggcggatcacttgaggccaggagttgagaccagcctggccaacacggcaaaactctgtctattactaaaatacaaaaagtagctgggcatggtggtgcacacctgtaatcctagctactcaggaggctgagaggcacaagaatcacttgaaccagggaagcgctgaaccagggaggcgctgaacctcggacagggaggttgcactgagctgagattgtgccacagcattccaacctgagtgacaaagtgagactctgtctccaaaaaaaaaaaaaaaaagaagacgaagaagaaaaagaggaggaagaggaggatgaagaggaggaagaggaagcgtaagaagaagaaacaacaacacaattaaacaccactacaaacttactagaatgactaaaatttaaaacactgataataccaagtgctgacaaggatggagaacaactacagcaactacattactggtaggaatgcagcatgctacagccactttggaaaacagtttgacagttcttatgaagttaaacatacatttaccataccaagcacactcttcagtattcacccaggagaaaggaaaacatgtccaccaaaggcctataggcaaaggtttggggcaacttacccaaagtaactggataaacaaattgtaattacatccatagaatagaatacttctcagcaaaaattaaaaaagaaacaagcaacttaattatgcaacgacatagaggaatctcaaatgcaatttgctgagtacaagaagctagtcacgaaaggctacttgctacatgattccatttttattcaacattctggaaaacaaagtgacagggacagaaattagatcagtggttgccaggggatagggatggggaagagagaaatgactacaaaggggtaaaagggaactttttgaggtgggggaaatatctcatataccaaatgtgatggttgttatatgaccgtatacatcaatctacacaactcaaaagggtgaattttattctatgtaaatcataccttaataaacctgacttttaagatgacaaagatgtaatctctgccttcaagctcatgatctaatgagagaaatatatataaacacataatttgaacaaggtaaatgctatagtaagttatgaacaaagttctgtggtagaatggaggaggaataaagtctgtctcagagtgaggcaaaggattctcagagaaaataacatgtaagctatgtcttaaaagtaacaaggctgggcgcagtggctcatgcctgtaatcacagcactttgggaggccaaggcaggtacaatcactgaggtcaggagttcgagaccagcctagccaacatggcgaaacccagtctctactaaaaatacaaaaattagctggacacagtagcgtgcgcctgtaggcccagctactcgtgaggctgaggctagaaaatcgcttgaactcgggaggcaggggttgcagtgagccgagactacaccactgcactccagactgggcaacagagcgagactccgtctcaaaaaaaaaaaaaaggtaacgagcatgatgatgacagaccaagaagaaaaggacccaagcagagagaacagttgagagaaaaaacacagaggtatgtaaaggcaagattagccatgtgagagacagtaaacgaagtgtaggatgagttagagcatcagaggtcatgccatacatgataagatttgtgttttagaaagataagtataaatatcatgtgggaaaatatatggaggtatagaatgactggcagagaacaagaacagttttgaagggtgttacaataatcctagaaagagatacctggggtctgaattaaggttcaattaaaaggctatttagtgaaagactacttatgggaataaggaagaaaagacaagttaaggttaattgaaatttctgcaaagaacaagtgatcatcaataagatgagaaacataaaaggaaatacagatttgtttgataatccaagttggggggagaatcatctggcttccattttcctatctactaactctcttccttgtaggcatgccttctctaactaaaactgatatttattatgacttatctacttgaactattttataaaataactataagaagtaaaggcaacacagcaaaacctcagcaaagtttttacagtatcttagatatagcagaatagttattttaaaggtaaaaataaggccgggtgcagtggctcacacctataatccacgcactttgggaagccaaggcaggaggattgtttgagcccaggatatcaagaccctagcctgggcaacatagcaagactccatctctacaaaaaaataaaatttaaagaaattaaaaataagttttaaaaaagaaaacattgggcagtttggctagagcataattattagaacagataattagatttcctagtttttcaaaaatttgaattgtaataaaaggaaatttcaatgttctatttcaattttcagcagcaaataaatgtgtacaaaaaggaacttaaagaataaaaaataaatgaaaataggagaggaaagaataaatttaaatactgcatcgccaacttatgtaataggttccaaatttgtctttaaaaagcaattatgtgatggctaggcatagtaggctcacacctgtaaccccagcacgttgggaggccaaggcaggtggatcacctgaggtcaggagttcaagaccagcctgaccaacatgataaaacctcattgtattagtccattttcatgctattgataaagacatacaaaagactgggaagaaaaagaagtttaattggacttacagttccacatggctggggaggcctcaggatcatggagggaagcaaaaggcatttcttacatggtggtggcaagagaaaaagaggaagatgcaaaagcagaaacccctgataaaaccatcagatctcatgagacttattcactaccacgagaacagtatgggggaaactgcccccatgactcaaattatctcacaccgggtccctcccacaacacatgggaattatgggagtacaattcaagatgagatttgggtggggacacagagcaaaaccatatcacccatccctactaaaaatacaaaaattagcctggcgtggtggcaggcacctgtaatcccagatactcagtaggctaaggcaggagaattgcctgaacctgggaggcagaggttgcagtgagccgagatcataccactgcactccagcctgggcgacagagcaagactctgtctcaaaaaaaaaaaaaaaaaatcaattatgtgaaatttagaatatattgccccaaagaaacaatgtgacactaaagcatagctaaacaatactagggtattacaccaacctgctgaataaccaaccccaccaccatcaccaccaccaccaccactaccactaccactaccaaagtacagtgttgaggagaacagggtgctctgaggctgcctgaggttcaacatcttttgtgacctcgactggggtaattaattctacaagtctaatattcctcacctttaaaatggagatgataaaatcacctgctccacacgagttactgtgaaaattaaaagagggaacctaaagcacttagcacagtcatccatccaacatgtatttattaagcacctactacatgttaggtacaaggccccaaggccctggcaatgaaacagtaaacaaaaaaagtaagtccctacttttatggagtgtgtattctaataaaagaaaacacgcaataaaaaaaatctgatggagttaatgctatgaaaataaagcaggatataagagataaagagtaacaaggagaaggatactattttggtagtggggaaaggttctctaataaggccacaaattttaacaaagaccataagagaatgaagaagagggtcatacagagaactgggggaagaaatcagatccatttctggcaatatggtagactagatgcccagaaaagtacttgtgattcagaatttcttaaaatgctgaatattaaaacaaaaatagtatttttcatgagtggctgagctgaaagaaagaaaaaacaacaaagcattggtgagcactgaaaccagcctctcccctgggagcatccatcaattccccagtggcttagaagtcagtttaagggactggtgagaaggacataaaggttggggcctaaacaaggtgggaaatctgaaaagcaacactcagtggatgaactgcagaggagggtaaacaacatgctaaacagagatcacagttggcatgtttgcctttcccagtctcggtggaagagaaaaaacgaagtcacccttcgctcactccagtttaaggacaaaattcatactacctatgtggtctagaaaaactcagactaaaaattcagtttcgagagattctgggttggaagagactagagcatgacagaagcaaacaccaatccagccaagaggagtacactaaacccaagccttcagtgatattcacaaataaaaatccatggaagattatctcacaattaaaaagaaattcacaaaataatgaaaaaagcccccaagaatcagcagaacaagcctttcaggaacagaagaaacgatgaggaacatgaaaataatcagatatataatataaaaatgttaatgtttaaggaaataaaagagatatagaaagtatgactgaggaaaagaaactgtaaaaaacatgaatatgaaaaaatcaaacaattgtaatgtttctggatagaaacattacaattgcttattgatagtcatacaataattggatatttgagaggagatcattctaggcaaaggaaaaaataagttcaaaggccctaaggtaagactgtgcttggcttgctttaggaagtacaaaagggccatggcatccagagttgagtaaacaaggaagaaaagtgggaagaaatgacgaccaagaactggtacttaataggtcacaaaatacctcaataaatattatttattatcccataatttctattggaaaaatttggatattagaaataataatttcttctttaccatttctgcattaaatatagaagccagagcagagctacagaggatctcaagtaggttcagaaggaaataagaaaatattccttttctatgaagtagggagagtcttcagtagaggtcccagtgccaaggaagacatctgggtcttgtgtgagcaaggtagaaatgaagtgattcagaagatacatttctggaaataataatgatcaacaacaaccaaaaaaaaaaaaaaaaagtcaagatggaattaccatttcaaagtaggagacatttcaaacttgggcattaattggtaatcaggacatcctcagagtactcaaaaatttcacggttcaagtgaacgtttacatcctatgacaatgagaatttagcataaatgaaactcccaaagatatgccaaactttttaactatctggtttaattctcaactttttctaaatattttcaaaagacactaacaagtagcaaaatagtactactctgatttttcttttcttccatattcctaccctcagactaaggtattgcctaaaaaagccatgaacaaaacacaagtaatacaggttaagaataatattcataagccacaactagaggtataatcaatccctaaatattaaagagttggtcattccattttttcctgattagcaaaataacagaaaattgactggtggatatcttaaatacatataaactaccatgcaccatttgacacatgaagaaatagatgcaaagaatcaaagtatgcattgttaaatcaatgataaaagttttaaaataattcattttctcaaagcttatcactcttaacaatgtttctaattatcataacctaatacaattcctgacaaatttaatcaaattaggttctaatacaagaacacaacttatattaataatcacacagtataacatggtacacacaaaattcaaaatcaaacaacctgagtccaaatgccatcttactaactatgacacttgagcatcattgaccactccaatcctgttttcatgctataaatcaagtttaataaagtactgccccatggagttgttacatggaaaaaataaaataatcccgtaaaacacttatgtttatcagcagactcagatatacaccctgacttacatctaggttccattctattataactggatcataaagcaaagcattaatttctttttttatttttattttattttaatttaagttcaggatacatgtggcattaatttcagtctttccttctgaagcaccacttaaataacttgacgtgactgttctcacacagtgcattcagcactatagaataaagtcagtgtctaacaataaaaactagaaagatatttgtgcaatatgttatgctaaatgtagaacttggctaaattgaaaattttctgaaatactttatgtaaataaagaaacagagcagtccctacaaatagaaatgactcctgaaatttttatgtcaaaagtcattgtgtcaatttatgtgtaatattcaagtgactaccaaatggtcatcatttgactcactcaaactattgtgtttcaaaagttcatccccatgcagataaacatgttaaagatagtataattcactaaaaatagtcaagttctctattgatacaaatgggatttctatgcaggttacttgtattcaatctaaatgactaagaacttataaagacttaagacgatcctgcaagaaagatgcctaaggggaaaaaaaaagaattaagataaagtagtattttgctctaggttgtttattttaagtgtgtagcggttggggaaaaaaacatgactcctttatattatcctaaaacattctacaattctttttttttttaataatcctttttgagacagagtctctctctgtcgcccaggctggagtgcagtggcgcaatcttggcttactgcaacctccgtctcccgggttcaagcgattcccatgcctgagcctcccgagtagctgggattacaggcgcacaccaccacgcccagttaatttttgtatttttagtagagacagggtttcatcacgttggccaggctggtctccgactcctgacctcaagtgatccgcccacctcggcttcccaaagtgctaggattacaagcgtgagccactgcacctggccaaacagtctataattgtaaaagctatgaaaactcttttttttttcttttttaagagatagggtctcggccgggcacggtggctcatacctgtaatcccagcactttgggaggccaaggcaggtggatcacatgaggttgggagttcgggactggcctgaccaagatggagaaaccccgtctctactaaaaaaatacaaaattagccaggcttggtggtgcatgactgtaatcccagctacttgggaggctgaggcaggagaatcgtttgaacccagggggcggaggttgcagtgagccgagatcacgccactgcactccagcctgggtaacgagaacgaaactccgtctcaaaaaaaaaaaaaaaagagagatagggtctcattctgtcgcccaggatagagtacagtggcataatcatagttcgctacagtctcaaactcctgggctcacgtgatcctgccacctcaccatctccagtgggtaggactacaggcacacactaccacgtagacctgatttttttgtttttttgtagatataggatctcactatgttgccctgggtggtcttgaactcctggcctcaagcagtcctcccacctgagcctcccaaagtgtcgggactataggcatgagcaaccgcacccggcaggaaaattcacttaattactaaaattttaaaacaccacctccacacataaaatcccccatgaataaatctatattttgttttggtaatacaaggttgctttctaagataacaattgctcatctgcctgtatgtataaatacatgtaagcatttgggaaagaagaaaaatgactaattttatcttcctacaatttcttcagtgatctacactagaactccattatctgaaattatctaaggtattcctaagcagaaaaataagttggtcaattgtagcctaagttggtcctatatttattcaatggctatcacacattcatcacttcgttataccttagacttccagcagataatgaatataacctttaaatccatcactttacaaatgcctacaaatattaggtaaatataacaaaaaatacttttcaatgtagaactgagcttgagtttgcaaagaaagaaagaaaggaaaatccccgagcctaaagtgaagaagaaacagaaaaataagtatctgaacttccattacaactgctgaagaggcaagaaagaggaagctagtactagggggcttgaattttatttcctttttagaaacaaacaaaaaaaaagtattcactcaagatggggaagtagagataaaatctctatataaatatgggatcctcaaaaggttgaccctcaggaaaaagtagattcttcctctcccccacaaaaaaacttccctggcacaggaaattacaaataattagtctttggctgggctgctgatttcctttttttttttaattctatagagataaggtctatgttgcccaggctggtcttgaactcctgggctcaaatgatcttcctgcctctgtctcccaaagtcctgggattacatgcatgagccaccgtgcctggtcactactgattatttttaagtttcctctaagatagtaaaattctgggatttcctctaagatagtaaaattctgctattcacataggaagtccaaatttacactactggcatgaacaacaaaccccagaatgacaaatttaaaaaacaaaacaaaaaaaaaaacaatttcaggtataatataccccctgaggctccaggcaaacttaatccatacgttctggtaataaacatttcctaagcacatactatgtgtcaagtactcttctaggggctagggatgcaataagcaaaacagacaaaaatctctactcttatgaaacataaacagtagtccctcttgatctacagggtatacattgcaagacccctagtggatacctaaaaccacagataataccaaatgctatatacactatgtttttttgtatacacacatacctatgataaagtttaatttataaattaggcacagtaagagattaacaacaataactagtaataaaatagaacagttagaacaatacacagtttccaatttttgacagtttgacttacaatttttcaactttatgatggtgtgaaagcaataagcattcagcacaaacctcaatttaacaatggagttacatcccaataaactcattgtaagttgaaaagtcaaaactaccataaatcaacaagtattttcaacttacaatattttcagctttagatgtaagtgcatcaagtcaaggagcatctgtgtaattcacaattacatggatagaagattcgtacatactgcaaaccttagcaacctcagcacatgattttttttccttgtaagtcaagaacttccacctattcacttaaaaaaagtgctttacaatgtctctgtgtcacatccaaattgccaacatcactactcttgtcccgaacattattaagtaaaataagggttacttaaacactgcaataccatgacagtcaatctgatcgtggagagggtagtcacttagtaaagtgactaaaggacaggtagcatatacgtagagcatggatacgctggacaaagggatgatttgcatcctagtcaggatggagcagaatgcttgagatttcatcacactactcaagagctgcacacaatttaaaacttaggaactgtcaagggcttcaagatggctgactagaggcatctcctacttgcctcctccactaggaataaccaaaatagtgagtaatcacaccttgaatagataatccaagaaagaacactggaattcaatagaaaaatgacaagaaacacctaaagaaaggaaggagagggaaacaagacagcctgctcggctgggagccgagagacaatccccactgcggggaaacagtaagtgggagactccctgtggtccacattcccactgtggactcctgcaattctagccattggggagcccctaggacctcatgggctctgaaactaacataaggatctgtctggaaatggtgcaacagcaccactccactgaggaaaattgcactgggtcccataatccccctaagtcctaagcagctacaacaaggcaccattttgacaacccagcccacaacagactgagcactatcctggggcccagcagctggtgcacagacagaagtaagaaacaggctgccaccaccaggactgaggcacaagcggggcatgtgtccccgaccgccgacctaggctgccaccattaaaggcagcctcatgttccccagtagcagcagcacagcacagccactgctgcccctcacccaatcattccagggcctgggaaccaccctgtcccttcttaccacagtaggtgtctgcacatattgttggggggcctgatgacatgccagcccagcttaaccaggtccccatgccaaagcgtgcagactaggggcctggggattgtctccctcagcccactaccattggcacctgaacacaacacctatcctgaggatagggctaccccccacctgccgctaccaccacagctggcatctacctgcatgaacaacctgcaaatctagagactggcaggcctagaccatcacacccaccgccaatatacacacacaccactcaggatccagtgggtcatctctgcctttacccatactatgctggctacccagaagactgagagtgcacccacccacacagcctatcactgccactaccagaatcacagcaatccatctggaagcccaggaattggttcacctcaacccactgatactggtgccagtgtatgctgccctagagcccaaggacaggcattctcagcccactgctgtcaccactgaggcctgaaaagtgccaaacatggcacctcagtccccagcaaaacttcaccacagcctccattaatagtccgaaccctaaggcccccaaaaaatcacagacgccactgacactgtttatacctgaaaaaaaatcacagagactatactaccacacagacccagaatcaaagccaatgcactctgcccaaccaacatcatagatacgtcttcaaataaaaagtcctcccctatgaaagcaagttcaaataatttgaaaaagtcattactacaccagaggaaagatatcaatgtaacgacagaggaaacataaaacagcaaaaaaaaaaaaaaaaaaaaaaaaagggcacctccaaaggaacataataattctccagcaacatatcccaatcaaaaacaaatttacaggccaggcacggtagctcatgcctgtaatcccagcactttggaaggctgaggcagatggatcacctgaggtcaggagttcgagaccagaccggccaaaatgatgaaaccccccccactaaaaatacaaaaattagctgtgtgtggtggtgggtgcctgtaatcccagctacttgggaggctgaggcaggagaatcacttgaactcaggaggcagaggttgcagtgagctgagactgtgccatcacactccagcctgggcaacaagagtgaaactccatctctcagaaaaaaaaaaaaaaaagaataaataagctcagtgagagacacaagagaataatgaaaactactacaaaggaatcagaaaaataattcagaatatgaataacaagtttaccaaagagatagatgatattaaaaaaaaaaatctggtactgaagaattaaatggccagatgcagtggctcaagtctataatcccagcactttgggaggctgaggtgggaggattacttgagtccaagagttcgaagccagcctgggcaacatggtggctgggcaacatggcaactacccccaaaaaattagctgggtgtagtggcacctgcctgtggtcccagctactcaggaggctgagatgagaggatagtttgagcccaggaggtggaggttgcagtgaaccgagatcgcactactgcactccagcctgggcaatagagcaagaccttgtctcaaaaaaaaatatgtgtgtgtgtatgtgtttgcgtgtgtgtgtgtgtgtgtgtgtgtgtgtaccaacatcatttttcacagaaatagaaaaaaacaatcctggtcaggcacagtggctcacacctgtaatcccagcactttgggaggccaagatggacagatcactttagttaaggagttcagatcagcctagccaacatggtgaaaccccatttccactaaaaacacaaaaaaattagtcaggcatggtggcgcacacctgtaataccagctacttgggaggctgaggcagaaggatcgcttgaacctgggaggcgaaggttacagtgagccaaaatcaagccacttcactccagcctgggtgaaagcatgagattcggtttcaaaaaaaaaaaaaaaaacaaaatcctaaaactcatatggaaccaaaaaaaagccaatagtcaaaggaatcctgagcctaaagaacaaagctggaggtgtcacactacttgacaagatgtatatcacgtctatcataaaagaaaacagcatggtactggcctaaaaacagagcgcataaccagactgggcaacatagtgagacaatccccccagcccccgccccttctctgcaaacaaaattttaaaattagccagctgtgatggcatgtaccatagtcccagctactcaggaggctgaggtgggaggattgcttgagcccgggaggctggggttacagtgagctgtaatcatgccgctgcactctagcctgggcaacagagcaagaccctgtctcaaaacaaaaagaaaagaaaaaaccaacacatagacgaatggaacagaatagacagacaatccagaaatgaatatgtgtatctatagccaactgctgtgtgtgtgtgtgtgtgtgtgtgtgtgtgtgtgtgtgtgtgtgtgtgtgacagtctcatgctgccacccagactggagtgtggggtacagtgacacaatctcagctcaatgcaacctccacctcctgggttccacaaatctcctgcctcagcctctccagtagctgggattacaggcatacaccacgatgccaggccaatttttgtatggtttgttgatacagggtttcgccatgctgcccaactgggttcaagcaattctctgcccggcctcccaagtagctgagaatacaggtgcctgccaccatgcccggctaatttttgtatttttagtagagagggggtttcaccatcttggccacgctgttcttgaactcctgaactcatgatccaccagcttcagcctactattatactttggggccactattaggtacaaatatgggtcacttgaatataatcactgcaatactgccgcaatcaatctgataacggagacggcaactgactaacaggcaggtagcatatacatacagcatgatgctggacaaagggatgattcacatcctggtgggacagagagtgatttcatcacactactcagaacaacatgcaaattaaaacttactaatggtttatttctgaaattttacatttaatattctcagaccatggttaacggaaggtaatagaaactgggaaaagctaacatgtgactaaggcagggtactcttgtaatggacagaaactgacaaaaagcaaaatatattaagttacataatatattagaagataaatctgttaagaaataaggtaacggctgggcgcggtggctcacgcctgtaatcctagcactttgggaggccgaggcaggtggattgcctgagctcaggagttcaagaccagcctgggcaacacagtgaaaccccatctctactcaagtacaaaaaattagccaggcatggcggcatgagccttgtaatcccagctactcgggaggctgaaacaggagaatcacttgaacctgggagacaggggttggttgcaatgagccaagagcatgccattgcactccagcctgggcgacagagcgagacttcgactcaaaaaagaaagaaagaaggtagggaaaaaagataagaagtggaggagagggaaatagtcaagaaatagtcaagaaagatgttaaacttacacaaactaatctacacaggattcccacaaataaaatcccacaaaaatttagttcagaatccaagattataaaacaccctgtaatggccgggcacggtggctcacgcctgtaatccagcactttgggaggtcaaggtgggcggatcatgaggtcaagagttcaagaccagcctggccaacatagtgaaagcctgtctctactacaaatacaaaaaattagccaggggtggtggcaggcgcctgtaatcccagtgaggctgagacaggagaatcccttgaacccgggaggcggaggttgcagtgagccaagatcgcactattgcacttcagcccagacaacagtacaagactccaactcaaaaaaaaaaaaaaaaaaaaaaaaaaaccctgtatataccacattagatgagagctaatgaatgaatactagaaaactatacagagtagattataagagacttttgaaaataatgacactgttctttttttttttggagacagagtcttgctctgttacccaggctttttttttttttttttttggagacgtaatctcattctgtcacccaagctggagcacagtggtgcaatctcagctcacaccaacctccacctcccaggttcaagcaattctcctacctcagcctccctagtaactgggactacaggtgcccgccaccacgcctggctaattttgtattttttagtagagaacatgttggccaggctggtctccaactcccgacctcaggtgatcccacccacctcggcctcccaaagcactgggattacagacttacagacgtgagccaccatgcccggcaacactgttctcttaagggtaaaacagactaaagtaattcaaaattgtacaatgaaaaatacaaactgcctaacaaataacttcataggaaacaaaataataaaggaaatatgcatcaaggttttaacaatatatcttttgcggaaaagaataatagggcagggcatggtggctcacacctgtaatctcagcactgcaggaggccaaggcaggcggatcacctaaggtcaggagttcgggaccagcctggccaatatggcgaaaccccgtctctactaaaaatacaaaaattagcagggagtggtggtcagctactcgggaagctgaggcaggagaatcacttgaacccagaggcggaggctgccgtgagctgagatcacgccactacactgcagtatgggtgacagagggagactccgtctcaaaaaaataaaattaaataaaataaaaataaaagaataataggaactaggcttcctaaagattgtacttttattttaaaaattaagacatttccatttaacacttttgaagtatcaaaacacttcaaaaagttctggagatacaaagataaataaaataccttattgtacatctatataagtattataaaacaaaaatgcattgtggacatttctgtttcaaccatataaaaactattttaaaatattttcaagaatatgtgtgtgaaaagggatgctttataaaaagtgaatataatagattagttcaactaggtcagtatgagaaataaaaagcttacttagtttttctattaattcacaaacaggaaaaaaaaatctgattttccagttcccaaatgatttctcagtttaaaataaatcaattcaaaggtcaacaaaactgtatgcttgcaggaacctaaattatcaagtctgtcacttccaggaaactttgaagttttaaaatttcaccaattcacccaaatttcttgtaattatcattaatattaatatataaccaataatatctactcatgatagctagtaaaatcccagcttgcttttttacaaaaattgatacgctgatcctaaaattcacatggaaatgcaaagggcccagaatagccaaaactgtcttgaaaaggaagaataaagaggtcttccctattttaaaactcgccacaaatcttcagtaaacaaaaggcaatttggtactggtttaagaatagacacatagataaatggaaaagaattgagtccagataaatccttacatttatgctcaactgatttttgacaaaagtgccaaggtaattcaatgggaaaagaatagcctttcaacaaatggcactctagccgggtgcagtggctcacgcctgtaatcccagcaccttgggaggccgaggcggacggaccacaaggtcaggagatggagaccatcctggcaaacacagtgaaaccctgtctctactaaaaaatacaaaataaaactagccaggcctggtggcaggcacctatagtcccagctacttgggaggctgaggcaggagaatagtgtgaacccgggaggcggagctttcagtgagcggagatcgcgccactgcactccagcctgggcgacagagcgagactctgtctcaaaaaaaaaaaaacaaaaaaaaaaatggcactcttaacaattggatatccacatacaaaataatgaatgtaggccgggcgcggtgtctcacatctgtaatccctgcactttgagaggccgagataggcggatcacgaggtcaggagatcgagaccatcctggctaacacggtgaaaccacgtgtctactaaaaatacaaaaaattagccaggcgtggtggcgggcgcctgtagtcccagctccttgggaggctgaggcaggagaatggcatgaaccaaagaggcggagcttgcagtgagccgagatcgcaccactgcactccagcttgggccacagagcaagactccatctcaaaaaaaaaaaaaaaaagaatgtagacctttcccttacccttatctcacaccatacaaaaattgacttaaaatgaatcataggcctaaatttagcagctaaaactataaagtaatgaacacaggatgtaaatgctttaaaattagattgtggtaataggtgcaaaactctttaaatttactaaaaatcattgacttgtatacttaaaatgagaagtttttttcttttttttttttctttttgagacagagtttcattcttgttgcccaggctggagtgcagtggtgtgatttctgctcactacaacctccgcctcccgggttcaagcaattctcctgcctcagcctcccaagcagctgggattacaggcatgcgccaccacacctggctaatttttgtatttttagtagagaccaggtttatccatgttggtcaggctggtctcaaactccagacctcaggtgatccacctgcctcagcctctcaaagtgctgtgattacaggcatgagccaccgcacccagcctaaaattagtggtttttatggcatgtaaaatacagttgtcccttgctatactggggacattggttccaggactcctgcatagaccaaaatctgagcatactcagataagtcctgcaatggccctgtggaacccagtgatataaaaagtaagcccttagtatgcaacagtttcacatcccaggaatactgtattttcaattcgagtttggttgaaaaaaaaaatcaccatataaatggacccatgcagttcaaactcatgttattcaagagtcaactgcatatctcaatgaaggtttaaaaaagccacctctaggctgggcgcagtggctcacgcctgtaatccgagcactttgggaggctgaggcaggcggatcacgaggtcaggagttcaagaacagtctagccaacgtggtgaaacgccatctctaccaaaaatacaaaaattagccgggcttgctggtgcatccctgtaataccagttactcaggaggctgagatagaattgcttgaacccgggaggcggaggttgcagtgagccaagatcacgccactgcactccagcctgggtggcagagtgagactccatctcaaaaaaaaaaaaaaaaaaaatatatatatatatatatatatatatatatatatatataaaatggtatttttttttcttatacagacaaggtcttactatgttgcacaggctggtgttgaacttctgacctcaaacttctgacctcccacctcagcctcccaaactgctgggattataggcatgagccactgtgcccagctcaaattttcaaatatagagtacaactgtttatatagaatttacattctattaggtattctaagtaatctagagatgatttaaagtatatgggagaaagccgggcatggtggctcaaacttgtaatcccagcattttcaggaagccaaggcaggcagatcacttgaggccaggagtttgagaccagcctggccaacatggtgaaaccccgtctctactaaaaatacaataattagctgggtgtggtggcacacgcctgtaatcccagctactcaggaggctgaggcaggagaattgcttgaacccaggaagtggaggttacactgagccaagatcgcgccactgcactccagcctggtgagggagcaagactctgtctcaaaaaaaaaaaaaaaaactagcgggttttggtggcatacgcctctaagtcctagctactcaggagactgaggcaggagagcagcttaagcccaggaatttgaggctacagtgagctatgatcaagccactgtactcaagcctgggcaacagagcaaggcgcggtggctcacgcctgtaatcccagcactttgagaggccagggcgggtggatcacgaggtcaggagatccaggccatcctggctaacacggttaaaccctgtctctactaaaaatacaaaaaattagctgggcgtggtggcacgtgcctgtagtcccagctacttgggaggctgaggcaggagaatggcgtgaacctgggaggcggaccttgcagtgagccgagatcgcgccactgcactccagcatgggggacagagtgaggctccatctcaaaaaaataaataaataaataaataaataaataaaaattttaaagagatgatttaaagtatacggaagatacatgtaagttatatgcaaatactataccattttatataagagactggagcttctgaaaattgtggtatccactaggggttctggaaccaatcccccacatatcaaggggtgactgtaattacttaacaaaaattttttaaaaaatcatgaaagtatgtatttgtcaccagctcatgggaatcactattcttgaattaggtagcactaaatacctttaaatacctgatggaagccttaaactcagcagcaagttcctgaaaacatgccaacatatattaattattctgggtctaaaagtttgacaaattactttaaaatacagatgaaaacaaaataaaatgttttaaactgcaacaagaaaaatgtacaagttgaccagaagtttgaaacacttgactacattggtgcactgttaatcaaaatttatctgcaaaacagatttgcaaaagaaattataaacagggtagtaaatttcaaagtaatttataacagactaaggtcaagctacattagcaaagttggaaggtagcacttaagaaaaaactctgggccaggcacggtggctcacacctgtaatcccagcactttgggaaggccaaggcaggcagatcacctgaggtcgggagttcaagaccagcctggccaacatggtgaaacctaatttctactaaaaatacaaaaaaattagccgggcatggtggtgcgtgcctgtagatccagctactggggaggctgaggcacaagaattgcttgaatccgagcagcagaggttgcagtgagctgagatcgcaccactgcactccaacctgggtgacagagtgagactccctctcaattaaaaaaaaaaaaaaaaaaggccgggcacagtggttcacgcctgtaatcccagcactttgggaggctgaggcaggcggatcacgaggtcaggagatcgagaccatcctggctgacacggtgaaaccccgtctctactaaaaatacaaaaaattagctgggcgtggtggcgggcacctgtagtcccagctacttgggaggctgacgccggagaatggcatgaacccaggaggcggagcttgcagtgagctgagatcgcaccattgcactccagcctaggcaacagagcaagactctgtctcaaaaaaaaaaaagagaaaaaactctggaaagttatatggctctaccatgtactatttggacacctctggaggagaggaacttgttcaattttaacagtataaactttattgtttaagtagctaatatttaggccaggcgtggtggcttaagcctgtaattccagcacttcaggaggctgaacgggtggatcacctgaggtcaagattttgagaccagcctggccaacatggtgaaaccccgcctctaccaaaaatacaaaaattagtcgggcctcatggcgcacgcctgtggtcccagctacttgggagtctgaggcaggagaatcacttgaactcaggaggcagaggttgcagggaggcaaggttgcaccactgcactccagcctgggcaacagactgagactctatctcaaaaaaaaaaaaaaaaaaaaagactaactatcaattaggaaatatttacgtgtagcagtactaacaacattgagatggactaatttacagaatcccaatactttcgttctaattttttttttcagggtgttgctctgcatgattgtagctcactgtagcctcgaactcctgggctcaagggatcctcccacctcatcctcccaagtagctgggaccacaggtatatgccaccatgcccagctaattttttatttaatttttttttttgtagagacagggtctcactatagtgcccaggctggtctcaaactcttggcctcaagtgaacctcccaaagctctgggattacaagcatgagccactgtgcgcagctgcttccaaagattttctagagtggccaaaaccccagataatccatgaaagagcatgaaaagtattttaagggacaatggaaggggagaaactgctacctaatattctcagcaacttttcctgccctacctgacaagcgaatgatattgaagaggagggtaactaactgaacagactcttctctctccttctatccaggcacctactatcctgcaaatacgcagctttgaaggacttaaccaatgaccttaaaatctataccaggtctacagttctaggaagcgtataagcaaatgctgctatagaatttggattttctttaatgataaaaatgcaaatgactcacgtttggtcatccactccaacacagcacattctaaagaacaggagttcaaatcctccttctgccaaaagatgttgtgtcttcacacacaaataagtaattatggattatattactaccacaaatttctgtttctcactgaaggcatatgacattttaaaaaagaacaaaaaatcagaaaggaaatgtttcaagtctattttgaggtaaagcaatcaatttaccatttatcttcctcagacttacatatgaaagccccacacacatgcgcacacacaagatccccaaaatgttgacaactgttgaagctgcacaacggataccagagttcattatactattctatttttgcatatatttgaacatttccataatatgcagttttttaaaatatgcatgtgtgtgtctataggtgtttatacataaactcccaataaactgacatagaaatatccaattgttcaaagctttcattcttcaaaagtaagtgaatttcttttttttttttttttttttgaaacagtctctcactctgccacccaggctggagtgcattggcacgatctcggctcacagcaacctccacctcctgggtacaagcaagcgcatccagctaatttttttgtatttttagtagagatggggtttcaccatgttgactaggccagtctcaaactcctaacctcaagtgatgtgcccgcctcggcttcctgaggtgctgggattacaggcgtgagtcaccacgcccggccagaattccatctagctactttcttattctagaagttgtactgcaggtgaccagaccattagagaaggtctagtgaaagaaataattaactgccccagaataaaacaagcctaaccttgaaaagaggcaaagggaaaggtgctaaacagttattacaattaactgcatgtttatatttggtcctgttatcctctaacacaggtgggtaggtagaaaagggggaagtattttagggccagatttccttttgattctttaagttgatgggcaagagaggctggaataaagaaatctaaaaagtctccattataaatgataaccaagccaggcacaatggcgcatgccagtagttccagctacttaggagacaagaggggagaatcgcctgaacccaggaattcaaaactagcctaggcaacagagtgagacctcatctctaaataaataagttaatgaattaattaaaggtagaattgtataatatatgaattatacctcaatttaaaaacaatttaagccctatacagtgatgcatgcctatagccacaactactcataagactgaagcaggaggatagcttgaacttaggagtttgagaacagcctgggcaacatagagaggcctcatccccctcccacccccacccgaaaaaaagcattcatagctcatcttagtataatcagcaacttccaatgactaactatgctttcctgctagacatgaatttataaaacacataaaaattatactgtatctgcttcaattccttttttcatattgccattcaattttcacaagattactttaaatgcaatcctaaattcatcaccaatttaacttttgttagttatgtctaaaaataaaactagtcaaaattaaaaatactaactttgcagcaaattaatcttgcatcagcactacaaacaaatttttaaacttattgtagcaaaacataacttcgacagaatcaaagacattaattctcaagtccaaaaaaaggtcacaagaaattatttaaagtggtaaagggaaacgcagacttaggcatacaagccaagaaaaaaaaaattagagataactcctccgctagaacctccccccaatacttccatagcaacaattatttccttagcacaaaagtgatgtgttcactttcacaaaacctggatcatctaagtttgcacaattcccttcaatctaaaaaacagatgaaattgtttcatttaggtgagtagaattttgtgtccctatacacgaaaaaagtcaccatcagtgtgagtaaaccacatggctccagctttaagatcttgttccccaacccactgaaaagagtatatgcttataaaatattcatggacttaccaggttaaagacagtttctacaatatccctattggatacttctccaacttcaaccaaaccggtcaacacggcaaatttcattctgatgcccctgatggggagccctggtttcagagacaatgcacccccttcagtaggggtttcttctctccctccacctcccccgtcatcacctgttggtggcggggaagggacacgattgtcttcgctagccattgctagctcacgataaaggacaactcagagtcaccctgggacggcagtcgctgcactggtaatgagcacaacacacgcaatgcaaaacgaaagggtccctcttccaacttgtggagataccccaaagcagttgatgtggaaagtccttggcgtcgccctcctcctcttggagaatatttgtccaatctctctccccgaggctgacaacaacgccaaaccctattggaagattaaatatatgttaaataggctaggttttgttttagggttttgaggggacaagagggaaatagttattgtcggtcaagtaagttactaaaggcaccccactactagccacccgcttctcccgggctcaaaaagctgggttctgggtgaaggcaggtccaagaggcccccgaacaggctcactcctcccccactctcgtgcaggttctaggcgcagggtaacctctcctcacaggtgcactagaaagagaaactgtcgcggggaaaggagggatcggaggaaagaaggggggcccacaagctatcacagaggtagaaagttcttcctcacccagatactccggactcgtcctcaccccccgcccaggagcagcgagaccgaggtggcggcggagat

SEQ ID NO: 1850 - DNA, 750839 bp, Homo sapiens
  source 1..750839: mol_type = genomic DNA
ttcacaacatacaaagaatttatttatgcaatacaggccttttctcaaatatttttcacagaattccacacagtaatctactagaaaagtagaattatacaccaccaaataacattgtttcgtttcttagtacaaattgctaatcaaaaggaaggtggagatgatagtttaataacaaatagtaaaacaggtgttgctgaatacagcacccggtagcctctatttgcaaacccggggagggaagggggtgccccaacaaaacaacagtggctccgcctcattgtccaggcacaggcaaaccgcagtagtgagctttggtacttgcatttactttaaaagaaaaacaaatgttgtgagctcaagagcatttccatcatttcgttttgttgtgctatgaagatgacagatcaggaaaaaatggtaactatttcacacttgctataaattagattccttgtgctaaccacacaataaaatagcctcccccaaaccatacttttctaggtctaaaacatgcttgaagaacaatattgatagacagacttaattgagatgttttaaattacatttaccataatttaaacattactatttaaatcccagaaatattagtgctgaagaagcacagttgtttggaaaaatacaggacccaaattacagcatcaaattttcctattccaatattgtaacccacttccccactgtgaaaatcctatttctcaagcttgtagatgcatgggaaatgttcttcataatattatagctggaataagtggtttacttgctccactgtatgtttccataattggtgaaaatagacttctcattatgactaaaaatatagattttttaaaactacagaacccagcagccagttttctgctttgctaatcccccccaaaaaagtcaagcaaagactacaaaaatagcaattattaataactttaaaaaatattttgcttctttgagcaaatttaagttacattcagatgtggtagaagagaatgatgctccaggtacttctgctcatcctaggggcagagttgatgtacagctgtcaccatcagtagcgggtttggtattcatgatgccaccggttaaagtcgttgtaaaatagcacaatgcttcctgaagccatgccagaaatgatgcacctaggagaagcacagagagaaggacttttacaaacctgtgtgtcctagagatgttactaaaaactgctctccccaaatccacaaggtaaatatagaagctggcagtgaaggctccaatttgtgggaactaaggtatgtatttcatgactaaaatgtatccctgagtaagctcagagtactgcctctgacactccacaaggatccaagccacagcttgctttttcattgaaagggtacggacagctggtatgtgcaggatgagtaactaaaatctgaacagatttgtaactaaaatctgaacagatttggtaatttctaaagggggactgggctggcaagacccatccattatataagcaacagactcaaaagaaggaaccacaatctcaaagtaactgctggtggaaagaagcagcacacactcaagtgacaagagacaccacctctgacaggtacagaatcaatgaagagtgaaaaagaagagtgttgttgaccataatttaagctggtctcccctctgtggagaagtagtctatgtccatcatgctctgggtgaggacctagtcctcgtaacacagtaactcaccgaaatcactgaagataagaacttctgcaagcttcttggtctcctgtccccaaagaggtggtgcagggaaagagatggagaacataggtgaacctaaactgagcatagccagatttttctctgtgtagtttggttaggaccagcccttagaagccatattcagtatccttcctagtacctcgtatcaaaattaattaggaactaaaatgtgtcactacaaaaaaaatcaactaaaaacaaaggaagacagtaaggaggaaatgagagacaaaactctaaggcagagagaaaattaaatagaaaagtggcaaaagtcagtctttccttatcagtcattaaagagattaaattctccagccaaaaggaagagattggcagaatggataaaaaacatgatccaactatatgctgtctacaggagacccacttgagatctaaagacaaacatcttgaaagtgaaaggatggaaaagatattccgtgtaagtactagcaaagagagctgaggtggcttacactaatatcagacaaaatagtctttcagtcaaaaactgttacaagagacaaaggacactacactgagaaaagggtaaattcacagaaatataacaattatatatgcatttatcatcagacccccaagatacaaagagcaaatattaacagaattgaagggagaaatggttctacagtaatagttttagacgtcaataccccactttcaataatgggtggaacaaccaggtggaagataaggaaacaggacacttgaacaatacgataagccaactggacctgacacacgtatatagaacaccttcccaacaacaatagaatatacatttttttgcagtgcgcatggaatagtctccaagataaaccatatgttaggccacaagtgttaatgacttagtaaagattaaaatcacaaagtagcttttctgatcataatagaatgaaactaggtaccaataactgaaggtaaactagaaaattcacaaatatgtggaaagtaaataaatgatgagtcaaaaaaaacaaacaacaacataagagacatcagaaaatactgagacaaatgaaaaggaaatacaacaagccaaaacttatgaaatgcagcaaaagcaatgctaaaatggaaatttttagctgtaaacacatagatttaaaaatatctcaaatcaataacctaactttacctcttaaggaactagaaaacagacaaaaccccaggctaggcagaaggaagaaaataataaagaacagagtagagagaaataaagcagaaaatagtaaaatgattgataggaaaaaacccaaaaattggttctttgaaaaaataacaaaattgacaaacctctagctagactaagatgacttggctgggcatggtggatcatgcctgtaatcccagcactttgggaggccaaggtgggtggatcacctggggtcaggagttcgagaccagcctggccaacccggggaaacctcgtctctactaaaaatacaaaaattaactgggcgtggtagtgggcacctgtaatcccagctacttggaaggctgaggcaggagaatcacttgaacctgggaagcagaggttgcagtgagctgagattgcaccattgcactccagcctgggtgatagagtgagactccatctcaaaaaaaaaaaaaaaatgactcaaattactaaaatcagaaataaaagttgggacattactgatttggcagaaactgagttcagagagactattagaaacaactgtataccaacaaatagggcaacctagatgaaatagacaaattcctgaaaacagtataccaaaactgaatgaagaaatagaaatgattagacttatgacaagtgaagagattgaatcagtaatcaaaaacctcccaataagaaaagtcctagacaagatggcttcactgatgaattctaccaaacatttaaagaagtattaacaccaatccttctcaatttcttcttccaaaaaattaaagaatccagaacacttcctaagtgattcaataaggccagtattaccatgacaccaaagccagttgaagacattacaacaaaagaacacacagaccaggatacaaaatactagcaaactgaattcactagcatggtagtgggaatgtacaccatgacccagtgggattcattctgggaatgcaaggatgactcaccatgcaaaagtcaaccaacatataacatactacattaacagaacaaacaacaaaacaagcccacatgatcatctcaactgatgctggaaaatttgacatgtgacaaaattcatcatccttttattatgaaaacaataggagtagaaggaaactacctcaaatgataaacagcatgtatgaataactcacagctaacaccacactcgatgaaaaaaagtttttcccctatgattgggaacaaggcaaggatgcccactttaatcactcttatccaacagtactgaaagtcctagacagagcaattacacaagaaaaaagtatccaaattggaaaggaggagtgaaactgtctctgtttacagatgacatgatcttgtatgtaggaaatcctaaaaattccacaccaaaacaaaacaaaagagctaataaatgaattcagcaaatttgcaggatatacaacacgaaaatcagttgcatttttatacactaacaaacaatgagcagtccaaaaggaaaattaagaattgcagtgagccgagatcatgccattgcactccagcctgggtgacagagcgaaacagaaacccctaacagccaaaacaatcttgaaaaagaagaaatatgttagcagttgcacattttctgatttgaaaacttacttactgttgttacaatgcgacagtaatcaaaacattgtcacactgatataggcagaccaacagaagagaaagttgagaaataatccctcacatatgtgctcaaatagggtgccaagacctttcaacggagaaagcaccttcttttcaacaaattatgctgggaaaataggatgtccacatgcaaaacaatgaaggtggactcttacctaccattatattaaaaaactaaaaacagatcaaaaacctaaatacaaattaaaactataaaacttttagatgaaaacatatgggaaaaccttcatgaccttggattttgcagtggcttcttggatatgatatcaaaacaaaagagacaagataacaaaacaaactcataacaaaaaataggacttcataaaatgtaaaatcagggctaggtatagtggcttatggctataatcccatccctttgggtggctgagtcagcaggattgtttgtttgagcccaggagtttaagaccagcctgggcaacatagtgagaccctgtctctacagaaaataaaaaagctgggcatggtggcacatgcctggagtaccagctaccatgtagctgaggcgggagaatcatttgagcccaggaggttgaggcttcagtgagctgtgattgtgccactgcactccagtctgggcaaaagagtgagaccctgtctcaaaaaacaaacaaaaagtaaaatcttttgagcatctaaggatattaggaagagagtgaaaagacaacatcactgatcattagggaaatcaaaaccacaatgagagaccacgcctgttaggacaactgttaaaaaatagagcaaggtgttgataaggatgtggagaaattggaacccatgtaaaatggtacagccactgtggaaaacactttagggtttcctcaaaaagtcaaacggaattgccatataacccagcaattccactcctgggcatacacccaaaaggactgtaaaaagggacttgaatagatatttgtatgataatgttcatagcagcattactcaccatagccaaaaggtagaaacaacccaagtgtccatcatcaacaggtgaacgataaacagaacacagaatattcatataatattctgatacgtgctacgacatgcaagaaccttgaaagtgttatgccaagtgaaataagccaggcacaacacaacaaatattgtatgattccacttaacagaaggtgcttagaagaggcaaattcatagagacagaaagtagcatgcacatgagctggtgggagagagagtcattaacatgcagagcttctgtttatgatgaaaagggtctggaaatggatgatggtgatggtggcacaacactgtaaatgtacataatgccactaaattatatatcgaaaagagtttagatggaaaatattatatgttgccacaattttttttaaaaggaacaaaaatgagtgactatacgttaagaggaaataaggtgccagataaagatgatccccccaaaatctaccacttgagagcttttaggaaataagccctatctttcaggggactctccatatgcagagatatgcagagataaaggcattttacattaaacatctttacagctctttcaattttatttactgataaagatgatgatacttcttcaggctggcaatcgccgaataggagcagatctggtctgcagctcccagtgagattgacgctgggtggatgatttctgcatttccaactgaggtacctggttcatctcgttgggactggttggacagtgggtgcagcccacggagggcaagccgaagcagggtggggtgttgcctcacccatggaagcacaaggggtcggggaattccctcccccagccaatggaggctgtgagggactgtgccatgaggaatggtgcactctggcccagatactgcgcttttcccacagtcttcacaacctgcagaccaggagattcccttgggtgcctacaccaccagggccctgggttttaagcacaaaacagggcggccgtttgggtagacactgagctagctgcaggagtttttttttttttttcataccccagtggtgcctggaatgccagcgagacagaaccgtttactcccctggaaaggaggctgaagccagggagccaagtggtctggctcggtgggtcccactcccatggagcccagcaagctaagatccactggcttgaaattcttgctgccagcacagcagtctgaagttgacctgggacactcaagcttggtggggggaggagcagccagggagccaagtggtctggctcggtgggtcccactcccatggagcccagcaagctaagatccactggcttgaaattcttgctgccagcacagcagtctgaagttgacctgggacactcaagcttggtggggggaggagcgtccgccattggtgaggcttgagtaggtggttttaccctcacggtgtaaacaaagcctctggggagttcgaattgggtggagctcactgcagctcagcaaggccactgtggccagactgcctctctagattcctcctctctgggcagggcatctctgaaaaaaaaggcagcagccccagttaggggcttatagataaaacccccatctccctgggacagagcacctgggggaaggggcagctgtgggtgcagcttcagcagacttaaatgtccctgtctgacagctctgaagacagcagtggatctcccaggacagcatttgagctctgctaatggtcaaactgcctcctcaagtgggtcctcaacccctgtgtctcctgactgggagacacctcatacaggagagctctggcggaggcccctctggaatgaagcttccagaggaaggaactggcagcaatgtttgctgttctgtagcctccactggtgatacccaggtaaacagggtctggaatggacctctagcaaactccagcagagctgcagctgagaggcctgtgagaaggaaaactaacaaacaggaatagcgtcaacatcaacaaaaaggatgtctagacacagaaaacccatccaaaggtcaccaacatcaaagactaaagaaagatagataaatccacaaaaatggggagaaaccagtgcaaaaagctgaaaattgcaaaaaccagaatgcctcttctccaaaggattacaactccttgccagaaaaatggaacaaagctgaacagtttgagaaattaacagaagtaggcttcagaaggtgggtaataaactcctccgagctaaaggatcacgttctaatccaatgcaaggaagctaagaaccttgaaaaaaagttagacgaattgctaactagaataaccagtttagagaagaacataaatgacctgatggagctgaaaaacacagcacgagaacttcatgaagcatacacaagtatcaatagccaaatcgatcaagcagaagaaaggatatcagagattgaagatcaacttaatgaaataaagagagaagattagagaaaaaagaatgaaaaggaacaaacaaagccttcaagaaatataggactatgtgaaaagaccaaatctacatttgatttgtatacctgaaggtgacagggagaatggaaccaagttggaaaacactctgcaggatattatccaggagaacgtccccaacctagcaagacagaccaacattcaaattcaggaaatacagagaacaccacaaagatacttctcaagaagagcaactccaggacacataatcatcagattatgtgaaggtagaaatgaaggaaaaattgttaagggcagccagaaagaaaggtcaggttacccacaaagcaaagcccatcagactaacagcggatctctcagcagaaaccctacaagccagaagagagtgggggccaatattcaacattctctaagaaaataattctcaacccagaatttcatatccagccaaactaagcttcataagcaaaggagaaataaaatcctttacagacaagcaagtgttgagacatttagtcaccaccaggcctgccttacaagagctcctgaaggaagcactagacatggaaaggaacaaccggtaccagccactatgaaaacataccaaattgtaaacaccatcgacgctatgaaggaaactgcatcaactaatgagcaaaataaccagctagcatcataatgacaggatcaaattcacacataacaatattaactttaaatgtaaatggactaaatgctccaattaaaagacacagactggcaaattggataaagagtcaagacccatcagtgtgctatattcaggagacccatctcacatgcaaagacacacataggctcaaaataaagggatggaggaagattttccaagcaaatggaaagaaaaaaaaaaagcagggttgcaatcctagtctctgataaagcagactttaaatcaacaaagatcaaaagagacaaagaaggccatgacataatggtaaagggatcaatgcaacaacaagacctatcctaaatatatatgcacccaatacaggagcacccagattcataaagcaagttcttagagacctacaaagagacttagactcccacacaataatagtgggagattttaacaccccactgtcaatattagatcaatgagacagaaaagcaacaacaaggatattcagaacttgaactcagctctggaccaagcagacctaacagacatctacagaaatctccaccccaaatcatcagaatattcattcttctcagcaccacactgcacttattctaaaattgaccacataattgaaagtaaaacactcctcagcaaatgcaaaagaatggaaatcataaccaatagtctctcagacgcagtgcaatcaaattagaactcaggattaagacactcactcaaaaccgcacaactacatagaaactgaacaatttgctcctgaatgactactgggcaaatactgaaatgaaggcagaaataaagatgttacttgaaaccaatgagaacaaagacacaacataccagaatctctgggacacatttaaaatagtgttttgaaggaaatttatagtacgtaatgcccacaagagaaagcaggaaagatttaaaatcaacaccctaacatcacaattaaaagaactacagaaggaagagcaaacacattcaaaagctagcagaagacactaagatcagaggagaactgaaggagacagagacacaaaaaacccttcagatcaatgaatccaggagctggtttttttgaaatgatcaacaaaatagaccactagccagattaatacacaagaaaagagagaagaatcaaatatacacaataaaaaatgataaaggggttatcaccactgatcacacagaaatacaaactaccatcagagaatactataaacacctctacgcaaataaactagaaaatctagaagaaatggatacattcttgggcacatacaccctccaaagtctaaaccaggaagaagtcaaatccctgaatagaccaataacaagttctgaaatcaatagcctaccaaccaaaaaaagtccaggaccagacagattcacagccaatttctaccagaggtacaaaaaggagctggtaccattccttctgaaactattccaatcaatagaaaaagagggaatcctaactcattttatgaggccagcatcatcctgataccaaaacctggcagagacacaagaaagaaagaaaatttcaggccaatatgcctaatgaacatcaatgcgaaaatcctcaataaaatactggcaaaccaaatccaggagcacatcaaaaagcttatccaccatgatcaagtgggcttcatccctaggatgcaaggctggttcaacatacacaaatcaataaaagtaatccatcacataaacagaatcaatgacaaaaaccacatgattatctcaatagatgcagaaaaggccttcaacaaaattcaccaccccttcatcctaaaaactctcaataaactaggtactgatggaatgtatctcaaaataataagagctatttatgacaaacccacagccaatatcatactgaatgggcaaaaactgaagcattccctttgaaaactggcacaagacaaggatataccctctctcaccactcctattcaacatagtattggaagttctggccagggcaatcaggcaagagaaagaaagaaagggtattcagataggaaaagaggaagtcaaattatccctgtttgcagatgacatgattgtatatttagaaaaccccagcatctcagcccaaaatctccttaagctgataggcaacttcagcaaagtctcaggatacaaaatcaatgtgcaaaaatcacaagcattcctatacaccaataacagacaaacagccaaatcatgagtgaactcccattcacaattgctacaaagacaattaaatacctaggaatctaacttacaagggatgtgaaggacctcttcaaggagaactacaaaccactgctcaaggaaataagagaggacacaaataagtggaaaaacattccatgctcatggataggaagaatcaatattgtgaaaatggtcatactgcccaaagtaatttatagagtcaattcaatgctatccccatcaagctaccattgactttcttcacagaattagaaaaaactactttaaatttcatatggaaccaaaaaagagcctgtatagccaagacaatcctaagcaaaaagaacaaagctggaggcaccatactacctgacttcaaactatactacaaggctacagtaaccaaaacagcatggtactggtaccaaaacagatatatagaccaatggaacagaacagaggcctcagaaataacaccatgcatctacaaccatctgatctttgacaaacctgacacaaacaagcaatggggaaaggattccctaattagtaaatggtgttgggaaaactggctagccatatgcagaaaactgaaactggaccccttccttacaccttatacaaaaattaactcaagatggatgaaagacttaaacgtaaggcctaaaaccataaaaaccctagaaggaaacctaggcaataccattcaggacataggcatgggcaaagacttcatgactaaaacaccaaaagcaatggcaacaaaagccaaaattgacaaatgggatctaattaaagagcttctgcacagcaaaagaaactatcatcagagtgaacaggtaggctacagaattggagaaaatttttgcaatctatccaactgacaaagggctaatatccagaatctacaaagaacttaaacaaatttacaagaaaaaaacaaccccatcaaaaagtgggcaaaagatatgaacagacacttctcaaaagaagacatttacgcagccaacaaacatatgaataaaagctctttatcactggtcattagagaaatgcaaatcaaaaccacaatgagacaccatctcacacccttcagaatggcaatcattaaaaagttaggaaacaacagatgctggagaggatgtggagaaacagaaatgcttttacatcgttggtgggagtgtaaattagttcaaccattgtagaagacagtgtggcaattcctcaaggatatagaaccagaaataccatttgacccacaatctcattactgggtatatacccaaaggattataaatcattctagtataaagacacatgcacatctatgtttattgcggcactattcacaatagcaaagacttggaaccaacccaaatgcccatcaatgatagactggataaagaaaatgtggcacatatacgccatggaatactatgcagccatacaaaagaatgagttcatgtcctttgcagggacatggatgaagctggaaactgtcattctcagcaaactaacacaggaacagaaaagcaaatacctcatcttctcactcataagtgggagttgaacaaagagaacatatggacacagaggaacatcacatacgggggcctgttgtgggggtgggggcctaggggagggatagcattaggagaaatacctaatgtagatgatgggttgatgggtgcagcagaccaccatggcacatgtatacctatgtaacaaactgcgttctgcacatgtaccccagaacttaaggtataatttaaaaaaagatacttcaaagaaatataaaaagctttgcatcactgtaatcagagcctttgctacttaaattctgtctattccttgagaactcagcctttgtccaagagtggcaatgtcatcagaaagaaaatcacactttttaaaaaagtgttcttggtttgattgtacaggtgacccccacaactcaactccatcagcccatttaaataaattccctctgcaggttttactatacaattttgaaaaaaaaattttttttttctgtagagacagggtcttgcaatgttgcccaggctggcttcgaactcctgggctcaagtgattctcctgcctcagcctcccaaagtactgggattacaggtgtaagccaacacgaccagtcccctctgcagtttttgaaacccctatttgtagcccatgattccagtgttacctctggtcgtaagacagcgccatggcccggattccagcgtcacatcctggataggcaaagagctgcttgaggtccgacacctgccggaccacgaccactcctctgtctcctcctgtgagcaggtactgcccatctcggctcagctggatggcctgtgagacacagcaacattcagtagaaatgtggttctaggaaactttcggcccccaccctgtttttgagtcattcttacaccagctactacggtgcagagagaagagagagagatcctcaggagtttttagaaaatcgtgagttgtagaagatctgccatttttcaaaaaccaaatggacaaagttcatcaatgcttgagattgttttggctttgcttttttaaatactaggtagcaaactcttccagttctacaaatgctactggaatggtgtgtgttgtggactgggaccagtgctctaatgagaagccctggcatctcttcatttgcactgcagacatgctaataagcctgttttgtcccaagacttggcagatggtgccacctgaccttacatcccctctaatcccctgcaactccagctggagggaggcggccagcagcctcggcaccttccctgagcctgctggattttgacagcagttgggaagaagactttgtagagagctacaacaacttccagggtgattaaatctcagttcagcattttcttgctccagggctgacagtgctccagcctgtggtttagtcagctctaggctgtgcccctctgtcctttcctactagcgctgaacagacagtacaggctcagaatttgctctttgatcctgtaaaatgggcatccatgaatgaaagcctgcgggccaagtgcagcccactgcctgtttcatataattgtttaacattttttaatgcttgaatttttcatgacacatgaatatttatatgaattccaaatttgaatccccataaacaggtttttttttttcccccctcgagacagggtcttgctctgtcacccaggctggagtgcagtggcgcagtctcagctcactacaatctccacctctcaggttcaagtgattctcatacctcaacctcctgagcagttgggattacaggtgcccaccacaacacccgtctaacttttgtatttttagtagagacggggtttcaccatgttggtcaggctggtcttgaactcctgacctcaagtgatccacccgctcggactcccaaagtgctgggattacaggcgagaaccactgcgcctggccttccataaataaggttttaccagaacatcgccacacctattatttgtttatgactgctttcacaggtagttgcagcagagaatgcagaaccctcaaagctgaaaatatttactttctgtccatttatagaaaaagtgtgattactcctaattgtccctccctcctccaaaagccaatcctattaccccttcctctcctcctgcctggtacctccaagccttgctttcttagcttattaagatacaaatttcctttctttagtggatggcatcagagttttaaagccactacaaacacctgtaatcgcatgtccacctggacacaggggaatacagattgtgctggcaagccagaaagaaaaaaacctaatttctgatacattgacactgttctacattcagttctagcatagctgccttaagtcttcactgtttgacatatcttttaaaaaatcatagaaaggcaaagactttcttagccatttatttcacattcacccaaatgccaacttttagtagtcccttaaatacagcttattctcaagaacacaaaaacacatctaggaaataaaaacccatgtgtggaagacagttagttacatattctctaagttttgttaacacagatattaagatattttcaagatgagcaaaaatcagtatccttttcccccactcatttcacaaatggcaatctctaggggtgtctgggaactgcagtggagactaggacaaacaattatttgctacacttataaaattcagctgatgaaaatccattaaccttatggttgtagttcatttgaatttgatacttgaagctttttactggataagtgttatactaaaacaaaaccactgatctttaattctttgttctagtaaagaatctctaatcctgcttccatctgaaattaagtaaaacctgggctttagggactatacagtcatcagcattcaaaacattttaatgaatcagatgcctcccaaggtgaaaaaagatttcgctggcctctttcaggagaggccaaattcctctggcggcaagagccagggtaacatttagcaagcagcacctgatctcccactcaaattctgacaggccgcctccgcatccaggttgggttgtgactagaggttttcagagggccccagacacatgttaatctcatcccctgaaatcctgagtgctctggacaatgccgtggctgcacgggttttaaggaggtagtagcaggccacagcaatctgctggggatgaccacattctaaaacagcctcaggaagggaaaacaaatgcattcccctgggtgaatggtggttctcccttgtttaggacaaaataactttgctgctctgtacaggctgcctccttaaatatcagctattcataaagacatctcaacactgtctagttgatggactgtgatatgctgctaaccaaaatgccacagagcaatctggcatctaaaataaaaataggtgggaagtgcagagcttccccaggctgcctgcctgcagggttcttggtatttcacagaaacttaatttctggtctgagctgatgactaatttgtttccatggtgtccattccttatatgggctcagattgaggaaggagctggagattctgccctgtggtgtcttggattcccagcctgtggcttccttcctcgcctcccgaggtagtgagctgtgaaagtatcagtctctggagctgtgggcaggtattgctcattttaggcaagctcgctttaatcacacagttgccacttgcaagttagcatgataaagtgcaggagtgctgggaaaaaggcaatggattgtttaagcctaaaatccagtgggaaatattaaagagggaaaaagcaatggctacagggcagagaggagaagcatgtgtgtatgaatggtctgcagaaagcctcccactgctgcctcaaggaacttcccagagcccctggtactaactgaaatgccacagaaattgcttcagtcagccagggatctcaaattattttacagatttattagcgtagctgacaatataatcgcaactcaaagtgacagattatccacattattattgtaaagaaaagaggaaaagaaaatcctctgatgtgtacttggtttaaatgcagcattatgggaaggtagggaaaaataaaagcgagtacgagtgtgtctctgtgcgtgcctcgtggaggccggcagaatgtgatggagagaccgcagagaacagtggagacaagaaggaagccgtccactgaatcaagaaatgaatcccaggagacagagcagcaagggtccttcatttcctcaatgtaacctatatgtaggagctttgttccctgagaccagtatttacttaggagaagggggtgatcagactagatctgggaaagtgggagaatttatgacatctaagctgcataggtcagaatagcaatgagtgaaatatccagagctagcccaacgccagggtagaagcccctgtgaccctactcctgcccccaacatgtcctgggtcccctcattgtatacagctcacatgccccgccctccagcctgattctggaaaatgaggaccaccccagctttattttactttaaccttcaccaaggagtttggaggtaagaaacaaaggaccttgagaaactagcctctgaaaagaatagttcttactctttttctcaatgtctaatacttgtggagtcctgtcctggagatgaagcaagagcccagaaggtccactggcggtgccatttcgggtagacccagtgggagaaaatgcctgcctaattcatatcataatttgaagcccagcttctttaacatgtttttggtcttgttgtccataaagaagtcatagctgaaattaataaacctaaatagtcataatccctactgctcccaccaccaagctattcagatgtaaagagaatccagttttaagtgtcatctaatgtactatttcagctttcatactcagaaaacaatgtgcagtgcattttcttagaaaaaaagaaatgagcagtgccactaaaagccacccaggatggcttcagaagcccctaagaaaacctcttctattgaaggaccgtcctcagctgcgctgagtgacgtggtcagcacagctggcactgctgtggtgtgtgaagtgtgtgagccttgtctgagtgctacctaaagattttttgttggtatggaaaagaggccctcggcaatccaaaaatagaggtttctttcgcgaaccctctccctccccacttgacacacgttgaggtaaaagtcgtgaatgctgaagagtccccagggcactcactcttatgttatcatctgtttccatcgtggcctggagttttccattcacactgaatgtacagaagaggccgttttcatagaatatgacacaatgaccctctcttgaagcctgaatgagttttggtttcaggcagttttcaggaccctccaaggtcctcaacaagtctccattcatggaatgtatgagacatggtccttctgagaagagaggagaaataaaaggcaaaattattgaatgaaaacagacaatatgatctgaatcttgagcacagatcaaacaggattatagaaccacactatagatgtagaaagcctttaaaaaacttccatcttacgtgtaagttattttgcaaaatctcctcttcatgtttgccagatctcaccttccactcaggagaggagagaagccaaaccatgtaagtccaagttcactttcctcaagagacaggaagttactctatgaaattcattatgctaacaggcaatacaaactggaggaactgagaaacaggataagcttcaaattctagcacagcttcaaggaggctgggatgcaaacaaacaagggctgcgggcaggtacactaagacctctccctgcaccttgcaggagccccaacggccacggcactgtgggcctatgcagggacagccagctcaatcagcctctgagtgccttagccctcttcccccgcaactgctcactactttttttacactgaaagggggtccctggtagttcctctcaacctccaaaaaattcacacaggaacccttcggccacttctccttggcaactgagtgaagccacctccctgctgccttcacagcaaggagcagcatctaccactcccaacgcctgggtggaccaccaggccaaggtgccagagaaggacaggcagctactgggagcccacacacagccaagctttttgtttctgttgagtacctgctgcatgcaaggcaaagaaggaataaggaacaaaaattgcttgtgtgatgagcaagttccaagagatagtcagataacgggggtcactggggtatgcgccctgctactctactggctaaattactcatggccacatggaatcgttgccttttccccacaatgactattgaaagcttgcccttttaaaaataaggcttttagctctttcttgaccactcaggtagttgataaattttttaaatatccacaggcagtgtttgctttacacagttccagcatgcatgaatttcagttatcactccttaaataacaccagccctccaataacatagttcaaatttaggttgtcatagtaattgcataaagtatgcacttttgtggctagctcttcagtccacaaatcactatataaataacagatgtgcatcatcatcatcagtgaccaatcacatcactcctttcaaaatatgtcgatgactgctcactgcattatctgttattcagttcccacacagacagcaaactgtgcagctgtgttgcttttttgtctcccagtgataaagccatgtaacatttcacaaaaatggataatcaaaaaggggtattggccaacaaagatgaaactgcagtaaagaaatggaaaatgataaaactgaaagtacaatttgaattgaatataaatggaattatagaagagcgagctgcctgtgggatgctgaccctgctgagacactgtagatatgcagccaggaagggaatgaaggaacttatcagtgtaagttagggaagaaggtgtaacaaaaatgtcccagaatttaaaccagcaaaagcctcacattaaaggaattctagggaatatttcatgacattgaaagcacaaaagataaaatgttagatgctggttccaacttagaaaagagtatgacagctccccaaggcatagaaaagatgctagctccttacatgtatataacaagaaggcagtaagcactgttcaaactactcttgatatgtttttcacaaataaaataattatcaatgtatcaaatgttttaaattacagtgtattaagtacatgtgagttttactacttttttcatgttatatgtataactgagtatgagtttttaatgttttgacaaaattattcttagagacagggttttgctgtgtcacccaggctggagtgcagtggcatgatcatggcttactacagccttcacctcctgcaatcctcccatctcaccttcccaagcagctgggactacaggtgtgcaccccatgcccagctaattcttaatttttttgtagagatgggggtctcactatgttgccagactggtcttgaactcctggcctcaaatgatcttcccaccttagcctcccaaaatgttgggattacaggcatgagccaccatgcccagcctgacaaaaatttttaaagaccatggaacaattgtaaaatttaccaatgattattcagatcactttgtatggtttcagttggcgtgctcacttttacagttccatactactgtgcaaagaaaagatgacctgtaatatataataggttcattttacgactcctgttggctcaggacgtatgaaattattgagtataagggaaaaatccagtggttatagaattattgctatcattattactatttcaatgttttgaccaaatttataaacataatcctttaaatatttaaaacaccttattaactagactaataagtattacattttaggacacagaggagctgatccaaatactctgtttccccaccagataaacccaaaagatgtgagatataatactttgttgtgtgttcagacttcagctcagagcagagacagagagatggatagactattatgatgggataagtaagcaacgaattggaaacagctccattcctagtcagatcctgatttgttgcatgtgctctaagctcgcttaatatcttgggcctaaatatataatgctgtttccagcacaaacctccaggcaaaccagcttaagtatctttctactccactctcaatgccactgtggcccctgcctcattaaaacagacagggtcaggggcttccattcagatataagacggaacctggcccagtaatagctcagaagaataaacaaatatacaaagacgttccttgttcctgcttcaggggaatatgaatattaacaggatatgtttgtaaaaacatcttaaactccttagagcagtgctgtgaaacagaactttctacaatgatggaaatgatctgtatctgtgctgtccaatgtagtggccactagccatatgtgagtactgaggacctgcaatgtggctagtgccacgaagaaacttacattttaattttatttaattttaaataatttaaatagttccatatgactaatggctatcataacagacagaagctttagaaaaaaggtaccaaattaatctttggtaatttgtttctagaagacagcaagaaatgcatccattttgtgaaggtaccacaggtttaccttgtgaaccactcaacaccaggcctagctccgcacacaccgcagcacatgtgacctcatagtcatggccggtcaaaatggcccgaggagcagcagtctcacctttaggaaaaaacagataaaaagaacaaatcaattcaatttcatgcatattaaataatcaacaacttgctcctaatttccatcatgcctatttaatttatagtttgggaatttgtccagcaatcctactttaggactagatccaagttacatactatagtttgattatgagggccacatcctgctaaaatgtcaagtaacctttatgtgattatcaagcaacaatggttgaaaactcagggttaaatacaacaaaatctgcattccaaaatgcctcataaaaaatcagcccctcaattagatgttttatggtcagatgattataaaattaggaactttggctcaatttacatttcaaagaaaggcctcgcccctccttcctccttcctcatcctttgtgggccgctgaaacccatcataatgaagacagtctgaactagacttctgctacccccacagtaattctgcagcccctctcttaaatatgtattctctctactaagcttatgtatttttctgatatataaatttcatggatatatttctctgtggttcattcaaataaccgaaaaaaaacccaatataagaaacacctaaaaaaaaaccaaacccttacagataagtctacagatagtgattgaaaatgaggggcggtgggtagagaaggggggacagaggaggagtatccaaaaactggcagatattgccgaatactttcacaacttgaaagaacaagtcatcctgtatgtctgtcccaaactaaaaagaaaacgtatggttggttggttggttggttaataaggaacccatcatgactaagtaaaatggtaatggtcttgatttgtggatgggttcgtgccaagccacaaggataaactggattccatgtctagcctgaagaatatgatttgaagactaaacggatcctttacttttatagtctctaaaggtaaagatacaaaaagtctttccaagtggagagcaggattctattagcattcccgatttcttgatttggattggttttatagtatgcttgataactaacactgtgtaatccagaagagacaaatgtgcccacagagtaagtggctaccaccagctatggaactctgtggaagagaatcgcttgtatcttaaccccagacacctgactatccttggagcagtcacccactcagaggaaggaagtccagcagctcaggggaaacccactggaaacctactgtacttggaaaggcaaatgctgctgtcagaaaactaacccggcttccaaagcaagggttcttccagtaggtcactgggttatttgaaattttatgcaaaatgtatctacatgcctgtttttctaggtagcaggggaggaaaataagttttactgaatggacagaggtccatgaacaagaaaaggtgagaggcttctaccctgaagggaggtctggtctctgtgcttgtagccccacttcacctggagccagcagtcacttcaggtctagcttttcacaggacagttccaatgcatgtaccagagtacataatgcacggccatgtccctacaatgtccttcaaggctttggtgactgtaggtaatcctgagtgagacttaagttgaaggaatgccacacggaactttgcaccacactggcgtgctatgtgcagccagctgctggacctagcctacaggcttagtgataaagggagaccaaaaataacatacaaagaggcaagggggtaggcagaacaaggggcttcgtttcatttgattccaagttttaacacttctttgggaggcaaacttaccttaattagaaagttgacatttcccaagccacaaagaatttgtcacaagagcaattttgtttcttacaaagtccagaaatttgggaaaattttaaagaaataaagcaaataatgtaagccaatctgaactacttaagcttctgttaggatccacaaattttttttttttttttctgagacggagtctcactctgtcgcccaggctggaatgcggtggtgcgatctcgactcactgccagctccgccttccaggttcacaccattctcctgccttggcctcctgagtagctgggactacaggcgcccgccactgcgcccagctaattttttgtatttttagtagagacggggtttcaccgtggtctcgatctcctgacctcgtgatccgcctgcctcggcctcccaaagtgctgggattacaggcgtgagccaccgcgcccagccaggatccacaaattttaggaagaagtatactgttttaaaaagttattggccgggcgcaatggctcacgcctgtaatcccagtactttgggaggccaaggtgggcagatcacctgaggttacgagttagagaccagcctggccaacatggtgaaaccctgcctctactaaaaatacaaaaaattagtttggcgtggtggtgtgcacctctaacaggtaggagaattgcttgaacctgggaggtggaggttgcagtgagccgagatcacgccactgcactctagcctgggcaacagagcgagactccgtctcaaaaaaataataaaataagaagttatcaatactttagccctgattcttggttttccttttccccagaaggctgtacattccacaaaaataccatacaatgttgtttctgaaattactgtctaattagatccattggcaactttttttttttaccagcaattaaaatcactaagatctaaggaatatatttttggtgtgattgttcttttttttttttttttttcttaagttaccatttcatggatggtgaaatttgtgttttaacttgaattgtcttggaattcctcagtggaaagtgaaggtttgaaggaaagctgatggcaaatgaaggcattctaagtataagacaaagtaaacaaaggacagatagataatggtggtcccagaggatgatgtcacttaagaacatcaatgctaactttttgttttcttgggagcatggtggaagaagggagaggattgctgtcaattttctttctttctttaatgtaaaagagttgaaatactgagcattttctatgactacaaagttaagagtttaggaagcctcgtgattaactccagaaggtgggttaagatataagcattattttttttgtaaactcgtaagatttttatcattatgctttgtttacaaaatactagtttccaataatccaaactttattaaatcatttttcactccacagatcagaacacacacacatgcagagtaatttcaaaactggaaaaggatttcttcttttcctagggcctgatctctaaataaggaactattcaatgctaggactttggcttcaaagtttggcaaaatgtttgctaatcccggaagcaggttagacagttcaggaaatacaaaagagagagagagaaaaaaagaaaaagaaattaaaagcataagggtagacttatgatcattaggttctcaggtaaccagttttacagtcactggatttccagtaaaaagacagcgctacttaactttcctcacctataggaaatgtacattactggcctctataaacccacatacatcaatataaggagagatatgtcatttcctctaagaaaagctgtttccaatcttctttaaagattgtattccctttattatctgctgtacagattgagcattctttacattttctcctcatcaaaaagtacattcaaaataaatacctactacttgatttttataagttttataataaagagcttgaaatagttacacttcaatatagcagatatatgatatgggatttaaatctaacaggtcaaaactgtttaagttcaatggacattttgggaaccacttgcaatgaaattactgagggtagcggggataatcggaggcagagcagaggctttacatgtggctcacagaatcgatctttttatgtctctgtagttacactgtatacatcatcctggatcacagcagagccaaagtgacaacatcccacagaaaggaaaggcaaaatccctccatatctgtgtacatttctgtttggaaagcctagaaacaaaatcttggaaccatataactcattctcactgcagtgttctcagaaatctgcccctcccaactacttgtcagcccacatagttaatacccagggagaaataatcagctcaaacaagatgattctggccatatgttacttttcaaagatgccaaaactatcaataatctctcattgaagtctctaaaccaaacgaagaacaagaaaaaaaaatcttctgaaaaatatcaagttaattcttctgataaaaatttgcaatagttaagggatacaaaaagtctttacctttgctttctgagatagtaggatctcccaaaggctagaccataaagcagaacagattcccttaagaaccttttaaagtcttactgcttgaaaaattgtcatggccttcaataatgctgagagaaaaatttatcttgctgctagtttaagggactacatttcaaactcttcttaaagaaaaataaaaagagaaagaggacagacttctaggactgctttgaaaagcttgagcaattacttcaaaggaaagggtgtctttgtccagagagcacgtttatgactactgatgcaaatcctaaccaaaggctgaaaaggatacccagtgcatctttatggatggccttaaaggaagatgaacaagtcaaatgagattaaagacagcccaaattctgctgcaaataccagggcacatcaggttttacagaggcacttctctcagtacgtaatactagatatcaataccaacttacagagacaactataacaacctaacttgcatttaagcaacacaagatctctatactaaccacttagcatttatattggacttatgttttatttatttattttttattatactttaagttttagggtacatgtgcacattgtgcaggttagttacatatgtatacatgtgccatgctggtgcgctgcacccactaactcgtcatctagcattaggtatatctcccaatgctatccctcccccctccccccaccccaccacagtccccagagtgtgatattccccttcctgtgtccatgtgatctcattgttcaattaaacaccaaaagcagtggcaacaaaagacaaaattgacaaatgggatctaattaaactaaagagcttctgcacagcaaaagaaactaccatcagagtgaacaggcaacctacaaaatgggagaaaattttcgcaacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaaaacacatgaaaaaatgctcatcatcactggccatcagagaaatgcaaatcaaaaccacaatgagatatcatctcacaccagttagaatggcaatcattaaaaagtcaggaaacaacaggtgctggagaggatgtggagaaataggaacacttttacactgttggtgggactgtaaactagttcaaccattgtggaagtcagtgtggggattcctcagggatctagaactagaaataccatttgacccagccatcccattactgggtatatacccaaaggactataaatcatgctgctataaagacacatgcacacgtatgtttattgcggcattattcacaatagcaaagacttggaaccaacccaaatgtccaacaacgatagactggattaagaaaatgtggcaaatatacaccatggaatactatgcagccataaaaaatgatgagttcatgtcctttgtagggacatggataaaattggaagtcatcattctcagtaaactatcgcaagaacaaaaaaccaaacaccgcatattctcactcataggtgggaattgaacaatggacttatgttttaaaacattaggtgaaatattttaacaccacttggcagaatagcaaacgttttcattagttgtgtttctttggtgccctcgcaacattaagtatatttatcaaacagactccgaaccacttaaaattacacctgaaagaagagaaaagaggaatttctctagtatcttgctcataaatatccagtgagaagaatatttcataaggcctatatccatttaggaaaacaggtgacaatccaggtacaaatagatctgacatgtattttctggcaaacttgtagttactttataaaaagtgaatgaagttcttggtgttttggcgtcatctccttactcttatgaaaatcagatcactttgaaatgcagtataacgttttcacttgtaggttaaatatgttgttattagcagagtgaatcctcttcattccattttctcaataccatctattaggaaatgaagcgggattaaacattttcctattcctagttttgtacaactaaaattatttcttccaattgatacttagtttagatgactcctggctgggccagaaaatcacatatcccacttgttcacccattcattccttcactccttcattcacttaataatatttattgagtttgtattcttaagatatgtgaggtactatggaaataaggaaaggagtaaaacacagccttttatttaaaaataacttgattttaaaggatcattggatctggttttgtcaactgtactataaacctgcaaattataattataaatatctatgcttgtaaaggtcaacataatagtactgaagtccataccacttgtaacaactaattttgtatgcaaaatcaatatttaacaataattaacatgcttaaagaccaccaatataattttcttcattagtaaaaatgtatcatctgaacttttatagaggaaaatcaaaatataaaacctggctttataaaaaaagtaataatttcaatagaaaacaaattaagaaataaaatatatttgtttaaaaagcccaaatacataatgaacttattaggcatatagattatagataaaaaacaaaaatatattatacaatatatgccagtcatttcctaaagacggatacctctattttacatgtgccttttgtaccatttagttacaattgattactacaaaacattcatgtgaaaactgaatactaagctttctcatgcggctcaccataatggtaaatcaagaaaggaaatggctttgctaaagcggaaatgagcttagatattaaatgtttcttaaaccttttccattaacttcctagttttacaatggaaattatactgcattttaattatgcttagaaaaactacttgaaatttgtcctatacatttcatcttcaccaaatcttttcccttcccctattcatcatggtctctttggtgaaaaatcacaatttgattagacatatagactatagatgataagccatagctgcatttagagtacaacaaccatcagacaggaaattttagtagcaacttcttgtaaataatattagaagtattaatgcaagacaagataatgttggtacaaagaacaactgtaagtccttggtatataacatttctcctcttctctctatgatacatataaatgttggtaacacgggaatcaccctctaagactaaggttgacccttgaacaacataggtttgaactgtatgggtctactcatttgtggattttcttctgcctctgccattgagacagcaagaccagccctctgcttcctcagtctactcggtgtgaagacaacgaggatgaagatctttatgatgatctacttccacttaatgcatagtaaatatattttctccttacgattttcttaataacattttcttttctctagcttactttattataagaacacagtatatgatacatataacatacaaaatatgtgttaaccaactttatgttatcagtaaggcttccaagtcaacagtaagctatcagtagttaagtttctggggagtcaaaagttatatgcatgtttctgacggtgtggggggttggcaccccgactcctgtgttgttcaaaagtcaactgtacattagaaaatgggtttatatgagtgtgtacctgcaagtgtatacttaaaagtataccccttaaatgtatatttgaaaaatacaaaatcttaccatgacatgtactgtcataagaactcagtataatacagttgtctttttgtgtctctcgcaaatactaagaatgctttagtgataggattgcatcaacttctctatagctgatattctaattaaatgtatagtttagataactctgacctagactgcctgagtttaaatctaggctccagcacttgctagctatgtgagctcccttgggcaagtttccataattctagtaaggagatcctaaaagtgtcaaggcccagggcagaaagtaaaggcatatttataatttctccatgcctcatctataagtcaaggatactaacagtagataccacacagggctactgtgaagattaatgagttaatatgtaaagcactcaggatggtgcctggcatgtagtgagcacccattagtatcatataagtagtagtagcagcaggccaggcgcagtggctcacgcctgtaatcccagcactttgggaggccaaggtgggcggatcacaaggtcaggagattgagaccatcatggccaacatggtgaaaccctgtctctactaaaaatacaaaaaaattatctgggcgcgctggcgcccacatgtagtcccagctactcgggagctaagtcaggagaattgcttgaacctgggaggtggaggttgcagtgagccaagatcccaccactgcactccagcctggtgacagagagatactctgtctcttaaaaaaaaaaaatagtagtagtagtagcaacagaatgatcccttttttcactctgttataaacactcctttcattgaaagtatatttcatcctatgctgcataaaagctaattagagatggttctctccttgataattcatataaattctgatacaactactaatatttggcagcctagaggctaacagtggggagtgaaggtacagtacagtaatttggtgcattccccaaattaaaatagctttttttttttttttttttttttttaagacagggtctcactctgttgcccaggctggagtgcaatggtgcaaccacagatcactgcagccttgacctccctgggctaaggtggtcctcccacttcagcctcctgagtagctgggactacaggcaccacacccagctaattttttttacttcttgtagagacagcgtctccctatgttgcccatgctggttttgaactcctgggctcaaacaatacccttgtcttggcctcccaaaatgctaggattataggcatgagccactgtgcccggcctaaagtatctttattgtctctgattatcaaggtagtacatgctcattataaaacattcagatacttcagtaaagtatgatgaagaaaatgaaaaattgcttccaaatcccactacctataaataaatgttgctaatatatgtcttgtgatcatttcatactttttctatgcataaatgtacatagaatacaagtgtatacacatataggcataggtacttacatatgtagcttcgtgatcttttacacttagcaatacaaagagtgtatccctccatgtcaatattacaaatttatagtatctttgttaatgcctgtacaggacttcattacatggacatatcattactatacttaactaatgtgcttcttttttcctacttgcttgagacttcatttgttgttttcccatggaggggcttggtctttggttctaggtaagctatggctcctgtagctgcatatgagtgtctggtaacataaacatggtaaaattctaccccccaaaaagaaaacaggtagaaaatttgctgaagtgaaatcttattcagatttgttgcaatgcaacattgtctgatttttatgaatataaattaaaactgaaaattggttttatctatttatcctaaatacccaaattatttaaaattctttataatacatcctccttaacatttttaatgttcttttgttaaaaatacgtaagtaagggactctgaaaactatagaggagtttcatatctttagctattaaacactcctgaccccactcacccaaaggaaataaggcagtctctcagttgtgcaaagttacaagctacaagaatgaaagcttaaaaagctcaacagtcatgcagccttaagccacaaaaggcagaaacaattcagagaatttttttcctatataaaaacacttcaaatccaaaatctgaagtcttatcaaacacattcattttctcacttgaatgtgaaaaaaattactgttaaaaaattaccagataaatgaaatgtaatgatatacttagataatggccctgttaaaagaccaagaaaatcaatttttaaaaatttgttaacacttataaacttctgctctgtaaagcgatataaatgagcatagcacataaaaattgaggtaactagaaaaaatagggtttaactgttgcttcgtaaaaaaaaaatcagagatttaaatattgaatttcatataaaaatggttatcttttcataaattatcagtaatatctagagtaaaatgtgagttacataggcacaaagctgtcgtagaatttctcttacgaaatgagcgtttttggaaggtagtaaagtcagtctactatgttgttccaggaagctttaattaagtgtatccttggtagttctaccaataatgttatggaccacccccccgcgcccacccccaccgccggcacagagttctgcaatattttaaaagcagaagaatcctacgtttagttgactagaaggaatttttactttcttagactaatgccaactattgtttgaaattaaatttcccatatgagcataaagtgtcaagacaactttctttggcatggcactattaaaaaggtctacatatgaagatactcaatctgagggtataaatcatcaattcttctgttctcatatttatatggctataacctatgggctgaatggtacagtcatttttctctgcaaccaaacaaggtaaataaatgtgatatattggcatatcaccccaccactctgcatatggtgcacattaaggttgtattcatttgccatatgaatataattcctttttaccacatctactattagttacaagcagtaaatacagagttgttttgctggaacttgagggcctgcattgcatcatggagcactaaacatcctggaccttctggagaatttcatagacatacttttaatgtcacctgaacttgaacactgccaacataccatttgaaaacgcttcttgataaatgcttcaaggaaaaaataaaaatacagggtagctgtagtgtgacagtacattccaaatgcaggcccagaagggaaggtcttgatgagacacacacaagaactcttgttcctgacaaaggatcagatcaagagtcatatccaggtataaaatggtttcttgtttcaagcattactttcttattcagaatctagtgaacataaggaacctaaacataaaataccatccaaataacttcctcaacggtaacttattgaagagctgtgatcaagaagctaacaagtttatttcatcaccaactgtggtgctttgtttcattaggcaaatattgtgcttgctttttccttacacaaaatatttatcgtacagttgcaaatccaggttagggtagggtaaaaggaggagtaaagtgatttctttttaagaactcatatggttcaacacaaatgtacataccttgacatttgtgacccttaaataatatatcacaggcaattaaaaacaaagtacacctgtcttaaccaagtaccaattttcatgtttcccaacattaagtccccaaatgcatccagcagatggtgctctaggacacctacttacagagagtaatattgtttatattacatccacctaaattttggcaagacaaagaataagaatttatcagtagcttcagtaaaacatactaggcttcacaataaaaaggacataattcctaaatatgtgtacaaaaatatgcatacacataagcacatgtgcacagaggcagccagtaaataattcacacctggacatgttatgatactacttttcttacagacttgatgagtagtctatgtgtatcagtagtatttatagtcacatggcaagatcattctaaattcattaaaaaaaatttagaatgccttaaagttagaattcatttttaattatagcaggaatgtctcattagggtgatactagtaaaattaacaacagtaggatttacggtaatgacttaagtgattgatgagcgtataacaaaatgaagttttagacagagaaaaagcagggcagctatggcatacagtactttaaaaaacagctctgtggtctgttagtgctagccttatggttaataaaaccttctttctaattaacggtgctgaaatattcttaaagaacagaatcttgttgttatgaagaaaagttaggtttttttctcagtagacgccaatcccataaaggagaaagctgacatagattagcatgtctgattgcaatgaggaaaagaaaaaaaatgccacctttcaatcaaatcaaaaccagaatgcgagaatggaaaatgtattactgaaatactacacacacaaatctgtgcaacaccctcacagttagcaaccatttgcttctgaagctgatcgaatgtggctttaaaagatattattcagatatctaaaaatacctaataaacatttaattttttaaatccatgtttatgaatataaaagtgaataaataataactgttttgtatatattcatcttgcttatctaaataagatcatgtcaaagtttaaagtatttatttatcaatggaatgcactggggaacattttctccaaaatttaaaaatgtacagtctggagagcattattctgaaggtgaaataactatctcaggaaaagcactttggtgacaaggctcagtcctaaaacacagagtactaggacaaggagagagagatgccatgctttcatgtacaaaacatctctcagtgaaatattcttggttaatttcattttttaaatccctaattaaatggaatcctatattcatttttcttctcattgaaaaaactgcattccacaggagataattattacaaaacaatagagtcaaagatgaaaaactatctggtatacaggaaaataagccttttgctatgtagtctaggcaggcttcataaaacatttacactttttaaagccccaaattacagtatttataggttttacacttgatcttagccaaaaggctgagaagcgatgtatttataggttttatccagtttgaattagcctgagattgccaaagcagtatgtatattaatattagataatatgatatttttaaaactttgtcatacagctatcaactttacatataacatcaatattagatatggaaaaaacagtgtatgtaggcttatgaccctagaaagtaaaatgactacctattcccatgattttttaaataaaaaaaccctgagatagacctataaaatgcagaaaaagcaataacctggttttcttttatctattttcccttcaagaaagaaaaagtctacaataaaaaatttaaagttgaggtattaatgtgcatttatagaacatattgcaattatatgtatatacacgcttcaccacttcttaaaggtcatttacattgtatctaagaggtacaatataggaatacacataacctaaaacccttcatctgaaaagctctgacttcagcagctgcattgtggaaccatcaatgagccagaggcttataaaatccgaaccagcttgcatgaatgtttgaaacagtttacacacggtaacaatgtctttgtttttgtttgtcattttcttttgaaaagcgtagattgcattttccatttttctattctaatatgtgtaaattctcattataagaaaaagtgcctatttgtctttctcctggattcatctttcaaagctgaagcaaaattaaatcggggcatcagacattatacaggggcttgaaaggataaggttcactttgagaaaggtaatttaattcagtcaagatacattacaattttctaaaatttttattagatgtgctgttatattattcttttattgtttttcttttcattgctagcattactaggaggtaatgtccaccatactgcagacaatgagagggtatagatgaagtacgctatgaaaaatataacattataatatttactctaatgccaacaagatggtgttttgtggtgatttatttgctctaatcatcctgtgcttctgataacaccttaactcagttctgttgttgctttcattttacagacaagacagaaggaccacagcaaagcttggaacttagattttttttttactacaaaccccaggatttgttcagtcctacttaattcgttttttaaaggccatgcatgtaaaaacaatctctaggttgagttacaaagtatttaaacatatgaaaatatatttaaatgtatacatatatcatgatatatatcatactttcttcctttgcgaagagctgaaaattcctaactttaaggcatacttaactttctgaaatgcaatagtaattacatacaagtgtagctaataggtctttagctgctttttagaatacacattggtaatgacggtgtataacatagagaacatgattaagtaaaataaaacaagaaaccaagaacccaaatatctatgtgtgttcagatttctttatgtgcatgaaataccttacatttttaaggcaagaaaaagttcttaaatattttgagataaatagcaaaatggtagatttattatcaattttaaatataggtttgcctgagataattgagtgaatctcggtaactggatttacagaaaccagaaaaaagaaattgaaaggagtcacttattctaagaggacagacaggaagaaggaccagaatattgtgttcatgatgaaaagaacatggtacttttcaaaagaatatgaaaaacaaaatccctgaaatttgcatctttgtaatttctattgtaattacagagatgtctgtataaatgtgaaatacatgtacacctactccccgacatatacacacactacaatttgatcacaaagtctgtattatcaatagcatcacaggcttaacattatttttcatatcctatttgcataggaaattatcccttttttgattaaaacaggaaatatctattagacgttcattgaataaaaactgtatttacctatcacatcaaagtctataatgtacataataagaaacagctttgaaaaatacttcacacacacttcttttaacattatactagcatttgactaaatgttttgaaaaaaaggttcattttcatacaaatattatacatttaagaacagctttgagaagtcaatccaagatatgatggacttaaacatatttagaccatttcacaatctggggtggagtgacagagcaaggaccgggtattcaggtaaagtcatcaggaagaatgtgatccttccttaaccaaatacattgcaacttgccttaaattaagaaactgtaaatatttaagagcagttaaaatgctctaccttctgaagtaaaaatctaaagctattcttgcaggaattctacagtgttgtcataatcattttaattaaattctcatttttcaggtggtccctttaattgttttttcctacttcttaatgtgtttttctaaagccatttcttttctgcagctgtgtgcgattggttttaatggtagctgcttccttttttgccttctgtgaattacaattttaaatggttacacattttttgttttactgccttcagcatagtttcataaagatgtttaaggctgttggtgaacattttcatttcccatctgaaaaaccaagagccaatttgagtattccacattggccttttatgacctgttttatctttttaatacataaatgaaagcataattttatcaagactagtttgtttctatgaaattattatttttattttgttcttttaaaatatgaattcaataaacaaggtaatatgtgattgctcttttatgctgtatcttcatgaataaaaactactttatttggtgacagctatttccaatgaagaactagaatttttggatcataagaatagcctataatatgaaacataagatttcatgcttagattttaattatcaatggtcacaaaattgataatgaggctatttggatcattcttaaattataataaataaaaaatacttgataatcctgtctcacttttaccataacaaaaaggtaactttactgcaaaatgttattctctacatccttgtaaaagtttacttaaaaaatgagtcatacttactgcctgggttatctccaatcccactgcattttccattccaataccacagcaaaagagttgcatcacgtgaccctgagagaatgtagcaatttcccccaatatatgactcagaacgagcaaggcaagtgacgacatcccaatggccaaacaccacttggatcaatcttcctgtaatgcaaaacaattttctttaaaaatgctattaaaaaaataaaaattctagtgaacagataacttgtaaaacaacgaagctatatgaactctgatggtcataattcagattttataataatttgacatggtccaacctaacagttttctttgcatgctaacaagaacaacaaaaaaacaattgaaaattgttaacatttttgaaaggcatgtgttaaaactatttcaacaaataatacttgaggaccatggcactgtatcattacaaatggcttctataaattacaaatgaatcatgtttactgattaaagcaggcccaggagaacccttttggaaccattttaacactttcttgagttactctatatgattcaaaattaaacttagttgcttttctgtaaaagtactcataatttagatgtcactaataaaaacctatttctgatttactgaagatttaatgtatttcttgttttaagtgatctatacaaagacaatataagacactttggagagcttctaccttttcaaatcaggattatatggaaattatgatgaaagaactaatatattgtgattgcaatttgagccaggtgattctttgtcttaattttctgatgaaaattccttgagggtgaaatcaagatggtaatgactggggacaaaggagaggaacccagtaaacttactatatatctagggcttcaaacacagaacagttgttcatgtaaaggtgtcagaaaaaaagtaaagccctcacccttttttgttatttttatttatttatttttttgaggcggagtctcgttctgtcgcccaggctggagtgtagtggcgcgatcttggctcactgcaagctctgcttcccaggttcacgccattctcctgctcagcctcccaggtagctgggactacaggcacccaccaccaccacgcccggctaattttttgtatttttagtagagacggggtttcactgtgttagccaggatggtctcgatctcctgaccttgtaatccacccgcctgggcctcccaaagtgctgggattacaggcgtgagccaccgtgcccagcagccctcaccctttaagaatctttgtttaaccagatatggtggtagtaattcacacaaacttgtctaaacaattaaatagctgtgacagacccccattccatctttagaatttctagcttacatatttcctttgaaatgtctacagagtctacagatgaatgccatacaatgtctacccttaatattcagcatggctttctttttctttaaataagtttttatatttcgattataaaatataattccgatgttcaagaaaaaaaggctactaagctgaaaattaaattaatatgcctaaataggttatgtgtttaacccgtaatacattgtaaacttcttaaaaggttaaggtcccaagtactggcatatcaagtgtatttaacttttcaagataataaatataagataatatttacattaaatttttaaaattcttgattttaataaatctaaggcttattatgaaggctgaaaatttagaaataaaattctgaaatattatctaaatcagatggaaaagtcaaatacatgttttcattcatgagtggcagtcttgcatatagcctacttctaataaatttaaaatcagattcacttcaatctcaagttgcaaaactaatatagtactttttttctcctgtgattaagggagagcagacttcaaagcaagtgtctctagctgctaaatgttcaagatgttcacttttgaatttcttcagccttttaagttgacaccaaaacatttcattaaaaaataagcttatatcaataaagaataaaaaagaatccaagaccttcaagaactaaaaaaaattgagcaaattaaatgtgaaatatataataatttttacttcatttccaatttacatgacaaacagaatgtggaggttcagtggtaaactggcggggatcagattacacgcaggccttacataggataagacaaaagttaggtagctgaaagcagtcttattaataactagaaaatcaaaggttaaatccatgtattttaactactgaaagaaatacatcatatatacatcatacatcatgaatacatcatatagtgatgtgatcatagagtatatatatgacttctgctttagcctatgcctaaatgctgagagcacataaaatataggtgtgatttaaatagattatgtatgggcaggcttatttcagatttgaaacccaacaatcagtgggttgtaggagtgaggaggagtgaaataactaaccaggtacttgaggtagacgacatagaggaaacccaggtgttcttagtgcagtaggaggcttgcaaagaacagctattcacttggtaacttaatttccaactcatgtgaggacaaagggaaaaaatgtagctgtaaaggtgggatggattaaatataggggcagagttttacaagagtcacatggtaattctcatgagttgaagtcactgctctgtttctccaatgtcagtgtaaggaaacatacattcagtcatggtggttccttttcaaaatttttagtgttttgattgttttccaaaaagttatcacaattagttttcattcaacaaatacttagcacctattaagtgccaagcattaggccttcttacctgtatacagtggtgaacaaatagacatggtccctgccctcatagcctttacagtcttgtggggcagacagtcattaaacaaacccagactggtatataattatgaatagggatgagtattataaaagaacaaggttggattaatgacaataacaagatagaacaaatttacactgggtgtcagggaagatctaaatgagagagtgacatttaagcagttacatctaaagggttttatatgttaacacaaattaactttattctttacaatttatactttgggctcaactctggaaaacattatttttttaagtttactttttcctgttctggcagccttcctcagcaatatttgttattgctataaggttgaggttcactcctcctaaataaatcacagcatataaatacctgctgctctttttggtaaattattttctgataatcttataagtgttcctcaacctttattttttgtttcctttaataccagtccacctctccacacactaatatcaaatattaccacaagcactagaatatcccttttttgacagaacaaattttctagttaatgttttatttgacagctgtgctacaaataaaaaaattcaagctcaggactctgcaccactgaatctaaaatgtggcctgaaaataattccgactgccaggggaaggttttattgttgcctctgctgttctggttgtggcccgaaaacatgatttatgtttaaagaatttcctgttacaatccatgtttctcctccctcctccccaatctaataagagaaggatttttttttttggcttgtgtgctaaaatataattgaatttaacacttgtgttagctttgccattatatattactgatcatatgattttcccttgattctgtgctaaacttaagaaaaaatatttaatattcctattgttgtaaaatcacagacacatatttaccttaactgaaattattttaaataaaactagcatcagagtttttatacaagatattaagaaagacaccaggactatcgtttgagattttttttatacaacttttctggtaagtataaatatttttatttcacaagctaagtcagtcccactgaaatgaagtttaaggctattccttatttgtacgttttatacacacaaacacacacatttttaaagacattagaaggtattttgaaagagggaaaagaatgacatcaggtttattaagtctaatgtaacatggcaaacatactaggaacttagtgttacaaattacagcattttcccaaaaaaatcagtgactgactggtaacacctagatgagacaacatgctatgatcacaaagtgtgctacatttaaaatttaaaaagctaggtccaaggcctacttctgtcactattagctacatacatttcaacgaattacataatctctctaaacctcagttttattatctgaaaaatggggataagacacctgtctacttcacaggattattgtgagactgaaacaatatctagtatgtgagagaattttataaattctataaaattgtgtgaatataggattttaattattagtgttatatgaaagtgaagttagctttactttacaaatgttaatactgagtgtctttaaaaaacaataatatagaatgtcaacaaactaaaaacactcaaatgtcaaaaccaaagattgacatggtttgtgattccatttatatgacattctgaaaaaggcacaactaaagatgaggaacagattagttgttgccaggaggttgagggtggggtaaaaagttgacttctagtaggtggcacagggtatttgggggcgctctgcaccttgattgtggtggtggtgaattactctatggtttgcactgtaaaccaaaaagagtggtttacagttctattagttctatattacagtgtaaaattcattttcatgtttaaaaatgttttaatcacttaaaaaatatatggaaaaacaatatgaagtccaaaagaatatttgagaaaaactccaggagtttaagaccaccctggacaacagagtgagaaccctgtctctataaaaatttaaaaaaaaaaaaagcaaaaaaaacaagaaatagctgggtgtagtggcatgtgcctgtggtcccagctacttggcaggccgacgcaggaggagatcacctgaggccaggagtttgaggttgcagtgaactgtaactgtgccactgtactccaactgtctcttatactgtctccaactgtcttctttaaaataggcagaaaaaaaagacatgtccaagactcaaagaggagtgtttaggttcaatagtaatccaccccatagacttaaacatctagtaaaagcccaaataatcaaaaaggcttgaatggtgatgttttctttcctacacctacagaataaagatgcaaactataagaaaaccatgtcatcaattccatataacaaacaataaagattaaaaagatgttcaagaacaaactccttgaataaccaaaaattaattgttctataaactatattaaggcaggagtatggactcaaacattttataaagattattaataagactgaaagatgatttaccataaagcattcaaataactagaaattttaatttaaaagatttttcaattcctacaacattaaataaagatatatgtaggcctttgttccagctgaaatatctactgtcataatatacagtcatgagctttataacacaactttttggtcaacgatggaccacatatatgatggtggtcccatgatattataatgaagctgaaaaattcctgtcacctattgacatcatagctgtggtaacgttgtagtgcaatgcatcactcacgtttgtggtggtgctggtttaaatggacttactacactgccagatgtataaagatacagcacatacaattatgtatagtgcataatacttgataataaataactctgttactggtttatgtacttattatcccatactttttattgttaaagtgtagtctttctacctataaaaagaaaaagttgattctaaaataggcacaggcaaacccttcaggaggtattccaaaaggcagtgttatcacaggagatgaaagctccatgcgtgttcttgcccctgaagaccttccagtgggacaagaatgtggaggtggaagacagtgatattgatgatcctgaccctatggaggcttagcctaacttatatgtttttgtcttcgttttctaaaaattttttaaaatagaaaaaaacctatacaataaggatatatagaaaatatttttgtacagttgtacaatgtgtttgtgttttaagctatgtgttattacaagaattgaaaagcttaaaatcattaaaaagtttataaagtaaaaaagcttcagtaagccaattattagtaaagaaaaaattttaaaaacaaatttagtgtagtctaagtgtacagagttttataaagtctacagtagtgtacagtcatatcctaggccttcacattcactcactgctcactcactgactcacccagcgcaacttccagtcctgcaagcttcattcatgggaagtgccctatacaggtatgccagtttttatcttttattattattattttttacttgcagaagacaatggaatggtttttatctcttataccatacttttactgtaacttttctatttttagatgtgtttagacacacagatacttaccgttgtgttataattgcctacagtatcccatatactagtatgctgtacagatttgtagcctaggagcaataggtgaccccatatagcctaggtgtatactggaatatcccatctagtttgtgtaagtatactctataatgctgcacaacgataaaatcccctaacaatgcatttatcagaatgtatgcctgttgttaagcaacacacgactgtagatcaattagctctaaagaattaagagctcattttaattattttaaatatcaaactatatatttactataactttatttcatcctgtaacaatttctaaaatattttaagggacaccattaaatttctcaacgtttctcaatttcttacatgcaaaaatttgtaaacatttactcagccggatctcctacagtaatactgagctcagcttggtttgtcccttagggagatgcatgtaaatgaatatatagactgaaaatttttatattttaacaagagctcctgtcacacataaaagcaatagtcagctacttttcttcatgatggtgtagatttcagcaagattctaggcagaattgggtggaggcaagatatctactgccaagagttagacttaatgagtctttcaagtaggaaaaagaaaatcctttaaataatacaaaagtgagaaaatacacttctgtgtgtgtgcacttgccgtaagattatgcatatactcatgcatggtatttacataccaggatttgccttcaaaatgaatcatttattctgtaagcatgagcttgggtcacaaacctataaaaaactgtctcttacaaacatgctgtagcaaatttaatagtggactatatatagtagattattatttgaagagggaaaacaatgccctcttctccctattttgtaaattttaggattttgtaatttttggaaggaagcagataagaatgcatcctaagcctctcaatactacttatagtaaactttagttcactgataaagaaaatgaaaattacctgtgtctgtagaatagactctgaaacttttatcccagaagccacagacgagaatatagcggttgtctgaagtgatgacaaagcactgggaatgcacttgaatactttggtctaaaaggtcagtgatttgcctcctgtgcattcctgtattgctggctgtaagaatagggaggaaaaacaactattaaatccacatgggcaaagaaattctatagtgagggagaagaggagacacattcccagataagagtacttgatccttaattctaagtataataattgaaaaaccgagtaggaaaacatatccaattgctggaaaaatgtgggtagctaaattcaatatctcagttaaaaattttgcttagaggaaagaaagaataacacactactatttaaaaatagaacacaattcacagaacatgctttctagctcttgggcagaaccaaactagattacaatctccagattgcatcacagttaggtttgtgtttctgacaatctcattacatttattgtcatgagaatggttcatgttgtgacaatctattacctttaacattttgtcacaaggaagagatattaggatttaaatgtcatatatttgaaatattgtagcatcttgtactactttggctttaacgggtctttaatttgactagatgggaactcccatttcccctgtttacaactgcacttgcatgtaaggaaagggtagaatgactgtttattaaagattcctgtaattgaaaaagtcaaagcacagcagactgccactttcttactccttatttaagcaataaaacaagacagccttggcagtgtgtttcaaagtgctacggtgcacctgagacggggtttgtcaccaagaaaaaggtcagacatagagcaacaccgagcacatgggaagagtaataatcgtccagaaatacaccatcgactgtgccattatcagaaacggaatcttcactgagatgacttttttggcattgaggccaaccaaatagaaagctttgtttctagtgatctaagggttatttcaccatcatctctccagtacaagtaaggattctgatgctgctaaagaaatttgattgtaccagaaatcagaacaaacaaacttctgcatccgattattaagcttttcaccataattttcaattttttgaaaaatcaaacatagaaaaatatttatatgctattcattgtatgtaataactatattaatgtgggtagtttaatagaaagctcaggaagtaaaacagaagaaaaaaaagtattcaaaatactctccagtgctgtgctgggagccactggggacacagaggactgatggatctgttgccctcatggcacacacaacacggcacacacgtacacatacatgtgcaacactgcagaaattctgctaatgtctgtggacacaaccatttaagattattggataactgtttgataatggaggcttcatatgcttttggaggattaatgggctagaaagtgacagcagtagtgaaaagggcagaatcctagttgggaatcattttttccctctccttctaacaaagggaagttgctggcagataataaaagcttttgtggatatcatagtgttactacagagagacagtgtccaccaacagcaatcaagtatcccattgcaatgaagttgtatgatacaatttttttttaaattccaagaaatctagcaattaaaacaaggtatgtggtactttctgcactggttactgcagtactttgttccacatgagagctgtaaacatgtttattcttgtcagtgtttatgtgacttttgctcctatgatataaactttcgctgaactttcttgggggattgggatgatctcttgggaggacctcagcagatttgggcatgtacataattttgaattgagtgaccacaaagtacccattggcaaaggcttgatgccccctcagcacacacatgaactattttctaagcaagtgcttacttgtaatttaacattgccaagtcccccatccagctaaggtatatttatctagataagcagtcttcaaactagggtatgcatacccctggaggtgtaagacttcctaagagatacacaggttcagaagttaataccagtaattttctaattcctcaactttaatatattctactgcttgaaattgatttgcctgagaactctcctgtgagttttcctttcttacctcttctttctcacgcccttcttctactagataaaataaagacatatttcccttccacacagaatcttactatgtgctttagctgagtgtaatttcttgcccccaataaagggacaattcaaaatactgaggtaatactgaaaagtgaatgtataagtatcaaatcattctgcaagtcaggtggtttccaatttactgctttcaataaaatggaataaggatccaatcatgctgtcaattggtagataattaaaaataagttttaatgatagactgttaaaattatagattacttaataataaaccataaaaataactcttaataatagatcactatatgaattgccactaatgcagagagttcaaagatttgagtggtacagttgaaacaaagctctttcccatctattttcctaagtgagtaacactgctcagaggttccatctataaaaacaagtaagatagacctgctgatgatgtatttttaataaatgttcattttatgtaaataaacatttattaaactttataatataattaaataaatacattaatatttgtaataatcactcaatacagataaacttattttaaaggctgagccttatggtcataggaaattttaaaatttaaattgaacacatatgcttaattttgcaaacacatttttatggctgaaaagcataatagggtaatcaattttttaaagttaacataaaattatctgggggaagtagaatgaaaatataaattcaagataaaaaagtaataatgtgaaatttccatatgttaaggggttttcaatgtattttttagaaacagaaaatattgaatatcaattcactctgatatttagattctactggatatattaaaattttgtttactgagtatcaattcactctgatacttagattctattggatatattaaacaatttttacactatgccagaatgtataacctttgcaactatttgaacttgtgatgaaaacttttagatgtcaacttaaaaattgtctgagaggatacatggttttaaataattcttttaggaggtagaagtgtaaagtctgttgaccagtgatctagggcagggacagcaaaactagggccaaaggctgaatcctgcccatgcctgattttgtatatgtagttttattagaaaagagttatgttcattcatttcttttttatttatggtggcttttgtgctatactggtagagttaagaacagcttgagtttcccttatctgaaacacttgggaccagaagtgttttagatttcagatttttttttcagattttggaatattttcatagattgagatatcttggggatgatagccaagtctaaacacaaaattaatttgtttcatatagaatatatataatgtatatatatatatatatatatagcctgaaggtaattttatataatattttaaataattttgtgcctgacataaagtttggactgtgtttgaatgtgacctgtcacatgaggtcaggtgtggaattttccacttgtcttgtcacgttggtctttaaaaagtttcagagtttggagtatttggggcttgggatttgcagattagaggtgctcaacctaaaatatttactatctggccctttaccaaaaaagtttacccatgcttaccctaaagggttacaacaattgatgaattcatttaattagacttgatagcataggatattcattgtcaaggtgcaaagaaaatgatgggtctaaaattcagaaataatgctttaaatgactcagcaaatgggctttattattttcctgacttttaaactacccaagtgagcattttagtttttttaatatatggcaaatcatatctactcaaaacaaaacaagatttaagaaccagagtggtatttatccttcatgtagataattacgtattagatttctgattatacttggggaaatgataaatgaattggtttagagcttaaggttatttctgttcatcctgatagtctacctgctaatggtagccatttagctctccattgaaacaatgccttttaaagacaaaaatggtaactatataaagggaacatcttggattttaaaataataaatctgcttcattcatatgctttctttaaaaacattaaaattctaacaaatttatttgtgccaggaaaatctgacaaaattacaagccaaatatctatgccgatagcattacaccacaggtaggcaagtaagtttttattctaaaagttattaaataacatcttcaaaatcgaggcttaacattcttagtgatgccacatttgaaatccccacacgtaaggatgaaaaatgctaaactagagatttcgactaatctactcaaaaagcctaacagcaattaaatattctaagtcatctgctgcagatgctcatttcatcccaatggctctttctggtcgcctccctatttttttctcccctgaacaaatttaacctccaatggcaatttattgggctgtaggaccctaggaaaatgaatacaaatatcttaacactaccattggctgggcaatatatttcaactttgaaactgctctgcaattgcacattaatcccctcagactgaacagaaggtctaggaagaaaggattgatctcctttaatgatgaaaccctggcactacagttttatttttcataacgcagtgctgctaagaaccccactgttattatgaaaattttcctagcaaaggagctccatcacattaccggtgcaccaattcatcataacgtgccttgctcctgctcatcaacaagtctgagtgatgaaaagatccaatattatcctgacagtacttcatgcgcattctcaatcacacattattacagcatccatattaattttcagtgacacgcgtcctaggcctgttcaaattaggcaaaccaacgagggggagttgatgaaataccagcatagccacagctcattgcattccaatttgcatgcaaatggtttatcaggaaaattccattcccagcaaccagcaagtgaaaaacaactgtaatctacacttcagggccaccatacagagcttaatgaatcgcaaagagagaaggaagtgacagacctatgagaggatcgatttccactggcagctggtatggctggtcttgtacagcaccttgatgagctggaattcacaaaagataaagaaaaaaggcattattttttatatactaaactacataaaaatgcataagtcaaaccttatgtagaattgtttccaatctctaaatctttcatgcagttttgtgaaatttaaagaacaaaaatccaggtgcttttatggctagcttattaaacatttattttagattagtgccgctctgaactgtgccatcagcagtggctccagtcctaggccataagctatagcagatgcttgactggcaacctctgatgctgcaacaaaacaaaattaagtggtaaagcgcactgaaaacaaaatgtgacaaccatctgctgactgtagcaaatactatttttttgttacttcttaaaaaggcagttttgaatgctacagcacaaaggatctacaaaaatgtcaacttatgatggagaaagggaaagctctaagtcagggaacatttagtgtttcatccatcacttaaaatcaatcaattgaaagtttgaataaaaataaagaaagctatccgcagataaatgttttagttaaatgcatttggctgaaatattttcttaaagattggattgagggtttaaaaagaagttttattaatatttaatatttccatggtttcaatttaaaaatactctgagaaggagatgaataacaaaaatcaatctatcctaagaatactttgttcaattctcaaaatggttttaaagattcaggcatacttattttataattgaagagaggttttgcaggctgtttccctctgaaagggagaaggactttcggtagagaggaagtatatcaggaatcaggaactacctgatgcaaccttgtgcaaatcataaaccctaaaacagggttcagaatagattatcttttcagcttcatagttctgacagttaaattctgggcccttttccaaactattttccccaaacgactcagccattcaccctgctcagtatctactttttatagactcacaagcattcacattattgcttggttggtattagagctctgcttaatgccattgataccggtgggctaggggaggtccccaaacaccagtgggacctcaaccctggctcttgacactgtggtgagaagaaactcaaggacaagtcagaaaatagtgaaagtatggagatttattgcaaagcaaaaagtacacactcaaaaggggagtgtgggtgtactcaagagagagtcgtggacaaggggcgttggggttcctatctttatgggtttctgttaaccaaggggtggaatgttcatgaagattcctggaaaaaggtggcaatttctcagaactgtggtgccatccatttttacaccaaatatgagtgctcctggaacggtcatggccctggtgggtgtgtgatttgtatgttaatgagcatataatgaggtcctatgtgaaacctagatcaaactcagcaccatgttgggtccagacagtctcagccagcttggcctgcaccctggttttttcagggtcttatcagatcttagcttctgcagctatttcaacagtttccttttgatagtcaagaaactgctgcctggaattttctattctcctgtgattaccatatattattcctgtcttaccataagattttaggaaatctatctgtctttgaggggctgaaaataaatatggggtacatttcaataagttcattagattattttatacttactctgtcatagtttctccagttagtaaataccaactttttaaagatgtttggaaggtcattaatactgataaaacacctaagtacagtattggcactagaaattacagtatgtataagaaactaaagtagctgaagaaaagaaaccacaacggctcttttaaaaaaaacccaaaaggtatttgtctttgctgattactgtctctgctggcaaagaaatcacaggatactcacaagggaggaccaggaaaaatgcactacagcctctggtctacccaatagtgccacttacttccagcaataccagtgtcaatcaacattaatacctttagaatttccctctacttctctgataatctgagatcttagaaacatttaaaccaaactgtcagtgaaatgggtttaaggaggtttgctgatgcttcaaatcctacttctgccactgactggctgtatgaacttggtcaagttatgtaatctctatgtttcaatttcctgatctataaaataggttagattgaaccatatgaaattgccaataactgactgttttgacctataaaaaaacgcgatttcatatggtttcaacctaagtacagaacctacatcctcaggttgttaagaagattgagttaatacacataaaatgattaaaacactacttgaagaggcatgaaagtttatctactccagccatgttttgccagtgaggacactgagcccagggagctcgccttattctgcatcaaatatgcccagtcagtggcagagtttgagcccaggttttctcactcggattttatgaccacctctcccctctttcattagagcaggaaagttgggacctggattcagcactgttctttttggccaccagttagaattttttttaagaagaaggaaaatcttagaaactagaaaaatgctctataaacatttgctggtgttattctaatttttggaggttttcaagatcctttgaatgagaagggaggttaaagattatttattttctaaatcagacactactcaaagaactgaggggaaccagctgtctaatgaatgagctatggaaatcatagatcctcagaaaagaaacagaacctaaaattaaaaaaataaatattgtaatatggatttgatatttaccaaagaaaaactgtcagggatttttgatgtttgttttaaatcaaggcatagtgacaggtaaaggtagcaagagatagaatgaaaggttagatttatgtaaacatacctaaaatgaagcatagacttaatataataaacgcttaatattcttagttgcaggtgcagctcaaattggagatcacattctagaaagataactgcctgtggtgtattcccatatgttatcgctttttgtatttttctggtgaaaagttgctgtgtcatactgtaaaggcagtatgtatggaaagggtgaagacaaacatctctaatgacatggttatagacacaatgaaagctcactgaacagaaatataggcaagattctgcagaaccttgcagttcccctagctatcttacagaaaggtgagccaggactgggaacagttggatgcatcctaagtggtactccagcagtgagactctacccctaaatcactttacatatttatttatagaaaaattggaagtggagaagataatacctgaccactaggtattaagggaagcaagctttgtagtgagggacaccagcttgctggaaaggtgaaagccagaagcttagtcatcaacgcgtagggtcttaaatgcttagggttatcagtgctaaaacttgaaatcagctggagaccgaggagccctgtggttgagccagctcagttcccgttgagccagctcttcctaggctaaagtaaagatgggggcagagtacagtcagggctttccagcagttgcaaggtttgcccctcctcacatctgatgtcactctgtttaaactgaagaagctctcagggctgccacaaacagccacccaggataagcatcatcattggtggtcctgaagtcacacatgctggtgcaaagctctaagggtaaccgcacatagagtaggtaaatcctctagtgtatttgatagaacatatcaccagcatgtttttcttctaaaaagtgtttagagaaacaaaaaaatcacgtttcttaaataaattgtaatatttagtcccaaaatataagtatgttattttcataaatatttacttctgtaagagaagtttacttaaagaaaaaagaataaaaggacataataatagagatattaaatatctgcctccatttttactgtctctaccttttctgaaatctattttgtagtcaaatattggcatttatttgcatcgtttcatttccaatatacccaggaaaatggctatatttaatcaattctaataccaactacagattctttgtggtaggtataccttattgagcttagtcaatgtaccaagtttttgtttgaatgtcaattctgttcccttgtgaaagctgttgcatttaatttggcatgaggtccttgttcaagaacttgtatttttgcaaccatttcaggtattctaacgagcagtgctttatgcacacttcagagatttaatgacaatttcatgaactattaaaatgtatcttttaaatttgcctacctaaaacaacggcttgggaaaaaagtctataatctccagaagtttaaaagattttccttcttcttaaaaaaaattctaactggccaaagagaacagtgctaaatccaggtcccaactttcctgctctaatgagagagaatacattacagaggggtggtcataaaatctgagtgagaaaacctgggctcaaactccgccactgactgggcatatttgatgcagaataaggcgagctccctgggctcagtgtcctcactggcaaaacatggctggagtagataaactttcaatgcctctttaaatctgcactgtttatgattctaatggttatttcagttgagcatgactgtgttgagcatttaatggaagaacagaaggtacttacagatattcaatattttggctatgtaatttaagtgttcttttttttttctattatcctcaacaaatactaccaatactaccatgccaagcacaaaaaggtacagtttctggcacataatagacaatcagaattgtttactgtggctggacatagtggctcatgcctgtaatcccaacactttaagaggctgaggcaggaggactgcttgaggccaggagttcaagaccagcctgggcaacatagcgagcccatctctacgaaaagttaaaaaaaattagccaggcatggtgctgcgtgcctgtagtcctagctaatcaggaggctgaggcaggaggattgcttgtgcccaggagttcaaggctacagcgagctatgatcacaccactgcactccagcctgagtgacagagcaaggccttgtctctaaaaacaaacaaaaatttgtaaaaacccaagtgtttattaagtaaaatgaaagtaaaaaagagaaacatttgataaataaataaatatatactgtttatggacataatatagaatatcattatattaaaatactatattagaaacaatatttatctccaagaataaagataaaccaccagaagctaaaaagtagtttatgtttttaacatttgtactatatgcctcacgtgggccttttttaagcctttcaaactattaaacaatttgattcagactaatgcttgaaaattaaaagcttaaatgttgagatatgctatatttaagtgggtattacacagtgttcagcagttaccatgccttataatggtatttctttacttaccaggaaggttgtgccatttgttcaccgcaaataacctgttagcagtgactgtgatcacagcgggagttgccaaaccaggctgggtgttggctgccacgtgagtaacaggggagttggagggaaacttgaggaccatgataacatcctgctgggctttgtctgtgaacatcaatggactctgcaggaggagatactgttgagtgggcatgacaagacccaaatagacaagaaggaaaagatgaagaaagacaagaaagagagggggtgcaggaaaagaagaggaagaccatattaacatgagttgtaagtggaagcacagtgagcagaaaggcttgtagaaacagcagtcatgatctgttattcatgtatgtcgttagttggaattttgggggactgaagtagaatacattaacagaaacactttaaaatttataaattttatgagctccctttccctccccactgccacgaaaaactaaaagaatgatttgatttagattctacacaggcaaagtgctggggattgcattaaaccattctggttgctatcgtgtcacataatgatcttttagcactaaaaaaacagtaagaatggacaacaggcataaaagcaagacaaggtaatttccaaagatcatcaaaagttgtgttgagttagcaggaagattttgacaactacaaagaggtaatgaaaacaaatacatttataaacaatagttagactgcatgcatatattattacagtagagaaataacttatgaacgtaatatacaaacttaattataaaggtgtttgaaagcaatgcataaatgtacttgtaaaaacaatatatttatatagtgtaccaaatcataaacactgcctattgtaatgcaaatgctactgctttctgctgtagctaggaataaagagaaatacctaggtgttcctcttccctgttggttaaaaaacaaacaaaactagagctcaagacttttttgatttctccttcaaaaaacagagtaattgaaaatgttaaatgaaacactgtctgttctaataaccagcaaccaaataaatcttgaagactactaaggatttggaacattcttacaacccatatgtcataatccaagacatatataacactgctctgatttattggctttatttatactttgtggtggtgtgctatcatacagtaattgcactgtacattttcagcaattctctcctaccatgtctgttttctaatagctgattagtatcattcagaattgaaacactttgatgaaatgcttctggctgctttccttctgccatatttcaaaacaccaggtaatatgtaaatgtggaggcacatatatttaacacatatttattcagaactggtaataaaaaattaaatacatttgcatttttattatcagtccttttaaaaaagttattaagagtacttagaaaaacatattgcactaagaattcctatttgcactctttgcataaaggtgtaaataaaggcaactaataagctacccggacacccttctgagcaagtggctaaaagccaatcaatattatgagttaatcctccctggatgctcattcaattaaaggtgtcagtaatgcctcatctgatgtggcctcaattaagtccaactatctgatggtgtgaaaacacagggggatacagcaacagcagcaaaaccagacaaataggcagccttcgtgtgcctgctaattactacacctggtgtatattatggttcatgcacttaacgcagcacgaggtggctttaatttctgctatatttgtgtgtgtctctgtgtgtgtgtgtgtgtgtgtgtgtgtgtggggatgcattgatggttgatgggggagctcatctgaatgttactaaaaacaataaatatgtggcctttgatttttaaaaccctagtatcactagtttttgtcacacaaagaacgttttatatagtttttaaggaattctgtgaaattaggtaaaaatgagaaacagggagcaacatgaaggaaaatatcccataagctaattttaaagaagtcctgggaaaaggaaatgaacatcatttccaagtaccaagtcttatttttcaattatgtagtttttaaataatatttacgaaagtcaatttataaactcagagaaaatcagagtacaacataatcataaaatctcactgaaaggaagtacatacatatttctgagcttaacagctcatactataaatataattaggctcaaattgaatagttccaatgtttatgcccttaaaaaacacaaaaaaaatctctcatgtgtaggaagaatgtcttgtttacatagtgactctggtgggccaactctaagccacacggcaaggaccagccaccttccacagcaagctgcagacaccatgtccagaaatgtccactgccttcgtacaaatatctgtccctctagtctgctcctccataccccatcctgactagagctcctgatgcaggcaagtagcaggaaactctcttgggcgtttcatcatatatccttggctaaaaagcatgaatgagaaacaccagaaataagaaaaccataccccacactactaggctactctgcagtgacagcagcagctgcagatgagcagagcaactggtaaaacagggataagagaaacaaagcctcttttaatactgggtacctctgtgagccaaggctggggtacaagtaggaaattgctagccaggtttcatcagttttcccagattaagtatacatttgttgacaactctggtttctttttaaactgccttttccccatgcacatatggacaaagcgaaaaacacaatttgtgcaagtctgaagaggagttcaggtattcaattcagaggataaaggtaatggaaaagacggcctcccatccttatatgagcatgagccttccccgccttctcaccctcgggatagcaaagctgctctgcctgtatgagccaataagcctctgccatggaagaaggctgggcagtgaccccagcagaaagtcaatggagcagaggaggtgcttccatttgccagcaccaatgcagcctgagtctcaatggcaagctattactaaagctaattccaaatgcaaacataaatcattcttactatttttatggcactatcttccattgttcttgctaaatgtttgctatctatgtagtcttctgcccactaaagtcactcttcacgttcatctaaatctgattttactgatttaaaaacatgtaggggaaagagtgatgcaaacaatttttaaaatgtgtatagcttatgatggccaattcatactgctagataaagaaggagaaaaaatcttggaagaagaaagaaaatgacaaagagcacagagggaaaaaaagacacagaaggtgatgtgggaagagaaaggaaaaaaaaaaaggaaaaaagagccagaggtagcagggcctcctctctatttcttactttcttcactgctactctttccttcccagtatttatcaaaattctgctatctctacaccacaacatggaatttgactttatataattgttaattatatttacgggaacagactttgtagtttctattcttaatttaaaacagcaatgagcaacttctttttatgagggacaattgaaaaacaatatgtatagtctattccttaaaaattattttaatcacgcacttcaatttgttactctgccaatttttttttcctcattgaagaattttccccctgaaatttcaggaactataaaggtaaaatggccaccttattttgtagctcaagtctatttccgtacccatgattctgggctgacttttgacttgctttgaccaatgaaatgtggcataaatgatgtgtaggttcaaaagcaagcctcaagaagtctggctgcttctgtctgtcttcattctcatgggactgctcctaccatgggagcggcctggtctagcttccttaaggatgaaaggccacatggaaagagaagcctggctacatcagcccacccccaagcagtgtgtgagtgaggcgaggtgaaaagagcagaaaagattttcatctaaccctcagaatcatgagaaatacaatacatgattgttttaagccactaagttttgggtggtttgttataccaaaccatcatttttctcctcactgtggtccctgaccttcagtaacaatatcttatgtattagaatttgttttaaaattcccaaactgaaaaatatattgggatgtaaagaataaacacaacagcaaaactaatctagaaactcagagaatcaaaccagaaaagtcatcaaccctatgtctggagtcctttatcctacagtgaggattcatgacaattatggacctttcaattctgtaacacaagacaccaactgatgaaatacaagagcactggagcaacatttaccttctcaaagattccaggagacaatgcaataacatctgctggttgttagcaggttaacaaatattgcataaaaaaacaaacccacatatggtggagaaactcaagcacaatgaaagactgttatgaatatcaagcggatctgaaggagaggcaagaaatgaggagagtaaaaatagcacttaccacttgcatggcagaacctctgggaggatggggctctatgagtagttgagaaggagtctgtccaaaacttcggatttgagcttcaacagcctgaaaagggcaggggcaagtctgaaggttaagaggtgctaattacaggaaatagaaccccaactgtcacctgaaaatatcattccatactctggcttgtttcatgctgaaaatcaacctgtgttttcacagtggggctaaccacctggcaagggcattgagggtgaggtcatcatttagaaccgcagaagctgttcctctaaaactctgcaaaactttctcatcttgctcagtgatatgaaacagaaaccagctattacaatcagaaattgtcctttttggcttcatctctgttttcttgcacttggttttcctgcttgcatcatccccaatgatgaaaagctaatcttttacaggtatagagaaaaactattgcttctttgattctaggtcccatttcatcctggggagtaaaaaggaggaaaaaagaaacatagcacctgtgaaagtggcttgatgctatattaattttgccataggaagagcattattgttgactgtctctttgaagttagacaactaaataacaaagtaaaagccatatgttgcatctaagcatgagatggttaaaccagggagtcactaaacatgaggaacgtgtgtatgtgtgctctttttgaaagacgtgtgcttttgcaaggcactctcctactatggctcttggtgcacacatagcacacaaatgcccatttccatcaccaaccacccatcatgggaaactgctaaatgccaggtgctatcacatctgtaagcattgtgtttacttgtttatatctgtttcttcccagtaaaatacaaaagccatgaaagcaggaccttatgtatcttcttcactgttagatccctaaattggctgaatgaataaatgctacatgctgggtgaggggagagaaggaagcaaacacatataaaggctacttcgacactcccgtaacagtcagtatgcttaactcccaggctaaaaggatgaggaaaaccctcaaattaataagaataaaaattggagccaaaaggaagtgaggtagggactaggatcattttcagaacatcatctcaaatattttctgatagagtgaaattaatttatgattaaacatcaagaacaagcttgagaaaaaaatcataaaatgggaacctgaaggctaaaggtagtcacaaagaaggaggtagcaacactgctaatttatgatatatgaacttatggacttagtttatgaatgagaactttatatctttttgaagaacagctggtaaggatgggcatgatggctcacacctgtaatcccaaaccaagacaggaggatcgcttgaggccaggagttcaagaacggcctacatagtaagaccctgtctctacaaaaaataaagaaaattggctgggtgtgctggtgtgtgcctcaagtcccagatacttaggaggctgaagtaggagaacagcttgaggccaggagttcgaggcagcagtgagctatcattgcaccactgcactccagcctggacaagagtgcagcctggacaagagtacagcctgaacaagagtgcactgtacaagccagacctgtctccttgacagttgccttctgtggttcctgcccggcagcccacatgcctccctgattaaaaggggagggaggtggcaaagaacttattgcttcagcacttggcctatcatgtcagatggctcagagtgctaatcctgactgtgacacttatctgctgtttgactttaggcaattagcttatctccgtttcccatctacaaagagatagtaacaatacctagttcacataattgtttggaaaatgaaataagataatgcatataaagtgcttagcacagtacctagcacatacaaagcactaaataaaatgctgtactgtattattatttcatgtgggagttggtgtattccccacttaacacagctaaaataaagaaggaagaaatgcctcaggagtttatgtaggaagagaatgagaaatacattatttaagaaaactgaaatctggcttgggatttcaaaatataccacagggctaagagcctagagacagagagatttctttggaggttctgagagcagtccaaaacatgaggaattatacacctgggtccttatggaagctatggtaatagtaacaaagagatgaatatgtgaaccagctaaggaaaaatcaacaggtcttagggactgatgactttgagcaataaagaaaatacaaaactaattccttttcttaaaaaaaaacttgcatgtttcagagaatagtaaagcaatgagcagaaataggaatacaggagtttctgttagggaaaacaagtttggcaggagaaagacagtaaattttacgtcagacacatggaatccaacgtgatagtgataaccatttatctaggtcagtatgtccaatgtgtaaaagcctaagaatggctctgaggtgagagaagagaggtattgattttggtgtcattcatataaaagagaaatttaagttacttttttttttatctttctctcttgttgtatatgtgtgcatgtttttaagcagcagaaatgacctcctttttgaaatgaaatatcacatgaaacctcaatacatggagatagggttattcaactttacaggggtgaaaccatccctaacaagcctcctcatcagcctctgagacaattctgagaattctttagggctctggagcacagtttgaaactatactcgttaagccctaggatgaaaatacatgagacccagacacaaaagcacctagagcagaacctcaagaagtatttatatttagggtacaaatgaggaagtaatgaagaagacagagagagggcagtcagagggtgggtgggaggaaaagcagcatagagtgatatggaagccataggatgagggttttgaagagagaatgggcagtaacgccaactatgatagagaagctatgaatgatgacattgtagcatatacatctttattatagatacaaatttaatataactggccttaatattacatatagtgttttgcacttaacaatgttttgagatgaaaggttatggatgagacaacttctgaaaataccaatctcctctttttaactaacttaactttaatcttaacattttaatacaagtggcacattactgaaaactctgaggaaaaggcttttttaaatcacgtaatatagtggtctgattattctatctcaatgacagaataaaagctatagtctctcacacaggttaaataataatcaattttctttccaagtcttgaaggcatctgaaaaggctgtggaattctcagacacaaatgctttacttcttaacgaacctttcagttcttgatattaaaaatgcaacagaaaggactttttcaagtgtgaaaattatagaataagattgtaaggtaatgactatgatctcaaaactttatagtcacactgtatatcatcaactgataattccagttctcctccttgtttttaaaattcatttgccatttttcattcatcttaatctctgaagcaatttacagagattctcccttctgtggcttcaatggcttaatgcttagactggctctgtagtctactcctttaatctctgtcttttgctgacttgtcatccataaataaatttattactgtgagttctcttttagcactatgattcactcaacttaagcttgctttcttggaaattttttctactgggcctcaaactctgcccctatctgaaaggtttccagtcctatgaccagaggattgcccactcccatgaagtttgccctggccatcttgtgtgtaagcacatgtatgtcttagcacatctaaaatcttaaaatactattttttattttagcatttctcagtcaagaattagattcttctgattttttaaagctcagaatcttgtctacattttaaaaattttacctgtttcacatataaagtcactaagcccaatcacttcgaagtttatcacattcatcactcctttctgaatctaggccccttataatttcaagtatcgattattataacagtctctttgctggttttccccctctattcagtttctgcctccagcatatcctgcagaactaagttttcccaaactcgcctttatgcaatatttctctgatcaaatgtcttcaagtgattccagtaattaaaagataaaagctaatgccaggcattgcaggttttcctatctctctaacttttattctctcattctatctattaccttataccagtgttccttttcagtcaagctggttttcttctacaaatataagccatctctgccttacattttctaccatgccactgaccctcctagaatggtcactcttatcttcagttttctaagttctactcctctctagaaaaccctgtttgagttctaccaagtttccctaatcttgttaaataatattacacctgttcatactgctcattacagtatatacttgattcagaatttcctgtaatgttatttatgtctgtcactacaactacactataaggcactggtccccaaactttttggcaccagggactggtttcatggaagacagtttttccatggacctgcttggaggggtggatatggttttgggatgaaaccgttttacctgagatgaccaggcattagattctcatagggagcgtgcaaccgagatccctcgcatgtgcagttcacaatagggtttgcattccgatgacaatctaatgctgtggctgatgtgacaggggtagagctcaggcagtaatgcttgcccaccactcacctcctgctatgcagcctggttcctaacaggctgtggctcggcggtcagggacccctgctagaagggtctgaataccatatatgtgcaacaggtggaacagtaccttgcacatagtatttagacaacaaaaaatttactgagtgcctgttatatagcaagctagccaggaacccttatggctcatctatggttggactggggacaaaaccaagcttgagagatgagcacacttcttgatgagggctgactgaggttgcaggggaggataaggagtgttaagtaaaggctggtatttgctattagaaagaaaccaaatgagtctctcagggaagctctgaaagatgtcactaaaggcagtaattctcatttcttcagatccagcatactggaggataggacaacactccattgtctcactatagtagtaattcttaaggtcaagtgagaaatcctggggtaatatgtatgatttgaaaaagtccctcaagtgattatgtttcttgccttatcttcacttgcctattcagccctctatatagagcaataaaaaatttaaaggcataaatgaggtgtgaaataacaggaaacatacaagcatccttaaaccctgtacggttcagcaaggtgggttggtaatagggtagcttaacagacattaccaaatgcctcaactgctcttaatgaactctccttcacctagagagttttggtgctaggtgatcactttttagacattcagttatgtaacattttttgttatggaataggataatgaatccccacatatccattagccaccttcaataattattaagacattttggctttaggttatcttaaagtcgggtcaatctagacaatgtcctagatagattcattgaaaattaacagagtgcttctgcctttaaacaatttattttttttaacttctaatgcaagactatactgagaataaaagtatcttacaatgaccaaaaatataagcattagctggcagccttcatatttcttctaaggggctgaatatactcagacttgcaaggagatgttcaatccttaagttgcaaatttgattatgtgactcaaagccttccgttccaaatccttaccctgggtagcaccacagcataggattaagtatgcagacactggaatcagacagcctcagttcaaatcttaccactatcacatattagctcagtgattctgggcaaggtacttaaccttctgtgccttaatttcctcttctaaaaattgtgataataactgtcaatattttattgagttgtgaggattaaatgagataatataaagcacttagaacagttcatggcacatactaagctatcagtaagtgtgtgatattattacagcatatatattaaagacttaacacagtgcctggctagggttaagcaagcactcaataaatgttaccaactactcatctttaagatgaatagttatctagccccaaccactgtccatttcaccactctataatgtgacatataatcaacatcatattgcctttaaacccttgtatatattttctattccttttctctgtgtggtttctttcctcctcattcttgaagacttagctcaggcatctctggcctctgggagatctttcttgacctcacccagactgttgctgtccctccctttttgctcttgtagcaacatgcataaacttttactgcctatttatctaatattctaattactggtttaattttccaacttattgatcagactataagtctcctttagatcagagactgcctaatatttctgtgcttctacagcttggcacatagtaggtgctcagtaaatatttacccagtgaatgtccatgcaaatcaacttaatttaggagggatgcagctaagaaatgcactactaccacaatcacagagcagtctagtgttgaataaaatattatattaaaacatttcaaaaaaagcttgctttattaaatattcttattcatcaattcccaattatttctgtaaatagcctgttactactttctataataaaacctgaagtcagcaggcagcattccagatgttgagatatatagtaataaaaaagactatgcaaatacttcaagacattgcagtaaaaccacatatttatattttataaacagcatctcaaatattacctagagaatgtattaatggatcttcaaatggaaatattatgaagagattttcaacaagctgtgtattctatagtttttgtgtgtgccaactatttcatacttgcatgattttatagctatatatagaaaaagagacaatatatatagagagaatatacatacacatactagacagaatgaaaggaagaaagaaataagagataaaagtaaaggaaagtaaacttggcttagtgacagtgtagtatttggcttcaacttaacaaagactattttagtctctctgacctaggctttttaatctaactgaggaaacaagttaactcagtacagcacttagtaaccaacaataaatattgtaaaattttatttaagatgtagggtaggggagaaataacttaaacatatggacacaattaatatatatgcccttttttttaagcacacaactctgatattgtattttatcacctacatatttacatctgaacgcactataaaattggaatagggaaatagagacaaaataatttattaagaaaagatatgtcatttattaatatattaaaactttctcacattaccaaaattaagttcaagaaagctgctgtaagattctaatccacctctttaccaagaaatgtttaagcattccaacaagacttcatagattaaattcttttcaatatttaaaaagtcacactaagaccatccagtgatgtctactgtggtatcataccattacttgtgccagttttcttctttcccttcagatgtttgaacttaaattgtagaacacttgctggatatttgacaggtttctactcaaagtttactgtctagctgactagcctcagtgtcctttggaggtatggttcaactttagcttcgatatcagttaagtttaaaaacatattaatcaaatgactacttaatcatgatatggttacgtttgtatttaattcctaaaggaaaaaaatcctgataatattgtaactgctaaggccaaaaaaggacccatagcaagtaaatatatttggtaaaaatgggatgaaaatcccaaaagagaaaatcagagatgtttggatgacatctctatctggcttaaaagaaagaaaggcaaagcatcattagaaacatttggaaaccagactcccacttaaccttaggaaagaaatacaaagttattaatagtttttagttgtcagagcaataaattcacaaaattaaaaagtagtataatgaacctaactcaaattatttaaaaagagtcttctaagattaaaatgtaaatattttaaatgcctgagaaataaaatacagaattcaaactttataaagcataaacataagagataaatagtttttcaagaaaatggatacaccaggatatggaatatttaaaactcaagcagataaatgttcaaaatatacagcagaggatattttcaatgaaatttgcaaaataatctattaatacatagaagagtaaatgaaattcaacagaagtgattctatgtaaatttggacttgaaagacttaatgtttttagttttgagaatgcagacataaagacagatatctaagaatttagataaaagtcaagtttgtatgttatatatatgtatgtgtatatatatataacacacatatacttacatgtgttatgtgcatacatacatacatatgcatgaacacttgcatgcaaaatctggggggtatattccaaactattatttgctattttctctgatggaggaaggatgaaaagattggcagaataaaaatttatactttcctcatttttataccaattgatatcttacacaaagcatgtattatttttgaaataagcataacaaaacaattttcattttgaaaaaatctaaaagacaatttaaaaaaaaaggtctgcaaatatttggtatatcattattaagttttttttgttttgtcttggttttttttttttttttttgacagagtttcgctctgtcacccaggctggagtgtggtggtgcaaccttgtctcactgcaacctccgtctccgaggttcaagtgattctcctgcctcagcctccctggtagctggaattacaggtatgcaccaccacacctggctaaattttgtatttttagtagagatggggtttcgccatgttgtccaggctggtctcaaactcctgacttcaggtgatccgcctgcctcggcctcccaaagtgctgggattacaggcataagccaacacacccagccccacttctatgaattttcataaggaaagaatcagatgaagacaaaaagatttagatataaagaaagttattatagcactctataacagtaaaaattggaagaaaaaaactacttaaactctgataatggaatactatgcagccattaaaatgagttgaatacacctgacatagaaactagttcataatataccaaagaaagaaaaatttctaactaccaaagtatatagagtatgaccttatttcagcaaaaaatatatgtgtatgtgtggctgtgtatatatatatacacacatatatacatatatatatacacgtatatatgtgtatatatgtgtatatatatacgtatatatgtgtgtgtatatatatatacacacacatatacgtattatatatgtgtgtatatatatatatacacacacacatatatgtatatataaagcacttagaacagttcatggcacatactaagctatcagtaagtgtgtgatattattacagcatatatattaaagacttaacacagggcctggctagggttaagtaagcactcaataaatgtttttgtttttgtttcttttttgagataggatttcactttgtcacccaggctggagtgcagtgatatgatctcagctcactgcaacctctgtttcctgggtgcaagcgatcctcccacctcagcctctgagtagcagggagccacaggtgtgtgccaccatgcctggctgatttttgtatttttgtagagatggtgttttgccatgttgcccaggttggtcttgaactcctgagctcaaatgatctgcccgccttggcctcccaaagttctgggattacaagcctaagccaccacgcctggcgaagccactgtgcttggcctttatgaagtttaatttatccattaacataatagcaagaaatacatatatttttaacttttattttaggttcagaggtacatgtgaaggtgtgttacataggtaaacttgtgtcctgggggtttgtggtatagattatttcaccacccaggtattaagccccgtacccaatagttatcttttctgctcctctcccaaggaatattctgtaaccatctaagaacaacttcagttgataaactggtcaaaaacttaaatctatagaccttgctataaaattaattttgttaatattgagtttacttttttaacttatctgtatctgattccaaggatcccttagttttagcaatttttgccatcatttagtattaattaaatacaaacttgtttaagtaaataatgtgttttcctccaagaagcactcagaatgcatcaggtaactggaaacaaatacatatcatgatggaatggagtacataaaaaataaagagaaagagcagcttgttaaataaagtaaaacatattttaaaataataatgcaaagaaaagggggagaaggaaaattagggagggaaaggagtatttatactagcatatctactcaaataatattattatggaagttactaatgtaaaatatgatgtaattataatttgtgaaaatgcacacagatttttccattagtgcctgtaacggagcccgtacttttcaggcacattaaactgagtcccaacccagcctcactacaatctccagttcttgtagctgtccatctactacagcataatcccagctgccaatctgaaagaaaccagctagtcagagcagacacaaccaacagaaacaaacgtcactcaataatgttcagcggcactgtgttcatggataatttcaaacagtatctctgtctagaacattgatgtgctcattcaaaacacctccatctctggctactggaaatgagtagataaagcagcctgcctagaaaaataagtggaatgtcttcaaagaggttgccaatgctaagaagcaaatgttgagaaaacacagtaaaggtcttaaaggaaaaaaactcaacaatatccagagagttaattttcacattaagaaggttaaattatttctcaaaaccaaacaaatatgtttaaactatgtcatgaaaagcagcagtcattggttattcatttgctaagagtgacctagatgaagtaaagatggtgcctgaaaggaaacaggggttcatgacaaaagtcatcagtataatagaacggctcagaattctgtaggtagttaataggaaaaaaaatcataaaaatattaatattttgcttcatgtccttgagtgtataatttagttacacctaacttaactagtaagtctgcaaaagacataataatgagcaaaatacaaagagtagctttactgacaactttgatgctcatttaattgaataagggaatttttgtctgattattgtggttttgaagtaaaagaaagtctggcataattttatggtattttaaatgtaggttttcaattaaaacctgactaatccttaccgtttatttggcttctcattgtacagttcctgccctgcactgtgtcaaatatgccatctgtgtaacacacttttggccagaggtacttcatgattatttctataacactttgaattgtggctgcatgaaatcttaacttcggtattcaatactcctaatttactatattgctacaaccactgtaatcgtgtcctactcttaaatctcaccacagtcacaacaaagattcttgcgccacctgcttgaaacaggcttacagaccactcccccaactatttaacaaatgttaacaatgctataaatactaattgtgtttatgctttctgaaagattcactgcagccagtgttctgcagcagtgttggagctgctgactcccaccaacagactgatggaattctaagccaaaaatgcttttccttggataagatatctgatttgctactgctgtcatgaaactggggtcatgtaaacttaaacactgctgctgcttcttttggaaaacagacctcagagtgattacgcatagctaagacagcatttggaaggataaatttggaagagggaaaaccaaccactgacactaaacacaacttagggaaaattttcaggttttactttcatgttgaggtcacttgtatacagtaattctttaaactgggcaatatcacggctctcccctctcccctatttatcaatgcaaatagagctgagttccattttcaaaaggaaatttaaaactttaattaatttctgaactcacataaacataaaacaatgtatttacgtgaaaagtaaagaagaaaatgacacttttagaggaaatgtaccaagtacttataacaaagtacaagatgaaaaagcacagataatattgttcatattaaggttgtctgacagcaacatctacctgcaagtatctttcagcctttgaagccccaccccttcttccaacctccagtgtaccccaagatctgccctggtgtcccttatacaacaactgctccagcctctgctgtgtttgtacttttcctttgatcaaaacctactgtccagtcttactcacagacagccacatgattggaaaggatttttttttaaaggatttgtaaccaaataagtgatctctaatggtagaatttcaggcattaggaaaggacaatgagttctgtagcagaggctttttttctttacatacacatcaaagtgcatcaaagaggaacttatagctagacattaacatgtgactctggcattagttaccaatttgaggatgagagctttctagtctctcactttatactttttgtattatttgactcttgaaatagttaacatgtattgctttgataaatacatttttaaagcactttgtataactatttaattatacacacacacacacacacacacacacacaagtagtgaacccagagttctagaattcaggaatcttaagccaaaagccttcttgcttttagataatgacaaaaactacaattaacagcgatacacctaagatattttccctgaaagtagaagtgttctttgtgctctccctcaaatatgatgggaaaaatgaagaaataaactcaaatgttaaaaagtatgaaaactcccatagctcagtggattaaataacatatatagaaaattaagagattggaggtactctgatttctgagtgagataaaagttaagaaattgtaaattccttcattcctgtcaaagttacacgaagatcattatagacggtcagtaccctaacaacattgaatgttgagaaagaacatggccaaaacccagaacgcaattacaaaagacctctgaacagccaaaaacgaagtcagtattcatatcctcatgttaacatacattgcttgttcaaattttcaagaagcagattctttccccctgaaaagggagaaagagttgtgtttggctttttttctctctctgattttcaagagacataattttttagaatatagaaagaggcaaattaaagaattccatgatctcattaaccaaagataatgaccatgaacattttggggtccataattccagacttttcctcatgcatttgtattttatatgttccataacattgtctattattcactgtaatatggcaaaatattcttccatggtaatacatatagatttacacagcaacatttttgatgatacacagtattctactgtgtaaatttaccaatatttaattaactacttctctactggaaatttacgttgctccttttcctttttttttttttttgctattatgataatacggtttggctgcgtccctacccaaatctcatcttgaattgtagttcccacaatccccacatcgtgagaaggaccccgtcggaggtaactgaatcatggtggtggtttcccccatactattcttgtgatggtaagttctcacgagatctgatggttttataacgggcatcctccttcgctcagctctcattcttctctctcctgccgccttgcaaagaaggatatgtttgcttcccctttcaccatggctgtaagttccctgaggcctccctagccatgtggaactgagtcaattaaacctctttcctttagaattacccagtctcgggtatgtcctcatagcagcatgagaacagactaatacatatgaactatataactgaatatttttttcacacttggtcaattattacttttggttagagttctaagtaaatagtacatgaacattttaataattgatacagattgctataaagattcaacctattttcatcctcaccaaatatatgacagtatctgttttctcatactgcaccaacattaaaatttttattatttttaatcttagataatctagtggacacaaatgttattgtgtgttcaatttaatgtcattgattaatagtgaggatgaactacttctcttactgggtcctgctctttgcccaggctggtctcaaactcctgggcctaagcgatcctcccaccttggcctcccaaagcattggaattacaggtgtgaaccactgtgcccagcttaaagtgcttttcatatgtgacttgcatttcatctttcatgagttttctattcctgtactttgttatttgttgttgctttagatgtacagaaacatccttttcatgtagtgtttatacgtgaatatattaatttccttaaggatttttagctttgatattagacttacaaaggccttccccttcatgtaatcaggaacagaaatgtcagtgtgacaggacacatcgatgaggaagagaacagacgacatgagatcagggaggtatgcagggccagatcatgtgagtcaagcagattttattctatgtttgatgtgaaataggaaagtttaagaaggaagtgaaatgatctgacttacagtttcaaataccactttggcagctcggtggaaagtggactgtaggtaggcagggacagaaaaaggtgacctggtctactagcgttagtccagtggggagagtatggtggcggcttgaactaatgatgaacagatatgaatggtttccaaatatgttttagagatctcaccagcctagctgctcttttgagacagagtcttgctttgtcacccaggctagagtgcagtggtgtgatctgaactcactgcaacctctgcctccccagttcaaacaattctcattcctcagcctcctgagaagctggaactacaggcgcataccaccacgcctggctaattatttgtattttaatttttttaggaacagggtctcactatgttgcccaggctggtcttgaactcctgccctcaagcagtcctcctgcctcagcctcccaaagtgctgggattacaggtgtgagccaccttgcctggcctatcaccaacttcttatgctctcccttcctaccacacgattttttcaagtcatagagccatactgtgctcttttccacatgccatactctccgctttgaatgtcccttccatttcttttgcttcactgacttaactcaaatttcttaaggattatgttcagacagttgatactttcttaacctgggttagaaatgtctcctttgtgctcccgtattcagtgactgtcacattgccatatatataatatatatatatttatttacatacacacagacatatgcatatatgtgtattttttaaaaaaatatatttcttacctactaaacttcatcaatgaactatttcatactaagatactaatgtctagatagctttcaacctttgtatattgcaaatagcatttatatgaaaattaatgggtgaattctggataaggatatagaattgttctagaaaccatgcctatagatatgattatactttaaatatattaatttaaggaaaatacttatgttaaatcttttagaagagggaaaattattttataaaatattcatcatgtatttaatttgtggatttcgattttaagagaatttttttaattcgtaaaaatagttattcttactcatatctgaccctgagttcaaatattctaatttttatcttttttgaaaatttcttctttccttgggttttacgtttttcaaaaatggggttagaaaggcttaataagattgtgtttgaaagaaaagacatgaatgagccaaatcaaaatcagcagaataatcagaaaatgaccaacttttatttatttgtcccttatctataaaagaatatatgtaatattgaggaactagaatagattaaaaaaatgttaaaggcagtgaaaaaaagaatagtgccaaaatacagagaaataaagaagagtaaacagataaagataagactatattcttaagttggggtcacaagatattttttgaaagattagcatatttgtccgaaaaagaattctttctggtgtgtgatatatgtaaatgcagacatagttgtatattgataacccagctgttttctaaaaattaaaaacaacataaaagtttaatgtgctgcaggctgtttctctgattactcttcctcctcttatggttattatttctatcgtttagtgctctttttatagagagattatttttatgatcacttactatgccatgtgtattaaccattcattataaaatggaaactttctcaagaagaatggcgcttttcccaaaatagtaggtgattacatgacttgtatgtacacaacttgcctctgtatgactgggaacgtatttccagactgaattaagtgtatagaagtgaacagaaataagtaaaagtatagctactgaacagaaattagtctaatttgcttttgatactggaaaggtacaaatctatccttgtaccatgattgtggttttgcagaaataatgctttaatataaatcaagcagatatacaaatgtgctaatattaatgatattaaagcaccttagagaaacaagattctgaagaaaagagaggcgtggcctggaggtgggggtggggagtaaattagtagaaggcaatagtgaaagtttcacaactgacatgaagcctgtgacaagacttgacttggaggctgtcccaggctgggcactgcagggacatgcttggctgtgggagagcagtaggagctaactccctggtgcccttgtttagctgtactccgatcctaaagttttaaaggaaacactgtttatgaagacagagaggcagtcattaaccatcccttctaacagttctccaccctcacagcactttgtatcaccttacccacttctattttctttatagcacttgttataattgaaattacagtctttaaattttattttctgtgtgccccattagaatgtgagctccaggagggaacagactttgcctgtcttgctcatctccacatttttagcatcctgaacaaaacgaatatttgttgaataaatgaattagtaatgaataaaaggataaactttcccagtttatcactcccttccttcctttcttatctactcaatccagcccaggttcacgtttcatcttttctacaacatccctttaacagtttcatcagccacccttgcaccttcaatcctttttcatacatttcaccatacttccatggcaaaccccacctgtgtctatctttctgtctctctctccacaaacacacaggcgtgcacacacacacatccctctctgttcaacttttttctacacctattctcctgatgttgaaaacacagaaaaacaatattgaaaggaaattataattattgagcagcacccattaagtataaatattatctcatccttagcacaaaccctcataaacagaatcttgttgcctttccacctcattcatacacatttacttacacaagtccccatgctatccgtctactctccaatctgagatgaggccctattgttccctcctgttcagtgcttatctctatctatgctctgggttttgttcttctccactttcacacagagcttgatagtgtattacacactttctctcctgcatgtctgacatgcttccctccttttggatctttcccattaatatagaaacatagtccaatatttactcattaaaaaaaaattatcctttagagcaactgctggcgcatataaagatttctttttgtggtgacaaaaatgctcttaaattgtggtgatgcttgtacaactctgtgaatatactaaaaactatcataaactttaaatgggtgaattgtaacatatgtgaactatatctcaataaagcttaaattattttctttatttactgtgtttacttcaacatctcccattcataacacaatcctctactttctaagctatttctctaagatcaccaatgacctcttagaaaaatccagtcagtactttttagttcttatttgttcaatcttctttcagattctaaacaaacatattagtaacatggggctatgtcaccaaccttcagtggttccctactgccttatgatgcagttaaaagtattattttttaaagatagggtcttactctgtcgcccaggctggagtgcaatggcaggatcatagctcaatgcagcctccaactcctgggctcaagcaatcctctcatctcagctagggctatatgtatgtgccaccatgcccagataagtttttcatctttttgtagagatgaagtcttgctatgttgcccaggctggtcttgaactcccagcctgaagccattctcttgccttggcctccaaaagtgctggaattataggtgtgagccaccatgccctgctgaaaattatgttttatggtattgaagactgtttaagatctggctcctgtgtctctctctctctcatctgctaacctttacttcattccacatataccatattctctagccatctcttttatctatgtgcaggaagggtatgcagttgcctctgtgtaggtaacttctgctcatgactctacccaatgatcttattcatccttcaatatgcaactccagcctctcattctctggaaaacatgcctggattctgtcagtttgggcttagtacctatcctatgcttgtgcatacatacttacatatatttatctctgtactgaatttatcagattatattataattgtttagttacacttattttcccattagataatgaactctagctgagggagggcagggactttgcctttcaaccctttaaccttattacatgattcgggtttagtaaaaggttgttgaaaaaatgaataaattaatgacctattcatgttttctgctttcttgcctcacttaacaatgaactcagcatgcatccactaggaaatggtctctgataacttctctagtgttaatgttttatgattctttctatgatctaatcagtagttcatattccttttatagctgtgttttctaacccagggatttaactgtgagcaacataagggaaagaactaacacttgctgagtacttatgaggggataggcaccatgccaggcggtttacatgcattatatgtcatctcatcctctgtagagtgggcattatcgtatgacttctatatataggaaacagagtctgaggaacacaactagtaggcatcagggccatgactcaaattcaaatttatttatttgtttgtttctttgttcattctattatatcaaactgcattatactataggatttagcactggtaaatggtatgaaaaggctataataaaagactattcccctcaacctttttttttgagacagggtctcactctgttgctcaggctggattgccatggtacaatcatggctcactgcagccttgacctcctgggctcaagcaatcctcccacctcccacagcacccaatagctggaattataggtgtacaccaccacacccaaacaatttttaaatttgttgtggagatggggcctcactttgttgcccaggctgctcttgaacccctggactcaagtgatcctcctgccgtggccttccaaaatgctgggattacacgtgtaagccactgcgcctggccccatttattttaatgatattcagaaagttttataaattaaatgtgtgtatttattttaatagtgctaagtaacaaagcgatatattctcatttcaagaatatcaaatacctaccatacttagaatatcacaggccatgtttaataaatgccaaatctaatacagaatatatattatatataagtctatataatgtataatataaaaacaaattaaggtgtgatgtgtggaagactatcagttaaggcttaattttctcataattaactacttaggattgtggtaaagaaaaggaagtcaaacttaaagcaaaagttttaacggtctttagcaaaagttgatcataaaaaataaatattaaaaacttatctgtggccgggtgcggtggctcatgcctgtaatcccagcactgtggggggccaaggctggcagatcatgaggtcaggagttcgagaccagcctggctaatatggtaaaacccgtctctactaaaaatacaaaaattagccgggcatggtggtgcatgcctgtaatcccagctatccaggagactgaggcaggaaaatcacttgaacctgggaggcggaggttgcagtgagccaagattacaccattgcactccagcctggcaacaatgtgagactctgtctcaaaaaaaaaaaaaaaaaaaaaaaaaaaaaacacttatttgttatgatgcttcttcaaaaagttaaacttggaattatcacataatccagaaattccatttctgggtgtatatccaaaagaattgaaagcaggcatttgaacagatggtgtacatccatactcttggccacattgttcataatagccaaaagatggaaacaacccaaaatgcccattgatatataaatggataaacaaaatgtggtatatatatatacacaatggaatattactcagcctaaagagaaaggaaattgtgatacattctatagcatggacaaatcttgaagatattacgctaagtaaaataagctagacataaaaagacaaatgttgcagcattccacttctatgaggtattcagggtagtcaaatttatagagataaaaagtagcattgtaattgtacagggactggggaggaaggaatgaggagttattgtttaatgcttagagagtttcagtttgggaagatgaaacatttctagagatggatggtggtgatggctgtacaagaatgtcaatgttcttgatgccactgaactgtaaactcaaaaatggtaaaaatggccaggggcagtggctcaggtctgtaatcccagcactttgggaggccaagggaggcggatcacttgagttcaggagtttgagaccagcctgggcaacatggtgagaccccatctctactaaaaatacaaaaattagccaggcgtggtggcaggcacctgtaattccagctactcaggaggctgaggcaggagaatcacttgaacccaggaggcggaggttgtaatgagctgagcttgcgcaactgcactccagcctgggtgaaagagcgagactctgtctcaaaaaaaaaaaaaaaacaaaggtaaaaatgttcaattttatgttatatatatttatcacaataaacaattttatttgaaattataatgtgttagtttaggtgaaagaaaaaatataattgagcttacacctatattcaaatatatatctaatgtctacatggagtattcccactttgaaatatcctaccaagtcaatttaacatttatttttccattgtctgatcacatatgctgaactcagagtaagaaaagatggtcaaagacaaacataagtcttctaactctctgctgtacaatgctgtagcctctagtcatctgtgcctatttaaatttatattaattaaaattaagcatttagttccttagtcacactagccacatttcaatgtacaataactacatatggttcatggtttattagacagtgcagatagagaacatttccagcactgcagaaaattctagacagtgttcttctagattaacgcacagtaaacttccttaaacaatcattggtgtgtaagtggggacagtggtcaatccagaataaaaataaaaagccaagcacatagagtgactcatagaggaaataactagctgattgagtgtactacttgttaactagccatgacaaacagatataggccaagtgacatttttaatcatgaaaacattgcgtaacctttaatgaaaagtagagctacttatgtcatcttggacataccaagagacaagtcttttaagtaataggatcttgcattgagagaaacagtgttaagcatattttcacagcaactctatagaacattacagaatttcaaaattagaaatacggagattgcatatagtgacacaaaaaatatatactggcatagtaagtacaaccaatttatgctggtacaaaaaacaatatgctggtatattaaatacaaccaatctctttttaagaaattataaaatcagttctacagtgagaattcagttatatatcagctatgtagagatatggataattactacaggataacaggagaaaacaaaaatagctggtatatttgttgaagaattatgggcatttaacagaataaagtattacgttcaaatattgccaaaatgaacaaaaaaaagaaagtaaataggcctatgctattttatcccaacaataaaactatgcagtgttttgtaacactacctgtatgttgctctcacctcaatacctttatggaatcctatgtatattctgtgtcatacagtcaattgatgttctgatcaaataaaatacccccagaaggagtattttcaaaaaactgaacaactggaagagtctttaagagtttatgtgacccaattctctgctaccacagtttttaaaactgaaacatagcaatttaaaacttgggcaatttaatgcaagtgtacatctagtacacagtgcttttgtgtgcatgctaacttatctagcacataagccaggtgataatatgccaatttatttaaatatgtacttacataccttccgcatgatcagatcttagtagaactataaaagaatgcatcaagtgctagggaaaaatggcaaatctcacacattacaaataatgttcccttcaaagtgatatataacttgccccatgaatcaaagctcctggtttcctaaacgcagttgtgttctaaaattgtacagattaaggttgtatcattcaattctataatttttcatatgaagtatattggaattagaaggatgcataattagattagaaatactaaaaaaagtaaggtcttctacagactttttggtgagtgctgcatttgccaaaatcatgttttaagtgttttacttgagaaaataaatgacaagaataaaacaagttcaataacatctaacaacaatttgatcacataggaaagatttggacttcaacccccccattaacttctatgtggttatatatgttcttaggtattacatataaatatgtgttttatcacatttcaataaatttatgctcataatcatatctctttaatgaattattactattttcctacaaaaatcatgagtaacccccaaagttatataaaattataaataagattatttataccttaacaggttcaaatagaaaaagccgtcatcttatattgggtcaaacattttgttggaaggaacctctgggttcaagttcttgctaggtcactgataaattattctgcttaaggcactttacatctagtttcactttcttcatcactaaaatcaaaggatgggggaggtgttctctagctccttctagtttaaatatacctgactataagttgctttctcaattcagataacttacctctctcaacacaggatcagttattgaattcagattgacagctccttcataggtcaagtaatagaacacattgagggctcggacagcttctggtccttgctgtttatagccaaaaatgagatcaatccattggtgaagctggcaggaaacaaattcactctccagggcctgaaaaaaggtatacattgtattactatgctgaattcctttttaaaaatatagagagacatttagagcaatcagtaaagtttaacactaactttactgtgaacaaagatttttaaaaaacaaaacttgtggccgggcgcagtggctcacgcctataatcccagcactctgggaggccgaggtgggcagaccatgaggtcaggagtttgagaccagcttggccaacatggcgaaacccggtctctactaaaaatacaaaaattagctgggtgtggtggcctgcgcctgtaatcccagctattcaggaggctgaggcaggagaatcgcttgaacctgggaggcagaggttgcagtgaaccgagatcacgccacttcactccagcctggaaaagagcgaaactccatctcaaaaaaaaaaaaaagaaagaaacttatctgatgtcctagtttctaccagaatctgtcctccttggtttataattagaggctttccggcacttggcataattaattacaataaatgtgtaagtttcagtatttttctaccgtactgacagcactgaggaccaggactgggcctatcttggtcacatttgtaactcagggcctgacaggtactcgatttatgcttcaaagaaaggaagccatacaaggcaaagactattttgggaaactaaatgtgaaaatgttaaaaatttaccatccacttgaaatatttattatttttctagaattaaaatattttgtagtctatttcaacatgtttaaccaaattatttagttatgttgattgagttcttatgctaacaaattagattttgtgggggatacctataattactgaatttttattctaggtattaatatcaaacctgaccaaatatttgatgctattaacataatagtgtccaataaataacgaatgaacacaatcaagtatttggttgagatgctaggcacaagatccatttcctatccatcattatattcccagctacaagcgttgtgcctaaaacataatagatgccaataatgtttggtgaatttaataacgttataaatactaaagacttttaaaaactaaagatattttttaggaaactatccatctttatattatttaatattgttcaaaatcattccaacatcaaagtttagcattatggattagtttaacgataaataattatattaaaatcaaagagttttcaaacataaactctaaagcttaattaaaagtatacagtaggccgggcacggtggttcatgcctgtaatcccagcactttgggaggctgaggtgggcggatcacgaggtcaggagatcgagaccatcctggctaacacagtgaaaccctgtctctactaaaaatacaaaaaattagccgggcgtggtggcgggcgcctgtagtcccagctacccgggaggctgaggcaggagaatggcatgaacccaggaggtggagcttgcagtgagccgagatcgcgccactgcactccagcctgggtgacagagtgagactccgtctcaaaaaacaaaacaaaacaaaaaaactatacagtaatcccccctcatccacaggggtatgttcttcgaagacccccagtagatgcctgaatctgtgaatagtaccaaaccctatacctatatgtactatgttttttcctatacataaatacctatgataaagtttaatttataaattaggcacagtaagagataaacaacaataacaacaaaattgaacaatgatatactgtaaagaaaaaccataataaatgttatgtaaatatggtctctgtctctatctcaaagtatctgattgtactgtactcacacattttcagaccttggttaaacacaggtaactggaattctggaaagcaaaactgtggataaggaggagactgctgtaccaacttatatctggtaatgtatctcattgaaattgatttttatttttagagtagtaagtctatgattgtgatgtattttcagtatggcttgctgctatgttataagagatctgttggttttaaaacaaaactgaccaacttgtatagcaagtaaccaatgagacataaaccatcttgtgacaaaagacgttcctattcctttacatgtggacacttgtgtaaagatacgctttattaaaataagtgcctatgaaaaagaaatgtttatagctaaatacaaaaaaaatttcctttaatatttaacatagctttatgatatatcacaaatataaaattgaaaatataattttgtaaacaaaactctatgcaattctcacatcccaaagtatactttaaatgaaatatgccttaaaaatacttagctaggttcaattgagaaagttattgttttagacatctcttctaaaatgctttacatttacaaatttattaaacagatatgacagcacaaaactgcttcatattttacttgaaataagaagagaggagcttgtgataactttaagtaaatgcctattttaagtacataaatttgaaaaaaatctaggaactactaatgcaagttacacacagaaatgatacgttggtttcattaacttagaccttgggtagggatgggggtatggggtaggcacatttacaatgacacataaaaacagcaattgtcttaatttgtgtgcagtgcactctacacaaaagccctaaatatgttcaaattagagcaagctgcttgattgtcactgcagtctcatgtcacattaatgcatgacaaacattaaaccatacacttaaatggcaatttatatcatttaaatgtttactgccagactagctcatcactcatttaaatgtgactttctgacagctaatttcagttaattttctccaattcacttaattagaactttcaatcagggaaggacctatgcatatcttcaggcttacatcctttttggtggctgttcgaaatctgagttcataaactgccgaaaagctctactataatagattagcatataatatctctgagtttacaaaaaatatgactctatgaagagtatatactcacagtatatactcttagaaagaacttatacttatttatgtaaatagtactcttgccagtagtttaaataaaaaacgtgtagttcatatacacacactattgaaacaataaacaaaccctgcatccaagctaattaaaaattaatgatttcaaaattgtttaataagataaaacagtcaggagtctcctgagtgtccatggtgttgtgatttgagaccataaaattctagaaggctcagcaaatgacaaagtacaaatgaattttctcaatattaaagctctaaaaactagggcaattttattttatgtgtcaccaaacaaagaactgttgaattttccttacggttgactacttctttatgcacactcaaaatggtaaagttggttagatttcgatgcttaaagctttacatcttgatactgcatcagaattttaagcaaaaatgctgaaaggaaagctaccgtgtgctcatatcatgctgcaaacacacatgcagagatcaccacaatgccatggttcagacctcaccttacattgtcataggtcagtccttaaggagttgaccagtaattcgcggaactattggcaaaatcacttccagaagttgataaacacgttaccttcatgaatatactttaaataatttctcaaacactcaactaaaaattccattagtcagcttcaagcatgtcttgcaatataccaaagctttaaaaagggacctaaaagaacaaagtggtaagtataagagaattccaagaagtttcaaagtcatttcagtacaaagtcagctccgaactttaacatccttttgctatcagtgaatgacaactgcctaaccaaaagtaggtaatgcacttaagacttgaggggagagagaaggacaggcaggaagaaattaagggaaaaaatacaaacagaatgtaattcaaaatggaataccctgaggttgccttttataactcccatttttaagatttaaaaacataaatcataaaacctatattaaaatagcttttttatatattaagattttttaaaaaaattcttcatatatagaaaattctcatttagatctacatttttagttacaaaaaaatgaaaaatgccagtggaatgctgagcatttgagatttttcaaagccttcaaaaccgacagtcctcattaagcctggagttaaatacggtttgcagctaggggatagtaacattcttcccatgctgctctcaaacctaaccaatcaattgttagtactcccctagcaggctgcatacatcacttacatccaatgtgtgctctgagtaatatttgtaaaaaagaaaatccactaaaatgtccaacacaatataataatattcaactcatctgagttattataaaataaatcagtgactaatgtccaattgttaaggatcagataagactatgaaaagactatcatatgaagcctcacacgaatgttcaatccaatccagggggactcatattagtgttgacaaactgtcttggcgctgatatctgttttttttaatgagatctattaggcagagtaaaatacttcagatatgctaaaaagtacagtatacagatgtcaaatacacttattactaactttcatttgtttgttctgcatacagaatatcaacaaagttttaatattataaagataatagtaaattattcataaataggaggtttgtataaccctgtgtcagaaataattacaatatgtgtgtgtgtgtgtatatatatatgtgtgtgtctgtgtgcatgtttagcaaatctcactgaaagaacacaatctatgctttcctgaaactaactcacttaagaaatagattatttctttataaaaagtgttatataaaattattattttctatagtggagtcaaaaaatgtgataacatatagaaacagctttttccaagaaactctaagctatttgagaataaaaattctaaactaaaaggcattaactatgtatttaatctacacatgcattagtgatacactagcaatttccttttattttcaaaaaaccaaatttttgccaatgtaaaaatcaagaaaaccaatttcaatcaacaaaggaaattattagataattgtttacctcaagaccaagaaaccttatttgtttattatttatgtttctcatacttgtcattcccagcttaatgctaatatttacttattctttggctaaacattctcataccactccattaaaaaaagaaactaaataaaaactagcaatatctatgggataaatgatttttataaaaagttaaataaaaagatcaaatattctttatacactttttataaccagagagaataggcctaggcagcccagaaatacatttctgcacacctgtaccactacttccactcccaggcttctagaaggcccaaggtacaaaggttctgagatacaaaataccatagctgtaagtttcaaatgagaaaatgaaaatcactgattaaccctcctgacttgaaatacatttacttataagatgtatttaatcgtatttataatgaatgaaacatccattttgtaaaattttaattgtacttataattaagagtcttaattcatttgaacatagataacagtatgttttaaaggaactgacattgagattggcaaggcggtaatatacaaagttataaacttggaattttaagtatttttcattttaaatccatgtaatacggccttcttcctatacaaacacatatacacacagagatttaaaatgaactggtctgttatgtttgcatgtgttggatttcaaacactagtggtaatgtttccttaacattgatatatgacctttgtaatttacattgaagaaagctgtttttttcagcctaattagaactgtttcaaattttcctgctaaatatatgatataaagtcctttcaacttttttattctagagtttctttccatgtcaactttgttccaatcaaaatatgctttgaattaaatgattttgattgaatatgtggatcacatttcacttctaagatgtaaagtccaaaaaggaaaagtttagcctgttcaaacaaagcaagagcagccactttgcggaaagctattcacatttaagaagactgacaaattgtttgtgtgcaccattaggtctagtttctgcaatagttgccagatttcctgtccccctaataagatgcattaactccttaaatgctggctctgaatttgcagtgaatctgagttactttagcaaatttcaattttatctataggtaaatttccttatttgaaataaatctaaagaaaataaaagaaaatttgatgttaactatgttgtatcaaaattttctaacaaaggtcacagaaaattaacattttttcatattggttggatataaattcagaatacaaatatgttttctatatgtgacttgccagaagtgacaaattcacatcaatcctcatttaaaaaaaatgcatcaatttcactaatttaaagattacatcttcaggtaaaacacaatggaaatatttaataaactaaaatccatgaatatgagcatcaatttcctccacattgattatatataaaacacaatgcttcagagttcagctatttaccttaatatacatatatatataatgtgaaacaagctttatcctatttacaaagaaaagtttaattttgagagcttaaaaatatgtgtgaaattgtgacattaagatcaataagtcatgaagcccaagaaagtaaaaatggaggatcaaagatttagggaaaaaactgtgggatgctaagaataaaaattgtatcagacagttttaaaaaatgaaatttagtcaacaacatactgaagttcagcctgaaaagcagatagagaaatcactaaaaggggttctatacttctaaactgcccttgaactgttgggcagaagagatattttgagccagcagtacacagttcatttctacatttatatcattactaaagaaaagtgtgagttagtatcgtatcttgatataactatcaagcactcgtgcatcttttggcaggagaatcattctgtctacgattgttattgtgtagttttaaatggactagtcaaccagctgttatatattttatacactgaaggccatgtttcctttgaaattcatagttttaatctcaactgaagtctgtattgctgtgtgccaagatcaaaaggattagacaaacttgtacaattaccttcctttacagagagatgatttttaaaaaatgtttaaaatactcctatatactgacattttatccaactattttctttagaactacagaacattaaaacatttaattaacatttcaaccttaggtcacttttcatctaaaatctaggaattcacaacatacagatatgctaaactaattatagtatcacacacatagggatattgagcttttttttttttttaaaaaaaacctttagtttattaaaaatggatggggaaaaattatacctatttcttttatgtgtttgcattttgcaagcctttgctcagaaaataattcatagagcttacagtgatatatatgcagcaagatacaaaagagaagtgaggcaatgcaaaatttaaagggagatatcacataaaaactatgccatgaaatttcaaatacttgttttaacaaatctatatatgctgagccatgtatttgctgctaagctttctagcaggcaacataaagaaagaaacacgaacaattacaggagacaaaaatgaccataatgtaaaaacaaaccagatggcctggaaaaacacattatttctattcctgagataagaaattcctcccttggcaatatgatggaatccaggtatgtaactctcagagggactgagttaatcctgagatagatttaaagtatagacaaatggggagaccacatattcttcagataatcttgcacaaacattatttctcttagaaaggctttgaatggtaggttctagattgtgcttcatgacaagtacctggaattaagctattttattttgttagttaaatgcagagctaatatgctttgataacaggtaaactgagtcccaggactaataacctcctaagaatgtgaagagtataaggagaaggacacagcctgtatgaaaggcaggctcaccattacttggaaggtagactagcctgccttaaaacaggctcaaaggtaaactttctcacatagataaatatgcatcaaaaacttccaaattccaaacatgatgctgtaatatttatagacattaaaatgtttaaaacaggtatactagatgttcaactctttaaaaaattagtaaagtatccctagaaacttaatgttgaggactttatattgctgttatattttctaagataaactagttataaacatagacataagtaattaaaatattaatttaaagtggtcaattatccacctaggtatagaaaaatgaatgtttcctcttcagcagccatcacaaaatgtattaatttactgtatgaactcctgtaggttttatattatatagtcagttacaaaaggaaggaaaacaaaataaaaaaaatttaatcccttcccatttgcttatccatatagatctgataaatactagcagtctcttgcctttgaagatggccagaccagaatctctacttattgccagatgtagtttaatcccatgaggactccagacaaaaacaaggagctgtctgcatggcaccaatgattccctggactgactgccataaacttatactggcaaatcaaaatccttggcaaagtagaacatttattatgtcattactcctaagaatatccaataaagaaaaacttgaattaaaaaaaagcaaaagttgctgaatataaagcattaagttctgccagagaatcaaattacatctgcatttactttgtgtatgcgattgcatacttgtatattatataggactaaaagtattatacattctgcaactttctattaatgttagcatctctctcatctattcattcagtaaatatttattgagtggttactattggtcttgtgctagactctggggatactgaaatgagacatccctttggaagaaggaaaggggagcaaaaggtcagctctaagactactttcatagtctaagtgagaggtagtgagagccttaatcaagaaagtagcatccggagtgaagaggggacagagttcagaaagatttaagatacaagttattacttacagcaactgattaccagtgtgaggggtgaagaaaaaggaattttgggtgatcagtttgaaccttaaccatactagaggagaaattgtttacatggtagaagattagttgagttttgaacttagtattaatattttggacttccttttatagacttgaaattaaccctttgttttggatctaaggctgagaattttagtggaagtttgtacactattaaagtattaaaatatgtttgaccaggcgcagtgggttacacctgtaatcccagcactttgggaggccgaagcgggtggatcacgaggttaggagttcaagaccagcctggccaacacagtgaaaccccgtctctactaaaaatacaaaaaattagctgggcgtggtggcgcgcatctgtaatcccagctactcaggaggctgaggcaggagaatctcttgaatccgggaggtggaggttgcagtgagccaagatcacaccactgtactccagcctgggtgacagagcaagactccgtctcaaaaaaaaaagaaaaaaagaaaatatgctcatgttcaatagtggaatgcacaagccaaaaaaattctgtgtaacaaaatcaccccaaggattttataccagttttgtccaacagatatatatccatgccagatatgcaatttaaaattttctagtagccacatttttttaatttataaaaaattttttttaaaaaatgacacagggtctcgctgtgttgcccaggccagtcttgaactcctgagctcaagcaatcctcctgccttggccttccaaattgctgggattacaggcttaagtcaccatgcccagcctatagtagccacattttaaaaagtaaaaaaaaaaaaaaagtaaaactgttttaatgacatggtaatattttatcaagaatatacaaaatatcatttcaacatgtaatcaacatagaaattattttgtattaaatctcagaaatctggtatacattttacacttacaatggacagcacatgttgatcacactagccacatttcaagtgatcaacaaccacatgtgactagtggttatcaactggacggtgaggctttattcagttccaaatactgaatctgcatccagattttgatacaagacagaatgcaggagttaacaatacttaacacttttaaaatacaccttatcttactgaaaataaagataaaccttacaaagtacgaagtaactgccagactaaaatgaccttcaatgcagttttgaagaggccattacaattctcagtgccgtgaagaatggctacaccttaggaaatgacagcagaaatgtaacatcttcaagtgtgaaacagacataatgtcctacagtgtatattcttcagccatttatagatctctgaggaaatgtggcagcatctgaaagacggcattatgactatcctctaaataataaaggtaaaagggctaattctaccaactatgctgtaatctataaactttccatccttaaaggtccttagttagagttcttaaattttggctactcagctctatcagttatgtactttaagaattaccatatagccatagaccacaacttagtataggggacataatctttgctgaaagtcagatatatgacatctgtaatgtgtatgtattcacaaaactcataaaagacacttcattttagtagcagataacgagtctctgtctactcctagagattttttaacatctacaataacattctgattcccaaaattttgggtctgactctttctgcattttcgattaaataatgattagttaatagggtcagtcttttaaaattatttttaagtagccatgaatacatatgcaatatgaggtcaacaatagagacttcttgcaagagttaaatacatttcttatttatgtttccttacctccctttcacttcttaactagtttctcctctttctgttacaggcacaccactgaaaatgtttttgcaaagattactaactgtctgaatccagtgtatgctcatcttttctcatttcacctctgcattatggtgtttgtttctctttcttcttctcgcttgacactctctctccagattctctttctacatttctgattttcctattcattttcttaatatagggtctttttcctctaacatttcagcatttattctcctcaagattcagtcccaggccctctgcctctggtataacccaggctagatgagccacacttcaattacttcaaccaacaattactacctctctggagcttcaaatacaaaatgccaactgcccatcatactacttttttttttttttttgagacggagtctcactctgtcgcccaggctggagtgcagtggcgtgatctcagctcactgcaagctccgcctcccgggttcatgcccattctcctgcctcagtttcctgagtagctgggactataggcacccgccaccacgcctggctaatcttttgtattttttagtagagacggggtttcaccatgttagccaggatggtctcgatctcctgacctcatgatctgcccgcctcggcctcccaaagtgctgggattacaggcatgagccaccgcgcctcgcccatcacactactttttttggtgtgcttcacataactcaaaattaatatatcaaaaaccaaatgaatagtatttcctctgacacttgctccttttcttgtctttctggtgagggactaggtccttcatctagtcagccaattcagaaatgtggcagtcatcttgacttctcctttcccctctccctacaaaattttatcagacaataagcctcctaaatatcttcccaagtcattctttcttttcctttcactgggactacctttggtttcatgcttcatgatttctttgttcagttattctatcggtatccaaactgtttctttatctctaaaatttcccttttcaatccctcctccatatgaactgctatctaaaacctagccaagtcactgctctccttaaaacttttctcctttccctaaagcagtggatctccaactttaacacacaccaaaattagctggagaacttgttaaaacaggctccaatccacagtctctgtttcagtagatcaggggcagagtccaagaatttgcccttataacaagatctcaggtgatactgatgctgctggtccaggaactccttttggccaccacctccccaaagaaaaaagtccatactatttacgaggcattaaagatttatcgtacaatctgcctccagccatatatttccatacacaccacccacagttctctcaaacacatacttcagtctaccatctgaattaagtttagctcatgtggctgcatgcagtggctcatgcctgtattcccagcacactgggaggctgaggtaggtggatcacttgaacccagcagcttgagatcagcctggcagcctggcagcctgggcaacatgatgaatccccatctctactgaaaatacaaaaaaataaaaaataaaaaatagcaaggcatggtagagtgcttgtagtcccagctacttgggaggctcatgtgggaggatcacttgagcctgagcagttgaggctgcagtgaggtgtgattgtgccactgtatgccggcctgggtgacagagagagaccttgtctcaaaaaacaaagcaaaacaaaacaaaaaacagtttagctcatgtacagtactataaccttgatatctttgttcacagcgcttcttatatctgtaatgtccattccatcatcttactccctgcctggcaaacccctattcattctcaaagactaaggttacatatgggttccttggctaagccttcctcaaccttccccagaaacagaacaaggcatttcctcttttggtcccagaatatatatttattctctctctttctctctttgtgtctctctctacacataatgttaaatgctttcatggtaatcttgctactccttcatggtatatatacaagtatatttattatattacatgttatcacaagttatatatttgtttacttttttatttattatctatttcccttacaaaacaataaattccaaaagggcaggtactatataccatctttctcactgctgtataaccagtatgtagtaggtactcacaaaatatttgtagaatgaatgactatatcgcttaatctatttctctaattagttactgtcatgtctgtctgcttctcataatggcagccccaaagggcaggtgtcacagtcttccaattttgtgatcacagatctaattatccagtaggcccctaatacatgtctgttgaatgaatgaatggcatttaagaaattcttctgatttaccgcaattcaatgtctatgctgagggactagatcttaaagcactgtttaagaagcgtgaaattgaccatagccactttacttggttgatacagtgctggtttggcagagttatagaaaatttgaaaaatttctgtgattactagccactgcaaaatgagctgtctgcagtttgttaaccatacaatcaaatttgaggtagaatgattacatgggaaggaaaaaaaagtgaagtggatattaaagtatcatctttcaaggttttattttctcttcaatagtgtccagaagacagatgcaaatgatatccctaatacacttgacaaaagctcaagaaagtcagtatgttatgcaaagaaaatgcatctagaggtcaacttgggggaaatgcactgtccaactaaacaaccaccaccacactataacaataccagcagcatttaacatttagtgagtatttatgctgtgcccagctttatgctaaatgttttacatggactattttatttaatccttacaataatcctataagcaccacatttttaaaaactgttttacaaatgaagctaagaatgcttaagcaaattgtctgatgtcacagctagtaaatgtcagagttgtgacctgaacccagatttctctgactcctaaagccatattaaccacaacacatccttttgaaccaaagctgcaatatgaaaactctaaaaatatgaaaccactacataacatggattacttttcattggtttcacatatatcatttagaaatactagtaacaagtattgctgagtatatactaaatctggtgtgccatgttgatctggaggctttatttacaggttttactgttctttcaactggttttttgctttgacacatgcatttttaaaaccaatactttcaacttgtattacagcttatttttctcttttattaactggaatgtaagctcctagaaggtatagattatacctgtattcttggaactgagcatatagtagatgcccaataaatatttattgagctggataagaaatttatattctaggcctctttttcattaatgtaaccatatattcactataatattttatatcataataaaatatcataaaaatgtatatcataaatatatatcataatatatatacacacacagagagaaagtgtgtgtgtgtgtgagagagagagaaagagagagacagggtgtcactttgttactctggctggagtgcagtggtgtgaacacagctcactgcagcctcgacctcctgagctcaagtgatcatctggcttcagcctcccaagtagctggactacaagcatgccaccacacccggcgaatttttttatgttttgtagagacagagtttcaccatgttgcccaggctggtctcgaactcctggactcaagcaatctgcctgccttggcctcccaaagagatgggattacaggagtgagcaactgcacccggcctcattatgatattttaaaaataaacagcctttagagcaagacagagaatgataccaatatattagttgctaagtccaaagactcttaataaataaccaatccattaaacaaaaaaactattttaggaatagttaataataggagttcattctgcaaatttctaaacgtccatgacattagcaacttatgaaaatgtgattttaggctgggcacggtggctcacgcctgtaatctcaacattttgggaggtcaagatggacagatcacctgaggtcaagagttcgagaccagcctgaccaacatggagaaaccccatctctactaaaaatacaaaattagctgggcatggtggtgcatgactgtaatcccagctactcaggaggctgaggcaagagaatctcttgaaccagggagacagaggttgtggtgagctgagatcccaccattgcactccagcctgggtaacaagagtgaaactctgtctcaaaaaaaaaaaaaaaaaaaaagtgatttcatgtattttaatttctatattttgacacatgaactatttgatttccttaaatcaaactactatgcagaaataacagagaaaatttctgttatttcctacttaaacattttcatgtaactacccgattggttctacgtttctgttaatatttggaaaataccttaaatacttccacgtaataacactgctcaaactattcaaaatattgattagatttttttattttaaaaaatgtatagcacaaacattatttgtttttgtgattttaatatctcttaaatgtaccatttgacaaatgcttttaaattaaaatactataactgataagaaaaaacagtctcaaagaataaggctgttttgagattttttttaagcctttcagacaacccctatgatagctggtaagacatattagaatactataaaatatgagttagaatcactatctttattagattaggagaactgaataaaggacataactgtattcactctgaggctactattttcctcctttgttcttcaaaaatataactctttttgtagaatgtctaccactgtagttaaattcaactcataggatgcagttataggtcagaatctagcaaaatatattagaagcaatctaagcatttaaatttttcttaaatatgaggtgaaaagacaaacagcatggcaagagttaattgaaacattcctgtttgagagactgcatggaggagtgggggctggtggacagtgagaggagggagctaggccgagagatgcagagttaatcagggagcaaatccaaagccaggcatggataggcctcactaatgagcctcaagtaccctgcagtggttttcaaacttaactggcttcaaacgatgccaccccatgacagaatgcagctagccataagaggagggtgattagaataaatgactggagtaattaactctgatgtgaaaccacctgattggaaaagagaagccaagagctatttagctgatggtcctccagtagaaaaaggaagctttccctttctcttgtgtgggtgttcagttagaactcaactctttcaagtaggtatttggtagcactaatgaaaagcagctttcattcaagggcctctcaagggccttcccattcattttgaaaggggaagaaaataaaagcttcaaagtagaactaatttactttactcccctacctcttagtgaattttgcattagtgaagtctgcattagtatttatgctaacaaatttacctccaaataacgtcatcaaatactaaaaattttatttatagaataactagatattaaggctaattaaaattttttaaattttcctttctttaaaagtgttttagaaaactaaacttataatttataattaattgttgattagttacagcacttcctttactctagaatgagggagaagtaaaacataaatggggtacatctgtttttgaagagaaaccagagaataaggtggaggtaaggaaagaaagaacacatatttttgcaaaaagacagttttcttacagtgcaaattgagccaaagaatccaccacactctctggcctgctttattttataaaaagaggaattacaaagacttggggcattactgcctgctgttttacaagtaatcatcaattcattgggccaatgttgttctgtacctgctgagttaatgttcctcggcacacccctcccccaaaaacaggttcacaagctgcccagtaacaactacagcgtaagtagcacatgtaacttagcaaatgtttatgccgaaactcggatttatttgacagctttacacctttgggcatgatataattaaatgttttgacagctaaacaaaaactgtataaatttaaaagctattaggagctcagcatctagaatcaaaatgaagtaatttgcttataccctaagctacttttagtaatgcattccaataaaaagcatgaagaaagggataaatgtctatccgaatgttttagctaattcgttcatattcttctatgaagaatattctccttatactgataataaatggcatcttaaaaaggcaacataaacgcatttaagattgtcaatataatccctaaactctatctctggatattttctgtaactttagaaatggtaatattaaaaagacatagactaagaaatagtatattactgtatttttaaaaggccaccatgtgctataaaaaaggattgaaagcaacacagggacagtgaggtatccttcaaactcagccattaataactcaagggggttaatcctcattctctcaaggtgccggttccagattttcacaatatgctatgctgctgtagtcctccgagatttcagtgctcacttcataatacccccaattcacagtttaccttcggagaaaactactgttcattatctgagctccagaaaatgttcccatcagtggtactactttaacacaagatttaaaaactcagatacttccttaaaaaggaaaaaaaaatactataaagcaaaattgtccattaaactacaattttttagaaaatgaaaggttgttttatacccaccatatggcatcacattatcactctggacagcacatacagagtactggctaacagtctaacaaaagttaaatttaaacagcatctaagttagaacattactgaagcattttcaggctatgtatatacaaaaacatttaaaatttacttttcattatgtaacaatctaaggaatactgtatcttcactaaaggtaacaacgatcagttgtttatttaaaaaaacaaatcactaaaatgtttgaaaaccagtccacttttcatgtggatgtttatatttcacttaatcatccttcttggaaagacagctctaaaggaagaaaatactgagaaccaaatcctgtttaacttacacaaggtgatgtcaagtaatttaaaaaacatattctaaaaagagcttcttctgtacacatctaaagacattactgcattatctaattgttctcttcctctcactcatgttaacaggatagatgtctttttgtgtaccatatttggtttcactggcacatagcctgaaaacagattaaactgtttggagtgttcaaatatctgatggtgtatggactgtgggaataagagactggagactcagaagctgatagttcccaaacagctattttccttctttcttttttaaaaataaatgaaccttgagtcagattaattaaacactggttataagactcaatattcctagtagataaatagatgtttgaagacttagtcaatttcaggcccaaaagtaagtattactaggtgtaaaatttgtttaaaagatgtcattaaaatattacatattaaggtggtcctcttaatataatcttgatgtcttttaactatctcattctttctcttctccatggacatcatgttttgcaaaatgttatcaaataatcaaatgttataaaataatctcacaaagatgcatatatctgccagaccttctgattaggagataaccagtggtgctaacctgatataatttagctgaaagcacaagaaggttgaatttaacccaggttgcctttttataggtaaatgtactatgttcagaatgcttagaaattgctgtggtggctctaatggttcaacaacctttggctgagacccactgaacacatacaaacatatgatgcctaaaaaaatatactttttttttttagaccaaacacctttgtttcaggtactgctaagaaatataagagctgcaaaataattataacaaaatgcttacttatgcagaattttaactttagattcattgaaagaactatcaaactttttgacagattttgctaagtattgtacgtatataaaaaagaaaatataaatgaaatatttgtaaaatgtttgagagtctacctcttctgaaatgcttcctgattcaaaggtgttgatttctgtgtttctccatatagtactgtcctccatgcctttataagagcattagtgaggcagcattttttaaagagtcctccattattacatttgaacttttcttccaagtatcatactacaaattatgatgctgacatgttcttgatctttttgacagccttgtacacgtgccttagggctcccagtgctttcttcatgactgctcaatttctagcctcttctagtttaactatgatacttctatctcaacgcctccactgtgataactctatcttaaaacttaccaaaatacattaagaaataatgttttgtggagtggaagacagtttggcagtttcttacaaaactaaacattctcttaccatatgatctagcagttgcactctttggtacttacccaaatgagaggaaaatttatgctcacacaaaatccttaacataaatgcttacagaagttttattcacaattgccaaaagttggaaacaaccaagatatattttagtaggtgaatggataaacaaactatggtccatccatacaatggaatattattccaaaataaaaagaaatgagctatcaagtcacacaaagacatagaggaatcttaaatgcatgctactaaatgaaagaagccaatctgaaaaggttacatactatatgattccaactatatgatacattggaaaaggcaaaactatggggactataaaaagatcagtggttgccaggagtggaggaggaagggggaatgaataggtggagcataaggaatttttaggacagtaaaactattctgtatggtactatacatttgtcaaaacctacaggaagtctaacataaaagtgaaccctaatataaaccaaagactttagttaataataatgtattgatattggctcatcagttataacacagtaagtgtaccacactaatgcaagatgttaataatatggtgtactgagatgaggaatagtaagaggtatatatgagaactctctaaaggttctgctcaaattttctgtaagactaaaactgctccaaaaaataaaactgataattttttaaaacatgatgtttatatttttctcctcttctttgtcttccaaagaatatctcatgcctaagaaagttgctggcacatattatgggtttcaattgctactttctaaagcgaaaggagtatggaacccaaaagaaggatctcaaacccttcattcccaccaaatgtgccacggcctacagagaaagaagcattaattaacacatttaattaattaaactcacacttttcatatcacgtatatgaacatgttctagtatcaatattaatatataatctatctccttttcatagtaggttgaaaagcatgagctgcaagctactaaatttttttttttttttttttttttttttggagacagagtctcactctgtcacccagcctgcagtgcagtggcgtgatcccggctcactccaacccctgtctcctgggttcaagcgattctcctgactcagcctcctgagtagctgggattacagtcgcccgccaccacacctggctaatttttgtatttttagtaaagatggggtttcaccatgttggccaggctggtctcaaactcctgacctcaggtgatctgcctgcctcggtctccaaagtgtcagattacaggcacaagccaccgcgcctggccgcaagctactatttatctaatatttatatctcttattatgttcagggtactctggctgtgtcctgtgggataaagacaaatgaggcattctatacttgccctggaggaactccagtctaatggagacacaggaaaacaagtatgtccaaaggtacatggaaagcagagagctgagaacataaaacaagcttaagcaatattatataacttattttataaatatataatattaaataatgctattttctatatttgttaggtaaaaatgtgactcacatgaattaacactcaagataccataaagcttaaagttttaaatgctgtctatattcctatcctaaaaatatttcctcaaattatccttaaacaaattatgaactgcctttatgaagcatatttcattttcttcaattatttcagcctttggttcatagtcctattccttgtcatcattcttgatagcttcagcatttcatctaatggttcttctctggaagccttccttttctactcattttagccacttttaagcattaatgtacctttgatttaataagccatgtgattcaagtctgcatgaaccattatctcttattctatcagttaatttttctgtcagatgctcgttatgctaacttcttgtgactccttttagttcttaaattacaaagataatacaataaaaacaaccagtaagtgtttgcttactatttatttgagtactgtgataatttctataaataatatcaattaattctcaattttatgtctccaaagtaggtgcaccaaaccactacaccgtattttatttctgtataaaatattattgaaaatgttggctgggcatggtgacgcatgcctgtaatcccagcaatttgagaggctgaggtgggaggatcacttaagcccaggagttcaagaccagcctgagcaacatggcgaaacaccctctctacaaaaattagctgtatgtagtggcacacgcttgtggttccagctagtagggaggctgtgagcccagaccatgccactgcactccagcctgggtgacagagcaagatcccatctccaaaaaaaaaaaaaaaaaggaaaggaaaagaaaaaaaatccaaaagatctggagtcatagcctgggtaaaatggttttgaaatcttgggcaatacttaacttcttaaagcttcaatttattcctcatttaaatgtaaaaacaatatgttccttataaaatatccttattattaaattatatgcctggtacgcagtaagttcttactagatattagttctcctcctgtgatggccagcctccaagatggcccttgatgattttcatctcctatactaagtacagctgacctgtgtaagcaataagatagtgcagaggtgacagtgggagttcgaagactagtcataaaagatattgtggcttccctcctcctctcttttgaatcatttgatctgagaaatgctccatatggtgaggatactcaagcaatcctatggagagtgtcatgtggaactgaggcctcctgccaacatgtcaacaatgcgagacattttggaagcagatattccaccctcggtcatacattcagatgactgcagcctcagcaaacagcttgactacaatctcgtgtgtgtgtgtgtgtgtgtgtgtgtgtgtgtgtgtgtgtgtgtgtgtgagagagagagagagagagagagagagagactatgacccagagccacctagctaagccactctcaaatttcttactcaaagagactatgagaaaaaaaaaagaaatgtttattgttgttctagctgttgtatttttgagtaatttattacatagcaacaaacaaccaatacaactcctggtccatatttttctcagacctgctttacctgtttgaacccacactgaaccacatggtggttattttcaactaggtttttaagatgtaacctagactctcatcaacttgactgctctccatacctactttgttaatccctaatcttggtgaatcccatgatctaattttctggcttctacatatgggctgccataatttgttagagaaaaatcaaaacatatactaataattttactataaatccaagctatcttcagctgaccctcaaaatactcactatttttgtgtttctagttcactaacatcatatttccttcagtagctgccctcaattacacagctgccacactttccttctcagaagagtatctggctggcctttgacttcaaaatgaggacatcattaaatttttcttgatttttttcttctccattgcataatgtttatatttcaaccttacctctcctcttttccctgtgtttggagtagaaagtgttatccactttctatattaattcagtgccctcataccatctaaaaatatgctatgtactggttttcagtttctccccttctaagatattccttttctgagactattatctgctccagattctgctacctaaaaagaatttattctttaactccactaacatcccagaatcacctcttctttcatggacaccatacttctcaaaagccacgttcacccactctgtaatcttcactccttcactcaattccttgaaatctagattttaccacaaacactccatgaaaacttccaatactctcccttttatgtacggatgaaacgtttctccctctatgagagtgaactattgtggcagagactgctgttttttatctgctaaccactccttattttctttaataataaaaatttcacttagccagagacacatttccttgtctcccttataacctgataaggccatgtgctcaagttatggctaatgagatataaacagaagtaatgtgttccacttccagttgctcatctcaaaaggaatgggcatagttcctttccttcttcttactggctatgaagtagacccaccttgaacccagagatgggagtcacatgttatagctggaagattcattctcagcttcagactcctgctctctgtactattacatgagagaaaaacgagaagatataaatgatactgcaggttgggcatacctaatccaaaaattcaaaatacgaaatgctccaaagtctgaaatttttttgatcaccaacatgatgctaaaaggaaatgcttattgaagaatttcagatttcagatttttgaattagggatgctcaaccgtaagtatagtgcaaatattccaaaatgtaaaggaaatccaaaacctgaaatacttctggtcccaagcatttcaggtaagggatactcaactggtacatataacatatcaaaagtgtataattcttaagtatgtgaatgagaaatagtaagactccaaaatacagttgcttaaacatccgaaagaatagcttagcctgaaccataactaatatactcagtgtacggtcagggtcctagcaggaaacagaagacataatcagatgaaaatctgaagataatttaataaaggttctattcacaaaaagcatcaagggaaccaacaaactattttgagaaacctgcaggcttgtaacaacaagagggcatataacccataagcctgtaagagtaagggggggaattagtattactgaagctcgttgagtgctaaagctatagaagggaggctgtctggctgtagctgtagctttaactattgctgtagagggcctacagccctgaagcaggcaggaagcgggagcaagaaaaaatgtgaccccgttctcctcctgcagtcctgtctcctgtttttcatagtgatcagccctacaaggcataagggggacagaagggagttgtgggtaatgacctggggggtaatgctggaggataatcagaacacctattaataaattaaaagtgtattattacatcaggattggctacttttgaccacgctgaagcatatttttaaccatccaattcctcttgaaacagtctctctacttactttttttttgttttgagatggagtctcactatgtcacctaggctggaatgcagtggcatgatgtcggctcactgcaaactccgcctcccgagttcaagtggattctcctgcctcagcctcccgagtagctgggattacaggtgcgcaccaccacacctgtattttttttttttttgaatttttagtagagacgggatttcaccatgttggcctcaatctcctgacctcgtgatccgctttggcctcacaaagtgctgggattacaggtgtgagccaccaagcccagcctctacttactacttaacactaatgcactcttctatcactgctcctgataccattttataggttcctctttctcttcttgttttctgaaagaaaactatttcccagggctctgtttttggatttttgggctctatgtggtattgcagggtgaagtcataaaccctctatcttcgaccatcactcactatagataagcaccaaatctccatctctaacactgatctctcccctggagctagatcaaaggttgcatatttaagtatctatggaatccagataggtaaaaataattaattaggcaaacaatataacacattagagagagagaagggctgcagaaatctagaaagatatgcctacctatatctacaggggtggctattgctgagttccagttgattttactatgaagtaatgcaacccccacactgtgtctaacttttaaagaaaggctagaaatacagatttggaagaaggaaaggtgtccttattttactttttttttatggcaactccttttattaaaatattaggtagtttatctcagaaataaaattgaaatccctataactaaaaacactcagcagtgatgaataaaacaaaaatgtttttaggtcggcacaaaattgtggttttcgcctaaataaaataaaaccttttgattttgaaataagtttagacttccagaagaaatacaaaaatagtaaaagagttcaagtatatacccttcactcagcttcccctaatgttagcaacttatataatcaaagaaatattagcaaaaccagaaaatatgtactaaaccatggttgtaatgtgtaaccagcttttctccaatatcctttttctatcggaggacccaacccagaatcccacactgcatttagttgttgtgtctatcaattacaaaggaaaaaaaataacaaataagtttttaaatgaacactgtgttagaaagaaaacagcaaaagaaatccccaggagctataaacaaacaaacaattgtactacagagtggtaaagataaccccgggtgtttttgttttgttttgttttttcttttcttagtcaaagtcagctaggagtttgtttttaatgcccatatggaaaaagtagatgagaccttggctcctcttttaggttggtggaagtgaaatttccctatatataaacctgggaccctcaaagaaaccatgcccacagggaaaaggtcggggtgggagtgaggggaatctacctaccagtcaggacttaagaaaaagaggctgggtgtggtgactcatgcctgtaatcctactactttggaggccaaggtcggggataacctgagtccaggagttcaagaccagcctgagcaacatggcaagatcccatctccataaaaataatggaaaaaaaaaaaaaaaagaagctcttagtcttgacttgggcttaggataggaaaacttcccctaggaattcatatccacaggtctgtcccttatatagatttaggatttaaaagtataagcaagtagtctaaaatctacacagaaactggacctaggctttcaaacatggaagaggcaaaagcaaaaacactctggagaagcaactgtattcgtttatgcaatgctttgcacatgaaaacctggatctgtgattaagcatttaaggtaacactcataaaactatatcatttgcagtaaacatgtctaccaagtaaattaaaggacccttatactatgcagcagctaaagcaaagtaggatttgattaaaagtccttagaaatggaggactgttttaattctagaagtgggggaggagaaactcataccctttaactgactactacaagtctttctaagaactccagctttccataagacatgtacccacttaggagatcataggtcaggttttataatatactttataattaatataaaaaattaaccatgattataaatcaatgcctcatttataggagcctggagtctatcatacttgttttaaatgttttttataccaatttatttatttatttgttttgttttgtttttcttgccaacatggtgaaatcccatctctactaaaaatacaaaaaattagccaggcatggtggtaggcacctgtaatcccagctacttgggaggctgaggacctgggaaggggaggttgcagtgagcggagatcatgccactgcactccagcctgggggacagagtgagactctgtctcaaaaaaaaaaaaaaaatgccttgtccttgttggtacccatacccataccaggtaaacctatatttggtcacttgataatcacctgactttgcatgccttcttaaatgtcccatatcttgtcattctgaatagcattcaaaattatgttcatcagacgtaaatagatattttactaattagcatgatcccttacttcttatgtataagtgattgacagataatagctgactacctgccaatttggtttttgtactccattgagtataatacccctcctcaaggtaggaaatgttaagaattttttttctcatttactgctgtctgctgaactagacagctatctctaaaaggtacacaataataactgctgcttttcataaactgtttatagtcattcacagcctctatttcttctgtacgcaagtaaatcatgtttccagatgaaaatgaaaaatacttttattaatggcttttattatttttaaagtgctataatttcaaagatgttaattgtgtaaggatgtaaataaatgtaaactctccaggtcaattttcttaaaaggaagtccagatactaaaaacaacttcaggatgtaaaatgctgggaaacagcacgagcaactcatatgcatcagagacggaatcacattgtaagtaaaggtgttaggctgctctgtggacaggtaaagaagagccaaaacagctctggtaaacagaactcatagctaccatccaaaggtaagttaaacatacaggtaatgtagagaaagcctgccataaccacatgatgaaagcaagagcacaaacaaatgtcttcaaatcgaatgacaataatgttatgactatgactagtatgtaccttagcaatcactcagggaacagaaaaaaaatgatagattcagaatataaattcactaaaatgatttcttagctattttatactattatttatgtaataataatttgttatatattcttactattgtattaatttacccattaataaaagacactaacaataagccactacattaaaatagcagatcaggccaggcatggtggctcatgccgcctgtaataccagcactttgggaggccaaggcaggtggatcacctgaggtcaggagatcgagaccagcctggccaacatggtgaaaccctgcctctactaaaaatacaaaaattagctaggtgtggtggcgggcacctgtaatctcagctacttgggaggctgaggccagagaatcgtttgaacccgggaggcagaggttgtagtgagccgagatcacgccatcgcactccagcctgggcaacaagagggaaactctagctcaaaaaaaaaaaaaaaaaaaaaaagcagatcagaattcatcattaaattcctatatacaaaaattccataattagaaatatcaccagcagatacaaatttaaatatcaagtttgtattagaaaaaaaagaatgctggttggttaaaatggatagaagacagcaataatgagtcaggttataggttcaatcccatagagcccagctgggttcacattgagaaaagtacatttcatggtcaaagacaggtccctgatctcagcaaagggtcacacatctatgctattagttgaaaagggaattatactggagatggttcaaaaaacaaaaaactatcatcattacaggaaataactcatagcatacatcctgatgacaaatgaatagtgctattttctttgtgaataacatcttctgctgcactattactaactctaggaagatatgctggacttcttggctttgttttaacactatccacatatcatgaaatattatattgccgaggcagtatttatgaagccaaatagaaagcaaaccatgaactccatacataggaaaacaacaacaaagaattaatggctgggtgcaatggctcatgcctgtaatcccagcactttgggacaacgaggtgagaggatcacctgaggtcaggagttcaagaccagcctgaccaacatggagaaaccccatttctactactaaaaaaaaaaaaaaaaaaaaaaaaaattagccaggtatggtggcacacacttgtaatcccacctactcgggaggctgaggcaggagaatcacttgaacccaggaggcagaggttgcagtgagccgagatcacgccattgcactccagcctgggcaacaagagtgaaactctgtctcaaaaaaacaaaacaaaacaaaataaaaacaaaaaacaattaatgatcacaactctactcctcaatggcgcagggtcaacaccagcattagaacaacagggatcactcaactgtattctgaataatatttacaaagcacctgtgaactaattcttagcagttaagaatttttctttccccactatcattttcctcttgaaataaagcaaatttaaaatatgccaactaaggcaagagatttgaaccccacctacatcaggatcacctagggagttattccagggcttattccagaaaccaccagaaccaattttaataagtatggtgtagggccctgggatctgcattttaaacaaacactggaacactaaaagtttgagatgagaattactgactaaaaaaaaaaaaattgcagtttatgtagaatgcacacattagcaatataaaaggaaaagaagatgtctacttattattttctcttgtttatttttctaaattaagtatattttgttttaggccaggtgcagtggctcacacctgtaatcccagcactttaggaggctgaggagggtggattacctgagatcaggagttcaagaccagcctgaccaacatggtgaaaccccgtctctactaaaaatacaaaaaaaaaaattagccaggtgaggtggcgggtgcctgtaatctcaactacttgggaggctgaggcaggagaatcacttgaactggggaggcgggggttgcagtgagccaagattgcaccattgcattccagcctgggcaacaagagcgaaactccatctcaaaaaaaaaaaaaaaaaaaaaaaaaagtatattttgtttttaacttagaactatttaatattccttaggaaatagttcaacaagccgaatttaagtggtctctccataaaggcacttacatgatttacacttcaaaactactgaattttttaaaaccacttaaattccttcatacaatttttgaattaaaatgacaagtgtggcttctttttcaacatttaaatataactcacataccacagaattcatcctttaaagtgtacaattctgtggttttcagtattatcacaaagctgtgcaaacatcaccattaaattcagagccctttcatcacaccaaaaagaaactccgtacctatatggcactcactcccatttccctcaccctcacaccctgacaaccactaatctactctgtatttctatggatttgtctattctggatattttgtataagtggaatcatacaatatgtggcttttatgtctggattatttaacttagcatcatgttttcatggttcatgctgtagcatgtctcactatttcacttctgtttatggctgaataatcttcagcatatggatacaccatattgtgttaatccattattaattatttggtaggcatttgggttgtttctactttttggctactatgactaatgctgctataaacattaatgaatatgtttttgtatggatatgtttccaattatcttggatatacatataaccaagagtggaattgctgggtcacacggtaactcaatgtaaagaatgtgcaccattttacattcccaagagtaatgcctgagggttacagtttttacatatcttaaccaatacttgttattgtctgtctttttgctagtggttgtgaagtggtatctcacgtgaggtggtgtgatttgcatttctccatgactactaatgttaacatattttcacgtgccttttggccattcagatatcttcttgggaggaatgtctattcaaatcctttgcccagtttttcattagactatttatcttcttattcttgagttgtaagagtcccttatataatctgcatagtagactcttaccaaatatatgatttgcaaatattttctcccattctatggattgtcttttcactttccaagtccagtttatttatttttgtttttgaggctttggtactgtatataggaagccattgcctaatcagtgtgattcactacttttattttttacaaaatgaatattttagtaaaaattggctctagcctatcattagcaggagagtagccttgcagtcttgttttgtgtcaatagagatttgctagaaaactgaaactgagtaagaaaccattctggggctgggcacggtggctcatgcctgtaatcttagcactttgggaggttaaggtgggtggatcacttgaggctgtgagttcaagaccagcctagccaacacggtgaaaccccatcctactaaaaatacaaaaattagctgggcatggtggcacatgcctgtagtcgcagctactcaggaggccgaggcaagagaatcgcttgagcctgggaggcagaggctgcagtgagctgagactgtgccactgcactccagcctgggtgacagagtgagactctgtttcaaaaaaaaaaaaaaagaagaccaggctctgaaaagttagtttgcaaatattcacaggctttttgtgctttttcaaggcaaactaaaccaatagtttctaaggtagttatttaactaaatttaaattaacatagatcttcaaaagccaaaagtagtgaagaacttaaactggattgtaaaaaaacatagaaataaaaatgaaaaacatggtctaaactactgacaaaatattttttcaaatttctaacactcataaggacaaacaaccttctgaggacaataacaaatatagaaataaattgcaaaatttttgtgggctgctaaagtggtggtaaacaagtactgaaatatgccaagattatttgtttataacatttactacttcagctttcatcaggtttatgaatatttatttgttttaaaatatatccccaaaaagatacttaatagcccatttcagaactagcacatcttatggatgattaacattagcaaggaagagtactgcctacagaaatctgatagtagtgctcaaagtagtactaagtacactgttctttaaaaatatgcttattaacgtcaccaaaggaaaggttgcttaaaatataattatcagtttttagtcaatcttttcttttcttttttgagacagtctcgctttgtcacccaggctggagtgcagtggcgcaatcatggctcactgcagcctcaacttcccagggtcaagtgatcctcccacttcagcctcccaagtagctgggactacaggtgtgtagaaccaccatgtctggctaattttttattttaatttctgtagagatgaggtctcactatgttgcccaggctggtcttgaacttctggactcaagtgatcctcctccttggcctcccaaagtgctggggttacaggggtaaaccactgcacccccaattttgtatagataacttaaaaacaaacacactttttttgagaacataaagtgttttagatagtattggaagtctgccacgcaggtatcatatcgctcttgtgtgacaggtgtatttcagggaaatgtatatgaataagatgtatataaaagaccaagagcatcactgttgtgtccccagtgcttgtagtactgaacaagcttaacaaaatgcaagtagcaactgctaacttcctgagggcagaaatttaaaaaaagccttacgttagaacaagacactctcaaaaagaatgtctaaatgctaaaattgctaatacccatccatctgcctccaggtggtgaaaaaggggagtgtgtatagcattacagtctggcaggggtaatatatgtagctttaaaagcatattcaaattattataatattctattgtttattggctccttaatacaaacattaaggaacagtttttttatttttattttttatttatttatttatttattttgagacagagttttgttcttgttgcccaggctggagtgcaatgtgcgatctcagctcaccgcaacctccatctcccgggttcaagcgattctcctgcctcagtcttccgagtagctgggattacaggcatgcaccaccatgcccggcaaattttgtatttttagtagagatggggttcctccgtgttggttggactggtcttgaactcccgacctcaggtgatccgcccacctcagcttcccaaagtgctgggattacaggcctgagtcactgagcccggcccagtgtgtattttttacatctatataaaaggttgtgaaactgataaataaagccttcttttctaaagagatttaaattcaggacatttaagaatgtgaaaagcagatcctcttctttcctgatcctcctttcttatgctctgcaaaggagtaagagtggctgactcctagttaaggttatgaaacagcatctaacttcttatgggctaatgcttcctttaaacttagacccagcattaaacctcacaaactaaataaaaataccttcagggaattacgatgagaagggcattttgtatctttaaaatacagacctaattgtggaggtagagtaaaacaatatatattttggttaaataaggctagagaaaaagaattcacaatttgttggatttataaaatacaaactttaatttcttttttttttttcagaggaaagaattaagattagggaaatgagaggaggaaggagataagggctttaaatgattctgatctataattatcagtatgaatttttcatgtttttcttttgcagacatttggaattgtcctgtagattttgttggcagttaatgatcgaggcctgcagagcactgttactgttcttgatcccccaattcataggtataatctttatgtcctaaactattggtcataaatattagttagctaagaatgcctaaaagttgtttacaaaccattacttgaaaaatgaacagccaacatttatagcatattcagagaaagttagtttgaaaaataactcaaactgtgtattcgaatcattgtatgtaaaaaaataaataaataaaaataaaagtagcttttcttttccttgtaaaacattagctagaaaaagattttacttttttcccacatcacagatcatcttgaatgagcaggcctgcataaaaacgatcttcacaactctttatgtaaaagcacaaaaaaaacaaaaacacaaacctatacacttttaatacaaaaaatctgcattatagccataaaggggcgaatagaccagtcataaaaaataaactcgttttttagttgatccaatcttgagcaaatgtttaattttaaaatttactattgttttattttctattacaagtatctgcctaattctggggcatctgctatactaaaagcagaaaaaaatcatttgggagattaaagagagtaagagaaaaataaaaggagagtcaaggaaatggatgggtaggaaaaagaaaaaagaaagatgaacagacagaggaagaagggaagagggggcaaattggcttagtcaagctctcttgggacagtgtgctgagttaccagaccagaaatgaggggttgaaagctactactgataactggtgcaggctgaaagtgctacttaagtgcctggtgtctgtggaaaaaagagggaggagaggtttaagactaaggatgccaagtacatttccagccagcagagtaaaaaggaagcattaacagtagcctcaggggaagctaagcatgctatcccatgagccagagggcaaatgtggcaatagcagtaagtagcagctggataaagggataaagaaataaagaaaccacaggaaaattggcagctttagacccataaggctgactcggcctcgtctagatacttagaggaacaaacagcctggaaaaaacactgccatctttctactgccgatgggttactaatcaacaactgaggtgcaatcaactaaaatttacttggcaaaaattatattaagcatggatttaactttgtggaacagaagctctgctcagaagatacatgtaagatattctcagtatttggcatcataataatcaaaatcagcattctccataactctccaaatgatactccgaaatgtttaaaatgaaaaaaaaaattaaatacctttttctaatgcagtatttcattaatgttttctaaatattatttcatacctcatagtttaacaaatttaaaaaggatacacataaatatgctctatagtatatattagtgaccctttgagtattaagcccagcctccattagctattcttcctgatgttttccttcctcccaccccccaccctccaagaggccccagtgtgtgttgttcccctccccctgtccatgtgttctcatcattcagcttccacttctaggtgagagcacgtgctatttggttttctcttcctgcattagtttgctgaggataatggcctccagctccacccatgtccctgcaaaagacatgatctcattcttttttatggctgcatactattccatggagtatatgtaccacattttctttatccagtctatcagtgatgggcatttaggttgattccatgcctttgctattgtgaacagtgctgcaatgaacatccatgcagacgtatatttataatagtataacatattcctttgggtatatacccagtaatgggattgctgggtcaaatggtgtgtctgcctctaggtctttgaggaataaccatactgtcttcaacaatggttgaactaatttatactcctaccaacagtgtaagagcattcctttttctacacaacctcgccagcatctgttgctttttgactttttaataatagccattctgactggtgtgagatggtatctcattgtgggtttgatttgcatttctctaatgatcagtgatgttgagctttttttcacaagctttttggccacatgtatgtcttcttttgagaagtgtcttttcaagtcctttgcccactttttaattttttttttgtaaatttgtttaagttccttgtagatgctaaatattagacctttgtcagatggatagattgcaaaaattttcccccattccataggttgtctgttcactctgtggatagtttcttttgctgtcaaattattttcattcatattcttccattaaaaaaaggttcaaagttatgtcataaggcaatctatattacctttatatggttttagaatggaaggtaaataccacaatgagagttcttgttttaaataagtatgtgctgtaatattttagtataatatccgaaaataagatttaccaagcacaacatttttcaaatgactaggcttgatatatttgataaactgcaatttgtaattgattaaataaaccctgttggcctaagagttgctcaattctctcttttcttcatcagggttattaaggtattataagattgatgttatgaaaaaagatcctactcctaaaagaatttcaaacatttaaggaaatcaaactgaaaagtaagaaatgccaattaagttgtgcaatgtatataacaaattctataagaattcaaggggtgaggagggggtggagtcagggaaaaaagttcctaagggatgtaaaatttaagatggctcctaaaccatgcataacatttgagcaaaaattatttggaaggaaaagatataaaaagagtaagttaagaagcagatacttcaataaagcaactgtaattactaaagttacctttggaaaattaagatttgacagctattacaggtagagtatagaagggatagaaggtaaagagagtgatgatacatagaaagtcatgatactaaagtagaataaaagactcggggtgttttagtctgctctggctgccataataaaatacctcagattgtgtggcttaaacatgagaaatctagttctgaaggctgaattaatttagaatttctgaaagctgaaaagtccaagatcaaggttcccataagatttggtttatgatgagcactctcctcctactgtgccctcacatgatagagagagagtgatctctggtaacccttcctctttcataaagacaccagttctactggaacagggctccgcccttacgacctcatttaaccttaatcacttccttaaagaatctatctccaatacaatcacaggggtgtaattagggctccaacataattttcgggggacacaattcaggccatagcattctgcctctaacctcctaaaattcatgcctttatcacacgcaaaatgcattaattccatcccaaatgcctccaaagttttaacccattccaaggtcaactctaaagtctacagttcaaagtctcatctaaatatcatctaactcagacatgggtgaaacttgaggtacgaatcatctttaggcaaaattccttcccagttgtgaacctctgaagtcagacagattatttgtttccaaaatacagtggtggggcagatataggatagacattctcattctaaatagaagaagtaggaaattgtgatataattttttaaaagcctgttgggagcattaagtgagattacatacaataaagtgcttaaactagttcatgaatatcagcagagtagaagtataaactccaagaaggcagggactttatcatcaaccactgtatctcaagagttgcacagtcaatagggtagtcactagccaaatgaagctatttaaatttaaatttaagttaattaaaactaaaaattcagttcctcagtaatattactcacacttcaagtgctcaatagccacatgtggctagtgggtacaataatggaccatgcaggtttccatcaccacagaaatattagtagacaagtctgttctagagcctagaaaagtatgtgacactataattattgaatgaagaaatataaaaactattagcattcatggttcaagaagaataacaagaaaacatcaagaagaatgagtatcttcaattttggatctttgtaaaagatccaaaagaatcacaacacaagattatcttattaacttttataaaggcagtaaatttagggctaggaaaatgccaattaagaaatatttctgtagccaggtgtggtgacacgtgcctgtagtcccagctcaggaggctgaggtgggaggattgcttgagcccaggaggttggggatgcagtgagccatggttgtaccactgcactccagcctgaacaacagagtgagactcagtctctaaataaataaataaataaataaataaatactccataggagattaggttaatattgttcagagttttgctttgttatgacctgaatcaagagaggaatcaagagaggaatcaggaggctgaggtgggcagattgcttgaggccaggagttcgaggccagcctggccaacacatggcgaaaccccatctctactaaaaatacaaaaattagccaggcgtggtggcacatgcttgtaatcccaactttttgggaggctgaggctgcagtgagccaggatcacgccactgcactccagcctgggtgacagagcaagactctgtctcaaaaaaaaaaaaaaaaaaaaagaaaggaatcaaaactccagagactaaccatgaacatgtctaatagtctcactcttaggcaccagcagtcttactaaatttgttagtggcaggatcaataatgaatggattcaccaacaaattcctatggtacataatgtcagtgttgtcggcaacaaatgtgagacaatccattgtgaatacagagatctggacttccatttttgtctgggtatttttttttttttttttttttttgccagtggatgagaaggaacggagtatctgcaactaacatcaatatttattcagaaaagtgcttcttatctttttaagcacttggaaacacaccaagttctgttccattacatggcattctaatgggtaattcttcatgatgtaatactttagcttacatcattagtgtaagatcaatttatttggttatcacaccgattaaataaaggaagtttccttctccagcagttgaaatgtttctgcaactcttatataaaaaagagttacaggtctttggcctaagctgtctatcttcttgaaaagtacagaaccagagaatacacttttccagcctaagccatccattttcttgataaatccaaaccacagaatgtgctttccctggacttaacactttggctatcttttctgagaatggaaaatttttcttactaaaacatctgcctcactccccacatcacattctctgccatctgacctgcctttgctatgctctgataactgccagaagtctacagcaatctcattttaagagtgaccctaccactaactgtgaataaagttttctcacctggtttttgccagtcttactctagaacctttccttcccttgacacatatttcttattccataggtagtgggatataaaataggcaaaaatttcttcctcaaggaatttttacccaaaatttcccaaaatttacccaaaaattcctcaaggaaggaattcttcctcaaattcattctcttagtttatcctctctttccattgctgagtaatcatttcttctaccccctaatacctttattcttcttgagtgataccaggagaggaaagcaaaggatgacacagaaaattctgataaaagaaggtgacagcaataaggctaaataaactgttcagctagaacctctcaagctgaaatcagaaattttctcctgatgtattgtataatatcagtgtcctcatttgttattacagcattagctactaattgtctcccattgtctatttacctccttcttccttttagcaatagacccatcctcccttgcagttttaggaagcccagcttgataccgcacttcccaaactcccatatggctaggagtcaccaggtgatgacattttagaaagcagaatgtgagcaaaaatgatgtgcccaacttcctagtcacattcttttaaaaagcaactgtgtgtcctctacttactgttgcctctttccaaagggctaaaatgtggatatacggggtgactgcaaaagaacagcaaaccctgaatgatgatgaaaccagacagaaggaacccgggtcctttgatgacatcatggattcaatttgctctaattccttggattgcctaccagttcagacttttacttcaggaagaaactttccatgtccatttaaccactactttttggtctgtatgaaagatgtaaaccttaaaactggcttttatataaaaagatttattttgggagaaacagagtatgtgggcatagtctaaaaaaggcaatatgatcagatggaagccctaaaagatcaattacactcaaacatgagaagcatttcttagggtgagacagaaagatgactggagaacatatttgattcaacaaactgttactagattcctacttaggccagacactatgtcatatacgtgacaggaactaggtaagtaaattgtgtgtgtgtgtgtagttcccaacttcactgaattttctgtacagtgagagattaaattctagggaattagctaagatataattggtcaataattactgttcaagtgataccatgtgccaggtaatgtgctaggtgctggaaaagatggtctctcttctaccttctaaatatttttcttcctcttgagtgccacttctttggtttaggctctcagaatttatttcagctcacacccttctaactggtttcctttccttcagtttcttctccctccaacccactgtcatctgagtaacataaaaatcctaaaataagaatctgattgatactctgttactctttaaaaaaaaaaaaaaaaaaaaaaaaaactttacaaaatttttcttactgaaacatctgcctttctattgccaataggttaaatttcaaaatgtcctttctagtcttattcttcatcactttattattcaccccagctacacggaactgttcatcatttacccaacataccttcatttgctctcttcttcctttctcagttcttcatctttgagtcagtttggactgcgataacaaatatcataaactgggtaacaaacaacaggaattttatttcctcacagttcttagagtctgagataaaggtaccaacatggccagtttctagtaagagcccttttactggattgtagacagtgccttctcactagttcctctcacataggggatttgggagtccagggggaaagagagagcagagtgagtagggtgtctgcatatttgctgtttcttcttataagagcactaattccatcatgacggctccaataccctcacaatgtcatctaaacctaattatctttatttcttaaaggccccatctccaaatatcctcacattgttggtagggcttcaacatataaattttgggagattgctaggtagtttattctctttgtgagcgaatggagttcactcatgatttggctctctgcttgtctactgttggtgtataggaatgcttgtgatttttgcacatcaattttatatcctgagaatttgctgaagttgcttatcagcttaaggagttttggggctgagaatatggggttttctaaatatacaattatgtcatctgcaaacagagacaattgggatttgaacaatgagaacacatggacacagggggaggggaacatcacataccagggcctatcgaggggtggggggcaagaggagggagagcattaggacaaatacctaatgcatgcagggcttaaaacctagatgacgggttaaaaggtgcagcgaaccaccatggcacatgtatacctatgtaacaaacctgcatgttccgtacatgtatcccagaacttaaagttaaaaaaaaaaggggggagaatatgattccatccatagcagatggcaaactaatccttcaatacccagctcaactgtctcttaagtatcctcattctctgaatgaaatttagttgctctgctatctatgctctgattaacgacattctggattaattatttccattattagatggtaaatacctacagggtagagattatatatattcatctttgtattttctcagaattaagtaggatgtttggcaaacattagccccaatacatatttgctgaatgaaacactggactttcagaagcaatgaaagatatgtgctaaaatctttttttttttttaatgcttttctctacttgcaggtcaggcattataataaactctttctcccccccacctctacaattctagactctgcattcataatttctttcattctttccctccttctcctcacctcttccctccctttccctccctccctccctccttttattagagacagggtctccctctgttgccatgctatagtgcagtggtatgatcctagcacactgtaacctcaaactcctgggctcaagtgatcctcccacctcagcctccctagtagctgggactaaaggtgtgcatcactacacttggctaattgtttaaactttttgtagagatggggtcttgggatgtttcccaggcaggtcttgaactcctggcctgaagtcatcctcccaccttggcctcccaaagtgttgggattatgggcatgagccactgcccttggtccatagtttgtttctttatagcatcattgatctcaagttgtctataaccactaatttctatggagttgaaatgcagattctatcaaccaatgctagattattaatgttgactttataattgcagacacttttacataaagagtaggtcaacatgttttcacaagagtaataagtaacttcagatgcccttgtaagaaatgcagcaataggactcacctattacttttctctactgaatgcatttccacatcaacagtgttaccaatcattattttatgttaccacagcagagaagatttaatcttcttttacataacaatttctttgccttagaggccttgtgatcattcaatattattcctattctaaatctgtcatgtttaaaacctactgcctgtattaaatatctattatctatttacagccaagagaggttaagtaacacagctgtggtcaaaagttagctaatactgaagctctgggattaatctccaaatattctgagtatgaatgcatattcattcagacatgaccatgcatatgtcataaaattttataaaattacagaggcagttgatatgaaaagtgtaaaatatgtgatcaaattaattagatatgttaattatggtacttaagttagagttgtaggtctatcaataaatattcactgaaagtttactaagtttaagtcactatttacaagtaacggaggagggggcacaggaggataaagctaataggtagaaagtataataaatggcagagtaaagggttaaaagagaagtacaaagtacaactgtgatgtcatagaaagaaagaaaacctggcaggcatggctattgtctttacatatcaggactaaagtgagatttaatttgctttgtttaagccttagagctagaatgaggaccaatgggtagaatttacatggcacaggcttcacttggtataagagttatttgaaaatagaatgttgaaaacagaatatttttgtgataatatactataagcttaatctacatgtagtagaggtgtcatggtgagatggtggggagcaggtggtctgtagggaacaatcccacccaagaccagtgagtacctgaataaacactattatatgcttgtagtcatggcttaaatgcaggagcataacacaattgtactgcccatttgcaagatatatttatcagcagtgtatcaaatgtataaaaaagtgatagggagactagaaggacgttattaccatagttcatataagagataagaaaggctactgtggtaaaaatgagccagcagagttaggaaaagatgttctaattacttcaatcaattatatgctaatattatctattactaaagaagataaaaatgggattaagtgtacataatagaattatcatctatcctattatttaccttaatatatttaaattccatattaatatatttactgtaacatgtctaaaactgaatttatcttcctcaaagaacttatcttttcctctttctgtaatgcctatttcaattgttagtatgacaattcatgcagtaactttagttaaaaatctcaatattatcttcaacttcttccccttatgttctttatgactctgatatgtctctagaatctagaatgtcttctctgtcctctctgtcattgttttaactaaggtcatcatctcctgcttaatttcctttaactgttatggcctcctaattgattttcctgtctccattctttcctagcttgagtccgatactcacactgccatcttcctaatgaataaattaaatataattatatcattcccatgtctttttagcagttcctggctgtctgtaagagaaagtaccaactcctcagcaaggtataaatgcctcttcataaatgtgacctcaacttaacctcccaagcctcatccctggctattctttcccaagaaacctatgcaatggccatacaaaaaattccattatcttaatcttttcctatactataagcttattcatttcatatggcacttgtcaaatatcagtgtctgggaaaggtttgagtgaacatttttaatcaattgctatttagtaaataaaccaacaatctttcagtacaatctacagtattctactggtaattgattctctagaattgaaaaaaaaatttccctcagcatctttcccccgtagactattatgatgattaattttgtgtcaacttgagtgggctgcgggatgcccagatagctggtaagacattatttctgagaatgtctgtgagggtgtttccagaaaaggttagcatctgaatcagcacactaaacaaagaagatccactctcactaacatgggcaggtatcatccaatccaatgagtaccagaacagaataaaaaagcagaaggatgaattccctccacccactccttgagttgagacacccatcttctcttgcccttaggcattagagctcctggtctgtgagtcttcagactcagggacttacaccagtgccctactcctgggaatttaggcctttggcatcagactgggagttacaccattggttcccctggttcttaagacttcacacttgggctgaattgtaccaccagcctctgggtctctagcttgaatatggcatactgtggtgcttctcagcccccataatcacacatgccaattcccataataaatctcatctcacacacacacacacacacacacacacacgtactcccagaaataatgtttatcacttatcctggcatccctcaacccactcaagctggcatataaaattaaccataatagtagtctacagggaaaagctattgagggaaaattcttttcaatcactctagagaatcaactagtagtagaatacgaatgtattggtttatttactaattagagattgatgaaaaatgtttgctcacaagcctttcccaggtactgacacttgacaagtgccatatgaaatgaataaacttatagtctagaaaaaataggaaatgattaggacaatgaattttctatatggctgtggcataggtttcttttattatacaaacactcacacacataaacatatatagatgttattggctctgattctctgggaaatcttaatacaactacaaaactttatttgccacttgttcccactttcaaaacacaatttactatttatttccattattaaaaataataactaatcattaaaaacatttgaaaagcaacggaaagagaaaagcaaaaaaacactgacgctttaagacactggagtaggtgtatgtccttgtaatgtttttattacattgagatatcatacacataaacacatcttatatactacatttttatatcctaaatttttcttttctccgaattctaaaataaaataaattttcatattttttctgatgaaaagtgaaaaatgaaagtaattttcctctcattaagtgcatattttcatacaatgtacgatacaaaaaggtattcatttttttcttttttgaagacagggtcttgctctgttgcctggtctggagtgcagtgacacaatcagggtttgctgcagcctcagcctcccaggctcaagcatccttctgcctcaggctcccaagtagctgggactacaggcacatgacaccatgcccagctaatatttttactttttgtagagatggggtcttactatgttgtccaagctagcttcaaactcccaggctcaagcaatcctcctcccttggcctcccaaagcactgggattatagatatgtgccaccatgccaggcctaagaatgtattcttaaaataggtatggtctcatttgtacaactaaaacttattaaaacatatgcagtagtataattttatcataggaagtataatgtagagtataacaacacaggtttcttgcactggaatcccagttcaatatttatgattgctgtgacaagttacctaaactcacaagttacctaaactctctatgcctcaagtttctaatctacaggttgagagtaataatagcacttacctcataaacttattgtgagacctagatgagttaatccataaatggcttacaacaatgtctggtgcatattattaagtgttcaacgcacgacagctcttattatccttctaaaaatctaaagtttaatgaacaaaatcccattaaacaaagcgaaatataaattttgtctattgaaaatatgttgcacagtgagcattacaaaaataattacatatatattttagtatcttctctagcacagaaaaaaagtagaaagaagaaaataagggatcatgagatcctggcaagagtttttctccacagacattctgttggtggaatagaaatatgtgagatggtgaatggaacagatctaaataagcatgggactaacaaagtacaatgtatgaaagattttacttagaaaaaacaattacaaattgactatacaatcaataagactaaccgaagggaaatgcagtaaaacactttcaaagaaaaatactgtggagcccagaagaaaataagccaattgacagaggtagatttcacgagctcataaaaatgaaaaagtaaatgctgctggacaaaaagtggtccttacttttgctctcaatgtttctagtatgctatgtagaacaattattttgcttttactgaaaaataactattgcatttggtataaaacgattcataggaaaaattattttttacttctgaataattaatgtatttcttaagtaatagaggaaactattaattaagaggcattcatgaaggtggatatcttacacctaaacattttagacttgttttccaattttctttctttctttttttttttgagacaaggtcttgctctgtcacccaggctggagtgtagtagtgccatcacagctcactgcagcctctacttactgggctcaagtgatcatcccacatcagcctcccatgtagatggaactaccggcatgtgctaccacacctagataagtttttttgttttttgtagagacagagtcttgctgtgttgttcaggctggtctcaaactcctgggctcaagcaatcctctgctttagcctcccagagtgccgggatttacaggtgtgagccaccatgcccagcccttttcaatattgtttttgaaaattccatcctatactgccaaatataaatatatcccaagaaattaaaatacagaaaattaaattgcaaagaaaatatggttgcagaattcttgcaatttaattttagtaaattctttatcttttttattaacataccttaaaattgctatgcacatattttctgtctcagttatgtactcaactagaaattacctttacttaactacctgtattttattgaaatactgtgcccatcctgcatggactattttgcgtcacttattttatgaatatcactattggatatgctcttttgcaccaatagactcttattcaggtatgacacacagagacacaaaatgctaaattctcctttcctgtgaccatggcagaaactactaatcaatattcttgggcaaagttggttctcaagatgctcaagctctgctgttgtcataaagcattttggttctcttctgatactttttgaagactcatccatttttcattctttcagcaaacatgaccatgataccccatatagaccagatattgtgctacagttgcgaaaacaaagaataagagaggtcctcaagcggctcaacatctcatggtgaaaatgagatgctgagccaccactaacatgctagctgttaagtatgtccacttaaaagagaacacaggagaaacatctcaggcggactctgttggcgtggttggtggtgagggaatgttgaagagtggatagaggtataattaaaggctttctggatggcgtggtggcttatatgagtagtcccagcactttgggtgggattacagcacttgaggtcaagagctggagatgtgcctggccaatatggtgaaaccccgtctctactaaaaatacaaaaattagcagctgagtgtggtagtgtggcgcctgtaatgccagctacacgggaggctgaggcatgagaatcacttgaactcaggaggtggaagtttcagtgggcggagatcgcaccactgcactccagccagggtgatgaagtgagactctgtcaatcaaacaatcaatcaatcaatcaatcaaggcttcccaagggggaggaatctggcatttttgtaggcaaaggaaacagcttataagatgtgagagaacacagccattttagagaagtgtacattgttcagtgttactggactatagttttcaagagatgaagttggggaagtaagcaggtaaattgtgaagatcattccaagtcatgttgtaaagctgggaaagctataagtaaccactgaagaattttaagcagtatttgtgagagcctccaatttagggagtatccaatttataaatatcttcatatagtttaaaaagaaatagttattttatgtggtttcctatggcaccaactagaatgtttctgggatgatccagaaacatgtacaagtgatctgctgctgagatgcagattatatttcttcaaaaaaacctggatcaaaaattttgtcgttttacttttaaaacgaatttgagtcagaatccattatatattattctctggtgtagagcataatggaataactataatacagctcaataaaaatgaaaacaagaggatatcataaaaagacggtttcaaagaacattttgaggccaagtgcagtggctcatgcctgtaatcccagcactttgggaggacaaggagggaggatggcttgaagccaggagtttgagaccagcctgagcaaacattaggagacccccatcttcacaaaaaataaaattagctagatgtggtggcatgtgcctatagttctagctactcgagaagctcacttgactccaggagtttgagactgtagtaggctatgatcagccactgcactccagcctggtgacaatgagatgctgtcttaaaattaaaaaaataataaaaaaagaagttttctttcaaaaagacagaacaagtagttgagtgagtgttatgggttgagctgtgtcccctccaacacaactccatatgttggagtcttaaactccagtacctcaaaatgagattggagataggttatttacagaggtaaacaggttaaaatgaagtcatttggatgttccctaatccaatatgactggtgtctttatagaaaggggaaaatgtggacacagagacagatatgcacacagggagaacaccttgtgaagaccgaggttacactgctgcaattgaaggacctatcagaagctcggagagaggcctggaacagatccttctctatcgccttcagcgggagaatggccctgctgactccatgatctcagacttaaagcctccagtactgtcagacaataaacgtatgttgtttaagccatgcagtttgtgggacagtaattattcacttaacattgtcaacaggttcttggaaactgtgactttaagtaaaatgacacataaggaaagcaatttttttccgataacatcataactaaatgacattatctgagaacctattgtaattatttcacttaaagtcccagtttccaagaacttatccatgatgttaagtgaggacttactatactttgtaatggcagccctaggaaactaatacaagtagggttacaggagaagtaacttctaagaatttacatggcaactaaaagcagtaacttaccctagactggatcccatattgcagcgtaaaaattatataaatattacatgttatatatcactaacaaaagtgatatatatggagagtaaattagacgaaagtattacatcaacataagtttataaaatggataactgtgctgtagttacataagaaaatatccctattcttaggaggtacacactgaaatatttagaggtaaaagaccatgaagtatgtaacttaccttaaggaattcagtaaaaatattgtgtgtatatataattatgtgggtgtgtgagtatatatacatatactacagagagggtgaaaaaagaggagagagaggaggaagggagggagagagaaaactcacataaaaaagagggagggaaaaaggttaacaatagtgaacctgagaaaagtgtataagaattctgtgggcacggcggctcacgcctgtaatcccagcactttcagaggccgagacgggcaaatcataaggtcaggagatcgagatcatcctgactaacacggtgaaatgccatctctactaaaaaaaaaaaaaaaaaaattctgtgtgctatttttttctttgcaagtttttataagtttggaattatttggaaataaaatacaaaaaaagaacttattttagacgagatcaggcactttcagggtggtacagcagtagaccaaaaaaaaaaaagaacttattttaagaacaatgcctaagcatattgctacaaacattttatttttagtatggcataagtatatgaacaaaaaaagtgaaacgataaagtgaatgaataactgattaagaaagaaagaagcggggaagaaaagaaacaaaaactcaaaaattgatttaagctatagaaattctaagtgccacagaaaattttgagatataaatttctcaaaataaaaaccaggtactatagtcacggcatttaatacaataaaaataatacaaactaaatttgcctttgcttaaaaataagaatcagaatatctactttttctttagaaagtagcttaacatttatttagaataactgttagtggagagaaaaaatggcctatttttgtttatttatataatactcacacaactattcattgtttcctagcattgcaatactttgatatttatcctaaagtttctctatgttctaatgataattctaaaatatagaattatctatctctctctatatatataaatataaattctaaaatatagcattatcattaaaaatatagaaaggaatcaaccggaccacaaaaaactaagccgttctggataagcatgtggcaatcctcttcttcctttttctttttttttggaggtgggtgggaaggtcacagtggttaacataatcaaggaaatttgctagtatatacagaagtctttgctaagaaattttcgtttgagatacaccagttaccggcaaatcaaacagacataaataccacagtaagcagtcatttatcgggtaaccctgtgcagagttgcatgaaagcatccagaggcagaacaaaatccacagcagagccgctgcttttcagatagactgccactgcaggtgccatggcccagtgccagaaacacaggcaggggaggggttacaggcagctcctgcacagcaccactgggcagaagttgcctgtaatcagagcactactgaaagcaatggtggtggcaaggtgaacttggtgagcaagcattcctctgtgaattcaatttcttcttgtgaatttcatattgcgagcccattagcctcacttctcttctctagccattatcattagcccctcgcagaaacgatgactaccagctgtaactggcagcacactaccatgataatttacacaaagattaaaaatgaaaaattaaatactgggatttctagccatcttttaactttttttattataaaaagtatctctctctctttcttcttcttcttccccttctcctttcccttctccttccccttcttttttttaacttcaaacctatagtaactttggacaagcactaagttaccataaatgaggttttgtttatttctttttcctgaagtcagtgcaacaaggtatttcaaaaccttaaagaaagaaattatgaaattaagaaatagatgacaaaatatacacctggctgggcacggtggctcacacctgtaatcccagtactttgggaggctgaggagggcagatcatttgaggtcaggagtttaaggagtttgagaccagcctgaccaacatggtgaaacccggtctctactaaaaatacaaaaaattagccaggtgtggtggtgagtgcctgtagtcccagctacttgggaggctaaggtaggagaattgcttgaacctggaaggcagaggttgcagtgagctgagattgtgccactgtactccagcctgggcgacagagcgagattctgtctcaaaaaaaaacaccacccaaaccagaagtattttgaataaagtgtcaaatacttacaaggtgtaattactattgatatcatgagcagccactgtgccaaattcatgcaccatagaagattctgaactccaaagggcctggcatgggtctttgcaatttagttatggacatgactgaatctcacatgaagaaatgtttaataatcaataaagagaaataattgaaaaactgctctaaaatgaattagatcagccatctgcacaataccatctcaagtaataattgggaaagaatatataggggtgtttctgaaatgtttcaaagaagatgagagttctgagaagagtatttgtaagtttttagattattttgctttttgagagcatagtgataagaagggtaacgatgcacgctttagggtatcatttggctaaaaaaggagtagggtaggctcatactgcaatgataagaagaacatgtggcaggcactgtggtaagaaaagcatgaggagtaactcaagctagaagcctaactattacaggttcctgtgtcaggaagagggagaaatctggcatttccccccacactttcagctatatcactgaggctgaagtctatagggaagagtaactactattagacaatccttttcaattatatagatgagatacccacggggaagaattttccaaaatttaaaaatcattaatatattttaatgaaatactaacaatgtggtagaaaatcatagaagttacttaccccagaataaacacagaatttgaatatttttctaccatggatgtagcatatattagaaatagtatcattttattttatttggcttgtatctagcacaataacatgtcactaaacaaaatgcggtttactctcatttgtccagagttcagaatttaggtgttcagagaatctagaacacagtcaaactcaaagcaactgaaggccaagaggaaaacaagcaaaaagctcatgaactttaacggtgggaggcattgggtcattcctcaagcttttaacccagccatatatgcattaaataacataatcaatcacaacaagatggaaaccctaacagagaagtgacatctgacatagaagagaactttgaatgctgacagaaaagctaaaagaaagcaaaggaatgtgggtcattttaagtgaggaacaaaaagctctatgcatctcagaaacttcaaggcatcatggaaaatgtctggaatattcaattgttagtaatacagaaaaggctatttaagatttaatttcagaaagaattctccatttaagaggcaaagaaatgtgtaatccatttcataaagagatttctcttcaagggaaatggtgaaaaccactggtatttgaaagtgtaaaccccaattctataaaacttttactgtatgatgttttaattccattcctagatgatgctgagtacctgatgcactcttctgatgccattttgaaatgtttctattaaggtaaagtagtgaatacaattaatagatattttttctcctcttaacttctttaggagataaaagatcatataacacaacatttataacactgcatagtaggcttatatataaatgtaatatatatatataaataatagcacaaattaggggtaaggaatggagctgagttggagcaaagctgctatattttactggaattaagttggtaataacctgaagtaaattgtcataatttaaaatgcagactgggtgcagtcgctcatgcctatgagcccagcactttgagaagccaagataagaggattgcttgaggtcaggagttcaagaccagcttgggcaacatagtgagacctcatctctatgaaaaataaaaaacttagctgggtgtagtggcacacgtttgtactcccagctactcaggaggctgtggtgagaagatcgtttgagcccaggaggttgaggctgcagtgagccgtgattgtaccactacactctagcctgggtgacagagtgagattctgtctcaaaaaataaaatgtatattgtagtctctataaatacgactaagaaaagaactaaaacaaatacatagtaaaaaaaatttaatgaaaatagtagaccagaaatattatttaatacaacaaagatgataaaggaggaacagaaaaacaaaaagacccaagactaaagaaaataattaataaaatggtagacatgaatccaactattatagaactctctactagatgagatttctttacatgtgctgatctatttctggattatgctattggatgctatctggattgtgctattattatgctatcaataataacattaaatgtgaataaacacttcaaatggcagagattgtcagtctagataagtaacatgatccaactatatgctatctacaaaagacattttgaaagtgtccaaaatccaaaaaaatggattgaaaataaaataatggaaaaaggtataccatgcaaacagttaccataagagaactgacgtggctttaacagtatcaggcaaaacagactcaaaaattactaaaaacaaacagagacaatttatgactaaaaagttggttaatttatcaggaagacataacaattataaacatatatgcactgtgataggctgaaaaatgtacccctcacccccaggaagatatcaggtcctactccctggaatctgtaaaatgctacattacatgggaaaaggttctttgcaatgtcattaaattgaggaattttttttttggagacggaatctcactctgtagcccaggctggagtgcagtggcataattgcagctcactgcaacctccacctcccaggttcaagcgatcctcctgcctcagcctcccgagtagctggaactacaggcacacacctccatgcctggctaattttttgtatttttagtagagatggggttttgccatgttcgccaggctggtcttgacctcctgacctcaggtgatccgccctgccttagcctcccaaagtgctgggattacaggcatgagccatggtgcttggcctcagttgaggattttgagatgggaagattatcctgattatgagggaggaccctaaatgcaatcacatgtatctttagaaaatggagacagggacagatttggctatagacagaaaagaaggcaatgtgaagacacaggcagacatcctctggacgaagtgtgatactgatttcagatttctggactctagaactgtgaaagaataaatttctgctgtttaagccaccaagtgtttgcagtaatttgctatagcagctataggaaactaacatatacatttaataacagagcccaaatatacatgaagcaaaaactgatagaattgaaaacagcatttggagacttcaatatcccactagcaaaacaaaaacaaacaaaaacaaaaacaaaaaaaacaactagacagaaagtcagcaaagatacagaatagttaaacacaaaaaactaagtcaatcaactcacatccacagaacactcaacaatagcagaatatccattcttctaaagataacatgaagaattctcctatatagacccaatgctaggttgaaaacaagtctcaatacattttaagcaactgaaatcatacacagtatgctctccaatcacaatgaaattaaaaatagaaaatacaggagaaaatttggaaaatacacatttggaaaatacagaaggggattttggaaaatatttggaaaccaagcaatgcacttctaaacaatccataagccaagaaagaaaccacaagaatattaagagaattgcataagctgaatgaaaacaaggaaacaaaatatcaaaatttatgagatacagcaaaaaccacacataacgagaaaattgtaattggaaaacctgatattggaagagaagaactcaaataaaaaaactaggtttccaatttaataatctagttagagtaaactaaacccaaagcaagcaaaaggaaagaaagaatgaatattagagcgaaaactcaacgaaagagaacacagagacaccatagaggaaaccagtgaaacaaaaagttggctctttgaaaagacaacaaaattgacaaacccttttagcaagactgagccagaaaaaaagataacaccaattaccaaaaatcagtataaatgaggtaatatcattactaaccttagagaaattaaaatgataataagtcatactatgaacaactttataaaaataaattagttaaatggacaaattccaagaaagaaataaattactgacatagattcaagaaaaaatttaaaaaaaatcttgatagacctataaaaactaaaaaaactgatttggtaatttaaaatcttctcacaaagaaaaggccatgcctaaatagcgtcagtggtgaattccaccaaacatttaaagaagaaataatatgtagcattcacaaagtccttcaaaaatatagaggaagaaggaacactgccatgtctcattctatgagactagtattaccctgataataaagtcagatgaggatatcacaaaaaaactgcaaactaatattcctcataaatatagattcaaaaatcctcaaaagtagtaattcctcaagaaaatactaacaaaacaaaaatccaggacatatcaaaagaacttaaaacatataagtgtaatatatttgtgaatgcaaggctggtttaacaaccaaaaatcaatttatataatatatcatatttcacttttttgtttcttgcttgaaaatctttccctattccaatatcacatagaaattctcctgtattatcttgttaaagtttatagttttacctttatatataaagctttaatatactttcattttgtttgtggcataaaataaggttccaattaaaatttttttccccatatatctgctataggttgaattgtggccactccccccaaatttttatgttaaagtctcaacctaacagcacctcagaaggtggccttatatgaaaattgggtcattacagaagtctttatttaggataggccatactggagtagggtgagtccttaatctaatatgaatggtgtccttattaaaaggaaaaatttggacagacagacatgcatagagggaggatgatgtgaagagacacaaggagaagacagccacatataagccaatcagagggctagaacaggtccttcccgtacagcatttaggagaaatcaaccctgctaaactttgatttcagacctctggactccaaacctgtgagacaataaatttctgttgtttctacccagataatcatactttgttacagaagccctaggaaactaataaaataactatttatctcagaatcctaaattgaaaagtccttcctttccccacagttctgcaatactagctctataatggatgaggtttctttacatatcctggcctatttctgggttctctgttcacttttcctgtactacttctccttccctaattactatagctttataataatttttgatatctagtaaagcaagtccctctgaaatctgctcttgttccccaaaaggattttggccataatggtcctttgctctttaaaatcagtttatcatcttccaacaaaacaaagtaaacctactgaatggtttttatatttttacattgactttataaataaatgtggggagaattaacaatctatcaatatggcaaatcttttttcctcttatttaggtgtcctcgttttttaactaaaaatttcacagtaaattacatatcacggctaaaagcaaaccaaacaatagtaattttagactcttcatacctatctccctacattcccagggaatttaaatccaaccactgcactgggagtaaagaggatgaagacatgagagggagataccctcagctaacaataattatttccaactgcagccaccacggctgtttacattcttggccacatcattatcaatatgggaaatgaaaaggaaacaataacaacaaaaaaaacaatttgaaaaaagcttctggcatttcaattccaaaaatttttttttttaaatgttgtctggtcagtggtcttaagaatgtcatttccccactcttgttcagtggggggcatgacagtctgtctctatgctgtcatcacttgagaagtgtaaattttccattcagagaaaaaaattatacaagattgacctaattcattcagaggtgtaagatctataaaggtttatgttgaatagatttaaattttagcaatgatagaaacaagtttagattttatttctttatcaaccttgttttttcctgtcaggcaatactatgaaaggacagcatctcttttaacttgtccacatattctctgatgataatggaaagcagatagtatattcattttatttttctttaccttgttaagtgagtactatttgtgtcaccattatgaaatagtagaggagacaaaagctatagaacatacacaaaagtaaatgtgattttaactggtaaccttaggacaattcaacaagagaacgcttcctttgctatattaatgccacctccaggccttgagaagctttctgtttcaacaaggtatcaaagagaaggtaatctccaaatagggatattgtctcttattcatcgaatctaatagtgctggtccataagcaagcacccaataaatacatgttaaatgaatgaactattataatttgaatcaattatgtatattatgtatcttttggctaaaacaaaatgctctatttttaaaggtcaacttttagtgattctccccagagtatggttttctttgtctcttattcaacatgaaacttgaaggttataagaggcagtataatatgtaggtccaaacattgacattatatcataagagacagatgatgggcattccgaactcataaatttttctattatttgaaagtatgaaagcctttttctcatttatatttctgatgctgtatctgaaataaatttttttcctagttcaggtaatagtagataacagggaccaatctcagggatataattaagactgctttggttttaccctgattccaactgttcagaacaaaatataatttacttctctgaaaaactaatgaaatttaggtgagttttccttctaaaatatgtaggatattatcttctgttcataagcccatccacttagccagttttccaatcctacatttagatcttcattacttacagaaaactgaggataagagtcgttgggtgagacagtagttacagtcctctaacacaaacagggaatgtagcattactggttcactaccaaaatcatgctcctaaaaataccctatcctcttgaattaacaaccaaatacttaaaaaagacatgctgggtatcttaaaatgagtatgtcagttaattaattctctgatcccctgctaccaaccgagtattgtataatctgttattattcactgtcctatagatcatctgttcttggtgctggtttgttccaggaagagggacagctgcaacactatatccctgttcaacctgaggaccatctgactttaattgtaacacacagcttgatgtggctctggctatgagaagccgaagtatcgtctgtaataatctggaaaagcagaaacctgccaacagagggctgaaaacagggattgtgctgtctggctgcctgacgggctgcaggaaatatgattaatgagtaaggtataatgatatcaggaacccgattagcaccacaaaaaggtcacagatcaaagtagtatgcatttcatgagctgcaatcattgcataaaatctgtggaattgaagtggtaaaccaaaaagaggagggggatgaaactcttatgtgacaatatgctaaccaatacataagatacaatactaacaatttagtcacttgtagaaagttaaaaagaaattacaaaatgaatcaatatagactatattgtaaggaaactttgttcatcagaggtgtaaaataaatattttgaatgaatgaatgaggtattaaattctttcataaaggcacatatatgtaaaatcaagtatctttcctaattatgaattaaaatgaccagatatatactcaactctaaactatgtttgcatttgaattgcagtgattttatatacagttctgtttaggaatgtaagctaattcagagtctaaacaatgaagacatctataaaactcaagcagtaggaatcactgggaaaaatattaagtaaactcaataataatgttataacaaatgcacagttaatactgcaaaatattatttggtatataactttacaatcatgcccaagtttagagcgtgggtagccaaaatccaaatctacttgtaaagcaattacgtaaaccacaatcttcttttccttagtgcccttgtaaacctgtcccaaatagacctggctcttctgaggtgaaggcagtgagggtagagatgggaggtactgtcaagagagcggcttgccttaacttatgtaattaaattttttaattgtcaaaatgttggtgaaaaacttaatatataacttattcaaatgtttctgccttttagagctcctttaaagtgaagtaaacatactaacaaacttctttatattattaataatactaactatggtaatgattaacagaaaaccgattcccttgagacttaaaatttcaagtcatatttgagaaaaagtgtgtcaataaaaaaatgatcagaacatgattttttcttaaaagtatattcaccaataatgaggatattttgtatcttttatatattgtataaatatttaatatctaatatttagttaaaacattttttaaatcgtgattcaaaagacaccattaaaaaataaaaaaaggctagttaaaaaatattttcaaaatatatgttggataaatgacttttatggagaatacacaaagatctcttacaattcactaataaaaagacaacccaatttaaaaacaggcaaaatatttgaatggatacttcaccaaagaaaatatatatatatatgagtagcaaataagtcggtgaaaagatggttaacattttcatcattaggataatgcaaattaaaataacaatgacctacctactagaatggctaaaataaataagactgacaataccaagtcttgttaaggatagggaaaaactgaaacttcatacattgtaggaatacaaaatggtaaacatttttattatatgacccaggaattcccagaaatctacccaagagaaataaaaacagatgtccacaccaagacttatacgcaaatatttataatagcccaaactagaaaaaaaagtccattaactagtaaagagattttaaaatgtgatatatctataaaatggaatactatacagcaatacaaagaaattaactactgatatatgcacaacatggatgaatctcaaaaaacatcatgctaactgaaagaagacaggcataaaaagactacatattgtatgattccattaatataaaatttctagaaaagcaaaacagagacagaatcagtgattgcctggagccggcagtggaagcagaggctgactataaagaggcccaaggaaactttttgtactcgtgagtgttctaaagctggaatgtagtggcagttacataactgtatacacttactaaactccttgaattgcatactttaagaagttgaattttattatatatagattgtacctcaatgaatttgttttaaaagaaaaatcactgaaagaaaaaagttgtagtatgaatgtaacttctattcacttttgtgtatccctggggaaaaaaaaccacacacgaccatagacacctgccgcatttaaaggtttgacatttccttcagtatctttcagagcaagtttagtcttcatctctcaatcacagaaactttgtgagaatctttaaaaattcttggggtaaaagtaaaatgcaacatgttccataagactgtgatagaataatattatttactattttctgagtgcctactataagccagataatattctaggcatttacatacataattacaattgtttactcataatttcaaaattacaaatgaaaaaaccaaagctcagaaaggttaaactgctaaggtcccacaatcagcaatgtgattgataaaggattggaaaatctggtcagattccaaagcttacatattctttccactcccctgcattgtttccagtatatatagaatgcaaaatttcaataataatgagactgtaataggatctggaagataggattaattgttggtatgaaaagaaaggaatgccacattaaaaaaatgcaataattttccttttttacatgtgaagtaaaaacaatgcaactgagatttcacttttaatgtagagtgtggtaaacattctacttttattttttaaatttattttattttttattttttcgagacagagtttcactgtgtcacccaggctggagtacaatggcatgatatcagctcactgcaacctctgcctcccaggttcaagcgattctcctgcctcagcctcccaagtagctgggattacaggcgcctgccaccacatccggctaatttttgtatttttaatagcagtggggtttcaccatgttgggcaggctggtctcgaactcctgacctcaggtaatccacccaccttggcctcccaaagtgctgggattacaggtgcgagccaccgcacccggccaagattctacttttaaatactaagaataaagctccctgattccaaacttctgtgaaacttaaaaggcaaaaaggaaaagtcatattagtgtctcgaaaataatactgaacccagataatgaaggacactaaagaatccactaaagaggatactaaagagttgtttgtaagcacaaattcaatgtgcttttaagttttaacattttcatattctcaatattacacgaagatttccttcaaatgatagatacaggacataatttgaaaatcttgtttctattatgaaaatgtgcaatggccttctaacctggaacacaaaattatgttcctttcctggaaagagaagctcatatttggaaaaacttacaatcccaatttcacttctaactttcgcttaaaattttgaatcatcatgtatatatgaatgtaacttaacttctgcataaaagaaactattactttatatatcaattcaataacatttcataaagtatatacaaggattcttgagctattatgtcactttcagttagtcctatcacctacagctttgtccagaagagcaagggttaatgattatacaccaacacatgaaagatgctttgagcaaaagctcatgacagacagagtagatgattattatcttaccaatctgtttatgtgaacaaattcttctgaggttttggcccaaggaggaagttcgacatcagacactactgtcccatcatccatcactccaagattataattattgaagttgacaaacatctcagggagataataaaattcagggatcaactcctatataaaaataaaagacaatgtgatattataaactgtaggatactgactagatattcaaaaaaaggacctgatcattttctattgttcagaagaacaaaataaacacagggaatttttttttctttgcatatcatagccctgtcacagtttctcataagatagacagatcctatctaacccaacttaaataagatcttactggtataaataactttcataggctttccttcatgacatgtctcataacctcaaaactcttaaatacaaatattttagtaataactgaggtttgacaagatataaacataaattaccatgctataacaataatgacaacctaactagattttttatgaggtatattgaatttttgccagaaaaacccaaaatctttctaagcattaaaatgccaatgtcttggtctcttcatcaaccaggaagataatttattacagtttagccatggtttctcagtaccttttcctcacatttcaaaacggtcaagtttaaagataccaactctgatagaagatcaaaatttaaaattagtctagaaaatgacttgcatgagaaactgagtaaattcaatatgtaactttaataatgacatttaataagcagaaaaatgcagctgcttagccttttgtgtgtaataaaccccatatataactatttcagaggctctgtagatcagacttgaaatccagtcttgacatgggtcagtggttcagtggtctttcagatatcccctcagggccagcaatggcaggcccggctttccaaacagttgagtaaaatagggaggtcatcagattttggacaaggtcagtatgaacttgccagagcagagaaaaaaaatccagcaggaattaagctattatcacctccatgatccatgtgaaatgttgcctgactttgaattgtacatcctttgtttacaatcacattaattaactaagcagggtagaaacgagcttgttcttccaaatggctgacaaccacctgaccattagacttaaaaagcattttaactgaacaattaaaaaaaaaaaaagaccttatttaaagcttagctataaataaaattagattataatcacacaaaaattttaagattctcatcttcaaaaacaatgtatataattctaattgacaaaagaggaaaacacaggtgtgtgttattttatgaagcaaaaagccatatccaatttgtctgagctaacacttattgcatggtatgagtcatactctcataccataaataaataaactcttaataaaccttattacatttaatctcacaaccactttacaaggtaaagtatcaatcatttctacttaaaaaatgaactaaggctcaaaaaagtgctttgtccaacgttaccagttggacaaaatatggaagttggaccaggacttgtttaactgtaaagcctgtgtcctcagtcatcaaataagcctgggttctacctacacagtatatgcagtgctaaacattttaagtataagtttttaacttatatacaaagtgatttttaaaaaaggaaaagaaactctaaacttttagcattttcatgatgagaaaacaactggctatcctgaatacatatatctttcatatatatatatttatctctctctatacagcaattgttatataaataattgaaaaagaatttttgtaatgtgatttatcccaataaatcactatataattttctagtattaatttgcccaagtgtgtattcaattaatttccagctttgacaaattttaccaaaatatgttattttcacttcataatacttgtgctactgaagatgaatgttactattcccaggccttgtttcacaataaagagggaggaacatgctttccttgttcattgacaatcaaaagcagcatttgcttaattaaatactaattattctcatttcagtaatacccgctgcccacttccacccccaattcacactctatcatgattagaagatagtgtccttcttttgctggttatacctaccatgctcttgttttataattctcctagattcaaagcaataattataatggatgaattttaagtgctagttttcccctgagttttaaaatttgagagatgcatcatttccattgtaaattagagatgcataataaaatatacctaaatgcatagtaaaaatatacctaaaaagtactcttaccaacaccaatttgaggaagcagaatggaacaaatgacatttcatagcaattgttacaaaaatgaagttttcaatccttctaatatatagtgtcaaaatattatgattttgtatatttgtctgtatcttctacatctgttatttcattcaggttactcaacaaattgacaaaaaatttatttgctcaaaacaaatattctccacaagtttttttggttttttgttttttttttttttggttaagagacagggtcccactctgtcacccaggttggagtacagtagtggcacaatcatagttcaccgtaacctcaaactttaatcgatctttccaccttagcctcccaagtggctaggactataggaatacactaccatgcctggctaattttttaattttttgcagtgacagggtctggctatgttgcccaggctagtctcaaactcttggcttcaagcaatcctccccaaaatatattttattcctggcccaatttatttttaaatacacatttattatgaattattatgttactttaatattgacaccttaacctaaatataaattcaattagttaaactagaaattaaatggagcaaaaccacccataaaacaaacaagaatttttaaataagtgatatgaagaaagcaatttcaaacttttaagtctttcagctacataatatctatcatgctgggaagaaggtaataaccatcagtttccatttaattactatggattttgtgatttcctaaggaaacattttatgtaaattttgtacaatgggcattgtaaacatatttcaaaattaaaaatttaaacagtaaaaattaaaaattagctttcaacatttcacttgaaatttatcaagatatgtatttgtgttttactctattttttcacctctcactcccttcacctttaattttaagagagcagacaggcatttcctttctcaagaacatttgcagggtccagagcagaggcctcttgaaggcatctttcttttctgtcttgtgtgaatctctaagcaaacagagagtatatgaggtatctaggtgaaggaggagtcaaatgttagtatttttaaagagagagaagccaaacaggcataaattttttccaagagtagggaagcaagttctcaaaatctacagtcagcattttttttttccccagcctgggggaaaggagaagggattaagaggttaggcaggaacccagaggatggggaatggtgagcgggtcactatatgcccatacagtgcctctatgtgaaatagaagaaaggtaacactgctaggctaatgcagtcctaagagaattcagtttggtaaatggagtaagtacaggctggattttagcttccgttctttctctcaatcaagtgccctttcatgaagaacaatctgcctactgtacatagtggccccatgcatggtgcacatagggaagctagtcccttggcaccatggtttttggcatcagcaaatattttctaacagtaacttggtataatcatcagagctgcctgccttcgaaagaccatatgtatcttagacaataaagatatgactaatgaagaaaacgatggactaaagatgtgaaggctagttttctaggtatcacacaagcctggactctcattcaagccttgagaaaagaaggtccctgccctaccaatctaataactatgaaggaatttttcaacagcctaatatgaagaagggctaagttcaaattaggatatttcttgtacacttgagttggtggttataattttatacctatgtcaataatggtaaaaagttagcaatatattcactgataatatcttttttttttttttttttttttgagatgaagtcttactatgtcacccaggctggagtgcagtggcgcgatcttggctcactgcaacctctgcctcctgagttcaagcgattctcatgcctcagcttccttagtagctgagattataggcgcctgtaaccataccaggttaatttttgtatttttagtagagacggggtttcagcatgttggccaggctagtctcaaactcctgacctcaggtgatctgcctgcctcggcctcccaaagtgctgggattacaggaatgagccaccaagcccagccatgataatatatgtctagcccaggcaccgtggctaaggcctgtaatcccagcactttgggaggccgaggcagaaggatggcttgtttccaggagttcaagaccagcctgagcaacatggcaagacccgtctctacaaaaaaattaaaaaatttagccaggtatggtggcatgcacctgtgcctgtagtcccagctattcgagagattgatgtgggaagactgtgagcccaggaggctgcagtgagctgtgttcacactactgcactccagcctgggtgacagagtgagaccctgtctcaaaaaaaatacatatatattatacatatatggtatatatataaagtatatatataatacacattatagtataaagtatatataatgcacattatagtataaagtatatataatacacattatagtataaagtatatataatacacattatagtatatataaagtatatataatacacattatagtatatataaagtatatataatacatatataatatataaagtatatataatacacattataatatatataaagtatatataatacacattataatatatataaagtatatataatacacattataatatatataaagtatatataatacacattataatatatataaagtatatataatacacattataatatatataaagtatatataatacacattataatatatataaagtatatataatacacattataatatatataaagtatatataatacacattataatatatataaagtatatataatacacattataatatatataaagtatatataatacacattataatatatataaagtatatataatacacattataatatatataaagtatatataatacacattataatatatataaagtatatataatacacattataatatatataaagtatatataatacacattataatatatataaagtatatataatacacattataatatatataaagtatatataatatacattataatatatataaagtatatataatatacattataatatatataaagtatatataatatacattataatatatataaagtatatataatatacattataatatatataaagtatatataatatacattataatatatataaagtatatataatatacattataatatatataaagtatatataatatacattatattatatataaagtatatataatacatagataatatataaaacatatataatatataaagtatatattatacacatatataatataaatatatacatatatcatacatattttatatatataatataaatatatacttatacatatattatatatataaagtataacatataaatatatgtcattttatgtatatatttatatatacatatatacacatacacaaaatgcaggaagaattcagtatggacagaaatacaaatagaatgtaaatgttatttcttattaaaataataaaactcataagaacacctcttaattatttgatttaaaccttaggtagaaatgaagggtgatgtagcacatcattatcacaaaaaagaaaccacatttatttagttcttattctttttttgtttgtttaacagagagcttcagtttcacgtcactgtcctagcttcatctacctgttgccaacaacttgaaggagtttctccatagcccttgattcctgaattgttcaacatatcaacagcaatagtcacaaatacattgacttaaggagtaaacaagcagcttttctctacagaccactgagcaccccaggaaggtgcagctctctgctccaccccagcgtcttggtgtctgtgtccagcaggaaggacctggcaggaggctgaatccaagcactgctttcaggccactctattctcatccctggatcctccagggaaataagggggaaaaaaaatgacttttcctgctttcaaaatggagggccttaaaatcaaccaaagttccagaacaaaaacaaaacacaggagctggctgggtgcactggctcacacctgtggtcccaacattttgggaggccaaggtgggaggactgattgagtgcaggagttcaagaccagcttggccaacatggcaagaccccatctctacaaaaaaagtaaacaaaaatcagtcgggcatcatggcatatgtctgtagtcccagctactctggagggtgaggtgaggactgcttgagcctgggagggcaaggctgcagtgagccgagttcatgccactggcaccctagcctaggaaacagagttagaccttgtctcaaaacaaaaacccaaaaaaccccccatcatctgcaaagccatgttgggagcacaactgtttcccataggctttctttttccttgccccattgacttccagaaggttttccccttacccatcattgtgacttttctcatctttcacaatggtgcaattcaataggaagaattaacaactagaaaaggaagaacaacaacaacaaaaaatctaaccctatgaaaactctgccttcaacataactccagggagatgaacattataatactggcactcctgacccacactatcctctgcaccccgtccctgaccacatcctcctctctggacacttagacatcaggttccccaagggacaaggttccatgaagagcaccctgagttccttagaagaactggcactgctccggctcctctaacaactgagactggcactgtgggcaccaccaggtgagcctctggaacccacctgagggcccaaagggcttcttcatgacctggtggccagctgggcactgttctttctggtagacctgcatgtgctgcggtttgccctggaacttgccctgcagccaggctgtactgaactccaccacgtgatccaccagggcctcctaacatggaggcactcaggactgaaccaagagaaaggggatggatgccagctctgtacaagacttcattcttaatgacgttccctagccctgagaagtatttctggtccaatggtgtataagtgacaggctgagcctggcctagagcttccaaggcttgtcctcaatggaacttctcagacaggatgtcacaggtgggtgtgacctctggggaagagctccaaggcatctgacaattataaagtgccaggaagctaccaccaccaaagtacaggaccaacctcggggcagggtccctccggtcccccttcttgttggctttcttggctctggagaagtcgttcacccaaacgctgccaagcaaacaagagctgacacgcagccgcctcccagcatctcctgtaggggtgtctcccttcaaacattcctaatcatcctctccctgggggacgagctctgcggactgtgaggaggcgtcaagggtcttctgcccacttgctcccgggcctgctttgagtccacagtcccttccttctgcgcttctttttgtggaggctctggcggtgagctgttgccagcgggccccatttcttcatctggatcaaatctaaggaataatttctttccatggacctgggtgtcctggagccacagagactggaggctggtgggctatacttcttactgttgctccctgtctttaccacctgcttgcccacaaaaggagagaccgaatggtgaaatgtcctcaccaacagcccttctggcatcccagctccgggtgggcagccccttggcccgacccagcaccactgcacgccccgcacagcagctccagcaccaggcagagatttctcagcgccacggcacacgtgggctccgtccccttaggggacgcccctgtaggttagttcttactctttagagagaactgttttagggtctgggatacataaaatgagtcccccccaccgcccgagaatacagatctaaatcagtaatagagaaagaatatatttttaggagaaaatacgttgtgaaaacaactagcactccagaagttcaaataagaaaattatgactaaaagttggggtggccagagaaagctttagggaaaagattgtaatacattgtatttcgctaacacagaactcatcaatctgtattataactgcttgtttgtttctatctccctctaaatggaaggatccatgaaattgaggactttacatgtgaatttaaagtatgacaagcatttctaagaaactaatagtgaggagagagattattaagattttacatatagtatgaagaacaacatcaaattagcacaattaaataagagagcgagcatatatacagcaaatcctcacctactgtcatcgatagggtcttgaaaattgcaactttatgtaaaatggcatataacaaaaccaattttaccacaggctaattgatataaatgagttaagttcccacggcatattttggttgccacaaaaacatcaccaaacttctaaaaagagacccaaaacacttctactattaaatattgaaataaatgtgagctatatgtacatctaagaaagattaacaaaaataagataattatttacccatttattccacttcagggttgcaggtggcctaacacctactgcgccaactcagggcacaagtgaggaaaccatggtgccttggacaggacaccaggtgccatcccatagcagggagcacgtgcgcgcgtgcacacacgcacacacacacacacacacagagtcagatgggtaccaggtagacacaccagttcaccttatgtgcacatctttgggatgtgggaagaaaccagagtacctggaaaaagcccacacagacatgggaagaacatgcaaacaccacacagaaagtggccccggccatgaattgatgttttttttctcaccagcgatataacaaaacattgaatgaaatgacgttatttgaggacatgctgtacttaaactatattgcagtctcatcacaagaaaatctgcatgaataagtcggtgatgagagtgcaatactctcttaatacgaaataaacatgctgaactcaactgatatataccaatatgtaacaaaataaataagcataatacagccaaaatcttactgtggatgacaatggcatttaagttatacagtagaattccattttaatactaaaagcatctttctaagaaccatatcttgatacaataccaaatattacagttcaaaattatctcttttgacagatgaaatgtagtaacagagtcaaagattatgcctttctaatacttttaatgcacatttacaaagtgaagtatgttttatattcatcagaacagaacagtcagctctggataaaaaacacatgttcagcaattctttaaaacatcagtggaaaatgataagtaaacaacactgacagaagacagatacatttacaattcacgttttcttctggcttgctcaaaataattttaatctctatcacttaattaggtagatgggtcttagaggcaggtaacatggccaacatttagtgtatcatctcctaagataaaaatttgaaaggttcaaccagaggttacaccacagttcaggataagctcattgctttgatcacaaatcccaaggctttcatggcataatgacaaggattggttgtgaccacacatatgctttagttttctttattaaggtataatttccactgatatgaacaacctttgcagccaggctgtatgattctccttttaatagtcaccaattctatgcactgaactaaacccaccacttcaatatattggggcaaacataccaactactaatctatcaaccaaaaagaaacaagataatcaaaatagaaataaaaatgaagaagctcctttttagttaaaattaaatatttatttcatttttcctaaatatgaaatattgacaactcaaatagaagcatgataaattagaagttaactaatttaaggtgcactgcttagggacactgatggtaaaaaaatgtgaaagcaaaattttagcttttcaccactgaaaaaatgatttaaaaaattgaaaataagctttcttaattaacaaaaaagagctgattaacaatatattataaaaatataatgtgcatgttttgatacattttaattttcaagatttattttgttagcccataataaaacttttaaaaaattcactagagatcaagaacattgaattgcatttataatagttattttaaatcaactgcatatctgaaagctttcaagttgatatttaaatttagtttgtcctaatttggtagataaaatgctgttttttcctacagtaaaagaaaaacaatcattttcaaaattggaaaagaaaaaataatctataatccttccagaccaaccccataaatattatgtggtttttagatattataaaactgttatttcaaatgcattacaataaagaaaaatcatggattacaaatcaatagataaatgataatctatttcaatctgatatagtagaaaaaataattgggtttaagtcttgtctactcaacttactgtcacatgtactcaaattaatttaatttctgtgacccttactcacctcaattgccatttcaaaatcacagggtttgctgtgaggctcatatgggataatgcggaattctatatatacataagatattattatcattagtaggattcatgataaaaatcccaaattacagactcaacttgcctaaatcctaaagccaataggtcattcactgaattatgcccatttataaaagcatttaacataactctaagaatacttaacaaaacttactttcaaaaatatatatgcccacaaaaatatttgagacttaatacttcctgccaaataactatgacattcaaaacaaatatattattttttttattagcaatgacagtagggtttaacatgcttcatattatgataaatatccccaataatttatggttctttcttgctttcaacacatttttcacttccatgtttgaaatggacatctccattgggccttttgctgttctagacccttatctccaaataaattataatttggaaagaaataatgggcaataataatgcaaacaaaaagtgagctgtaactgccgtaagagaagatgcaaataaaatttctggaataagtggtagacatatatttagtatgggagaagaaccacttatctcagtatctaagaacgcattaatgaacagtctacattttctagttgaacaaaaaatatgataagatcaccagtcaaaaaacaaatcacacttgacatatgcatgcatttttataattctggaagacatgaatattttccaaatgccttaataggtttttaattttcctgtatagtatgtaaatagcatgagaagaaaaatattcagggtttcaagtaatttttatcaatgagcaaaatgtagttcattgtagacacgagtacaaacttcaatacttaattagcacaaagtttcatcatttaacctactgatacttgaagaaaagggctaaagagatgtggctaaattaacaaatcgcaagttatctataagttacgtataaaaagcaaggataaacagacatatttgagaaagcttgagctcactgatgaaaaagaagagaggctggcaaaaaacagaaggaaggagggaagataggaaggagaaaggaatgagcacttaagttgaaaatgtgcaaatgcatgaataaggataagattttaattttactttctttcagcattttttaaaactctaaattattaaaatggtgtctgagaaccggatgcagattttttttactaagaaaataaaattactaaatcatcgaagtttaagttttttaaaaaataaatacattaagaaatacattgccatcaattatgttctattaactgtagctaagcattttcttataaacgggcctaatgttgatgatatcagcatccatggaatgtattaacatggtagaagatgtgctgctagggaaagaagaaacctaatttatcttcagattgcagacctctgggatttctgaggtagtaaagggaagtcaaaggtctcatgttttacaaatctcacaagccacaaaactattctatgatcacctctactgtatattattatttaacatgcatatgtaatttaaaactttttaagggttaaatattaaattatatatgagttcatataatattactgcatagtcatttatttttaaaataatatttagtatctcttaggacttaattgcattctatttacttaactgtaaatatagaatatactttactgaccctactaacttcataacttaatacactcaccactaatgatgcacattaaattataaaataggtttttaagtgaaaaatccaagatatgaccagtgatggtatgtccatgttcgcaaagctatcacagtaataaaatgtagaaaattgaatcattaacaacttgtggtcagcatctgacatccagctaccagttctcttgtggacataaaatctcatcctaaaaaatgagatgttagtagtcccacttcatatcaggcatatatccatttgagtttggctgtgcccttctggctagaataagcatacactctccattttctcctcaaactacctcgctatttttcccaggctctttcactaactcttagaaaagctttatgcctcctgtcccttacagtcaaccaaatgctcatttgtttgcatatctttaatagctgtgacacagatcaggcagattgcaaagtcaatcatatctattatctggctattacttgctgaactggcttatataattaactcaagcatttttagactgttaccaaaggccttcatattagactcaactgcctttcagaatctctgtttctatgttttctacacacccgaaacataagaccaattaacagatcaataagcaatgtgccaaacgtcttttctgagctttgttcatgtcacttcccttgctcagaaccctcttcctcatttcatcacattattaattcaatacatatttaatttagtgcctaccatgctccaaacacctttgtagattgtagggataaaccaatgaggaaaacagtcaaaaatttaggatctcatggagctaatggtcaagtgggatatgacataataaacaaatcaataagcatgagataagtatgtcagatggtgagtgacataaagaaatatgaagtcagggagtaagtaaaagtgcatgaggtgatgggggcaattttaaatagggaggagagagaaggccttactgaaaaggtgacatttgagcaaaaacctgaaaggcatgaagaatgagttcttaaagataactaaaacaaatgcctcaggtgaaaggaaaaggaaaatcaaaggtgctgaggtcagaagtacttgaaggacaccaagcagaccctgtttagctagaacagagtgaacggggtggcaaacagaagagctcaagatgtaataggattttggaaaggagttaggtagtgtagggtcttacgttgcaaagatttcagcttatactcaaataggaaaccatttacgatagggggaagactgtaagaatagctttgaagaaatgaagatcaggaatttagttttgaacatgttaaatttaagatacagtttatatattcaaatggagatgtcgaggagggagtcagatatcaggagaaatgcacaggctagagacataaatgtgggaggtctgttagactctcctgcatcccttaagatacagcttaaaaatcacttattctgtaaagtcatttgcaatcccatctcccccagtcagaattaatttaattttgtttatatcttactatataagatatagcacttatcactatctaatttgtactaaaaattattttatatatgcctgtctttttcatctggagagatatgctaactaaagaactatgtctattttattcttttaattctaaatgctctctactatatattaaatatagcaaataaccaataaatgctagcctaactaaacgtgttttgggggattttaattgacttctcatagttttcttcttaaaggcagggagctaaatatctatgacctaacaaaacttgttctttcttctgtgctatatatatatgcccaagtcaaatttaatctttcactctctctctctcatcttacaagacaaatcaatcaccaaatcttaacagttaccttctaaatatatcttaaatgtatccacatttctctagccccactggcattactgaatataagccttcactgctccttgcctaattaacaacttactgactgcttccactctgggccatagacaagggcaatacatatgtcaacaccaatcacagcggtctcttaaaagcacaaaatctattcatgtcacttctttgcttcaaactctcccaagtctccccactgcacccaggataaagttcatcctctttcacaaagcagaaggcccctcatgattggtcctgaatctcctctttcctcttccttctcttcatttcagacgctgtatccatgagcccaaggggcatgagcctactgtactaaattgctgggacttgttttactgtaggtatctcctctagtgcaaaagcccactgaaggcaagaattgtgtcatatttggtgctatatcacaaccagagtctgacactggataaacacaattaaaatacaaaattttaaaagtaaatgatatctcagggttcctccaaactttttaatctaatttacttttgtacaggttataatttaataatatattattatattaaattcggggtttctaaaaaagtatggttctccaacaatctccgtttcagatccatttactactgtccccattccaaagtaatgaactgggatgacatttatgattccttctatgttctagtaccaagtagtaatcatttctacaggagagaaagaaaataatttaaactgcagcaagtcagattgtacttcaccattagattgaatttatcaacactaaaggaatctgaaatgagtaggcaacctcaagagaaggggaaaaaatcaatgacaataaattgcctagaaaagcttagatatttgcctaatatttagatgtagctgtctagtcaaattcatttaaacttcatgagtctaatttgttacataaaatttggtcataataattcaaggttcaggctgaagaaagtaaactattctgaaccccagtttctaaatttaagtgaattttaaagatttaaaacacagaatctactggggattttaaaatattatttatcacagtgataattctccaacccaattttaatactttgtatttcagtcttcaagattacagattgttgctactaattgtctgtttatttttagatgaagtacacatcagaaacatcattgttcaaaaagggtgaaggcattctttccataagcccaaactatcccttgatgtgattccaaaacaatgctctgaatctgcactgccccaagacagcagccactagccacaaatggctattgaacacaaaatgtgtggctagtctcaacacagatgtgccatgtaaatagagacatgttgagtataaaataccactggaagacttagtatcaaaaaatgtaaaatatctaataattttatattgattacatattgaaataatattttggatatatacggttaagataaattattaaaattaatttttttttacttttaaaaatacgactatgaaatcatttaattacataagtggcttatatttgtggtttgtattatatttccattggagagtcgctctaagtctacttagaaaactgatcaacactactgatctgcttcttcagggagaataaaaaccatcattgagaggtcagatctgaaatggaatcaccaatgatgcagagaaatacaaattatccacaaaactttaaaaacagtaaattatgctataaataaaagattgctttagtgtaaaaaaaggtctcttctttaaaataaaaagaattaacattttaaccttcatttcataggaataacctcaattttgggtaatattattctttgagtattgggaaaatttaagaaatagggattttaagatattcaagtaacagctccccctcagcaaaaaaacaattaagttaccagaaatgtgaccctattcttatttttttctttctgaaaaaatttaaatcttcttcataccttacatttcgtttttggaaaatctcacaaaaacattttacagaatgtatactatattaatcaggcaaggtatgctttaggatctactcaataaaatgattcctaccaccccaccatcatatttcaccatctcctctctactgtttaacatttctttagtatttctaggaactccagcaagacaatacaaataaagttgacaattataactaataatgactccacctgaaatatgtgatagctgaatgaaatatttacatatatttacatatattacagtaatttaagtgtgttcttttttttttttttttttttttttgagacacagtctccctgtcacccaggctggagtgcagtggcgctatctcggctcactgcaagctccgcctcctgggttcacgccattctcctgcctcagcctcccgagtagctgggactacaggtgcctgccacattttttgtatttttagtagagacggagtttcaccgtgttagtcaggatggtctcgatctcctgacctcgtgatccgcccgcctcggcttctcaaagtgttaagtgtgttcttatatatttatctctattataataatttaaatatactttctaaggtgccaaaatataacattttaaaaataaacaggatcaaaacaacaacaacagaggcatgattaaattcctcctgttttagaaagaccaaccaacaggaggttctttaaatagcctgtataaccatatattatacaattgtcaaagtatttgaaagtcactaagttttagggcccaaattagctggttatcaatataaaaatgggggtaatttatcaatgccctacttactatcctacagatattagggcatggtgatggagatggagaaggagaatatacacattggtggaaaaatatcagtaggcttcacaaagtaagttctgaaaaaaattttgtgcttccaaacataatgaaacatattccaaacataagagggagctggatttgactccttattatttgtgatgaaacaagaataataagaaaaataaggaagaagaaaggtaaagaagaccatgtgatttcttttgatgttatagttgtttagatttcttttttattttttttacaggtagggtattttaaagaatttttagagaaaatgaaaccagacacaaaccaattaaagaatcttgaaagaaaaaggctgaggttcaggaaaaaaagaaaacaaaatcactagcatctatcatatgtacctcctgcccatcaaagcaatgaacaggaatgtctagtacagatagaggcagaaagctgaagatacctactattgctattataaagcagcaaaacataatattcaaattcatgacttcatttttgtttatatttctagtagcaaacttaggtatgaggttaaaatttggtcatgagatgcttaacaaatgaaggaatttggaaagaaaaaaaaacccacacataagtcttcaatttcataacaaaatgtcaggcttatcaatattttcatttctcttattatttctcaaaagagttacataagtaattaaacagctttgagattagaggtaaaatttaacaaaattattatatctgttaactattcttacttacttttatctaaacatccaattcaaaattatttactggtgatttttaaagagtatgatatataattttcaagagtatatcagagtatattatttgtgagatcaaaaaccctgatagatgtcccaataaaagattatttttgtatacaatagaatcttctttaataaagtatctttcacataagcaatgtactctacagtaagatgtgaatacattttgtagactttaaagtatcatacctaaaagcaagatgcaattgtcattatactgaaaaaatttttaagtactctacagtaacatacacattagcagtataacttttctccttttggactccaatatttctcatctggcacttattttctcccatatggtataattatttatatatgtcatatttctctatggaactataaggaacttcaaaaccatagggatatctcattatacttaatagatctaacacagtacaccttgcagaaagagacaccatttaaaaaaaaatagactgtatttctgtaggtagaagcaaaattctagtaaggactattactagctactgtgcagtttttgatcctttgatctttcatgcatatagatagaataactcttgtttttgctttattaataatggaatgctttactaagcaaaatcaggtatgcttttagaaccagcagcaggcaaaacacaattatttcaagaacgggtacataggatatctaaatatctatgtctgagatttttctcatggtatttttcagactatagtaattttgttcactgagtttggaattccagccaggcacaatggctcacacctgtaatcccagcactttgggtggctgaggaaggaagatcgcgtaagacagttcaagaccagcctgggcaacatagggagaccccatctttacaaaaaataaaaaattagcctagcgtggtggtacatgcctgtggtcccagctactcaggaggctgaggcaggaggatcacttgagcctggaaggtcgaggttgaggctacagtgaattgtgattgtgccactgcacctctagcctgagtgacaaagcgagaccttgtttcaagaaaaaaaaaaaagagttcggaatcccattacgcatggtgccttacatgctttacattcacactacctaccatattttcccttcaacaaaaagattctaaagagaaagggaaaataaaaaaaacactctacaacaaaagacagagagagaggaaggagagattctgatagaggagagacagtcatgtagaacttacagggagaggccgggcgcggtggctcacacctgtaatatcaacactttgggaggctgaggcaggcagatcacttgaggtcaggagttccagaccagtctggccaacatggtgaaaccccatctctactaaaaaaaaatacaaaaaaactagccaggcgttgtggcagatgcctgtaatcccagctacttgggaggctgaggcagaagaatcgcttgaaccctagaggtggaggtggcagtgagccaagatcacgccattgcactccagcctgaaggacagagcaagactctgtctccaaaacaaaaacaaaaacaaaaacaaaaacaaaacaataacaacaaaaactcccagggaaagacaagagatagagacagagagagacatgctgtaattcttggccatttaattaaggacttatcttctgagatttatcttttgtaaatagggctgtatggcagtagagaaaattttcaacattcactcaacaagtaatgcactggcaataacaactataaaacaaaacatttctgtaccttaatatcagaggtatcacgctgactgtttcgccaagctctggaaattgatgaaaaagttcgatctgcatgatcaaatttgcctccttgcaaatttaggaaataagttgtaaagggttcctaaaaaatagcaattaaaaaaatccatatgttccctcaggcataaaaatgtggtttttataaattcttagaactaaatactttaatgactaataggcattcactagtaatataaactaggtatataatgagaattatatctaaattattacattaatgttctcaagttatttttccctcaaaagaaatatttctaaatatttcaaaaatttggtatttgcaacattttcttcaggtagccttcctttccaagaataatgtattaatatcatacagacataaattagatgtattttcttcatagtacagggaatagtccagtatgtagttttcctattgttatggctcaatatttaatttatgattaagaaaagaaaaatgtttggatgatttaaaagcctcctcttagttaaagaacacttaaacacatattagtggataattgcttgaaattagctaagcactataaattacttctaggatttatgtctgcctgtatccttctaacaagctttaattaatgatgtgctgctaatgcttttccgaagaaattgctttctagtagatgaatcacctttcaatttcacagaaacatttcttgtttaaccaatatattatcaatacacgacagccttagttttaccaacaaacttaccttattccatttgggacaaccttccaaaatatataagtacatgtctgtgttagtaacaacttacttagttcttattttaatagactacattttaaaagaatttatgctacaatttggaatctggtaagacagcaagcatctgaaggggcaaatttaagaaaaaaattcatacaattccagatgaaacatttttaaggcaatacaagccaaatgagatagagatatttataattagaacttcaataatttaaactgactcttttagtattcaaaaaaatatgcttatgagttctaatttttgcatatccttcacaacactgaatttatttagccatggtgtattattcaaattgaacttactattcttagcagccatgcaagaacaaaacttgcagttgagtaatgagtaccatagtgaaactttggaacttgatcatcttcccatgattcataacgctcagcgaagaatgctgctctttttgggttcagagctcctattggctgccaatagggagggaaaaaacaaagaatacatcaatgtaatcatccttcatgtcttcctctcttctgatgatatcctactggtaagtataaaagtgaattttaaaaatatatactacttaagctgcaacacagtatcatattgggagtaaaaagcaatattttttccaacaagttaaacacaacatataagtaagtgaatggatgaacccatcatttctccataagtctagttttcatggaacataggtgtttaatcatcccataacaagcatcagataaagacaattacatgaagtgaaatatcagctgtacaacactttggaaagcacctataaaaccacatttagttaattagaagcaacaaccagaaacagaatcttaaagctgaaggactgacttataatgggttcttagaagaggatgaaacaaaactgggagataggtgagatggagcacaaaggaagaaagaaattgtgggaaaacagggttaagaaactagaaatttctactagtgtgagtgaaaacaaaggataaaaatatgcctatatgtctatataggatatatagatatatacatatatatgtatatactttaaccagaggattaaaaatatgccggcatgaactctctctctctctctatatatatatattataaaattaaaaatatcacattaaaaataatgctatatatatatcgcattaaaaaaagaatagtagacagattatgaacttatactggaaaataatactttacagcagaggtcccagagcaatatagcaacatggtgaaaaccctgagctcactggaatgataataatactcattcaaaaggttgttttggaagataaaaatgagtaggtacgttaaagtccaacaaactatgcctgacaacgttcaatgaatgctaactatggtttttaagataattgtttagaatttgggttaaagagtttgaatgaaataattgcctttagcaaattgcttagcataagataaagcttaataaatgttagttggtacctgtatctttattattgctactgctgttgtcatttaggtaatacacgaactccattaaatagcaggcaaaattctgtgtgatcaagcctatgcatgtacatatccttacaaagacgtagagaatatgcttgagagtctcaaaggagtctaaggctcaaaaaatgttaagatcaactgctttaagtaacaattcattctcaaaaaacattctgatctctagaaaatctctattccgtattcaaaatgttaagtacccactcactgaaaaagacatgatatataagattacttcttttcataagatacagaggccaggtgcagtggttcacacctataatcccagtgctctgggaggtcgaggtgggagattgtttgagtccaggagttcaagaccagcctgtgcaacatagtgagaccctgtttctacaaaaaaatttaaaaatcggctgcgcatagtggcatgtccctgtaatcccagctactcgggaggctgaggtaggaggattacatgagcccaagcaccttaaagcctacagtgagctatgattgtgccactgtactccagccttggtgatggagagagtccctgtcctgtctctaaataaattaataaataaaaaattctttatttaaaaaaagatacacaacagtcttttgccttatatcatttatgaacacctattagttaatcactccttatttataacagaaagaaaatatctgattatttgtggagaaaatgttaaaataaataaatcaaaaatattggtttaaaagggatgcactgagaaatattttattgaaaatgaagcaatgttcagaccagtttttaaactgcttttcatgttacatgttaagcaacatcttaaatttatcattttggttatccttattaaattgttaattattttttcaaaactatctttggcatcatcactcaatagcttggttttaatgaatattattgtatgttaaggcattttttcctttacaagcaaaattttaaaaatctttaattaccattttaagtcagtttcacagtaaactaatttaaaatgctatcttttaaagcattagtttctgtacaaaagaatcatatctgacttactaaatatgtgccagttaagaatggagctgactccaaggattctttctttgttacagaaccaatttgaaatgcctttaaatgtattttagttgttgtccctaaagaatgagccatggaaaagaaaagagagaagaaataaaatcactagaagacaaattatatgaattaaaaatagaatcaatgctccttttgtatggtctgaagcataataagtattcactttatctgctcctatttttattactctccaaatgagtaacccccaaaatcaatagttatagaatcacgtttcttgaatataatgctaaaaccaattaggattgatttcactagcatctgaaaaaaaatggcatcttgcagagatccatattggtagaacccacagtattgattttggctgttattgttacagttggtttctgaagcctgctatacgacagctatcaagacataccacgtttatttgcaagcatataaaaaagaagtccccaaataaaagaaagttaaaaaaaaaagaccagtggagctgtgcaatgacaatgatacactatcagcttactcagagaagttacagtgggaatacacacattgaattatacattacgcgaaagcactgatttattgtggtaataacatccacctcattaaaagattctgctttgctgcagttggaaggctacatattgtttactgctataaattaatggcagtgcaaagaagactgtggaaccatcctaacaatagatctgtaatgacagtgctgtatatcacagcttcctcagcagcttcataataaaatggagacaatgtattgagctaatacattctaccatgctggcccacatttttctgacaactgctttaaaagatgatctgaattcaactatgttataatgctgcaaaacatttaactaagcaagagtcagtcatataccaaagtgcatcaaagcatttttaaaacattgtctaaatcagcatttcaggatgtttattcatctctgcaaaagaactaaaagtaaatgctgacggatcctcttacttatatagtatattaagagtcaaaattctaagtcagtttgggaagatgctagcaccatcatcctacatagagcttactgtacaatgtaacaagcttgacaaagtatttttcttaaaaagcaagattttaaaggaaagtgactcaaaatactggccattaaaaatggtcataatttcttttaaaaaatcagtaaaagtaagtattgattagaaagtataaaagtggtataattccaggtaaacacaaatagctctagaatacagaaaaataattttaaacactacaaaaagctaacaaataaatagaattatagaaggttttcttaactctacaaactaagaaaaaatctcaatcacaatacaatgaaaaataggtttaagtaaaatagaatagaataatttaaaatgtagagtattaggtctaacaacaaaatattatgttaaaaatataaataaaggacaggcacagtggctctgcctgtaatcccagcattttggcaggctgaagcaggagaataacttgagcccaggagtttgagaccagcctggacaacatgatgagatcctgtctctataaaaatcagaaatcagatgggcatggtggtgtatgcctatagtcccaactacttgggaggatcgcttgagtccaggaggttgaggatgcagtgagctgtaatcgcgccactgtactcagcctgggtgacagagtgagaccctgtctcaaacaaaacaaaaagcagaaataaaaacttagattaaagtaggaaaagacaaattaaagaaaaccaaaactcttggaaatggtatgaatagccaaaaatcactgtatttaggatattttaataatttcacaaatagcaaagctgacatctgtggtagaataataagtattctgcttatgagataataatgatatctttcaaaacaggatatgcaaaataaaacttgtaaaattggttttgtaagaagactgcaattaaaaaaacattttttgttacgttctttgagaagtaattttgctagttaacaaaatccctgcatataaagtgatcagttcagtgcctggtacataataataatgataataattattatttttttcaggttatttgatgaagaatatttaataaaaaaaggcactaagtaagcctgatgaaattaatgggatctattaggaaagaccgtgattaaacatcacaatcctctaaagacaaagcaggataagaacatatagtactgtggatgatctgtaagaagcctaagagtaaacagtagtccccatcaatgaattttactactttaagaacataatcaaaacaaaattacttttcaaaaatccaggggcctccaaattttactacgaaaagcataagaaatatcaagcaacttataatcacctcctactatattatttataaagaaacagtttgaattaacagactcctttaaaagcacataacagactttggtctaatattagtaaaagctgtaaaaaggtatctgttttttctttctttattaaaattttaggaactcttacctgaagttatctaattaagaataccacctccagcttacattttgtaatttattaaacattattatacattctcataataaataggtaatctagatattcctattttaataataaagaaatgaattgagtaacctagctcgaaatcaacataaatttagaagactcaaacctagtactcaaaagtccttctctgggccatgttatgtatttatatttaaaactattgtattacaagttggttttcctaatttcaaaaatgtgctgtaatctcaatttttcaaatatttctttacttaacaggttgatttaaaggccaatataagtaagcacttagaagagttcctggcacacacacaaaaaaatacttaacaagtgtagctgctattaatgtgcttatataccataactataattccttctttccttctgaaatttatatatgaatgattacaattaatatcaacctttcagaagtgaaattccaaactactggactatacttatagttattgaaggtaagaaagttctgggaaattggcaagaaatctcagattttttacaaagcagagatttgcttgtgttagctaacttctcttttaaaacccaaaagtctcaagggagtttttcacacctttctgtaaaggctttctttggaaaatcattaaactccaacgtttggagatgagaagcagaaaagattggggttaaagaaaaggaaaaaaaggtaactctaaaccaaaacactaataaatagggtgcttgaaaatgcttaagcatagtattttatcaagatacattctgtgggtatacagaggagtgaagaaaagttgtcaaaactgaaaagaagctcaggaaagggaggcaaaagagcaggactgctttacaaccctgcttaggatcctgatgactggctgaaagccatctgccaatgtaatcttcatttgatatgactgggaaatcagaaacatcctttaatttcgtgatgacagataaagcctgccttacagtactgaagaaggtgcatgcaattagaggttatatgttatttcattcttccctaaaagtagggtaggccacaggaaacaaaagaaaaccactgcaaagtaagaggaaaaaactagtaaggaatagaatacaagatggctgaactcaatgttcttctatgctataaaaatgtcaggttaaaggacagaatatcatcaagcatctgatatatgttaacatattaagtaaaaaatttcaaattcagagaataaaagaggatagatacactattaggaaatgttacatcataaaagatggtcattcttgattagggaataatgatttggtctgagaagactccagggaaaaactatgatatatatgtcaaaggtgccattttatctgatgacaatgctactatttgctgaatataagcaaaggttctacgagtcttacataaatcatctcattatctttacaacaactcttaatacaaagaccaattagcatccccaatttgcaggtgaaaaaaacagttcgggagaaagtaaatgactatcagtggttggttaccagccagtggcagcagcaagattaaaagccacctcctgactttttaatgatcgccattctaactgctgtgctgcagaggatgtagagaaataggaatacttttacactgtttgtgggactgtaaactagttcaaccattgtggaaggcagggtggtgattcctcagggatctacaactagaaataccatttgacccagccatcccattactgggtatatacccaaaggaatataaatcatgctgctataaagacacatgcacacatacatttactgcggcactactcacaacagcaaagacttggaaccaacccaaatgtccaacaataatagactggattaaaaaatgtggcatatatacaccatggaatactatgcagccataaaaaaggatgagttcatgtcctttgtaggaacatggatgaagctggaaaccatcattctcagcaaactattgcaaggacaaaaaaccaaacaccgcatgttctcactcataggtgggaaccgaacaatgagaacacttggacacaggaaggggaacatcacacaccggcacctgttgtggggtgggagcaggggggagggatagcattagaagatatacttaatgtaaatgatgagttaatgggtgcagcacaccaacatggcacatgtatacatatgtaataaacctgcatgttgtgcacatgtatcctagaacttaaagtataattaaaaaaatatatatatatatatatatttttttttttttttttttttaaagccacctccaaccaaactgactagcaaatcccagagtgatttgggttgtgtggactggtacgctgcctctgcaaggccattagaatcctttcatgggagctttagattaaatgctcttttgaaaaaatactattaaagtttttatccctacttacataatgtctgtggatatcaccttagaagaaggcatcaaaaccgaatttttttaaaaagcgtattttatcttggggacatcaaaaacatgcttggcaaatacagtttttttaaaaaatgtgaacaaaaaaggtaaatgttgtcaccaaagtttattgccttatcttccttttaacttttctgtttttttcttttctatcttttccatgaacccaaatgagagcccttaattttctgtgttgctgaggctttttatagaagccaatgaatttgattcccagtgtctccatcacctgccttcctcccccaccactctagtgaagaaaataaataaataaatagtgtctgtcatttcagcaacattgccactgttagggggtgcagcaactattttctttcaactgtagcgctctttcatctaaatgacaagtataacaggcagcctgatcagcattttcactcaaccttggcttttagggtatttcgttatatgctatataaggccgaaatggtttggcacttatcctcacatgctctagattttatttaatactgtcaagaaaaaaatttcatcagcacaccaccgtggcttttagagttaacaaataagcacttttgttgtcaagtaccagaacactttttaatcccttgaaaacacatcttcttacaagtggcattaaatatatactcactacaccatttcgatttaacaaacacatcttggggaaaagaaagtattccattttacttattgtgcctatgtagaatctaaatcatttcaaatgcttgcactgatagatttactagtgatgtcttcatagttctatgttattcagctacacagtaagtattaagtaatttttctacaggtgtttatctcattttgagaaaatcacataaactgttaaaaataatctattaatccaatgccactgctgagctaaatgcctataacgaccccatagacagtccaaaaaatccaaggataattactaaaaatgttttaagttattatgaaaatgataaagaatgctgatataacaagatctatcaatttgcagatatattcatctgcccacttaaaaaaccagttaaggccattaaaatcaaataaatctatatgcttttaagataggtcattagtggcatacatgtcaacattctgctagcttctataaaccagaaacaaaacaaaattgggaactacttaagaaacattcagcttttgaaattcattttctatttgctttgaaagtcatctgaatataataaaactggttttaatttcggaaaacctctctctctctctctctctctctctctctctctatatatatatatatatatatatatatatatatacatatatacacacacacatatatatatgttgttttgctcaacgctgagttgggaaactgtgtgcttattgtttagcttaagcctgggctaatggcactaaatatttcaatgatttgcatgtgaagcacaacaaaatatatgattataaaaagcaaggaggattccaaatccataaagattagtaaaaatagttattttattctgttttagactaataaattgctttttggaaaaaatattaaatcgttttaaaaatgtgtttatttatttagagacaggctcttactctgttaccctggctcacatgcagtgatacagccatagctcactgcagcctcgaactcctgggctcaaacgattcttctgcctcagcctcctgagcagctaggactacaggtgcatgctaccacactgacataattttttagttttttgtagacccaggctggccttgaactcctggcctcaaacaatactccctcctcagccttcctaagtgctgggattacagccatgagccaccacccttggctggaaaaatactaaatcttaatacaaaaattagacataaagtagcataagttaaagatatcaatatataaggcatggatggaactagaggcattatgttaagggaaataagccaagcacagaaagataaatatcacatgttctcactcatattttggagctaaaaaaaaaagtggatctcataaagattaagagttagactggtggttatctgaggccaggaagggtaaggggaaaatcgatgaagggagattgattttaaaaattatgttaaagaacacagagagagccaggcatctgagttgtaaggcattttaaaactatagtgtacttcaaatatcaaacaaggagataaaatattgtttggcaaatgtaaatgagcctatgtggtagctttcagaagaaacagggcaactggaatcaatttaacaagataatctctaatgattccataagtgcaacagaagacactctaataattctcatgacttaagaatagccatgggtcatacataagagctggtaaatgttgataacgcttttggagtagattattagcaatgtgaggactgacaggcagttacattgcagttgtattcctagaaaaagcccaatcctggcaaggaaggtcaatgatattcaacctctaaaacaatccccaaaatgaagcccttataccaaaaagcagactctgctaaaatagtccagtccctgtatattcctccccagtgctccctcaaggaaagcaaaatccactagtcgaataaaacgggagcagccagattgctgaccaaaaactttgctccattgctggcgaaatgagtcaaaaaataaaggcggatgagattcacaactgctatctaaaatttaccttatttctctgtgcaagagggtatgttgggatagtcatcaacatagagaacttacattttaccctttttaaaatgaaaattttattgtacttttccctctacaactatatatctgatctatatggtgggggagggggttaaatttagtcatttaattgtagtacagtgataatcaatacttatgagggactagaaataagccagtaaagctcggatttagaaaccactgcacctgcaatagctggacagggttttgggctgcctctacaatttaagacaaaaagaaataaaacatagcataaaacataataaaaatcctttgttcagtttataagttactaccttccctttatcaactggaaaaaaaataacctcatgtaacacaaatcatatgaaataattttatgtgtcaacttgactgggccacagggtgcagagattaagcattatttcttggtatgtctgtgaagatgtttccaggtgagattagcctttaaactggtggacacagtatatagatttctttctccaatgtgggtgggcatcatccaatctgctgaggatctgaatagaagaaaatgcagagaaaggaggaatttgccctttttttcctgtctcactgctgaagctgagacagctcatctcatcttttcctgttgtcagtctgggatttacaccatcagctcccctggttctcaggcctttagacctgcaatgaattacaccaccagctttccagggtctccagcctgcagatggcagactgtgggacttctcagcctccctaatcacatcagccgatttctcataataaatctctttttggatacagatacatagataactcctattggttctgtttctctggagaacctcaagataccacatcaagaggaaatgaaattaattcataaggtaaatatagagtatttcttcatattttgagatcaatattgagattacaatcacttataaaatagaatacaaagttttataaactacctcattctggtaatagatggcaaaactatggttccaccatccacactccttttcccaaatgaggcaccttttttaaaactttcaaatttgacattacttaagaagctcattttaaaaagtgatttaacaacacgtggaggtcaaagaatgcactagacaattcacaggaagaaaagcctaagaagtccattaaccatgtatccaaaatgggtaatttcatatttaaaaagctagctaagttgaccatttcctactaaaaggaaccagaggtccttaaacaaatcgctgattctaattctggggcaggaaatatacaaaatagcctaggacaccttgttgtgccacaaggcaaaggatttgtcaaatattaatgggattgtatctaagggacataagacccttcttaaagagacctcactagacaaagtcgtggcaatttcggtaccacaaagaataatgcagttctaccttcatataaaaatgtagaaagtatcagggaatgttgctgtcattgtaacaacaataaaaagactaaaagttgataaccatttttgtactaatcagagagctgaggtaaaagacaaccaaatgaagtaaattccaaaaagttacaggcctcttcaacgagagatggtacaaactgctataattttggcaaagcatgggaggaagaggtagtcaacataaaagtaggtaagaagaaggccgggcgtggcggctcacacctgtaatcccagcacttcgggaggccgaggcaggtggatcactggaggttaggagttagagatcagcctggccaacatgatgaaaccccatctctaataaaaatacaaaaattagccaggcatggtggcaggcacctgtaataccagctacttgggaggctgaggcaggagaattgcttgaacccagaaggcagaggttgcagtgagccaagatcatgcccttgcactccagtctgagcaataagagtgaaacagtgtttcaaaaaaaaaaaaaaaaaaaagggggggggggtgggcaggaaagaagaatctgctaaaatttataaagaatttctaaataccagtattgggtgaatagatcaatgtagaaacacacgggagtttgcatgcacttgtaagctcttttccacgggcctctcccattgctcatgagagagaatacgactgaggcaaggtagaagaccagggggtagctctctaagtaacacaggcacacaggatatgatttacagttactgggaatggcaacaaaacagaaatcaaaatccttaagctgatgggagaggaacaccaaactctcattccaggtcctaagcaaatatcaacttgcacatggggaaagagtacgagcaaaactaatctaccgcaggaaaagggatagaaaatcctgtgtaccacccctaggacccaggcaaagatccactgcttctggggtagggtaaaagcaaaagccctttcaagaagacatgtcctgcactgatgcaaagaagaggtctgctactactgggagaaggataggaaattctttcctgtggatgccatgaggggtagaggcaagaacactgagaaagtccgtacctgaggaccatttcaatgggatctacttaagaatgaggatgaatcaggagaactgaggagctaccctatccaccccacaacaagcctggcactgagttaccaacaacagcaatctacttctggaaaaaaaaaaaaaaaaccagaaaagtacataaaaaaatgcctctgtggcacaggcatagagggtcggctagagagtagagcaagaacagtgagaaaaaacatccaccacccaggccaaattcttacagaagaatttgaagtttatactgtatttaaggtaataatagcaataacaaacctaactaagcttatctattgactagattgactgaactccccacactaactacctgacataagaagaagcatatacttctttgggcataaaatcttattcatatcccagcctatactgttctcctatctcagataaaatagaatcataaaaataatctaaaagaagcacataaagggagacaaagtacaaagaactgatgtgtagaataaaaaacagcaagaaggtagatttaagccaaccatataaaaaattacattaaatgtaaatgacctcaacaccccaattaaaatgcacagattgtcagactgggcatgaaagcaaggctctattatatgttgtccataaaaaaaaagttaaatataaagccatagacaggcttcttaaaataatagaaaaaatgctgcaagtaataatcaaaataatgccctcctgggatattaacatcagaaaaagtagatttcagaacatgaaatattactaagtataaagagggacattgcataatgaaaaatgaattcttttatcaaaaaaataacaatttgaagagtgtatgcactgtattagtttcctagggctcctataactaaatatcacaaactaggtggcttaaaacaatataaacttattgcctcagagttcttgaggctagaaatctgaaatcaagttgttggcaggttcatgctctctttgaagcctctagaggaggatctttccttgcctcttccaggttctggtaggctcagctgttccttggcttgcagcaacacaactctaatatctccttccatcgtcatatagtgttctctccctgtatgtctgtctttatatgacgttttcatacaagaacaccagtcatattggatttgggcccaccctaatgaccttatcttaaattgattacatcttcaaaaaccctatttatgaataaggtcacattcataggtacctggaggttaggactttaacatatctttttggaaacaaaattcaacccataacatgtacccaaaaataaacttgaaaacacgtaaaataaaaactaacagaactttggtgaggtggggtggcttacacctataatcctagcactttgggaggccaaggcagacaaatcacttgaggccaggagtttgagaccagcctggccaacacggcaaaacctgtctctactgaaaatacaattagctgggcagggtggcacatgcctgtaatcctagctactcaagaggcgaggcatgagaattgcttgaacccaggaggcagaggttgcaatgagccaagatggcaccattgcattccagcctgagtgacagggcaagactctgtctcaaaaacaaaacaaaacaaaacagaacaaacaaatagaaaaactaacagaactgaaagaaaatatagacaaatctaacttatagttggagacttcaacactcttctttcaggattcaacaggacaagtagaaatcagtacggatacagaagacatgagcaacgacatcttcaaccaattttacttaattgatatttatagaacaatacttaacaacagaatatgcactcttttcaaatgcacatggaacattaatcaaggtagactatattctgagccatcgaacaaattctcagtaactgaaaagaactgaaatcatacagcgtatgttcctcaaccacaatggaattaaactagaaataaacacaagaaagacatctgacaaatccccaaatacatggtaactaaacaacatatttctaaataatccatgggtcaaaaagcaatttacaagagaaattagaaaacatttaaatgggatgaaaataaaaacaatatataaaaatgtgttggacccagctaaatcagtgctttgagaaaaatttgtagtgctaaatgcttatattaaaaagaaaaaagttcttaaatcaatagtttaaagtttgcaccttaagttactaaaaaggaagataaattaaatctaaatcaaatagaaaaaatatagtatggaaagcaaagatcataggaattgaaaacagaaaaagcaatagaaaaataaataaaatctctaaccagactggtccagagggagaaaaagaagtaaatgccagtatcaagaatgaatgaagggacaacttagatgaaataaacaaattttgtgaaagatgcaaactaccaaaactcattaacaaaaagataacccgaatagcactttatctgttaaggaaactgaattcaaagttttacaaaaaaaccttcccagaaacaaaactcttggcctaaatggcttcactcatgagttccaccaaacatttaagggtgaaataataattgtatatcatcttttccaggaaatagaagaggaaaaaacaacttcaaaactcattttgtcacgtaagcattaccgtgatgccacaactaaacaatattacaggccaatatcctttgggaacatatatgcaaaaagtcttaagaaaatatttgcaaatgggatccagccatttattaaaaggataatacatcacaatctggtttatcacagaaaggaaacactatacaatcagccagtgtaattcactatactaaccaactaaaaaagaaaacgcaattatcttcagaaaaagcatttgataaaagtcaatacccaattatgatgaagactctcaacaaacttcttatagaagggaacttctttgggaggccgaggcaggcggatcacaaggtcaggagatggagaccatcctggccagcatggtgaaaccccatctctactaaaaatacaaaaattagccgcgtgcggtggtgtgcacctatagtgtcagctactcgggaggctgaggcaggagaatcgcttgaacccgggaggcagaggttgcagtgagccaagatctcaccactgcactccagcctgtgcaacagagcacgactccatctcaaaggaaaaaaaaaaaaaagaagggaacttaacctaatagaagcacctacagaaaagcctatagctaacatcacacttaagggcgaaagactgaatacttttcccctaacacaaaagacaaggcactctcagtacttgttaaccttgtatagtgcagtaagtcttcatttcacaatgccatttatgtataaagtcccaaaaagtctacaaaaaggctgctagtaataataattgagtttagcaaggatgcagaatacaaggtcaatttacaaaattcagctgtatttctatatactggcaacaaacaactggaattaaacgttttataacaagattaaaaacatgaatttttaaaggataaattaacaagatatgtgtaagaattgtatgctaaaagctatggaacatttgagagaaactaaaaaaggactaaataagcggaaaagacactatactaaggaattggaacattcaatattcttagtactttatttttacccaaaatgatctacagattgaatgcaatcctaataaaaaatctagaaggctttttaaaaattagaaattaacaggaagcaaaaagcctagaacagccaaacaatttttaaaaagaaaaataaagctggaggattcacatgactttattacatgatttactataaaaccacagtactcaagactgtgatactgatataaggatatactgattaattgtgaagaacagagtctagaaatagacctacacatatatggccgattgatttccaacaaagattccaggagacctccagagaaaaagtctttctaacaaatggtgttagaagaattggacttctacacacaaaaaaatgaaccttaactcttaccatgaacttacaatacattctagacaaaaaataagtagcattagcagccacaatacagaagaatagtaataattctgtttgatccaagttgtttttagaaaacccattaacaccattgggtcaaaataagtagatagtcaattacataatctaaatcagcagctttcaacttttcctgtaagacagtctctaatatatatacacgtacactatctattcacagatctcttgcaacaaacccacagtcccctcaagtgaccagagctcacaggttgggaacaactggcacatcttcatcttcctttctaccaacaagacaccagcaagtgttatacatttaacactgactaatcttaaacctcttttcttccttttcctgtacgaaaaattcaaccctaaatgtaagaattcataatagtccttcatatttcacttgaatatttcatgtgaatgtttcgatcaaaacgatttaaaagttttttttttctttctttgagacagagtctcactgttaccgaggctggagggcagagcacgatctccactcactgcaacctccaactccctggttcaagatattctactgcctcagcctcccaagtagctgggattacaggcacgcaccaccacatctgactaatttttgtatttttagtagagacagggttttaccatgttggccaggatggtcttgatctcctgacctcatgatctgaccgccttggcctcccaaagtgctgggattacaggcgtgagccaccacaaccaacctcaaaaatttgtattttaatttgtgtaaggtaagctacatggtcaatttgttatattagtgaaactgctgaacaagtcagaaactgggacagaattctaaaaagatgccctaaagaaggcaatatctcaagtttataaagacaattaaacaataggattgtatgatgatttgaacagttattaatgttactaacgacttttaattaccttgtctgtatttcagacaggtaacactcagattttaaaataatttactgagataggtcacactagatctataactttcccaatttactggcctaatcaaaacttttatttttcttttttaaatttttaaaaatttcaatagctttagggggtacaagtagcttttggttaagtggatgagttatatagtagtgaagtctgggcttttagtatacttgtcacccaaagagtgtaccataggtgatctttcatccctcgccttccccctcagccttctcccttctaagtctccaatgtccgttatgccactctgtatgcctttgcatacccatagcttagttcccgcttacaagtaataacatgtggtatttggttttccattcctgagttacttcacttaggataatgacctccagttccatccaaaaacttttatttcttattattaatttttttggtgttcagtgttttttatttttttttattgcttactccagttttattttattttttattttttttattatagtttaagttttagggtacatgtgcacattgtgcaggttagttacatatgtatacatgtgccatgctggtgcgctgcacccactaactcgtcatctagcattaggtatatctcccaatgctatcccctcccccacccccaccccaccacagtccccagagtgtgatattccccttcctgtgtccatgtgatctcattgttcaattcccacctatgagtgagaatatgtggtgtttggttttttgttcttgcgatagaaataccatttgacccagccatcccattactgggtatatacccaaatgactataaatcatgctgctataaagacacatgcacacatatgtttattgcggcattattcacaatagcaaagacttggaaccaacccaaatgtccaacaatgataggctggattaagaaaatgtggcacatatacaccatggaatactatgcagccataaaaaatgatgagttcatgtcctttgtagggacatggatgaaattggaaatcatcattctcaatgttttttaatttttaatttttataggtacatagtttgtgtatatacttatgggatacccaagatgttttgatacaggcaagcaatgcataataataccatgtaaaatcaagtgtctaccccttcaagcatttatcccttgtgttacaatcaaattatatttttaattatttttaaatgtacaattatattagtgttgactatagtcaccctgttgtgctatcaaatattaggtcttattctatcttgataatttttttttgtactcattaatcatccctacctatactccattccctcaccacccttcccagcctctgggaaccatccatccttctactctctatctccattagttcaatggttttgatttttagatcctcacaagtaagtgagaacatgtgatgtttgtctgtctgtgcctggtttatttcacttagcataatgacctctagttctatccatgttgttgcaaataacagtatctcattcttttttatggctgaatagtactccattgtgtataagcaccatattttctttattcattcatctgttgatggatacttaggttgcttccaaatcttggttattgtgaacggtgctgccaacaaacttgggagtgcagatacctctttgatacactgatttcctttctttagggtatacacctagaagtggaattgttggatcatatggcagctcatttttagttttctgagaagcttcaaaattgttctccacagtggttgcactaatttatgttcctaccaacagtgtacaagagttctcttttcttcacatgctcaccagcatttggtattgcttgccttttggacataagccattttaattggagtgagatgatagctcattgaagctttgatttgcatttctctgatgatcaatgatgttgagtgccttttcatatgcctgcatgccatttgtatgccttcttttgagaaatgtctattcaaatcttgtgcccatttaaaaaattggattatgagatgtttttcctatagacctgcttgagctccttacatattctggttattaatcccttatcatatgagtggtttgctaatattttctcccattctgtggcttgtctcttcagttttttattgtttcctttgctgcgcagaagcctttttaacttgatgtggtcccatttgcccgtttttgctttggttgcctgtgcttatggggcactactcaagaaatctttgtgtagaccaatgtcttggagagtttccccaatgttttcttgtttcacagtttgagttcttagattcaagtctttaattcattttgatttgatttttgtatatggttagagataaggttctagtttcattcttctgcatatgaatatccagttttcccagcactatttattgaagagactgtcttctccccagtgtacgttcttggcacctttgtcaaaaatgagtccactgtaggtatgtggatttgtaaaatcttttctttttaaagtaaataagttaatgcagttcaacgggatgtgtatcccagtaaaactactgattttcttttcctctaaattaaaaaaactatttgtctattctaatttttatattgctcccacaataatatgattttgtttgcagaatttactcctttccacttccaaaaacttgcttcaaatgataaattttggattcacactttttaaaaaattccttttctgaaagtaagacaatctaaaaattaagctactgaaaaatgttgtcttattagtcttgtataaatgttttaaatataacatgcatgcaattataaaggtctttaaaagtacgaacaatttaactcacttttgtttctggaagagtcctcagaatagtgtagacaaaagatgcccagcaaatacttaacaattatttgaacaaacacattgaatagaacttggagaatagaattggacaggaatttgaacataagaataaaatatatttattacattatccactgtaaaaaagcatagtacatattcacatacaaagtaacttttaaaatcataggcaagataagaatcagaagttgatacatgcaagtatattttaaaagctacaaatgcatacatgttttttaaatgtccttctactaaattcactttctataattaaaaaaaaatagccaaatcaggaggatagttactactactaattaaacttaaaaaaaatttcctaggtgttttgaaaatagttcctatgtaaattcacagtagatattccctactctaaacctacctcagtttgtacacccagcaccaaacaaatacaaagcattatgggataaaattaataatgctatgcaaataaaacaattcatttataaataataataaatagtcactccacatcacagtaacttagcatgattagagaataaatacttaactttgagaaggattactgactggcagtgtgttgctggtatatgtcaggattattcatcaccctgacagtaatattaaccacaatccatttcagttgcttcagtttatcattttctgactaatgttaaaaaacaatgtctttggaggctgcttgaattaagtgtagaattaacgtctgttagagtcattcaaaaacttctattagaagataacttctacagaaaaccaaatctgctatacagagtactaatgcttaaaagatgtaagtttcgaaacacagccatacaaaataaatggactaattctgttttaaaagcaaaacttcaacaaatcctgtaaatgccttataacatccatatacatatatattccttaaatatatatgcttccactttcctgaacttagtattaaattctacataaagagttgcacagacacattttaaactaacatgccacattgaacacgtaataattcaatttaaaaaggtcagtgtacccatgaaaaattttcttcagggttatataaattaaatagctacacagtttgctacctaggatcctcaaaattaagtaatctgctaaaggtctctctacttataaatggtaacaggaatatacaactctatctaaatccaaagattccctgctctggtctaattttatctttccaggctgttttctccacatcatgttgatattccttttagaagatatctgcatttataactcttctattaatttttatactgctctttcttgttttatgattattcactttccatagcataattttcttgttctattaatgcaatagtttccctttatctgaaaatatttattctagtttttttttttttaaaaaaacacttctgtttcataaattgcctctgtttcttctggttttgttttgattttctatttgctttggtctttgtcatctttcacattagaggttgtctttaaatgtttgctaatacttggctgcacctccatttttaagaatgagacactgaagagctgactgagcatatagaccataagtagtgatgtgaactggtagacttcactgaagggaaatcaagtgggctcgaagtagaatccctaaatgttttatttttttaggtgttttcttttgagccagtgaatatgtccaaagagtaatacaatcttctgtcttatggggtggggatggtataagcttagctgccgcagttctaatagcatgacagcagaaggggtctaggggctttcacgacttggtacttaaagctttcagttataatcctcctgttttccatcctttaccttaaaccctccttctggtgtgcttggtgttctcatatcagaaacgtgtctggtaaaatttctccaaaaaagtcaatctcttgctttttgacaatacagagggaagagtagttggattttggaatgaagcagatataaagcaagtattgaatttaaaatgttctttcagattatacctaaagtctaccagttgactgacagacagatttgagatcaaatcctgagcttaccacttggaaaatgtgtgacctcccagaattctttaacctcactaaatcttagtttccttatctgtaaaataaagacaataacacattccttacagggttattgaaggaattaaatgaaacagcatatgtaaaatgcctgtcatagtggaaagcacctattagggcttccctcacaatcctacaaatacgttgggaactctccccatatcatttttatgcttattagactgcaaactttccaaggccagacaatgtaatttatatcataatctctaaaatcaatgtggcatacaacagcatccatgtttgatgccaagattaaactattttaacatattatgtcagccaataaaacatatccaaaacataatcaagtatggggtaatttttagtttctttctctgcatttatattttatttaaacaatttaagatctattatttactgttgtagtatcataagatgtgtttcttttggtaagcttgaattcctttagcttcactgaagcccaataaatagaaaaatgaagtaaaagccataacacctaacaagtttaaacaatattccccccacccccaagagtgttcttttccctctgtgacatctagatggtatattgattcccagtgtatctgttacagagcagactaaaaggactggcattcatcagaaacagcacttaaaacttaaagagataaagaagtgctgtctgatcaacaacagttaaatgtcggtagtcaattccaggtcaagatgcatgctgtatattaaatgtgtgtgttaaacagaaatatctcacacataaaaatatacatccaaatggtaggagatacatgaaggagagaaaaaaaaatcacttacttttcctgaaagagagagcgagaaacagaaacatatactaagcacaaacaggagcaactcagcaatgaataacaaattcactatggttctgtcactcagttctcttcggttttgtcagaatctactctttagaactatttggatccaaactagggcaatgtaaactgctaggttaacagagtgtgaatagtctagcattgtaacataggtttaaaaacaaaacgaaacaaaacaaacatgatttcttagagcttagacaaaaatttaaaattcagttttagtcaattttcctctgattcctatgttgcaagataggaatcaggagatcatggtgcaggttcattttcttctactctttattttcctgtttctgcactatggaccaaaataacagctcattttgtggttacaatctaaagatgaaaaacagatttttctttaccttgttcctcaaactctctattttccttcattttaaaaatgtgagttgtaattattaaaaagtaagtatttgctttatcttggccattcctgtttctcccaaatcttcagcttattcttttactaggatagtaatgacttcattttattctttcacatcttcagaaactagcagtccatggcatattacagtactcaattaacaaccaataaatgaatgaacaaatgaataagcagtaacactggggatcctctagttttaaccgaacattcagctttttttgtaaaataggtttaatcaaaaaaggctggagcataacctgggataaagacaacaagagtagggcaatttgaaaagaaaaaaagctttcctttttcaagcaatagcatgctgcttgtaggtactaggtacttcagcatgagaagtgaaaggcaacttcataaataacattaaaacagaaccagcaactggtgccaaaagtggaaggcactattggcatattacagagtttctcaaactttctgggccaaagctcacgttaagaaatatgttactttaaaaaacacacatgtacatacactcaaacaaattgagcagaagatttatacaatatgcacagtgatggtttcttttttatgttatgctacggtatcccattcattttttaaaaacgcaattgtgagctacaggttgaaaacttagtgttcaaattctgattctacctacgtgcaacttgacctcatggtgcattagtttctgcctctgtaaaaaacaataatgttacctacttaaagggattttgtgaaggttaaaggaattaccacacacaaaacacttagacaaatgcctggcatatagtaaatgctcaataaatattagttaacaataataataaagtggatgatcctgtcttgtgaatttcatagccaagataattgggttttcattggcaagtggaatagttatcaattgcatttcaatccaagaacatgctggtttttttaaaaggtacccagattactatacaaatacatattatatattctaaaataactacactggtcaactagaagaaacatgattgcctcagattgtcttggtttccctctctcagaaaatctgttttacacaatcactttccaaagtaaagaaaaaataataaatcacaggtacaaaggaaatcatcctaatctacaaaggaagccctggtactgaaaaactcagccatcataatttacttttatggtatgacattttgtaaatatattcctgcgctgattataaattcttataaagaaatgtcaaaaagaaaatgttgaatcttatctcttccaaggaggttgtcaaaatataaaatcaatgtatgtttataaaatatggattaatgtcactccaaattctatgcatggttagatctgtcttctcatcagtcagaatttcagactactgatgaaataactgggaaagtagagggaaaagaaatcaacctcaaaattgattcctatttttttcagctttgaaagaataaattaaaccattttatgctaaatgaggacttttgcaatacaagaaaagatttaattttcaccagtctttcagaataaaatagatttgatcttctcaatgtacttatgatactaatttggaatgattataaagagatatattgtacatggaataaaagcttatacatttaaaaagacattttttacactgctccattcagactttttttttcttaaaagaagatcagaaaaataatacagaagaaaggatgctgattacattaattcagcttcagaaagagaattcccagtgcaacatggaagagattaccaaataaaattgtagctttgtatcaaaggtactaaaagtcctctgaaaaacagctttggcaaaattaaatagatataaatatgcataaataattcaatacattttaaagccagtcaggcaatattatccacttaagaacggagataagatctgtttgtattctacattaagctatgcatacaatgttttctaagatttcacaagtttatttaaacaaacagtaatgtttacaaaatgtatactatgggacaaattttaatacaattctattataatcattatttgtacagatagagctcatttatatatgagatgtattcttgaaaatgtgtgtataaacaaatatttgaaaactgaatcacactgtaaacattttggcaagccttaatactaaaaggaatgaggtacttttactaagtaaacaatcaccgctattttatatgtgcaaagtacaattttcaaatatctgatgtgcttgattatttcactaaatgcagttgattccaaactcacttatttcatcaatatttaatgaaagcaattagtactagtagaattccattctcatgaacctgaatgacttttgtagcattcacactaccattggtttataggaaaggagatattagttgtaaggcggtagaatgttagagctcctcacttctccccagacctactaattacactactgttcattattcaactgtgtgcccttcagttcttgttgaaagcactttttataactattccttcctcagccaaaagggcaaatatttcacaaaatttctaaaaatataaaaatgaatgccattacaattgaagtcacaaaattacacaaatgacatttcttatgtctttgtttagtggatgtggacatatttggatagaggttaatgaaagcaacagttttgttttgttttgcagcccccccttttttacttttaatgtagcaaaataaaaaagcaaaattactattgatcatctactggggcataaggtaaccttatttctcatatcctgaagaaaaggcattagttaaaataatattttacccacccaacaaaagtatttcacaagttccttaggtacagctgtaatatacaaataaaatttgattttaataaaggattctgtttagctggccactaatctacaatagcatttttctgatataatttcaatgaacattcataataaaaatcatacagcctacataataaaaatgtcctggaggcttccttctggtcatttaacatttttagtagaataggtaacaaagatgaggggcagagaatggaggcagttggtaaaaaagggtggtgttaggatgaggtaaaagggttatgagaacttttggtcaggtacaaagatggaggaagagaaaaacatatcctcaaaaaaaaaaaaataacctcccacttgtcaccattaggtactgtttcatcaagactgaatcatgagtccagcccgagtccagcccacaatccatcttagtactcatcacatcttaaagagatttctaaaaactcatctaaagcacaaaaaacatctgaataagctatgtgctgaaatagagtccaaactgtggattcagccctgaaacagaaggcaaggcaatacttctaggaccctagaacacgtattcatatatatgtcattcattttgtgaagcaaattttatattctaacaaaatcaaccccccaaaaatgatatttttacttttgcaaacacaaaattcaaaccatagagagagagtagggtataatagcctgaggattaaagagctgcccagtttttattattgacctactgcatggctcattacacaagtcaaactaatacagtcctcatttattagactacagagctctacagattccataatactatggggtcttagaacaaatatgataccgaggtgtaaggccttccttttcttttcaattttttttaaaccaaccatttatcattcctcatggtcaatgggtcaattgggaaattctgctgatctgggcctggctttgttgctcttagttggactccttcatacgtttgtggtcagctggcaggtcagctgaggactagcttgttaaggatgacctaagctgtcacagctcaagtgtcctccatgtgtcagtcacaacccatcagcaggttaacttgggaatgtttagggcatattctcaaagtgatcacagagaagcaagagcagaaacacacaagcactttttcaaattgtttctagtttgctaactttttttttcttgctggtttctcttttattaatggtggcaaaatatacataacataaacgtacagttcggtagtattaaatacattcacattgttgaacaatcatcaccactatccatcttgagaacttttttcaacttgcaatcctgaaactctatacctattacatgaaacactaactcctcattctctccctcaccccaggccctggcaaccagtattctactttttgtctctataaatttcacaactctaagtacctcatatgaatggaatcatacagtatttgcctttttgggactggcttatttcacctagcataacatcctcaagggttattcatgttgtagcatatgtcagagcttccttcctttttaaggctgaataatattacattgtatgtatataccatattttgtttacccatttatctgtcgatggacatttgggttgtttctatctcttagctgttgtgtgtcacgctgctacaaatatgaacatgggtgtaaaattatctgttcttatccctactttcaattctttttaattttttgagaaactaccatactgtttgacatataagctgcactatcatactttcgcaccagcatgcacaagggttccaattttccacatccgtgccaacacttgtgattttctgggtttgttttcattaacaatcttcctaatggttgtgaagtggtatcttattgtgattttgatttacatttccctaataattagtgatgttcattttcatctcattggccacttgtatatcctctttggagaaatgtctatcaggttctttacccatttttgaatgttgttgagttttaggagtctctacaaattcttgatattaatcccttattagacatgtgatccatgaataaggctttcctctgaaaattaaaactcccttttagagttcagtaagtagatatagaaactggtacaatttcttagctctaagcactatatcaggcacaagagatacagaaattaacaaaacaaaatctttgtattcaatgattttgcttaatagggaacacagagaagaaaatgttaaaattataataaattatgaaatgtattataacaagtatatggaaagtaccctgggagttcaaatttctagataaagaaaagagccaacagcaaaagcacaagaggtgaacatgaggcatcacaggatcagatgatacagcaaagatggggacagagacagaagacgtggtaataaaacagacaatggctagatcctaaacactattgtttgtcatgaggaaaatgttaaccttcgttttgacatcctcggtaactattgtgattgtctgaactgtgtgaagatcctatcctgtggatagagagtaggaattactcctgaacatcttcctggaatgagtaaataagagaacacactcttagagtccctgagctctaagtaaaggacactggatatgttgagtgaacttgtacttctcatgctgggatctgcagacactgggcaatgatcttctgactgagactgtgaatcactgagagccttgcatttctgctatgattgggtattcagtggagctttacataaacacttacctgtggcctaagatggatttagaagagttaagggaaatgactatgtatacccttgaaaaaagttagtactaacagcaagaaatctggtgttttgagaatgtaagagtgacatacaggaataaaggaccaacactgggtcagggtacagacagggaagaagcaacaaaaagtctccaggtcaaagatgtagaagacataaacatttgttagctgttcctagaaattactaaggaaagaagctttaggaaaaagactggatattccactcacctaaaaaatgagggtagagactttgtactcagacattaaaggaaatacaattctgaatataaattggaggaatcagtttgaactcataatgtatttcatcctaatttttttcctagcaccctctaaaaaagggatagaaataatgacaaattcagtagcaataagcagaatagacaaaactgtgatctccagatattaattcccactataagaggtcccacccgggctcctcaaagaaacagatgattctgtatctgggccagaaaatgtaagggttaagactagagtgcctggtcataccagagagcatgaaagttatcaaagactacaaacagtgtcaaaaatgtcccagtaataacttcaagaagctcccccggtcaaagaaagaacaactgaacatcagtaaataactgcaatggattgaaacatcaaatacattgaaatctatgagttcataaagatacttttttaatagtcagtttgataccattggagaatgctaggaatcaactcaatattttgaaaactgttatgtaaattaacagaaaagagaaagaattaaacttctatcctgtcttttctctgcaatgtaccactggataccccagtagtagaagagaggaagtgtctctttatagaatgagtcccataaataagtgaaataaaagtgatattttaaataccacaatttggcaatgcttactaaattaatgaatccatgcactgaatatcagtgctaacatcacaaaagagaagtagtgtttatcatgcacattaaatttttccatttgaaaatctgtttaagagataattatattaaaggtacgactatatttgaaaaaaatttttaagttaagtaaaataacgaaagacaatccaatttatttttatatgcaagacaattatatttcacatcattactgagaaattaccttggacaaatctctgaagttggtgggcaaggtaagatccagttcttctgattcataattagtgatgacccaaggaaacactggatactgatttaagtcattataactccgtcctgatagggaaaaaagttactcgtaatttataattttaaaagtgaaataaacagattcagtaatataatttactaaaaataagattaaacaatttttgattgccagacatcattctcagtatccatactttctctcatttaatcctcacaacaatcctatgaaattgtatcatctccatttcacagatgaaaaaattgagtcacaaaaggttaggtaacttgccccaaatcacacaactagtaatggtcaaaccatattgaaatccagattttctggtcctaagtttgtgttcttttaaactacatttgataattttttttatcacttgaaagcctgccccaaataaaatactcttttttttatgactttaaaaagctatttgtaattctcacagtttttcaaaacaagaatcctttctctgccattaataatcaaccaactaagcaatcaagtttaaatgacttaaccctggtggacattcaccagtcatctataaaatgagggcattgcactaaataattctgaaatgtctgtggtagttttcaaatcctataatcctctgaaaataatgagcagtattatcaatgttgcttccttacatgcccaaatgtggccacatgctcttctatacatctttctaatgacattttcaatgacatatttagatttattaaaaatacaaattacagcaaaagaggaggtagtccttctacatatgtacagcagttttttggatattacctttttagggaggtagcatagtgggtgagatcattgtttctggaatcaaaatgctggtgtttgaatcccagttcctatttactagtctatacatatttttagttagatttaacatgaacagacttttacggtgaacatagagacaagtatattaatattgtttgaattcctttcttattatatattctatcatttccattcctttttctttctcaaatatatactgatgttatatcaatacgtagctgaatattaaagtagttctctgtacatactcttggtatctaagccttttttaggtctgatgtttttaactttttattttactctattcatcttaggcttgaggcctattagggtaacagagttcatttttggctgacctggaacagtcttataaaacatcataacaatgacatttttaattcatagatcattaatgtcactacatatttctatcaataattttaatttctccattaaaaaaaccaaacatagcagcagaaaaaaaaattttatgctcccccacttccttctccttctgatttaaatgttggtaaacagtaaaatcgtcttgtcccatctacttaaataatcagaaataattttttattgtacctaaaaaatgaagagtatggacctgctcagtgattagacttaattaagttaaactcaatacacagttattgaatatcaactgatggccatttgggaaatgcatcatgatatcatgtttatctatatgtggcacaaataataatgtaaaagaaatcttaagtgagacttaactccatcctctaatgcacatttaaaaaatctaaagcaaatgatagattctatatttataaaacatatacagggaatatacttaaaggacactgcaggcacaataaaagctatttgagaacacatgatttcataaatgttgctccataatcataactgtgcattcaacatgggttaattgatttactacatgcaaaatatgtccattaaacttgttatataagtttcctctcactacttaaaaattcttttagtcactagttctataatttctactaaattcaacataaccattgacattttcttcatcccttttcctcagctgactgtgagataaacttctaataaaatttagaactttcaatgtgagcccctcaacttccaattctttgcaacatcccctcactctttcccatttctctaacagggtcttttctttgctaagagtaattgcttcacctgagctctcaaacctgtctccctcataacttgaattgttacttttcttctctcctcctcttacatcatttctcctctctgccccaacccatcttctctttaataacacatttaaaataaccataattggcagggcgtggtggctcacgcctgtaatcctagcactttgggaggtagaggcgggcagataacctgaggtcaggagttcaagaccagcctggccaacatggtgaaaccccgtctctactaaaaatacaaaaattagccgggtgtggtggcaggagcctaaaatcccagctacttgggaggctgaggcaggagaatcgcttgaacctgggaggcggaggttgcagtgagccgagatcgtgccattgcactccagcctggggaagaggagagcaactccgtctcaaaaaaataaaaaagacctgtaattacatctacagttactatttcatttccaaccattcattctgaagtctccctctccactctgtaacatttgacacaggtgaaaatgccttcctccctctttcaccttgcctctcaagacatctgacttacctcagttctcctactatatctgcacattctaggatcactcattcctttttgtcctttactaactttccttctctcttctcatatgcaagagaatttccctgtcttatctcactgctttctgtattatcttccttgctgatctcacatctcttggtgatttcctctctatgcagatgaaatccaatgtcctagttctaagttccgaatatcctccttgacctatacttccaaaaactctgataccttaactagaaagtctgccggcacagtaaaatcatcatctttccctagatcaaattttctgacttctttttccattaattgcaccaccattttcccactaacgcaggccagaagcctggaagtcttttcagatactttcttctcatttaccacctacattcagtcagctgcatatcaaatggttggtgccttgtgaattcttatagaatttgttccttcttttttaattcccactgatacctaatggaagccctcattactacacacacacacacacacacacacacacacacacaccacacactaaattacttcctaactttactttctgcctagtctctagccacccaaatttatcttacacacacagcctccaagttaatttttgatgcagctctaatatcacttaggtgctcaaaaactttcaaaagtttcccaatgaactgacgctaactcttcaaactgacaagaaaatcgttcttcgcatttctaacattcttattttttcccattatatctttatgaatatatacttcatgcacacaaaaatatacagtatatacatagatatacaaactataccattcttgctctctaggtatactttatattttcccatctttgtatgtttgcttatgctttcagtcttacatggaatgacatctaacattccaaccacctcctctgctagtcaaatagtatccatccttatacaaccattgaaaccttattttctccttactcccaccaactgggtgaatataatttccctctctccctgtccttttaatcaccacagtactttgagttttttactgaatctatatccccttgctctagaatcatgtaaacattcacatttgtacttaaaatgacttctatgagagtaagcaacataccttattctctttgtatatcctttgtagtattctagtagcaataacggcaataaaacaagctagttataccactacttaaaataatctaacaattgaaattaataatttattgtctaaaataaatcaatacatggaattaggttacctgctatcgtgttgagaaacatcaagtactcaaaattagatatctctctgtgttgccatcgctgggtcatattagaagccttaaaaagctgacgtggactagctaatgaaatacgtctgcaagaaaaagaattcaatgtgatatgattaattatatcacaataataaatcatgaattatctgtgcttattcattcataatatctataattctgaaaagttctattcatgttagactaatgaatactagagaggtttcaatctacaattcatggttaaacaaatgatttagactagccacagaggtattatacatgttgtattcattcaggtaagctgtcattacagtgccattataatgtacaggttcaataaaagttgattaataacagtataattaataattcactgctttaatgatataaaaagaagaaattatagcagctgggaagtgcatataaaattctattcacatgtctttattaattgtaatagttatcttaaatgaacacatttttacattataaatttaaatatatttgcatacactttgtatcaaagagaagggagactctaaactatttgggcgtctgttcatggggtaaagagaaatttttttaatatagcttaatagaagacaaattttcctgtagcctcctaatgaaatgtaaacatcagtgaatagaactgatcaatacaaagagtagtgagaaacagatggcagaattagttattacattcaaagcctagaatctcagagaaataggctgtcacagttctttctaccacaaaaaacaaggtaattattttgtaaaaggttcactgaagtataattttcatgccataaaatttattcaatttgtacaattcagtaatttttaaaaaatatttcaaaagttgtgcaattatcacaattcactttagaacattttcttcatctcttctcggccttttggctaaaatcaagtgtagaacattttcatcactacaaaaatttgccttgtacctatttacagataatcttcattcctatccccacctacaggcaactagcaatctactctgtgtctctagtaaacccaccttttctagacatttcagatcaatggaatcatacattagtatgtagtcttttgtgtcaggtttctttcactaaacataatgtctttgaggtttatcaatatggtagcatgtatccacagttcattcctttttattgctgactagtatcccactgtatatagaatacagcacattttgtttatctagttgatggacatttaacagtttttgctattataaataatgctaccataaacattcatgtatatatctttatatgaaaatatgttttgatttcttttgggtagattcctaagagtggaattgctaggttgtatgttgagtttatctttaattttttgagaaaccgccaaattgttttccaaggtggctataccactatatgttccaatcaataatgtatacattcatctccacatccttgccaatacttgctcttgtgtgtattttgattattaccattctagttagtgtaaaataacagttttaatgtatgttgttgagcatcttttcatgtgctgattggtcatttgtatatcttcttcggtgaaatgactaatcaaatcttttactcatttattgagctgtttgcattttatcactgagttgttagaattctatatacattctgaatacaactctgtgatagttaattttatgtgtcagcttgactggattaagtgaccttagagagctggtaaaacatgatttctgggtatatctgtgatggcatttccagagagattagtacttgaaccagtgggcttagtaatgcggactgctctctccagtatggtgagcatcatccagtcaattgaggactgaatacaatgagaaggagaaagggtgaattccctcttctgctcaagctgggaatctatattctcctcctcttggatagcaggagctcttggttctctgtccttcacttcttaccccatccctctctccttaggccttcaagccttgggctcagtcatgggctcccctggccttcaaattaggattgaattacaccactggctttcctgggtctccagctgtagatggtgtattgtgggatttctcagcctccatggtcatatgagccaattcccataataaatctcctcttacatatctatacatatcctattggttttgtttctctgaagaatgcagactaataaaaagtgctttatcagacacatgatatacaaatgttgtatcagtctgtggcttatttcttcatttacttagtggtcaattttgaaacacaaaagttttacatgttggttgagtccaatttctcaattttttcttctgtggattatgcttttagtgtcacatctgagaactgtttgcctttcccaacatcagaaagtttttctcctatgttttctttctgacattttatagttttacttctcacatataggcctataatatattttgagttaatttttttgactggtatgtggtaagcatcaaaattttcttgtatgtaaacatccaattttgtccaccaattgtttaaagcctatcttttcctcactgaattgtgttggcacctttgctgcaaaacaattgaccgcaaactcaaggatttatttctgtattgtcaattctcttcctttaatttatatgccgatctttgtacaattaccacaattgaagactgagtacaatgaaaatgaggaagggtgaattccctcagtattttgataactgtggctctacaataagttttgaaatcaaggtacatcttccaattttgttcttatatttcaaaattgtttcagctactctaggtccattgcatttcaacttcccaatttctccaaaaacgtctatcaggaattgatagggattatacagaatttacagatctagggaaaactaccctattaattatattgaatcttctgatccatgaacatggaatgtctccatttattaaggtctatttttaatttctcttaaaaatgttttatacttttcattgtacaaatcttacacttctgtgatctgtaaagagggctactttctttcttcattcccagtgcagatatctttaatttctcccttccttcctctctttcttccttattgcacaaactaacatctccagtgtaacgctgaatagaagtggtaaaaatgggaggacatttttaccctcctaaacttagggggaaagtattcagtctttcaacattaagtatgatgtacgtattgggagttttttggtagatgatttttgtcactttgtggaaatttctttagttgaaagttacttgagagtttttaatcatgaatgtgtgttgaatttggtcaaatgcttttttctgaaatgatagtaagctttttctcctttataaatactggtgcatgacataaattgattttcatatttaaattaactggcattccagtgataaaacccacatgaacattttataaatcctttttatatactgctgaatttgtttcctaaattttgttttaaaaaaatgtgtctgtgttcaggacggaaattggcctatagcatttttcttgttagttttcctgtaatgtctttgtctggcagtggtattgaggtgactgaccttatagaatgagttgcaagtgtttcctccctcctatcttctggatgagtatgtgaaagatttatatcatttctagtttaaatattttattgcattagccaggaaagacaactgggtctgggcttttctttatggaaagatttttaaattaatagctcattttatttatgtgttataggtctattcaaatttccaatttctttttgagccagttttggcaattctgtttttctaagaatttgtccgtatcatttaagtatctaatttgttggtaggaagttgttcatgatattcctttctactccttttaatttctgtaggctcaggctgggcttggtggttcacacctgtaatcccagcactttagaaggctaaggagggaggatcacttgagcccaagttcgaggccagcctgagcaacataggaagaccctatctctataaaaaaaaaaaaaaatcaaaatattagccagacatggtggcatgtgcctgtagtctcagctactcaggaggctgagatgggagggtggcttgagcccaggagtttgaagctgcagtgagctataactgtgccaagtgcactccagccagggcaacagagcaagatcgtgtctctacaaaaaaaaaaaagaaaaataaacaggaaaaaagattctatatgctcaatagtcatgtctctactttcacttctaatttaagtaatttgtgtcatctttcatggttaggttaaagtctgtcaattttactgatctttgcaaagaatcaacttttgtttcattgatcttcttcagtgtttttgctttatgtttcattgatttttgttataatcttcattactctatttttctacttgctttgcatttagtttgctctcctctactgtctaacagtagaagcataggttattgatttgaggaatttatttcagatatgggtgtttaaagctgtaaattttcacttaatactactttagctgcatctcatatattttgatatgttatacctctgttggatataagcatccaaattagtatgcttctcagtcccatgggaggaagagttgctggccacagaagtaaccaaagcactaatagctacatggcagagacatggcagaatgtgtgaggacaaaaagaaagatgcccccaaacccaggcactctctaggttctgggaggtatacagaggaggaagtggtgcagaccaaggagcatggaatcaaaaaaaatgaagccccctacaccaccaccactctagccacacagcctaagctcactcccttctctgtacctctctaagcttctaactgcaaaataacatatctcctggtagctgttataacccctgatatgcatgtattaaactccttggttagtgctcctatagaaaaaaggaaatgcctgaaaacaagtgatagggttaggcaaaacttgcagtgaaacagaaaaactaaaatgaaaactattgttggtggcatctttgggctgactcaatatatttttgttacggcttaaaactggtatctgtgtgtatatgcttgtactgtaagagctcctgggtgtcagaaagaatattccagatcaagaaccaccacaggtagaaaactgataacaggactaattctcttgctgattgccatcagtggtgagtcaggatttagcacaatagtccctaccctctcacgtcctactggctgacaagtcagaacatttggtcttaatggccctgacttgtagtgttctcacaactaaaccaaaaggagtagctcataaatgccaacaaaattcagggtcctgcttgccaagtaaagcttcttgatattgtgtgggcaaattcacaacattcaatcctctggaggtcaaaagctaaatgtgatggacagttttcagtctatgtcttactgatttctcatcagatattttcatgtttaaaaactaccatcccttggtgatatggtttggatttgtgtccccacccaaatatcatgtcaaattgtgtattagtccactctcacactgctataaagaacagcctaagacggggtaatttactaagaaaagaagtttaattgacttatagttccacatggctggagaggcctcaggaaactacaatcatggtggaaggcaaagaaggaagcaccttcttcacaaggcagcagtgggggtgggagaaccaagaaaaaattaaaccatcagatctcatgagaactcactcactatcatgagaacaacatgggggaaactgcctccatgatccaatcaggtcctctgttgacatgtggggattataatttgagatgagatttgggtggggacacagagaaaaaccatatcaaattgtaacccccagtgttggaggtggggcctggtgggaggtgattatatcatggggtaaatttcccccttgctgttctcatgacagtgagtgagttttcacaagatctggttgttgaagagtgtgtgacaacccccctccccgcttcttcctcatgctcctgccatataagatatgtctgcttccccttcaccttctaccatgattgtaagtttcctgaagcctctccagccatgcttccttatagcctgaggaaacatgagccaatgaaaccccctttctttataaattaccccgtttcaggtatttctttatagaggtaccagaaaagactaatacacttggcatcatattttcctggatttcctgtcttttgagccactcctgtttttgctcttagtgttgttgtttttgggagggcagggatgtcctgtttcccttacctaacctttacatgttgaggttttctggatgtagctctagttcctcttggcattttacaatctctccccagatgaactcattccctctcatggcttcaaatttcatctacttggtagtcattctcaattactaggcctttcttttgagctctcaacatacctccttatatctagcttcctattcaacatttcaatctggatgtctctcaggggttctaatttcaaggacctaaaattaaactcattttctgtccctccacctcctccacacaaccccagccatggggatggaaggatgtttatacaaatactgttcgtccattattcctaatcccagtaaatgccactgagcagctcaagctgagacttgagtattgactaaagatattgaatatctccccttgtcatcaccccccaaatctctgagtcttataaattatatttcttaaaaatctctaaacaagaatgtctctcttcagctacattatcaacatcacatatcatccagatgtcttcaataggctccggtcttatataaataacaccctcttcctaatatcactaagttccagtgatacttgctttccaacatttcttagaacactagaagctccctgccttgcttcagggcctttgcatatactgtgccttcgttcaaagaatagctggttatatttcttcaaatcaaaacttaaaagtcacataggaagatattcctggttatcttatccaaagcaacccatctctactctactaatcactactacaacactctaattatatccttcctgtcacttatcacagctatttagtttacatatttgttttaaaaatgtatgggtaaaatggtttctatcttgtacatggctgagtgcttgacacattgtaagtgaaaatctatttaagaaactgattaataaattaagacttataggctgggcacagtggctcatgcctataatcccagcactttaggaggctgaggtggcaggatcacttcagcccaggactttgagatcagcctggacaatggagcaagacagcatctcttaaaaaaaaaaattagccaggcgtggtatcatgtgcctacagtcccagctaccgggaagctgaggtgagtgattcgcttgagcccagcagattgagctgccgtgattgtaccactgcactccagcactccagcctgggtgacatagcaagaccctgcctttaaaaaaaaaggacatctagctttaactgtgggagaacattacagaacattcccaggtatgaaaacatatactaggtgtgataaacaaaacttttctaaaataaagagataatttgtagaaaaagacttcttaactaatataaggaaatccactatgctcctctgggctgcttcttcctgaactctgaaatcctcattaaattataaaaattatctaatcaaaagcattaccggtattgtaaggcaacatagcttataatccagaaggaccactttatttgccccatttacataaaagttgtgacctgtggtagttctggaatacatcctcgagaggtggagcttaattcccctcccctggactttgggctgtatttagtgacccacttgtaaatgaatacaatgtagcagaaatgatggtgtataactatcaagagaaagtaatttttaaaaattggggtttctgcttcattctctcttggatcacttgctctgcaggaagccagctcccatgtcatgtaacactccagtaacagatggaaaaactgactcggtaaggaactgaggcctactgctaaggagcacatgagagattcctttgacagccatccagccacaggctggctgtagctactactaacatcctagctgatgtttgtgcattctatcgcaattgcatttgtaataggatacttaaaatttaaaaataaacactgatcaaaagtagctcaattcaataccaaattaggtatgctaaaagtaaactgtacgtttccaccacgaatatgtttcaatcaatagaaaaatcccagtgttcgctctttccagttcttaaattagttaactaaattgtattgatgatgaatcaatacctactatgaaaggaaataatcagtaattatgctacttcaatgtagtcccagcatacaggagaaagatgcatacacctacactctcccaataccctataccatgagagatattttgccattttaacatttctctcagagacttattaggttactttcaactatataaatacttgttattaagtccatacattcaaatacaaaactaatatgtgaattctgatttaccagaggctacacatacaggttttaattaaatatagttacaaaatccttaatctatagatttaatatttatattaaataaaaaattgtatgatgtaatagagcaaaatccaatcatttttatcaaaacgatgaaaagtttcagatttatcatgtgtatattaaataatgctatagcacatactaaaatgattgtaataaacacttttttaaaacagcatcacatgtacagatgtaataagcacttttggcttagatatttttaaatatgcttagaaagcttatctttcaataattgtgattggaatataattaattttttatatttatttaaacagttttacatagatgtaataattgtacatatttatggtgtacgcagtgatgtgatatacataagacatagtgatcagatcaggtaattaggacacccattatctaaaacatttatcatttacttgtgttagcaacagtcaaaatcctcctcctagctatttgaaactgtattactgctaactctagtcatcctacagtgttatatagaactttagaatttattcctcagtccagctcttattttgtatactttaacaaatctctccctatcatctctccctccccactacccttttgatcctcgagtatccactgttctactttttactcatatggagattaaccttttggtagcttccacatatgagtgagaacacgcagtgtttaactttctgtgcctggcttatttcacttaatataatgtcctgcagttccatccatgctgccaccaatgacaagattccatgtttttttatggctgaatagtattccattgtgtatatatggcaccttttccttatccacttatctgttgctgaacaccactgattccatctctttgctagtgtgaacagtcctgcaataaacatggtgggtgcagatgtctcttcaatgtactgatatcctttcgtgtggatagatgcccagtagtgggaactctggatcacatgggagcactatttgtggtttcttgaggaagagatataatttaatacattatattaaatgtataatatttatcaaacttaagtgtacaatttgatgagatttgaatatatatatatgtttctgtaaccaccaccacaaccaagatacactctaaaaggtccctcataaccctctgcagctaattcccttgccccaactcttggcccctggtaaccaataatctgctttctgtcattgtgtagttttgctttttcagtaatttcatataaataaaaccatggcctatggctatgatgtatggagcccgtaatgtttaatttctttcatttagcataacacttttgaaattcatccatgttgttgcatgtaccagtagtcatttcccttttatttctgagtggtatttcatttattccagtgaatacaggtattgcaatctgtttagccactcacagttgatggacatcagaaatgtttacaatttgagactggaataaaactgctattaatatttgcttaaaagtaaatgtgaatatgtatgttttcattactcttgataaatgcctaagagtggaattagtatgatatacattaagttcctaacctatacatcctcattaactttacacattctttgttgttgtttttgaaaatcaagtttgttgaagaataatttacatagagaaaaattcattatttttaggtgtacaatataatgagttttctaaacatagaggcttatgtaagaacaattatgacatggaatatttccatgatccccaaaagttccttttattctcccttgtatgcaattcttcctcttttcccatagctcctagcaatcattgctctgttttctgtccctaacagctatgctttttccagaatgtcatataaatggaatcatacaacatgcagccttttgttttggctttgtacacctagtataatattttcaaattcatctgtgttgttgcatgtattagtgcttcactcctttttattactaagtactatatagattccattgtatggatttatcacagtttgtccatttaccagttgataaccatcttggttatttccaatttttgtgatgaatatggctgctataaatattcatgaagcagtcattgcatgaacatatattttcattcctctagggtaagagacctagagtgagactcctaggatgtatgggaaagtgtatggttaattctatatgaaagtgccaaattgtttacaaagaagtcgtaccactttacttccccatcaacaacatgtgaggttccagttgccttgtatactgctcttggtattgttagatttttaaaaagttattcgaataggtatgtcatgggatcacactgttgttttaatcagcatttctcagatgactaatgatgtttggcatcttttcatgtgtttattcggtatctatatctattctttgttgaagtatctgttcaaaacttacattttttttttgtagcaagcttatcttgttatatagtatgtttcctacatatcctggatgtaagtgctttatcacacataagttgaacaaatactttaatccagtctggcgtatattttcattttcttaagagttggcatttcaaagcaaatgttttttattttaatgaaatcaattaaagatctaaagaaatatttacctaattcaaggtcacaaagatttttctcctatgtgttctttcaagaagttctacttttagcacttacgtttgtctacactacgtttttttctgttacattttgagttaatttatatgtaaaattaaggggtgaggttctttttctttttggatatggataaccaattgttcatcatcatttgttaaaaagatcattttcccccctgggcataccttgacatctttgtcaaaaatcaaattgatcatatatgtttgagtctatttctggactctgttacagtccattggtttatatgagtctatccttaaataacaagctatcctaatgaatgtaattttatattaagtcttttgtttttttttctcaaaattgtttaaactattctggatatttacaatttcacttaaattttagaatcagcttgtctatttctcttttttcctttttttaagttaaaaaaatagagatggggtctccctatgttgcccagactggtcttgaactcctaggctcaagtgattctcccacatggactttccaaagtgctgagattacaggtgtgagccaccatgcctggccatcttgccaatttctttaaaaaagaaagaaagaaagaaaaagcctgctcagattttggatagagctgctttggacctcagatcaattctggagaaaactgacatcttaataatattgagtcttccaatccatgagcgtagtatagtacaattctccatttttaagttttaattctccaaaacagttttatagctttcagtgagtaggtcttataaatacattttcaaatttatctatatgtatttattttttgatagtatttaaacactagttttaatttcaatttctgattgttcattgctagcatacagggataaaattgagttttatatactgacccagtatgctatgaacagctaaactcatttattagttctaacagttgttgttgttgctgtttttttcctcatagattccctgggactttccacataaacattcaagaaggtatgctaaaatgactattttatttcttcctttccaatcaggatgtctgcagttcctatttcttgaaaggcctttgtatgcatttggtgttcaggtaatgctggtctcatataatgtttttggcaatttaacctccttttctattttttgcaagagtttgtgtagaaatggtattatttcttcattaaacatttgatagaattcatctgaactacaagttttctctgaggtaaggtcttttactacaattcaatttcctttgtagaactattaagattaaccatttcttcattagtgatatttgatagcttgtgcctttcaagaaatctatttcatctaagttgtctaatttagtagcataaatttgttcataatatttctttatttttcttttaatatctgtagtgatgttccctcccttattcttaatatttttaatttgtgtcttctctttctgcatctttgctagatatttactattaatacatttattaatcttgtcaagagacagcttttcattacactgatttttttctctatcatttatttttattatttttttctttcttcagcttactttgactacatgtgcttctcttttttcccacattcttcagattgaagctaagatcattgattttaggcaatgatcctctcctcctcccctcccccttaccctctcccttcttaaataaaatcatttaatgctataattctacattaggcacttctttatcttcatgttaaacatttctataggttgtgctgttattttcaattagtagaatatttctaatatctcttctaatttcatctttggcccatgttttatgtagaagcgcattaatttccaaatctcaagagattttccaaaaacctttctgtaactgatttctggtttgtaattaaccagagatccaagatctcaatctttctaaacattttgagacttattttagggctgaatatggtcaacgtgataaatgttctacgtgtatttaaaatgaatgtattttgtgcaattgactaaaatgttttatacatgtgacacagatcaaggtggttaataatgttccagtcttcagtatgcttactgattttttgtctacctgttctctaaattactgacataacagggagaggctgtctatatttcattccacttctatccacttttgtcttatgaattttgaagctctatttttagatgtatgtaaatttaagatcatcaccttgatgaactggctcttttatcattatgatatgtcactttttcctctgataatataatgctttgtgtggtaatttgataattgttatgggttgacttatgactccttaaaagctatatattgaagagctacctcccagtacctcagaatgtaacaatttgcagagagaatattttcaagttaaaatgaagtcatcagggtgggcccaagtccaatatggctggtgtctttgtaaaagagggaaacctggacacagagacatacacagggggaaaacaatgtgaagagacagagggagaagagaggcatctaaaaaccaaggagaccggcctggaacagatccttccctcatagccctcagaaggaaccaacactgatgaaaacttgattttgaacttcttgcctccaaaactgtgagacaacacatttctgttgtttaagccacccaatttgtggtactttgttatgacagccctagaaaactaatatagtaatgatatgactagctggctgtttttattaaggtagtgtttgcatggtatacctttttctgtccatttacctttaacgtataaatgtatttatatttaaatggggcttcttggttgccagaggcagaggagtgggggaaatggggagatgtggccaaagtgtacaaacttttcattgtaagacaagtaagttctgggaatctaatgtttaatatgaagattatagttcataatattaaattgcatatttaaattgctaagagagtagatcttaagtattctcaccacagacacacacacaaaggtaactgtgagggatggatatgttaattaacttgaatgcagtaatcatttaacaatgtatatatgtatcaaatcatcatgaggtagaccttaaatatgtgtaatttatatttgtgaattacaactcaataaagctggaaaaaaatacctactgcaaaagaaaaaaaagggtgggtttcctctaggtagcacataaatgagtattgcttttttatgcaatttggttttttcttcctttaaattatatagtttaggcaaatagtacttcaaggtagcatattttttattatattattttataaataagacattggtcataaaacttgaaagaaaaaatacataaataattttaccacagcattttttataataatgaaaacatggaaataaagcaaatcttcagcaatgagggaattactcaattttgatatattcatatttcagactattagcaaccaataaaaattatcatttttttgtcttgtatacatcacgaaatagctaatttgagcaaattaatatatccattacctcatatattcatcattttttgtaatctagtctccacaatttttaagaaaacaatatgctgttactaactatagtcactatgctgtaagatagatctcttcaactattcctcctaactaaaattttgtatcctttgaccaacatctccccagtcaccccacccctaacctctacccttggtaaccacgattctactctctacttctatgagtctaacttttttagatttcacatatttagatcatacagtatttgcctttctgcgtctttcttatttcacttaacagaatgtcctccagttcatccatgttattgtagataacaagatttccttctttttaaagactgagtagcattccattgcatatatatacaaccaaaatttctttattcatcagctgatgtacacttacgttgatttctgtatcttggctattgggagtaatgctgcaatgcaaacaggagtgcagatatctctttgacatactgttttcatttcagttagatatatacccagtagtgggattgcaggatcatgtggtatttctggttatacgtgtgtgtaccattatgatatatatcgtgtgtgtgtatatttatacacacatataccattatgatatatattatatatatatgtatctttgaaaagaatagtaattatatcgatatatatactataaatatctttcctaaaaggttagtatttaaactttccataaaagagataaaaagtaaatcttacaatatacacttttcttggggtaaggttaggcaatcttttatttaatgattatttgctaagtatatactctgctagacaccataccctatgctagggaaaacagtatattataatgcagtttagtcaaaagaaaacttaataacttaaaacagtacattataatgcagtttagtcaaaagaaaatactaataatcattatttactatgaaacataaaacagaaagttataaatttcaaaataagtgagaacattaatacagattaatgttaataagaatattaatactggttaattattataactattaagacactttactttccctaagtttctcatataaaacagtacctggtttgaggcaatccaaaacttgttccaacgccaacacgaggtagatagttaaccactttctttactgttgcagggtctgggaagttgaacatcacagcaactacaacagatgatttttaaaaattagaacacagtataacttcctttctggaaaactgactccttggtccaataaaatatttacttttaattcaggtatctattaaatacaattcttactatattccttttatatagtatatatcaagttttagtattaatatgccagtgataatattcatttcacttataaattcttttaccatagacagtgctttcctaaatactattaggtgttataacagttgatgttgcattgatatgacatgaagttgagattatgagacatgataataataatgataatgatagctgagataatgtgacatgaagctgcaactttaaatttacaaaaatgaattttggcaagtcaaaggtatttctaggagtttccagaaacaaatattaaaaatttaagtttatgtagttaaacaactaacactaaaaaacaaccaatatagctatgaaataatcagttacatttatttccaatcattaagttttaaaacagtctttttacaatgtctatatgtttatctttcatatgttcaaatgagcaaatgttcatataatccaaaacaatgtgtgatctgaaggaacatttttcctctgcagttaaaaatcaaatttaaatgctttctcatcctatttcaataatttcacatacatgagaataccaagaagtacatgtcaatatgtaaacatatttagcaataaatgttaatttatgagagtaatctataaatttttacccatttaaagaacatgaaagtaaaatcatacaatcttgagagagtttagaagatattcatttggtcagtcatggaattttaacttcaatgtcagaatcatatgtaagctacaagcgatcatctagaagatggtccttcttctctaccaacccttaaaaaaatatttaaagccaaaaaaaaaatataccaatgttcctatagtttttaaaacactggcattgccaacatgtttcaggtattcaggtaaataagtaatcgatcattcactaagcacctataacatatttagtaatgtcataatatatacacacacataagaatatatacacacacataagaatatatacacacacgagaatatatataacatataatatattatatataagaatatataacatataatatatataagaatatataatatattatatataagaatatatattatatataatatattatatataagaatatataatatattatatataatattatataagaatatacaatatattatatatcatatataatatataagaatatataatatataatatatcagaatatataatatattatatataagtatataatatattatatataagtatatattatatatacgaatatataatatattatatatacgaatatataatatattatatataagaatatataatatattatatataagaatatataatatattatatataagaatatataaaatatattacatataagaatataaaatatattacatataagaatataaaatatattacatataagaatataaaatatattatatataagaatataaaatatattacatataagaatatataatatattatatataagaatataaaatatattatatataagaatatataatatattatatataagaatatataatatataagaatacataatatatattatatataagaatacataatatatattatatataagaatatataatatattatataagaatatataatatataatatataagaatatataatatataagaatatataatatataatattatatataagaatatatattatatataagaatatattatatattatatattatatataagaatatataatatataataattatacataggaatatattatacatatatattcttatctgtgtgtgtgtatgtatcctttagataagcctcctttacatatccactattatactgaattcagggggaaaaaataaacagaagaaaaaaatcatcataggttatggcagatggtcaaggccacgaggcaaaggcaacagaaaaacacacatataaaaacaagcatgcataagaaatttcaaagaaagaaaatgaatgaggatgagcaagtaataaatattctaagattgaagctcctttgggacagcaaggatgcggactgaaataaagtgtgaaacattctcttgattatttgcctagaagaataatgtttagattagaagaagaggtatgtgccaggaggagatcaaacaggaagggaaaaatcttttcctaaagaaatttgtattccctaaagacagataatttcataaaggaaaaacaagatgtgtgtgtggaatataggcagttatgtgtacctttaaaaataagaaaccatcaacccatgtatatataatacaaggaatatgtacaataaatcagtaggttttacatatattccattgtacacctccacccataccaaatgatgcttttccttcaagttcaacttgtctccccttcttttcttaatggatttcaccaagttccatcgtaaaactgcaaattaaattttagttcaactttcaagaatgatgaaatacagagcaaacaggacagttcagtatcattttctcatggttcctttataaaagcaatatatcacatatatcacacaaaagattaaatagacatatgaatcgttattgtcctctcctctccccaaatgcagccaccttccagaaggaattaagtatcaaagcaatgctcaggacatcaaaactcctcttcaagctgattaaatggttatgtattccttatgtttataaagccttatatcaatttgtgatatggcaaaaaaaagaaaagaattacaaatgattctattaataatcaaggtgggaaaaaaccatgaagaagcatttggtacaaaaaaagaggtcactagaacagaaggtgggctacaaataactatctaaattgaagcaatatggtatgttcaaaaatgaaatcttaaagagatggaagttagctctgtaacaacgtatttctgtaacacattacctctgtttgccataaagatctccagggctgtattttgcaaaagataacgacgagaaaagattgatcgtatctctgtgaacagccattttccatgcagcccttctgtatatgccaagatctaatgaggaaaaaaataatcccaggtaagtaacaatacttgttttttgttgttgtttctttccccaattaaaatagaaaagaccctattaagaaaaataatttttaagaaaaaggatttaatagttacagacataatttggagatgaagaaaataaattgtaatttatagaaaagaagcttaaattaaaaagcaaagtaaaattataaaacatttaagtatatattcgggcttttaaaaacaatgatataatctactgcttctgaagaaatacatattgcatcatttactgattgatttttaaaccacattatgaaaagtaaaacttcagataaaatcttaaaaacaaaaagccctcaaaagaatgtcatatatgcttataaatcacatacacaattcagtttcacatgattataatttgcccaataatgcttttacatacattataatacaaatatattaagttcataactttaaaaaatgacacttttaaggtcactgttaaggcaacagtcactcattcagaaagcacaaacactgactatataagaggttaagtatcattttgtcagctaaagctaaacacaaacctgcaaatgaacttagcataatctccctatggggtaggtggttgtcagagtaacttgttacaattcttgtcatcccaggtgacagacagagttgcttaaaatgctttgccaattcaaagtaatcctgtctttagtcctaacccactttgttgctttgattcaagttttgtttttcaaaacgttcatttcaaaagcttaattgtgaaagcgttaagggaaaaccagactcagcatttctctacaccagtactatacataatacataagaaaatgagatgcacttgctatcaaaacctgatattctatgacagcaaattaagtttaaaaaattaagaaatatatctcaaaagtaaccactattaaaaattacaaatgaaacatttgattatgatactacattgtaggaataaagatgggatgagcaaagaggtaaaataacgagtagtaaaaatttatccttctcaaactgttttgtctttactcatttttattttcaaaatcctaatggcaaataaatctacattctccagtgcagaatgtagtttttttgaaaaaaaaaaaaaagagtaacaaaccttatttaagtcagtaagtatgtatttcagtctttctacaaaaatgattctatttctgacaccacagaatctagaaatagaatgggtataactctaagggagagtgtttcttgaaaatacaaaacaaaaagttcaaaagacaagataatcatgcgtgcagttttgaaatggatgagagagaaatcctactaattcagtaatataatcaacgcctatgtaaaataaaggtaaatgaacaggaaacgagaggacaaaaatatgaacattactctcagagattgcatgtatccctttctctcactttgaccagagataccaccagttggtctatggccccaaggtcttcagaggcatctatttgttctctcttttattcttacctctgaagtctaccatgaccagaggacccttcacctcaaaattttaaaatacaaatcagatcacatcattcctatatttaatagtatccagtgacttcccatgacatgtataataaactcttaagctctttatgactgcataaagcctcatatctgggactgtcagatgagttcaactcattcttcctcagggctttgttttgcccttgttttccactctgcctggaatgttctcccacatctccacatggttcactcattctcacatttagacttctcctcttatgtcacctctgcagggaagccacaggatctaaaccccagttactccattaacaactcatcccaccccaaacttaccagattttcttcataatacttatcactacctgaaattttaaatattaatttaattttcaagacagggtcttactctgtcacccaggctggagtgaagtggtgtgatcacagctcactgcagcctcaaccccctaggctcacatgatcctcccatctcggcctcttgagtagctgggactacaagcacgtgccaccacatctagctaacttttaacaatttttttgtagagatgaggtctcactatgttccccagggtggtcttgaactcctgggctcaagtgatcctcctgcctcagcctcccaaagtgctgggattataggcatgggccactacacctggccactaactcaaactataatatttgcttgctagcctattgcctcttcagcactagaatactagaatctaagttctgttggagcaaaggctttgaatataccctacttccaatgcctagaaaaatacctggcacaaagtagcaattttcagaatgactaaatgaatcaatgtatggcaaccttcagtccatatttgatccgcatgatattttaacaaaatttcacatggttgaaaatagttgagaaaacagatattcgcaaaaatattcggatttctgtcttctcaagaaaaactagggtatccagcaaacctggatctgtatgccacatggtaacaattggcatgcactctccattttggtaccattttcacttcatttattattattcactaatgtgatgtgagcattcactcatttactattatccacctagtttccattggtacttgagtttgctaccctggatttaccaaatattagagaatccaatatatgttctgcaacatttatagtccaatgtatccataagaaaaacaagagccagggccagtagcttacactggtaattgctgagctttgggaggccaagatgggaggactgcttgatgccaggcaacatagcaagacctcatctctacaaaaaattaaataattagttgggcgtggtagcatgcacctatagccctagctactcatgaagctgagatgggaacatcactcaagcccaggaatttgatggcacagtaagctatgattgcgccactgcactccagcctgggcaacaatacaacatcctgtctctaaaaaaagaaaaaaaagaaaaatgaggcctagacatgttaaatatttgatacaaaattccttggcaagttagtggcagaaaatggcctatacccaggttttctaacccaaaaatacagagcttccattgtatataccacattgccacatttttaagaaagggttaaatatctgttaaactagaacccaactaactgcttaaaattttcctgcacttgggttaaagaggaaagaggaaaatcaaaagaaaacaaacaaaaaatattttaagctctttgatatgttaggaatatcacacactggtctgaaaattctaccttttgtatctatagagctatataataagacctgttgcccataatagtgaatccactcattgcaaagtcatgatcatacaactaaagatttaatcatattctagactactccatttattaggagaaatgagtatactacagcattgttacaagatttttcatgtactgaaatagttttctgattaaataaaatataccatttatattccattcccttaaacagtatggttattcaaagatctacttgaaacactgcaagtgtcatagtcctttaaaatctgttttattccaatgtcaaaaatattcagtagtaggcggggcacggtggctcacgcctgtaatcccaacattttgggaggccaaggcaggcggatcacgaggtcaggagatggggaccatcctagctaacaaggtaaaaccccgtctcaataaaaaaataaataaataaaattagccaggcgtggttgcgggcgcctgtagtcccagctacttgggagtctgacgcaggtgaatggcatgaacctgggaggcggagcttgcagtgagcctagatcatgccactgcactccagcctgggtgacacagcgagactctgtctcaaaaaaaaaaaaaggaaatgaggtaagctccatgtacctactactcagtaaccttataaaatcataacactttgccatattattctatacatctataagaaagtgataaatgcattacagacagtgttaaaattcacacgcataacgcttcctgatcccattttcctcctctgtcacagccaatcactatcactatccttgtttttaggattatcatctatatgtaagtttttatattattagtacacatatatccataaataacataccacatcactttgtatgttttcaaacctgatataaatggtatcatactgaatgtataatgatatgcttttcaagttaaacatgacaaagtctaatgaagttttaaaacttagagaagaaaaaacagcatgagagaaaattatttaaaattgtcaaaggtgtcaaaaattaaaatcttaccaaaaaactagcctaatcttttaaaaaattaaataaaattccacaattagggtcaaaaaatttgagatttaaaacagaaactagcaatctcttaactaaggaattactagctgaaatttatataataatatttctttaagtgttcattaggaaaaggtgtcagtactgaaaagcagctgaggcctagctaagcaaggggttcatttcttattggaatagtataggcctggtctgaggcttcacttcaaagtctctagagttcaattaaaactggattaggtagaaacagacccttctttgggactttctgttcactgaaactctacatacactgacagcaccttagacagaggtctagccctccaatgaatcagttgccatagaaaccatatcattaccattgctctgcagttatgacctcaactcctgaattgcttgaaatctttactctctttgaatgtttaccaccttgttttattattgttagtattattattagtaaattaagctttcaattgttttaaataatttgtttcaaagctggtttattaaatgttgagacagtgtgttagagaggagagaaaggatttagtattgaatacatagattatatacacacataaatattctatttatttactgtaaaacatcaaacctatcttttttaaaagttttatttaaaaactgtgccttatgaaaaggatatattatttttcccaaataatgcatgtatttcttccttctgtcctacaaatagtatactattaacacataagaaaattgcttcactttgttgcacttattcttagtaaaagtaaggcattttttactttccctttaccagtccatttgtaaaagcttataagtttatccaaataaaactcttttttgttttcttgtcctcatgaaagaacaaaaatagaaaccaacactcactgcccaactatatactcttatttattgaatactagggatttttaaaaagtagatttaaaatagttaaagccaatcctttaagtgaatagaaagggaggttttatttttttaaaaaaaactatccttgatacattttaaatgttttaaaattcctcctgaagggtaaatattaaaaagtgataaaatgttttacctcaaaaaaaagaaatacttacatgagagcctgcacatgtaacatcaataaaaggtattttaaaaattactattcctaaggtttaaaactagcatagcatatccctatgccaaatatttcccaaattctatagtaattttattttttcagacaattccagatttctgaagattttggtgttaagaataaaatcaggtaatatatatcaataacaatatttaaaaattcacaacagaaccatctccaaaccctatcaatacatttaacatcaggaaaaatgttgttagccaaatatacaaaatgtaaactaatcataccattcattaagcaataacacaatggctaagaaagtctagaaaatattcactatatcccattttaatggaacataattacatagtcacaggttaacactttaatatggaaaaactaattatttgaaccacctttaaaataaagacattgaaaaatactttcatatcaattcaccaataaatatatgtgcaaatgttttatgttacaataattgtaatttgaacaaatagcttaaagaattttaatcaagtattttaaagttgcatcactgttattaacatagtttttacattttgctatagttttctctgaaggtagatatcaaagcatagcacgtaatttactcaaataatattgaatcctagttggttcaaggatttacttcatcaccaaccatatgacttttggttttaaaattcaaggatatattctttaagtaaaatttagaggtcttttttgaatttgacaatgacaatgacacacagtcgactctggtggaaaatttaagttgataattttcttactaaatgtatatccatgaacacttagaatgtccccaaacttcaacaaacaacaaaaatgaaagtcatacataaaaaataaaattacctcttaaattaatcatgtgttgttatttaatttttttcatctatacagtatatttcccttctggtttcaagtactatgatgtagtatagtattcatagcatttcatgggtgacaaattcaattaaacatattcattactctaatgttctacttggcagttttagtcagtatgaaaaattaaaaatatataaataaaatgctatgtgacctttgtattgattggactaaaatggctttagcctgggtgtggacgatggggcagttgggaggggcaagaggggagcctacaaacacacacactcttatgttttctcttccaattactgagggagatgataaaaccacagcaaatgatgtatcagctcattttatcttatcgctttggggctaggtgacaatgaagttcatatttcacgggctcccattgaagactgtgaaaattacttgcccttatgacctgaaatttcactagaagacagaaatttctcttctgcaaagtaatgcaatttttcagatgtcaacctttagcccagctttaaaaattaatttcatttatattaaccaatgatattgatattttcacagaacactctttgatacatgaagcactgactggcaaattgatgttgctttagatgggtaaaactattttattttaagctgctgtggcacacagatttatggcaaactgaaattcccatttcataatttaatatttgtgctggagttgatgcacctttaagcccttggcctgtaaataattcagactctttacttggttgttttattttcaatattcctcagcttaaaaataatttgcattctaaatgatgcatcttaaaagccatctcttattcaactagcattaaatatcaatcttaatgagtcaaaagccaaacgtagtaatgaaggagaagaacaaagaaggtatttatttatcttccagctcatttttaattcagtttttaaaatttaaactataccataagtctaaatttttttttgaaagaaggcaagaaaccaaaatgaacccgcaaaaggatattaaggaaccatagcaaggaacatgaatatattttatatctttttcatagcagcacataaggtgaagagctgggtgataaatttgtagagaaggaacaaaatgaacttagatatttatctaaattaaaatagatatttagctttgaaggtaccttttaaaatacaaacaaaaacaaagccacaatgtcaatatcattgtgaacgaggcataaaagggtctcatctgattttagtaaaggagatactgaaattaccttgtatctgtacaaaagaaacatttcaatatacaatttcaatattttagagtaataaaaatgctactaaaagatgtatgatctggtgtctttacaagttacaactttattatctttatccagtaaagagttttgtctaattcaaataatgccttgagaagataatcattaaacaaatacccttctattttataaggaaagtcaagcataaatatgcatataacttatacattcatttatgatcttaaaattagaaaaaggctaagaaagccatttatctaatttaggtagtttctccccaaatggtttaacactgctttggctaaatttctatactcaaaataatttttgcacctttatgccaacaatattcaaattgttttttcttcaaaatatttatatttagttcttccttacatgtacggtatagaaaaaaatcataatataaattttccctttataattttttcatttagattgaaaatattcccaattacttctcaaaaagttgtgacaataacatgctattgttgctgaattaagctataaagtatttctgtcagggccaggcaaagtggattatgcctgtaatcctagcaatttgggaggctgaggcaggaggatcacttgaggccaggaattccagaccagactgggaaatacagcaagatcccatctctacaaaaaataaaattagatgactgaggtggcatgtgcctgtagttccggctactccagaggctgaggtgggaggactgctcgagcccagaaattgtttgaggctgcagtgagctatgactgcaccactgtacttcaggttgggcaacagagacttttttttttttttaagtatttttgtctaatgttccccatattgattctctatagtcataagctttctattccttactagagagttaaaatttaagtcaccactaataaaaaactaactttaaatatattggaatatttcacaataagtactttaaaacaaccaatgggcagaaactctctttcttctcaatgccaattcttccttcatgaactccatctttgatgggtatcaaaagccctccctaaaaaagtgttttacttctcatagaagtaaaaagtaaaacagaggatactagaggttggaaagtgaggtgggaagcaaggaaagtgaggtgggaagcaaggaacatggaaagatttgttaaaagatacaaaattacagttagacagtaataagttctagtgttctataccactgtagaatgactccagtgaacaataacatatagtttcaaacagctagaagtaggatagtgaatgttcccaacatgaagaaaggatgtttgacatgattaatatgctaattaccctgatctgattactatacattatgtgtatacaacatctttatgtaccccatgaatacgtacaactgttgcttaaaattttttaaaaataaaatgaccaaaggtaaagttaaaaaaaaaaaaatccccccttgggctgggcgccggggcttatgtctgtaatcccagcactttgggaggctgaggcgggcaaatattcctgaggtcagtagttcaagaccagcctggccaacatggtgaaaccctgtctctactaaaaatacaaaaaattagctgagtctggtggcgggcgcctgtaatcccagcttactcaggaggctgagacaggagaattccttgaacctgggaggcggaggttgcagtgagctgagatcggactactgcactccagcctgggcagcaagagcgagactctgtctctaaataaataaataaataaataatcccccctctcccagatgtatgaactaaatcttcaagttagagtaatatcagtttactgatagactattctgtgtagcagatacaatatgatttagccactggaagtttctctgttacctaagctacttaaacaaattaaagggaaaacctttgtttatcttgaagaaatttgcttttgttctttgaacacagcaagcaagagaaatgaaaagcaaaatggaaaggaaaaattaggaacatagaacttgatgctaagagcctaaaatccccaggatacatttttcctaatcagagggaaatacttttctacttttttaaaattagtacctgcctcctactaaatattaagcttgtttagttggagtcagttataaatgaatagtacagatttgtattcacttccataatagagcatggaactaaatgctatgctcacatttgccttcagacgtaatcttccaaaaagccattttcttaaaggacctatatgtaatagaacattatgaataaaacttaaataagacttttggggttaacctcatttcattgcgtaactccatattgttgcacaatcctcactagattggagttcatactttaactggagttcttatgacactacatcactagtcttagtcatctttctattcacagtatctagcacaatactgaagagactgactgatggatggagggccaactcagcttcactaagtgtctacaatcaggccagatgtggtggctcacgtctgtaataccagcactttggtaggccaaggtgggagaatcacttgagctcaggagttcaagatcagctgggcaacacagcaaaaccccgtctctgctaaaaaatgcaaaaattagctggaggtggtggtgtgtgcctgtggtcccagatactagggcggctgaggcaggagaatcacttgggcctgggatgcagaaggtgtagtgagccaaggtcgtgccactgtactgggcaatagagcaagaccccatctcaaaaaaaaaaggtatctacaatctaagattctgggaacacatgaacataaacacagcaaaaaacaaaagggggaagaagagtaaaatggaaaactacaacataaaaatttttaaaaatcaaattcaagggtcagaatacttccacttttgatgaagatggagtaacagggcctggatttatcctacctaaacaatatgcaaaatgaacataatatactgaaaagttgttttcaaaatattaaatattaagcaataaaaaacagtgattcctgaaaaacaggaaacaaaattgtgacacctattaatgcccaagcacaccatctggaaagactttgcagggcccagaggaaaatagagaaacgtagttagaacgtaatggtctcctgcagtagagaaaacagagcttgaagtacagggagatcaaggcatcaaaagcttgcagggcagagtagcagatcagagagagctgcaaagcaacagagctccagagatctgcagccttcagctgagtactgaccaagctatgaaagaaaacaatgtgagaccagtgaaagaatcatcctaagaaattacaatgaacagtactcagagctcacacagaatgtaaaaatctcatgattcatggagcactgtagagactactcaaaagggttttgccacagaagtgggggaaagttagctctagacttaatgctgctctagttctccctaaaaatcttaaaaccaagctccagatggatcaaactatttctaagtaacttaactgtatcccagaacaatgtattataaggaatgcaaaaatatccaccacacaactaggcaaaaatcactacaactggcattcaattcataattactgggcctgtaaaagaagcaaaacaacatgacccacatgaggagagaacttaattaaacaaaactctcctagaaatgaccatcaacagaatttttagaaaaagacatcaaggggagccaagatggccaaataggaacagctccagtctacagctcccagtgtgagcaacacagaagacgggtgatttctgcatttccaactgaggtaccgggttcatctcactggggtgtgccagacagtgggtgcaggacagtgggtgcagcgcaccgtgcgtgaggcgaagcagggcaaggcattgccttacccgagaagcgcaaggggtcagggaattccctttcctagtcaaagaaaggggtgacagacggcacctggaaaattgggtcactcccaccctaatactgcgctttcccaacgggcttaaaaaatggcacacaaggagattatatcccgcacctgactcagagggtcctacacccacggagtctcgctcattgctagcacagcagtctgagatcaaactgcaaggtggcagcgaggctgggggaggggtgcccaacattgcccaggcttgattaggtaaacaaagcagccaggaagctcgaactgggtggaggccaccatagctcaaggaggcctgcctgcctctggaggctccacctctgggggcatggcacagacaaacaaaatgacagcagtaacctctgcagacttaaatgtccctgtctgacagctttgaagagagtagtggttctcccagcatgcagattgagatctgagaacaggcagaccgcctcctcaagtgggtccctgacccccgagtagcctaactgggaggcaccccccagtaggggcggactgacacctcacacggccgggtactcccctgagacaaaacttccagaggaacgatcaggcagcagcattggcagttcaccaatatccgctgttctgcagccaccgctgctgacacccacgcaaacagggtctggagtggacttctaccaaaccccaacagtttggtagaactgggtctggagtggactctaccaaactctctgcagctgagagtcctgtctgttagaaggaaaactaacaaacaggaaggacatccacacaaaaaacccatcaggacattaccatcatcaaagaccaaaggtagataaaaccacaaagatggggaaaaaacagagcagaaaaactggaaactctaaaaaatcagagcacctctcctcctccataggaacgcagctcctcacgagcaacggaacaaagctggacggagaatgactttgacgagttgagagaagaaggcttcagatgatcaaactacgctgagctacaggaggaaattcgaaccaatggcaaagaagttaaaaactttgaaaaaaaattagacgaatggataactagaataaccaatgcagagaagtccttaaaggacctgatggagctgaaaaccaaggcacgagaactaggtgatgaatgcacaagcctcagtagccgatgcgatcaactggaagaaagggtatcagtgatggaagacaaaacgaatgacacgaagcaagaagagaagtttagagaaaaaagaataaaaagaaatgaacaaagcctccaagaaatatgggactatgtgaaaagaccaaatctacatctgactggtgtacctgaaagtgatgggcagaatggaaccaagttggaaaacactctgcaggatattatccaggagaacttccccaatctagcaaggcaggccaacattcaaattcaggaaatacagagaacgccacaaagatactcctcgagaagagcaactccaagacccataattttcagattcaccaaagttgaaatgaaggaaaaaaatgttaaatgcagccagagagaaaggtcgggttacccacaaagggaagcccatcagcctaaaggctgatctttcagcagaaactctacaagccagaagagagtgggggccaatattcaacattcttaaagaaaagaattttcaacccagaatttcatatccagccaaactaagcttcataagtgaacaagaaataaaatactttacagacaagcaaatgctgagagattttgtcaccaccaggcctgccctaaaggagctcctgaaggaagcattaaacatggaaaggaacaactggtaccagccactgcaaaaacatgccaaattgtaaagaccatcaaggctaggaagaaactgcatcaactaacgagcaaaatagccagctgacatcataatgacaggatcaaattcacacataacgacattaactttgaatgtaaatgggctacacagactggcaaattggataaagagtcaagacccatcagtgtgctgtattcaggagacccatctcacatgcagagacacacataggctcaaaataaagggatggaggaagatctaccaagcaaatggaaaacaaaaaaaggcaggggttgcaatcctagtctctgagaaaacagactttaaaccaacaaagatcaaaggagacaaagaaggccattacataatggtaaagggatcaattcaacaagaagagctaactatcctaaatatatatgcaaccaatacaggagcacctagattcataaagcaagtccttagtgacctacaaagagacttagactcccacacaacaataataatgggagactttaacaccccactgtcaacattagacagatcaatgagacagaaagttaacaaggatacccaggaactgaactcagctctgcaccaagcagacctaatagacatctacagaactctccaccccaaatcaacagaatatacattttttttcagcaccacaccacacctattccaaaattgaccacatagttggaagtaaagcactcctcagcaaatgtaaaagaacagaaattataacaaactgtctctcagaccacagtgcaatcaaactagaactcaggattaagaaactcaatcaaaaccgctcaactacatggaaactgaacaacctgctcctgaatgactactgggtacataacgaaatgaaggcagaaataaagatgttctttgacaccaatgagaacaaagacacgacataccagaatctctaggacacattcaaagcagtgtgtagagggaaatttatagcactaaatgcccacaagagaaagcaggaaagatctaaaattcacaccctaacatcacaattaaaagaactagaaaagcaagagcaaacacattcaaaagctagcagaaggcaagaaataactaagatcagagcagaactgaaggaaatagagacacaaaaaacccttcaaaaaattaatgaatccaggagttggttttttgaaaagatcaacaaaattattagaccactagcaagaataacaagaaaagagagaagaatcaaacagacgtaataaaaaatgagaaaggggatatcaccaccgatcccacagaaatacaaactaccatcagagaatactataaacagctctatgcaaataaactagaaaatctagaagacatggataaattcctcgacacatacatcctcccaagattaaaccaggaagaagttgaatctctgaatagaccaataacaggctctgaaattgaggcaataattaatagcttaccaaccaaaaaaagtccaggaccagatggattcacagctgaattctaccagaggtgcaaggaggagctggtatcattccttctgaaactattccaatcaatagaaaaagagggaatcctccctaactcattttatgaggccagcatcatcctgataccaaagcctggcagagacacaaccaaaaaagagaattttagaccaatatccttgatgaacattgatgcaaaaatcctcagtaaaatactggcaaaccaaatccagcagcacatcaaaaagcttatccaccatgatcaagtgggcttcatccctgagatgcaaggctggttcaacatatgcaaatcaataaatgtaatccagaacataaacagaaccaaagacaaaaaccacatgattatctcaatagatgcagaaaaggcctttgacaaaattcaacaacccttcatgctaaaaactctcaataaattaggtattaatgggacatatctcaaaataataagagctatctataacaaacccacagccaatatcatactgaatggacaaaaactggaggcattccctttgaaaactggcacaagacagggatgccctctctcaccactcttattcaacatagtgttggaagttctggccagggcaatccgtcaggagaaagaaagaaagggtattcgattaggaaaagaggaagtcaaactgcccctgtttgcagatgacatgattgtatatctagaaaaccccattgtctcaggccaaaatctccttaagctgataagcaacttcagcaaagtctcaggatataaaatcaatggcaaaaatcacaagcattcttatacacgaataacagacaaacagagagccaaatcatgagtgaactcccattcacaattgcttcaaagagaataaaatacctaggaatccaacttacaagggatgtgaaggacctcttcaaggagaactacaaaccactgctcaatgaaataaaagaggatacaaacaaatggaagaacattccatgctcatgggtgggaagaatcaatatcatgaaaatggccatactgcccaaggtaatttatagattcaatgccatccccatcaagctaccaatgactttcttcacagaattggaaaaaactactttaaagttcatatggaatcaaaaaagagcccgcattgccaagtcaatcctaagccaaaagaacaaagctggaggcatcactcttcttgacttcaaactatactacaaggctacagtaaccaaaacagcatggtactggtatcaaaacagagatatagaccaatggaacagaacagagccctcagaaataatgccgcatatctacaactatctgatctttgacaaacctgagaaaaacaagaaatgaggaaaggattccttatataataaatggtgctgggaaaactggctagccatatgtaggaagctgaaactggatcccttccttacaccttatacaaaaattaattcaagatggattaaagacttacatgttagacctaaaaccataaaaaccctagaagaaaacctaggcaataccattcaggacacaggcatgggcaaggacttcatgtctaaaacaccaaaagcaatgttaacaaaagccaaaattgacaaatgggatctaattaaactgaagagcttctgcagagcaaaagaaactaccatcagagtgaacaggcaacctacagaatgggagaaaatttttgcaaccaacccaaatgtccaacaacgacagactgggttaagaaaacgtggcacatacacaccatggaatactatgcagccataaaaaatgatgagttcatgtcctttgtagggacatggatgcaactggaaaccatcattctcagcaaactattgccaaggacaaaaaaccaaacaccgcatgttctcactcataggtgggaattgaaaaataagaacacatggacacaggaaggggaacatcacaaaccggggactgttgtggggtggggggaggggagggatagcattaggagatatacctaatgctaaatgacgagttaatgggtacagcacaccaacatggcacatgtatacatatgtaacaaacctgcaaattgtgcacatgtaccctaaaacttaaaataataaaatttaaaaaaaaagggggggggggggagaaaaagacatcacatgagaccaagcagttttgttttgttttttttgagacagacccttgctctgtcacccaggctggagtgcagtggcgtgatctctgctcactgcaacctctgcctcctgggttcagacgattctcctgcctcagcctcctgagtagctgggactaggactacaggtgcccaccaccatgcctggctaatttttgtatttttagtagaggcggggtttcaccatgttggctaggctggtctcgaactcctgacctcaaatgatccacccaccttggcctcccaaagtgtgggattataggcaggagccaccacgtccagccccaagtagattttagagcaaaacatttaattagggataaagagggtcattttataataatatcatttcatcaagaggctttatttaactatcctaattgtttatgatctgaataacagagcttcaaaacacaagaagcaaaaactgagagaactgaaagaagaaacacatgaacccacaatataaacatttcaacattcctctgtaattaataaaacaagaagattgaaaaatcaataaagatacaaaggagttgaacaagaccatcaaccaacagaacctaactgacatttatagaacagtccaaccccagagcaaggttacgaaaagcatattttgggctaaaattcaagttgcaataaatttaagactcaaatcagataaagtatattctctgactacaatagaagtaaattaaaaatcagtaacaatagattgtttgcacagcatggtgactatagttaatggtaatgtactgtttatttcaaaattgctaaaagagattttaaacattcttaccacaagatataagtatgtgagttaatgaatatattaattagccagattttatcattccacaaaatatacatattattaaaacatcacacagtaccctatatataccattattatttttcaattaataagaaaatttaaaaaaagctatctggaaaaggccccaaatttgaaaattaaatagtacacatctaaataacctatgagtaagagaaaaaaacgaaaaggaaattagcaagtatttaaaattggatgaaaatgaaaacacaattttaaaaaattctagaatacagctaaagcagtacttagagggaaatttacagcactaaatgcatatattaatgtgaaagaaagatctcttttcagtgattttgacatcccctttaggaaaaaagaaaaataagagcaagttaaacccagattaagcagagaaaggaaataataaaaatcaaaagaatagaaaaccaaaaaaaaaaaagagagaaatatcactaaaacctaaagctgtttttgtgttttgttttgtttttttaaaaaaagatcaataaaattgataaacctctgaccagagattagggaaaaaaaatagatgtaaatcacgaatatcaggaattataacaggaattaccaatattaggagagaagagacatcaaaacagatttttagacattaaaaggataaggggatatcataaacaaatagtttggactactttgatgcgatgaacagatctcttgaaagacacaaacttggccaggtcctgtggctcacgcctgtaatcccagaactttgggagacagaagcaggcagattacttgaagtctggagttcgagaccagcctggccaacatggtgaaaccgcatctctactaaaaatacaaaaacagccaagtgtggtggcacatgcctgtaatcccagggacttgggaggctgaggcaggagaattgcttgaaaccaggagggaggtggaggttgcagtgagccgagatcacgccactgccctccagcctgggcggcagagtgagactccatctcaaaaaaaaagagaaagatacaaactaccaaacccctttcaagaagaaatagattgcataaataatacaatatctaataaagaagttaaatttgtagtttaaatcttcccaaaaagtaaactccaggctcagcagactacactggtaaattctaccaaatatttaaggaagaaactctatacaaacttgtccagaatattaaagaggaaagaatacgtgccaactcgttctatgaggtcagcattatccagatgtcaaaaccagacaaacacagtataagtaaaaaggcagtctgcacttaaatatttgtaaaatttctctgtcttgagacttactgtggataccctacaaaataaatatattaaatgtcttctcatactaccttcccactcttgtaccttcacaaattgtcactcaatgcacccatctttctctcggatttctcaaaaacatctacgcagtttccttttgtagtacattccaacttgacttcctttggatttcaacagagtggaattcttagccttcttagtttacactgagtgatttcatcccgaatcactgcttctattgttgccaaagcacgctggggtgtgagatgtagagctaagatattagaggtcagttttagacccctatatccaatcacctataaatagctccaccatatgccctctaaactctcaaattcttttattttttattattttatttatttacttttcattattttttgagacagagtctcactctgtcgcccaagctggagtgcagtggcgtgatcttggctcactgcaacctccgcctcccgggttcaagcgattctcctgcctcagcctcctgaatagctgggactacaggcacgtgccaccatgcctggctaatttttttgtatttttagtagagacagggtttcaccatgttggctaggctggtctcaaattcctgacctcaggtcatcctccggccttggcctcccaaagttctgggattacaggcgtgagcctccatgcctggcctaacctctcaaattcaacacatccaaaaacgaactcactaccacccctcaacagctgtcattagtccaattgagactatttcagttagcagagccataaacaccatgtaagccaaacaaaaacttagttatgctaaatactacatctcactccttttgaccctcactcacctctcaatgaactacttcacttgactctatctcccttctgcttttagtcatatagggtaaaacctactttagaagaggttcttatcatcttttaccattttcatagacatatcttatattctaaacatgtcatacaacataacactccttcaatcacgccatgctgcttcatgcttaagcatctcccagtgtgatggtcttcctaactgcaatgcagcttctttcaacgtgcaccaccaaggaggtggtggcagtggttgtattaaagtagtaccagacagtaatagcggtagcagcaacaaacacaacttacttagatctcattgtatcccaggatctatgctaagtgattcaattcagttatttcagctaactctcaaaatggcactgtgaaatcgatgtcattttcaccattttataaattaacaaacagtctttgagaggttagatgacgcagtcaaaatcacataactagtaagtagtgtagccaagtctatcagacttctgacattatgctctgagccactatataatactcccaccacagagaacttctcatccttaaaggccaagccaagattttgcaaaagctctgacttctcaaacagatgtgctaccacaggcctcttacaaattgtaaatgtctccctcactagacaattactgaaggcagatactaaacagtacttattttagtaattccagtgctactggtacatcacagaactcaataaatgtatacccaatgaattaatgatgagattaacaatttcagttgaaacagattcctcatcttccactccatgtttctataattagtttcaaaactgaacagaaaagagagatctttaggctttttaaaatagcgaactgtgtatttcagcccctggtaagggcattggggaggccataatcaaggttagccaaatttgttgtatctggagaaagtggttcaaatgacctttcataactactaaggaactggaaacttatgatttagatcatttaaaaggaacttattataagaattaaaaagtgagtgttatgaactgaatgtgtctttccaaaatatgttgaaatcctaacttccaacgtgatggcaacaggaggtgatttggactttgggaggtgaacaagtacttagaggagagccctcatgaatgggattataataagagactccagaaagctctctagccctctttccaccaggtaaggatagaatcaggagtcagcagtctagggctccacaccagaatctaccatgctggcatcctaatctcagactttcagcctccagaactgtgagaaataaatttctgttgtttataagccacccagtctatggtactttgttatagcagcccaaacaaagacagtgctttttgagaaaaaaaaaaaaaaaaaaaaaagatgaagagtccttgttctgcagtgaattattagaacctaaaagaaacatgtttctgaacaccttcacctccccccaaaaaagggaacaggtaataaaaatatgcaatgtagatttgctatattatgtaagaatattcaattctgctttagaagacaagaaaacaaatgtgatagatgaacacaaaagaaacattaaacattaatagtaacataatagcttccaagatgtaggcaaaaagtcataggctatgttaagtataggtaaggaagtaagtggcttatgagagacagacaaaattcaaatgatgttaaatacgtacagtcaatttaaagtttgaaatcagcaagacctgtcaaagacagaatacattgaatgtatgatggcacacaaaaaaagtgctatttacagatggatggaaagaccacctcaaggtataatcatactacctctgtgctgggtctctcatatttctgcagatcttagaggaaagtagtaattgccatcttatatgacacactgttttcaaggatgtttgcataattaatagccttggaagagacagtatctcagtttacagcaatgggcaggtttgtttactgtccagtataagaaaggtaatgatgctttataaggcagaggccagatcttactgcccattgtaaaaattttaggttctctacagttgaggttgcttaactgggatgtaaactcactgggaacacagcatccacctgggtcccacctgggtcctcattgggaacacagcacccacctgggtctgttcatgatgccctaataaaatactgcagactaggtggcttaaacaacaggtgtgatttcttggagttctggaggctgggaagtccaagatcaagttgccagccagtttggttcctgctgagggctctcctcctggcttgcagatgacttcctgctccctgtcccctcacatagtggagacagagaatttctctttcatcgtcttcttataaggccaaagtcctatcagattggggccgcatccttatgacctcatttactcttcattacctcctaaagagtctatctccagattcagtcacactgggggttacagcttcaacatataaattttggggaaatacacatcagtccatagcatctccaacaagtcactccatgaaacttggggatgcgagggaaatagacactaacaagatgcttactctgcttgtgctgtaagtctttgtccctaacctttgtcctatgtcttctgccaacatctaagaaactgtggcaagataaattgttagcttgcatttcagacctttcatagtttttttgttgttgttttgttttgtttgtttttgagatggagtttcactcttgtcacccaggctggagtgcaatggcatgatcctggctcactgcaacctccgcctcccgagttcaagtgattctcctgcctcagcctcccaagtagctgggattacaggcatgtgccaccacgcccagctaattttgtatttttagtagagacggggtttcaccatgttggccaggctggtcatgaactcctgacctcaggtgatccacccgccttggcctccttaagtgttgggattacaggtgtgagccaccacatgccgggcccctttcatagttcctgacaacctggatgatatctatgccggctttaaattgcccacccattgataatacccagtatagccccactctggcccctgtggttttatctgcacaagaaatgcagaaaaaaacttgtaaaactattcagcaggttaattggttggctccagctatgaccagggatagctgctgctgtgtgtctctaatagagctggtgtgtttcattggaccggaacactttccttctgtggtctcccttgtactcaaacctcaattctggcacttgtaacatcaaagaaaggcatacgaggcagaaaaagagacaggacatataaatgttacatgaaccaggactcaagaactctgatctttctacctgcttgcattcgatccgaagtatattaacttatcccaactctcttccatttcttcttattgcgtatgttaaattgatttaatgaatcatctgctttgagaagcttatttgatctgtgagcccttctgttctgtgaaatctgggacgacttgcctggtagtgtactaggaggcaacattgcattaggtaatttcccacagaacaggttcatagctaacctttatctcgccttaaactaccgttgaaaaaaattattctaggccactggggaaaaaataggaagctccataattcatttattaagccagcataatgttaatgctgaaaacttaaaaagagataaagagactatcaaaaaggaaaataatagagcatttttatcactgaataaagatacaacactcttaagtaatctgtaagcaaacagaatccagcaatgtctaatgagaacaatataacattaccaaggagggtattttcttggattgcaagagtggttcaataccaggaaatccacaacaggagatctactccttatatcaacaaattaaaaggaaaacattgcatcatcatttactagatgctgaaaagcatttgatcaaattcaggaaccaccactaaagaaaaaaagttagtaaaacaggagtggaaaatattacgtaaaataaagactttttaccagaaaccaacaacaaatattagctatgtgatctggggtcagtcatgtaggcttctcacctcagatgcttgtcttaaattaattagtgtaggtacagctagtaaaacagggcctggcacatcataagcactatgcatgggttagcaattattattacaataataattatcaccagtcaaattgcaaaagttgtaataaatgaaataataaaatgtaaaacctggtataaacattgaaaagaaagatgaaaatgcatttgaaatatccaaagtactccaaatgattaacggaaatatatataagataaacatgggaactattaatatttgttctccattttagcatttgacacaaatattgaaattagaaaaaaatttcattcataattgcaagaaaaacattacacacttaggaataattttaacaagaaaggcagagagggaccatgggacaaaaaatataaaacaattattagaggaacacaaagtacaatctgaacacccaaaaaacttttataatagtaagaaaataccattaaaatgtaaatttaccaaaaaccaatatgtatatgagttttataaattataattaaagtgacaataggacttttttaaaggcttcataaaattatttaatgtttacaaactatataccagaaaatagtcaataaaaggatgaaaacaaagactagtaaggagtattctaccttaaacaatatgcaaatggcataaaaacaaatatatatttttttaaaacattagactgtaattcagtctgacattttctattctcttttttttttttttttttttttttttgctaagtacctgttgtgatgcacaaagctgatagcacagcttaatgtggaatgatcaacacatatgcaaagcacctagactgtacagtggcttgcacacagttacctttctattgttcttcccatgtgactacatatataatctaaaggccaagagaatttttaaaccataattggaactcagaaagtactaaaaaatatttatacctataactttgtaaaattgtaaaattaatggcaaaaatatgactgataaagtcaaatagtgaaagatctgaaaaagctatttcatgataaagggttactataatatacaatacttataaaataaaaaatgaatagaaaatggataaagaatataaaaggaatttcacagaattcaaatgtccagcattttaaaaatgctgaagtttattagtagtactaaaaaagacattaaaataatttataccccagaaacaataaaaaaattaagagttataatacattttgctgacaagagtgcagacaaaagtgtatattgttggtagaagcatgaaatgtaaaatccctttggaaagtaatccaaaattatttatcaaaaataaaaatatgtatggcctttgacccaacaagcttttggataacaaatagaaataatagttttattacatcaacatgtagggatggttattcccacatttttcatagtgacaaaaaaatgaaaataagactttgaaatccaatgcaaatcactgggaaaatggtggtatatttatgatgtatcttcttcagtcatttaaaagaatgaattaaagtcacagagttgacttggctggatatccacaatcaatatattatggagtgagataaacaaacataccaagttgtatatattatatgactttatttttgtaaatcaatgacactcactccctacaacatacataagtttatatgaaaatgaagaaaaacatgagaagattacgtactaggttgcaaatatatgttaaggtgttgccaggcacagcggctcacacttgcaatcccaacactttaggaggccaagacaggaagactgcttgagcccaggagttcgagaccagcctaggcaacacagggactctgtctctacaaaaaaatacaaaaattagccaggcatggtggcatgcagccatagtcccagctactcaggaggctaaggcaggaggatcaactgagcctgggaagtcgaagctgcagtaagccatgatcatgccatcacactccagcctgggcaacagaacaaaaccctgtatcaaaaaaataaataaatagaaggtgttctgggggatagatgatgggggcaagaggagaaagccaagacaaagaaaaacaggatgcataaaagtaaaatgcacatgctaacaaaaaacaagcaatgagtagattatatttataataagctgcgggtatattcacaaacatataaaatctgaatgatagcaggtatgacattatttctaaatttttttctatgtcatattaatagtatttgtataaagtagaattcccttatccactcagaggtatgtttcaagaccccttaggggacatctgacaccacagacagtaccaaactcaattgtcatcagttggaacatggttttcttcagactttccgcccacaaatgcaatgctttttccaccttaactaagcacttattatgcactgtgctggtaacttttgcagtttgaagtatgacagcaaaactagcacaaatttcttattccctcttcacaattttatagataaagatgcattcttactatggatcttagcaacctcaacatacgctatttcttctttcagttcgagaactttcaccatttcacttcgaggaatcattttacagcttctctttagcatatctcaattgccaacatcactacttttgaactttgggacgattagtaagtaaaataagggttacttgaacacaagaactgtgttaccacattagtggatctgataacctaagcaactaacagcaggtagtgtagacagtgtggatatgctagacaaaggaaagatccatgtcccaggcaggaaggtgcaagatttcatcatgctactcagaatggtgcacaatataaaacataaattgtttattttgggaattttttatttacaattttcagtctacgattcaccactgtaactaaaactatggaaagcaaaaccatggataaggggaggctactgtatggtcatgtaggatgaaagtcaacttatctttctttcctttcttttagtttccagagctcaacctgcttacctttttttccctactttaacgtttgcaaaattctttctataggtttttgagaattcttcgcctacaaccagcctcccttccttctcattgtccttaaaaataagaatacaaaccctttgaattttaaatgttttactcttgttttctatcaggcaccaaatattcaggtgactgatagaatgattcacagacctttgtgagtcattaagtgtgaaacatgattcagaagtagcaactggaaacaaacacagtcctctgttaacatctcagagttcaccaaacttttttcttacccatctctgatctccataggcctaatgtaacaacaagagtagaatactaattttctggggtactgtgggtttgtttgcttttttttcctgaggaccggtatccttaaatgcctatctctgtgacctctgccacaaacattaatagtcccacatttgttaatgcatttttatgttgatacaaatatagtcctttcctagataattttttttcctttggtttattttacttcattcataattcatatcaaaatagcaatatttaaatgagacaagtcaattccttataatacattcttccattttcaaagccttgcacatttaagaattaaaataagagaaaacctttagaagtttaaatccattattctttttttttacttaaaattttattaaggtatagaaaatacttggtaaaatacaaagataacaggtgtggaacttgatgacttctaataaattcagacacctatgtaatcaccatcctattataatataatatttccatcatcccagaaaggttgctcacatctcttcactgtcaacatctcctgtaaacattcactgttctcatttctttcatctctgattagttttgcctaatctacgcatgatacacatggaatcgtacatcatgtatccttttgtttatggcttctttcactcaccgtaaagtttttgaggttgttccaagttgttctgtgtattgataattcatttctttttattactgagtagtattgcattgtataaatgtaacatgattggtgtatctacccttcatttaacattcaagtagtttactaagaataaagttgatgtaaacatttgtgtactagtctttttgtgaaccttgtgttttcagtcctcttggacaaatatttaggagtgacactgctgtttcataggataggtggtatgtttaagttttgagaaactgccagaacagttttcaaaacagttgcactattttacactcccatctgcaattgataggagttccagttcctacacatcctagctaacatttggtgttgtcagtcttactaattttagctatcctaacgtgtagtagtgtctcctggtggtttttcaagacaacaaattgtgctgaacattttttcaggtgcttattggccactcacctgccttcctttatcaagtccctaatcaaatcttttgtccatttgttttattgagttatctttttattattgatttgctaatatttagtagacacaagttttgttagataaatacatggaagatattttctcccagtttgaggcttgcctaatcattttgttaataatctaatatcattgaggagatataattttctagaagtctcttgttcttcaatggtaaatgggtcttgaaaagacatcttttgcaaatatattttttaaaggcagcttgtcaatttcttgaaatgacctactgggaatctgaatgggattgagttgaattgatagataaatttggggagaaatgacatctttataatactgagtcttatcatcaaagaacttgtcatatctttcaatttatttaggttttatttttttttccttaggaatattttgtagttttcagtgggcttacagatatttcaacaaattattcctaagtattttatgtttattgaatattattgtaaatgatattaaattcatatttttgaattgttcatagaaaaaacaatttttatgcccatcaatggtagatcagataaagaaaatgtggtacatatacaccatggaatactatgcagccataagaagaatgagatcatattctttgcagcaacatggatacagctagaggtcattgtcctaagcaaactaacgcagaaacagaaagccaaataccacacattctcacttatttgtgacagccaaccattgagtactcatggacacaaagaagggaacaagagacactggggcctacttgaggttgaagggtaggcgagggtacctatgtacctattgggtaactatgctatataatagtataatagtatacctattgtatactatcttgtacttgggtgacataataatatgtacaccaacctatattgtgttttagctatgtattcattttcttaaaaacaatagagacctaattaggttatttatttttaattaaataagctttagaagtttctgtcttcccagtaatttgttcatttaatctaaattgtccaatttattattttcatggctataacatgtataatgttcttttattccaatattggtagttcataccttctctgttttttattaatctgattagatgtttatcaatcttatcaaactttttaaaaaacagcttttggtttcactggatttctagttttttaaagttgatttttttccttttacctttattatatccttccttatgtttgagtttaatttgctcttcttctgacttcttaatgatgagcctcagatatttgattttaaacttttctgttgttctctatattgttatttataaagatataaatttcacagttataggttttcctctaggtactattttgtccatatcccactaattttgatatattatcttttcttttcacttttattgtggagattgggtttcactgtgttgcctggtctggtcttgaactcctggcctcaactcatcttcacacctcagcctcccacagtgctgggattacaagcatgagccagggtacccagcctctattttcattatgactgttaaatacttcctaatgtccctaatggttgcctaaccctatttaagaatatgttgcataatttgaaatatttgggatttcccagatatcttcattactttgatttctagttcaactgaattatgaataaagaatacaatctctgttatttaaattctattaaattagtgcactccttttataaccaaacaaatggtcttcacagtaaatattgcacttgcatttataaggatgaggaattctggagttaaaggtgatgtatcaatctcaattaggttaaatttgttgatagtgttcatgaattctacataattactgacaatacctattgttctatcagttactgatagaaaaattttgaaatctcaaatataaccatgaatttaaatattttcccttcagtttgcttcacatttaaaatctctattatttgatggtatattaattattactgctgtaacaaattaccacaaacttagtggcttacataacacaaaattattatcctataattctggaggacagaaataaaaaatgttccttaatgggctaaaaccaaacctgagttcttttcggggccccaaggatggtgtcatctataagaaacaggcttccaccagacacaaaacctgccagtgcctcaatcttggtcttttcaggctccagaacagtaagaaaataaatttctattgtttacaaattacccagacttaggtattaatattttgttagaggagcacaaattcactaaaagagaaattgttgtcaagagtagaatattgctacaacatatatctaaaaatttaaagcagttttggaactgggtaatgtgacaatattagtatgaatagaaggaagtcagatgctattcatcaaagcaatgcaagaataactccccaaagcatttcagagatctttgagtctgccacacctattacatgcccagagtgccagggcctgagggtagatctttttcaaaggaggggcccacaacaccagaggggctcaaggcacccgtggtaacttggggctcaccaaccagcacagctcaagtctccgcttcccgcattccagtacagtgctctttggccaccccagctatagctgaggaagggccaggtgcagttcaggccacctctctggaggacataagtgataagcctcagtagcatccatgtggtgctaattctgcaggcccacagagtgcaatagctgtggaggcatgacttctccacctagattttaaagaatccttccaagagtcccatggccaaggcagaaaactgctacagaagtggggccactgaatagagcccccactagggcaatgcctagtagagccatggggttgggaccaccaaagacagcacccactagagcaatgtctagtggagttgtgggacctgtcccacagttgtattttgaaggcggtaacttgtttgatttcacaggttcacaactgaaaggcaacttgctaaggctaaaacacaactttcagtctcactcagtctgacttggatggcatctacatgatattctggacgttaaacttttgagctagaaggagttaagacttttggtgctattgtggtagaataaatgtgttttgcatgtgaggttgacatgtattttgcggtgggaatgctatagtctgaatttcccccaaaattcatgtggtgaaacttaatctctattgtattgggcagtgtggtctttggaggtgatcaagtcatgagggctctgcccttatgaatgggatggataactttataaaagggctgaaggttgaaggggccactatcttaccctttctccatgggaggacacagcagcaaggtgccacgatggaagcagagagcagccctcaccagacacaaatggtactgacttcaccgtggaattcccagacaccagaactataataaatttctgttcttcataagttacccaatctcaggtattttgctataccagcacaaacagactaaggcaggtgagaaatgctctagttgacatatcctatgaggaattatatgagatccagatgatatcactagtgatggtaacttcatcacttgattaaggtagaattagccagattttaccaccgtcaagttaccataattcacttcgcatactcttttctatggaaatgtgtcactgaatctagactatcctcagagggaggtgggaagagtaggaattaagttccagctcctagaatgggaagaatctatctatctacccatccatccatccatctatacacaaatacatactagattttaaagttgtacaatctctgtcacttctgggactccactatttaatgatgtttctcctggattagaaccatattttcctgcttctttgcatgtctagtcattttgtgtgttagacattatggactaacaattattttatctacatgttgttgtcttactttagagaataatgaagttttgctctggcagatgggtaatttaattgtgaatcagatggttccttttcaaggttgttttaagctttgttaagacaagtacagagtactatatattatctaaggatacaggagagtacttatagtctcctacaagcacttcttatacatggtcataaaatagaataattggggcaggatgggaacagcagaaattaattttttcttatagttacatcactaacaatccatactaccttcctgacagtacttttcacctaggcaaatgattgtactccataatttctcacacaaaaattaatctacaggcttcttgcaatgtttatttcaccataattttaccttaataaatgtgaacagaagagtggagacagggtaatatagccaggctaatttgaatcctggactttccaagggataaaccaaaaccaatgggcacaaaccctgatttcactgtgttctacccaatagaaaataaaccagcccaagcataaagcagcccaagcatcattcaggaattttatacagttatctatcatgggatctttgcttcttaaactttattatatttactaatggctttcacagtctgtaggcatatttttcactgataatgaaatacagtagaaaatatcctgaggaaaaaatatttaagctttaaactcaggctacaggtagattgtcccttcaacttacaaatattgtgtattgtgaaatactgcctgtaaactagcaattagtcccactgaaatttaaaaatattaattagatgccaaggttttctcataaattactatttgattcaaaaagtgactgaatcatttaataattctgaattctaatctcgcaaaggccaaacatcctcttagcttcttcccatctcaactccaaagcctgacagaagtaatcatttttatagaggttaacaataattcaaaatttctaagtaaagagtgacctatatatatcttgatatttgtttggaaagtttgggaactctttaatcaattgtccaattacaaaggtctaattctactaagagcaaatgttaaaatagatttcaattctatatgtactgaaaacagacttacagacaataatatttttctatttatgtcttatatgaagtattatcagctatggagtgagcatcagaaggcattgtgtatagtctgcatatttaaaaaaaactgaagaaaatattattttatgctgttcctatgcagtcaatgacatgctctggcttttttttttctactaagagaacacattttgatttcagtgtttttccattatgttcttttttttcatagcccaaaagattcattactttgataaccatttatcagggactcaagttcaatctataatacctattgaaatagcaaataattcagcctcagtgtctgtgtgtgggaaaatgggctgtgtgctagataaacggcctacctgcctctgacacagattaggtcatcattcaaactaaccacagatctctagaacaaatacaaggaactacaggttcactttagctgatgtttctgttttagaaacagtcttccttttagagagttacaatatcatcaaagtatcatggcacaggcttgaaaaaccagcatccaggaacgtaaggatagaaatatttcacaatttttacaaaacaccaattatgcaacacatacttatatctgatttctcttttacactagggaatcttataaaacccctgctatttccatctgaatgaaattatataactatattatgctaggttgtaggcaaggaaagccgttacagacatacatctctttccatatacaaataagctctattttattcctctcaaatttctaatctcttcaatcttgctattagaagaaagaagtaaacattatttaaagaaggaaaccagttggctaccgagaccaatcctcacagggtgtaattaccttggtaaattcagcaaaatccagtttacattaattttacagattcagaaataaagtgttattacaaaggaagattcatttgtgaggaatatatttcttttaaccaattatacaaaatagaataaatgacttttaagatctacagaaagcaacattgccaatgaggagactagacacagagtacattccttttgtacagagaaaaaagaaaggaagaaaagaaggccaactaaattcagaatgacagcttactgatttaaaatgagaaattataatggctgttttctggttaaccatgggagagtaaccttacatttttatctactcccttgccctatggcagactttgaaggttacatcccttaacctccatttccaaacctatgtttccttgcattcttctgtaacagatgtttcacctcctctataatatgctcatttgcagttacagattgtaaaaacagtcttacttaatgagatatacagaaaaatttgataagggggattgtgggacaagcatcagtttctcaataaaaagatggataaatatgttatagccattctctcttcactttctccctcctatttaaactttttattacgaaaattttcagaccttcacaaaaatagactagtataatgaaacctttatattaatctatgaaacaatttcaataattatgccagatttgtatcatctatttcccttgcgacttctttccttttggaatattttaaagtaaatcacaggcatcataacatttcatccataatttcttcagtatggattcctaacagatgaagacttctatttttaattaacataaacatgatgccattatcatgtataacaaaataaacaatttattaaaattatctatgtgtaaaaatcctgattgtctcaaaaacatatttttatatttaactgtttccaaacaataatcacagaagatctatatatcacaattcgttgatacgcttttcaagtttttaatcaatgagagaatctctctcttcttcttttcttctactttttttttttttaaagaaactgggttatttaatctatagaatttaccatattctgtgcctcgctgattatttcttcatggtatcatttaatttgtttttgtatccactattcttggaatcagcaatttctccaaaatgagatgcaagcgtctcatgaaatctgctcagtgatttccaagaacggttttgctttctcaatatagaaacttttcaaccatacttttctttctagattatttaaacatcgaatccgagatacctacatctctgccagagggctctgtacctgagggaagtactggctgaaccaaggacataattttaaaattctgaaggaagtgatggtcaacctgaagttctatacctaatcaaactatcaaccaaacttgagggcagactaaagattatttcagatattaggcatttattaaaggatatgtacttcttaggcatttattaaaggatgagcattaccaaacaagggaccaataagacaaagaaaaggaagaatgagatctaagaaataaagaatccaatttacaacataaatcctaaaatgacagctatgggctatgtatattaggcaaacaatctgagaggttggagcagaagaatggatgataactaaaatatactggaaactgcttatttttttctcagcactatcctgctcttctaagctctatcttgaataatgagaactgaaaacttataaactatgtttcctacacttcttgccaggaggtttttcacttagagcccacaatgaaagaatttgtacaatatttagatggcagaagaaaatgagaagccttgttctccagggacaactgagggcagatgcagtggattccaggtgccaaagacaactgacataagtagctgtggttcacctgcaattcctgtactatcacatttcttgaaatccagcaatgatttcccattggttctgttagtctgtaattttaggcattaattcctttctttttaaactatgtaatgtagtttctattttccttacctaacctcaagtgattcaggaattctttaggtaaaaatatagaagtaatggatcatctgatgcttgaatgatgaccattatttatatactcactgtactataaatatcaacttctgattttatttagattgtggtatacctatatttggaagatagggatagggaaaaatgcgtgtgagaaatatgatgataaagaatgatacgttgtaatcccagcactttggcaggctgaggcaggtggatcacgaggtcaggagatcgagaccatcctggcaaacacagtggaaccctgtctctactaaaaatacaaaaaaaattagccaggcgtggtggtgggcgcctgtagtcttagctactcgggatgctgaggcaggagaatggcgtgaacccgggaggtggagcttgcagtgagccgagatcacgccactgcactccagcctgggggacagagcaagacttcatctcaaaaaaaaaaaaaaagtgatactttcttaatttccataaaagaaagtctatatacagtttaaaggtcttaagtttttttaaatagcagcataagcccaccccctctccctttttttattttaggcagtaaggttgtcttaggagagtgagtcaaggaacgaggtagaggattgattttaggtaataaagagcttttcagcatcatcgattttttaggtagataatatcttactttgttaaaaaggaatttttaaaaggggttagcaaagaaaaacaaaataagaaacagacaaagttttaaaacaaacataaaagatgcttgtgaaataactgggaaaatggctgcaaatacagttgcaaaataatgacctgagtcctctgtgacattactccttctatatatatttatatgagatgctaaattacaataaaatgtgtgcttgtttttcatttggtatgcatagaaccaaatgaaggaagttgagcaaaataatttaaatttgtaatatacttagctatgatagcctaaaacatttttctctacatgagatcatacatgtcaccaggacttatgggtttaaaagatttcctcttcctcagaaagaacatatattttcatacagcaaaatcattagcagtgactctgtttatggatcctagaatcgaccagtttcccaaataactggtttattcgcatatgcaggtctgtgtgtctatcaaaacaggttatagattaaatctaactcatctggaagccactctttacctttacggtgagtatgcatgttcctctcaaatccattttgtgaggatctattaattaaatttccaggtatccaagtattttgttaattaggagtggtaacaggagtggggatgtcactgggttcccatgtaaaacaaacaatattagcttatattaaaagcaataatctggccaggtgtggtggctcacatctgtaatcccatcactttgggaggccaaggcgggtggatcacgaggtcaggagttcaagatcagcctgaccaacatggtgaaactccatttctactaagaatacaaaaattagctaggcatggtggtgcgtgcctgtaattccagctacttgggaggctgaggcaggagaattgcttgaaccaggacccaggtagcggaggttgcagtgagccgagatcatgccactgcactccagcctgggctacagagcgagactccatctcaaaaaaaaaaagaaaaaaaaaataataaccagcttaagacaaagtagactgtaacaatcagtacactcttttctctactttttcttatggaaaattcgaaacatacaaataaagtagagagaatataataaattcccatgtagccatcacctagactcaataatttttttattctgttgatcttcttctatctatttcgcattatacttttctttctagagtatttaaaaactagtctcagatatcatgttatctcataatccttgcattccaaaatgtagactaagccatccttgactattttggcaggaattaatatttgaatagatatttaaatcttttgaaatttaatatgtgaatcaattgctctggcataagaagaaatacatattaggtgttgtcatatatactcttcatggttcatacaaattcagaaaaccatttaagaaaagaactgtccaacctcaggtgtgaaccataaagctctttcagggcatctattctctaagaagatacaaaagtgctaaggaagcagaaaagtatagagaaaaaaaaagtgatctaggaaaagaatcatcaagggagtatagaaaatctgaacttagagataaacactcagatactctggatgcctaaaaataagactatcatagtagacattgttagggctctcctcatatcccttggcaatttcaacaatctcctgtagacttccatctggcagtatctacacatccatgtgcctgagggagtactggttagacttggaataattttctgaagttggtgtataaataccacagctccctcaactctctcagttgggataattatgtgttatattttgcactgtttccaaaagttatcctgtaggattaaattcatctggcagctggcttataaggagcccatcattgtttcccctttccctgttccattttcccacctccctactagtgtcaccagctagtgtcaactacttgcactggaattcctgtttcagcatctcaacctggggaaacctgacacaattactaaacaagattcctttcttgttcttttagatgagcaaaaaaggaaaagaaagaccttgtattaggtactttacaaaaattaccttagtaaacccttataatgataatgtgaagtaagaattatacacatagggaagctcagaagttgtgtctgtgatctcaccactgggatctgaattcagaaataaagactaggaaaagcaccagcgacacgaattcagtaaacctgaatttccatatgccccaactcccaagccaattttacccagtgttatttcctcaaagcactgtagtatttgaaattatcttgtatatccatttgtttacttattgtctctctctcccacccactttagaatggaaggtacataagatcaaggacttttgtcctcattggcatatctccagagccatgggtacatttagacacaaattaatattttctaaatgaataattcagaatgattcttaaaatcaaaatattttggcttatattttgtaactcatctttcccagattttttgcaactcaatcccactttgctgattttccagaaacaccatgtttccttgccattccagtcacattcctccctccaggcctttccatttactgttccctctgcctagaatgttcttttcattagacagtcctcatggcttcttccctcacttcattcagatctcttttattgaagagacattattgctttcctttgtccttagtaattatcaccatatgacatacgtgtttatttccatgtctatccccactagactataagctcaacaagaggagaagattgtccacatttcttcactggtatattctcaacacttagaataaattttctagcatgtaacaggcactcaacaaattttgatgaatgagtggataggcacaatataaatttaaaatgtcatgatatcaacaacctccataaaattattttggttttctgaaataatcttcaaaagtaccaatacaaaatatgaaactgaaaagacccagttaaagttaagtggcactccatgcttaactgtaactgatgtccaaacagttggattctcctaattaaaataagacacaggacatggaatcaaaagacactttccagatctcaaatgtaagaaatcccagctactgtgctagacctctaccatgcgtatcatttaaatataaatgaaaacttcacacacatttgattaaatgtcctcttgttagttttagctcagttttgcagctgcaactgttaattttcaacagtttagtgaaaactgaagaataaagcccacttttcaaatggcatgttcttacagatcgtatagaggactgtcattctcatctcccaattggagcttgattgattactccttttccttatgttcattaatctcgtcaccttatcttttataccacttcattttagcagaaaggtaataataaaaccctcatccattatccttgtactcatctagtcaagcggaaatggttaataacatgctacaaattgaacttcaatcacttcattttctcctttgttgaatacacattaaaatatattccaaaagtgcaatctgttttacaggagaatttgtgttatattgctacagacaactaaaattaagtgtttctcagtttggttattaaatatatccaagtgctcttttaccaataatactaaaacattaactcattttattagggtataataatacaagagccttatctcttagaacacaaagacatctagactacctaatagtatgtgttatatgatagggtcatttatctttaaaaaaaaataccagtgataatttatgaattggtatattattacaaatgaaattgctatttttaaaagttaatttgtttacatgcaaccttatcttgaaatgcaagccctattagtgaaaaagtctataactgtcatataaaacagaaagagaagaatgggcatatacataaaatagactcaatgatttaagattttaaaagtataatcactgaaagaaattaaatttaatatgtaattagactagagttttcaaaagaaaaaagaaaaaatgacttctgaaattacaaaagatttttatgtacatcacaacaattgttgaactgatttctaatagtcttaaaaatactgagaggaaaaaaactatccttttgggaaaaaagaattttctactaatgtgggtaagtgtcttctatctatttataaatggacatgctcaccaactaactaaaaactagacctacagcaaatgttgaaaaacttaaccagataatcaaggcttattgtctattatctttctaccatcctgaaaaaaatgttcttctgaatctagataacaatgttagcaactgacaatatcaatatttgagcacccgaactctactacttaataaacccatctttttttgtttgtttgttttttaatttttttgagacagggtctcagtcacccaggctgcagggcagtggcaagatcactgctcatcacagcctcaacttcctgggctcaagcaatcctcccatcttagcctctcaggtaactagtcacatgtcaccacatctggctaattttttaattttttttaagagacagggtttcaccatattgcccaggctgttctctaactcctgagctcaagcaatctgtctccttgggctcccaaaggctgggattacagatgtgagccatcatgcccagccaaaacccatttttttttaattattgggaaagatacatatatatatctatttgcttacactgctgctgttgttgtttgaagggcatgtgtgtcagctatcaatttatcacctcttagttccatatttacccttcattatctgctctgaagtaatgaacctggatactttaagtatttctcctttgtagtagcatgacgttgttgagctttttcaacagacagccctggagggacgctgcaggatgaaagcagcttctttccccccattccagtgtgctcaactcatcgggcttccttccactcagacattagctaatgagtattaatactgagtgcctgaaatgatattttggcaagtttgcctgacctaagagtcatagagatcacagtggctgataagtcaatctccattccaccaccttctgttttatggcagaatgtgccataaaacaaccctacggccatcccatttggctcagtcatgaagatgctggattctatgatccacagacccacatcaagtatctctaccccagtccttgtcttttcctgttgttcaggatgaataccatatgtatttgccctgcctttctcagaagcaacaaaggatgaatgattaaaatgctgcttttaaaaagtgcattcctttttatccattaaattgtttcactataaaatatacacatagataatatataataattacaatgttatattttataagatcatttagtcaaggccttggtttttccagaatatagaacagtagtataccaaatgtatacattattgttcacatttaagactttttagttgtatacatatgtaactaacctgcacattgtgcacatgtaccctaaaacttgaagtataataataataataataataataataataataataattttttttaaaaaaacactttttagtacatcatccagtattcctaatatacaaagctaccctcctttttgcatgatttacacgttttgctttagtggaaagtttttaagatacttgtcatgttaggcatgaattacctgtcatagttacattatgttctccacaaataatccttcttttctgtaaactgtacaaaacaaaacaatattacaaaaacaatagcctaaacgtttttagatacttttttcctacaaaaagctgtaagaacatgctactaagtttatattacatatattacatagttccttttaaggagacaggaagaattaacatttaatattatttagcatgtgaaaattggaaaggaatcaatcaataagcctatgtatgcaacaatttttgtttcaccctctaaacattcttaaactatatcagatgccattgtctataaaaaatgaatttatcaatttaatgaggatttaggcagattagttgcttaatgagaactccagctaatgtgacagaggttttgtttcagtgctgacaaaatcagtgtgataaaactgtgattaaactgatgagagtacatttctttttaaaatcattatttcacataattaatgttaaacagcaatatataatcatttaaaaatattgtttataccttttatattttaatgtttttatatttagacataatagtttcaatattttacaatcctgagccttctcctcttacctttatctattgtgtattattttgttttgttttttagagatagtgtctttctctgctgcccaggctagaggggagtggtgcaagccttgctcactgaagcctcgaactctggggctcaagtgatactcccacctcagactcctaagtagccagaactacaggcccatgccactatgcttggctaatttttttctttattttttgtaaagatggggtctcactatgttgcctaggctggtccctaattcctggactcaagtggttctcccactttggcctcccaaagcactgggattacaggcacaagccatggcagtcaacctactattctgtttaattgtttcactcatttttcttgattttctctccttctttgttctctttctatatttacacaaatacataatatcaccatttaaataaatgcaaattacaattcacgcaagaacagtaattcccaatatattggctaaaagaaaactctattatcaaaagctttctccttagctgggtaatgctttggttcatagattagagaactatctaccttaaaacaaagactttttaaaattgaagatagaaaacatctgtaaacattctacattttcctatgttgtttcctaaataacctaaaaggtcaataagaaagagatattttgtactataaaatactttcgttcttaagacaagggtgctgtggcccatacatttgctagtattcctcttactgactctcagaggtggtgtagttaagaacagaacttcgacatgactaatgggggtcagcagatattacgtgtctcctcatatgttccaatatgaggcatacatcatcaactatagttcacctaaaaatatttaccttaatataaccaagcctttacatttaacttccagcttaaaggattacaaagtatcttttacaatataaataactactataagcaagtaaatagataagtgcagaggtaggacactctacagaacaaatgcactggtctcctcaacaagccagtgttatgagtaaagaattgctctgaaatgaaaaaaagacttaacagacagaacaaccagatacaatgaggattcccagattaaattccactttgggcaaaaaagttacaagggatatttttggagaaagaggacacatttaaatattgattaggtatgagataatattaaggactattattaataatttcattagataatattgttactttggtctttgtaggaaaacatattgttttaaagacatagaaaagtatttaggaatggactgttgggtaccaatttattttaaaacccttcagcatttcacttgtggtagtgactgaatttcaattgcggtcgattttggggcacaaaggtggcttctggtgctggtaacattctgtttcctattctagttgctggttttatcattctgtccactctgcaaaaagttagtgtgttgtacaattatgtgcagttttcagtatatgatgtatttccatgaacagtataaaacaaactaatcagcgttaaaaaatgtttacatgaattaattttaaaatgcaacagctctggattaaattgtttggttttcaattttggctctaagcctaatcaagaacacaatcccatttataatagacacacacacacataaacaaatgaggtgaaaggtctccacaaagagaacaacataacattgtgaaaagaaatcagagatcacacaaacaaatggaacaacattccgttctcatgaattggaggaattaatatcattaaaatggccatactacccaaagcaatttacacattcaacactatttctctcaaactaccaatgtcatttttcacagaattagaaataactattctaaaatcatatggaagcaaaaaagaggctgaatagccaaaacaatcctaagcaaaaagaacaaagctggaggtttcacattacctgacttcaaactatactataagactacaataaccaaaacagcatgatactggtacaaaaacagacacatagaccaatggaacagaatagacaattcagaaataaagctgcacacctacaacaaaagttttaaaaagttgacaaagataagcaatggcgaaaggactgcctatttaataaatagtgccggtataactgggtatccatacacaaaaaatgaaactggaccactgcctttcaaaatatacaaaaattaactcaagatagatgaaagatttcaaggtaagacctcaagctataaaaatcctaaaagaaaacctaggaagtaccattctggacattggccttggcaaagaacttacaaccaagtcctcaaaagcaattgcaacagcaatgtcaacaaaaaatgacaattgagatctaattaaaataaagagcttctgcacaccaaaagaaactatcaaccaagtaaacagacaacccatggaatgggagaaaatatttgcgaactatgcatctgacaaaggcctaatatccagaatctataggaaacttcattcaacaagcaaaacccaaagaaccccattaaaaagtgaacaaaggaccgggcacagtggcttacacctgtaatcccagcactttgggaggctaaggcaggtggatcacttgaggtcagcagttgctcaggaccagcctgaacaacatggtgagaccaccatctctactaaaaatacaaaaattagccaggcatggtggtgcacgcccgtagtcccagctatttgggaggctgaggcatgaaaattgcttgaacccaggagggggaggttgcagtgagccaagatcacaccactgcactgcagcctgggtgacagagcgagactctgtctcaaaaaaaaaagcgaacaaaagacattgaacagaagcttctcaaatgtgtccaatgtgcaaccaacaaatatattaaaaagtgctcaacatcactaatcatcagagaaattcaattcaaaaccacaatgagataccatctcacactagtcagaatggctattattaaaaaggcaaacaaataacaggtgctggtgaggctgcagacaaaagagaacttttatacactgttggtggaaatgtaaattcgttcagccactgtggaaagcagtttggagatttctcaaagaactgaaaacagaactaccatttgacccagcaatcccattgctggatatatactctaaagaaaataaatcattctaccaaaaagacacatgcactggtatgtttattgcagtactattcacaatagcaaagacaaggaatcaacctagatgcccagcaacagtggggttgataaaggaaatatggtacatatagatcatggaaaactgcacagccataacaaagaataaaatcatgtcctttgcagcaacgtgcatgcagctggaagccatcatcctgagtgaattaatgcaggaacagaaaaccaaataccacatgttctcattcataaatgggagttaaacactgggtacatatggacatacagatgggaacaagagagattagagactactaaaggggggagatggggaggggtaaaaggggtgaaaaactatctactggccaggcgcacacctgtaatccaatcccaacactttgggaggctgaggcagaatgattgcttgagcccaggctcagtgagccaagatcatgtcactgcactctagccggattacagagtgaggccctgtctcaaaaaaaaaaaaaaaacaaaaaactacctattgggtattatgctcactacctaggtgacaggatcattcctaccccaaacctcagtgttattcaatattcccatgtaacaaacctgcacatgtagcctctgaatctaaaagttaagggttttaaaaacctttaactttttttttttgttagacagagtctcattcttgtcacccaggctggagtgcagtggcatgatctcagttcactgcaacctctgcctcctgggttcaagcaattctcctgcttcaggctcccgagtagctgggactatgggcacgcaccaccatgcccggctaatttttgtatttttagtaaagatggggtttcatcatgttgttcaggatggtctcaatctcttgacgtcgtgatccgcccgctgcggcctcccaaagtgctgggattacaggcataagccacagtgcccagcagtttgtttaaattgaggctgtaccatgaactgggtaagttattaacagccctgcacctcaatttcttcatctgaaaaatgttagccataaaaaattttttaccccaatttctaaactaggctattctaaggtattttcttctttcacttgccattttttgtgtgtttatattactttccttattcagtccaaaatagatttccaatgccctatctctaaaagttggaaacattctgaaataaatctaaacaagagttttcaattgaaattaataccagtagtcttataaagtcgaaaggagattcacagtatcaacatagtcttaagcgcatcttaaacaatatatctgctctgaatagttacctggaagtggcagtgattgtatggcctcactagaatccaacgtaacatataccagaatattatacattaattgacctgaacactactcagtgtgctaagtgatctggagaacagtaactgagatacatatacatctagaagttcacaaagggaagtagaaaaggtgttgccgagaagactattcaagattactttgtcagtactgaaactgtatattttatcagaaataaaattctaggaatatcttttagagtatcagttcgttaaacatcagtaaaggaataaaaacatttatgtactcacaaatatcgtattaatatttgaaagttttttaatgtttagtattttattttttaatttttatgtatttatgtcatttgaagtatactgaatagcttttaaattaaatcatagctaacttactttccgttatatgtcttgctacttaataaagaatatcacaaaatacctaggttttacggacattttaataatataaactgaccattatttttgcattctcgaaaacagaccataatactcttaggtagtatgctgaacatttgggatgggtttttatgggtgttgttgttgttgttgggagacggagtctcactctgtcacccaggctgaagtgcagtggcgcgatctcggctcactgcagcctcctaggttcaagcgattcaagtagctggctacagatgtgcgtcaccacacccggctaatttttgtatttttagcagagacggggtttcaccatgttggccaggctggtcttgaactcctgacctcatgtgatccgcctgcctcagcctctcaaagtgctgggtatacaggcatgagccaccagcgcccagccaacattttgaaaaacaataaaaatgaagattttaaggcatgctattgttttacaaaatagcctggcttaattttgtagttgtaaagtaactcaacaaaaagcaattgtaagaatgtttataatacattccttaataacaatagcaacttatactttcttaaaagtgtttttcctttataactttcaaaatgttactattacacaactcagtgatatacatgtgtcatataagttggtgcaattatctagcagaaatacagccacagaagctaagaagggccctgtgtcagcaaaatcaactttaaagaacatcttgcttagaaactagagagcataaactcaaaatttaaagctatttttgttgctgtaaatttttaaccatatagatgcaccattaaacagcaaaacttttctgattttcaggatgaattttataatgctaatatagagcagcggaaatcataaccattactgtcctcaaaaaatggtggctttatcagttctaggaaaatttacatatgagtaacagaaaacctaactaaaaaatgttgtaggcagcttagattcctttcttctcaaataacaaaggtaaacgaaagttagccagttactggatttagtcagttcaatggctcaaatagtataaaggctcggggttctattattttcttggcttgttccacgtattatgtttaagttccagggaggaagaagggaaaggagaaggataaagaccaaagagcatgactgagctgagtcagctccacctataaaaaggtttcccagaactccaacccagcttctacttatctcttgctggcaaaaaatatacctaatgatcagtcctagcttcaaggaaagctggaaaaactgggacaggagaaggaggttaagctggaacattggttcctttcaaaattcacagtcctatcagttttcttaaaatatatttctgaaactactgccatccaaactacttcatatataacagttcttaagaacatgccaaatatagacatttctcctctttgaaaaaacacctaaggaaggaaaatattaaaaaatagaataaatgattttttaaaaggtatcaatttcagaagtttaaatacatttttatagtgtctagtaccgttttatgctattttaatgattcaactatatactatctacagaagactcactttataattcatttatttttagagacagggtcttgctctgtcattcaggctggagtgcagtggatgcttccttgaacctcatagctcgctgcagccttgaactcctgggctcaagtgatcatcctgcctcaggcagcaataggtgcacactatcacacctggctaatttaaaaaaaatttttttttgtagaggcagtgtctcggtatgttgcccaacctggtcttgagctggtctcaagcaatccacctgcctcgggagactccatttagatttaaagacagaaataccttgaaagtaaataaatggaaaaatacttacaatatttactgcatatattgcatactaatatgtaaaattaagcaataaagcatatgttatgtctgaatcatgcattgcattttagaatagtattttaaaatttatagtacttattaaccagctttttacttttgaaatcaatctcaaacaaaaatgggttcattgcctcacaagtgtctctaaaccttgctcctcccctatcctctggtttcctgcaggcaggcagtataaccaatgggtaagagcatgaattctggaattggactacctgggttcaaaactagctctagcaatgctgggcaaactaattaatttctcttagctcattcagctataaaacagaaataataattgtaagaattaaatgagttaatgtatataaaacttacagcatatcacacattaaaagtgtcatttcttgttattgttatgaccttttccttcatttgtgatacatgtattaagcacttaccatataccagacattgtgctaaatattagaaatttgggtatttgggttatgaccaaatcagacataaactctgtcttgcacatatcaaaaatattaaacatgattttaccacctttttattactataaaaagtgaatactgaatttgttttctgcagctaacgagaagaaatcaataaaggaaagttaatataaacacaaagcaatgaaaatatttataaggcattgatgatgctagccagttcctgcttcctgtaacacctagctatgaatgttcttaaaagacaaatccagaatcgaaaaacaaactcaatgatttaaaatcacccaatcttcagaatttctattccatataattatgaatctgataatgacacatccataatcatacaaaaaaattttaaggtttcatagcaaacttcaagaaaattttagatagtctggtggtactaaaaaattagaccaaaataattttataatgaggcttaacattaaaatacaaaaatgcaaataaattgccatctttattaccaaaaacataagtgtcccaaaattcaccagtcccccacaaaaaactagaacacatatttattaactcaaggggctttgctaattatgtaaatgtctatcttttctacatgtaatttcattcaaacttcctctctttcccccaattaacgatcctgccaaatgttgggacttgaaaaggccacagctttatacacaattaacagtcaaattctaacacaaattacatgtcattcttatctctgtatacacattgaactcctatatcttgttgccaagagggagcttgcactagggaatacatcctgaatttgtttaatgtccaggaataacatttcacacttagaaaggagatactatccactgccagctatgtgaactgaaatttgccatgtcctatccttttcattttgttcaaataggtagtttagaaaatgagtaactatccacttatctgttttaaccaaatattttcttgacgcagaagaggcaatcatgatctttggttttctttagacactttttaggatgattacagaaacttttatgaatggtaaacttattttctgaatagaaattggggaactatcatttgacacataatctcactaccagaaaaaatatttgcaattggatcaatcccagaaaattagatttacatatatggtcattatatttatgattgcttcccgagaaaaggtttcaacagcagcaacactagaaataaccaatttcttattcagtaagtatatgagacaatcatcacatcaaaatagtcagacatgtcccaatcttttgaagtatagcattttattaccaaagtacctcaacaaataccagtcatttacatactaaaagggcaactaaaatatattttatatatattaatatgtacatgttatgacctaaagttatgaaagcttgtaaaacacagcacttttagaatacaaacatccccaaattaaacttttaaagaaacaaatctgattgggtttagttactagcttactgctcttcagtagtctccactgtccttagaatagtatcaactggcatttgtctacctgtccagctttgcctcctacaatctgcttactaaaccctcagctccaaacataattcttcctttctttttttttttttctttcaagacagagtctcaatctgttgcccagactggagtgcagtggtacgatctcggctcactgcaacctcctcctcctgggttccagtgattctcatgcctcagtctcctgagtagctgagattacaggtgcatgccaccatgcccagctaatttttgtatttttagtagtgacggagttttgccatgttggccaggctggtctcaaacccctgacctccagtgatacacccaccttggcctcccataccataattctttctattcctccatctcaacaaactatctctttaaactgacatttaccctaagcctggaatacaataaccgctcatctttcagttcacacttcaaatgtcgtttcctcaatgaagccttcctttaattcccttctcctatccctgacccccaaatagattcagtgcccagatatacatttccatgctactccacacttccttgccacagcaatttctacagtatattgaagcttgttgttcaccccctgttggcatgtaagctctgtaacattaagaaaaaccatgtttgtcttgctcactattgaattcccaaggtctaaacatatgggcctgaccctcacaccctcatttgatttctaaaattgggcttacatatatcaaattaaggcagggctcatatgcattgcaacattcagttaaaatactctcttccatcgttataaattccttcatatgaatataaaatgttctgataaccaaaacaaacaagaaaaagtgaaaaaattgcaatttgtttctacactgccttcagtttcatgtggtgaatctggagtcagaaccctagatttgacttcagattgtatcgcctgttacctatatgatgatgtgaagtgcttaacatcacaaagcctcatattcctcttctgtaaaatagaaaatattaatgcttgtcccacaaaccttaaagagctgggatctattaataaaattatgctcatgaaagcctttaaaaacgatgaagcatttcataataaaatgaattaacatctttgttattaataccataatcaaggtaatctcagttaaaaataatgcatacaaattatttcagaaaaactttggcatatatatgagctagaatgtactagttaaaataaatacaaaagtttaacctcaaaagaagattacaaatcaattgtaaaatacattccaatattctaagatattgttgctacaatctcagaaaattttactcctgaaatttcatatccttcgtgatatctgaaacctatcagttaaattcattattaattcttttattttacttattgcactttagaatcccatccagggaatctgttattattctgagaccacaatcataattctttttaaaataaaaatgtgaacattaagcttaaaaaaaataattcgcaacttaactctgtggtaaacaggtgaacaaaacaacaattatataatatctaaaaccattttatgctttaaaaataggtttatatgtactgaatactggctaagataggaaatatttgatttcaaatttgttaagaatttaaagacataaaaagttagattagaagttatcttaaaacaacaataaggtagtcattaaaaacatgatcaaacaagaaaacaatttcttttaactcatgctaggaaagttattcaatattctattacttattagagtaaaaataatcttggtctttgatttttgagtgttaaaaaaccaaacttttccaaaattcaacttctgatgcaacagctaattcagaaaagaaaaagtttttttttttctttttcctatccatttgggctacatgattctaaaattacaggtatagtcacaaagagcatatgcttcccccaaagctctgaaggcatgtaagaaactactgtagttaaagcttgaacaagcaagtcttttttaatccacatttttcatatagaagaaagatttgtgtattttgcaaaagtaatgctattgcgatattacgactttgaactaaagctctaaaatcatactattcaactaaaggtttctttagcaatattaacatggccacgctgcacatgttacttttagcttctttgtgtacaacaaactgcattcaattggtgaacaaatacaatgtttagtatcatatttaaaaccactattcaaaccttttcttaatgctgttatcagttttccttttgcaacaattttgtgtataaaaataaaagcactggatttttattagcgctgccccttctttgttttgctccactctgcaaagcccttttgggacactaagcctgcatttaccataatacggattaaactttctttgtcccattgcacaaggtttgttagcaggttagtctttttacacttttcacaggctgcctgcagcttaccctttaggcctcactcaaaatacttctgtggatttacaaaaataccagagtggtcttggggttaattggaagataagtgcagtctttaacatagagactcattaaacatttagccttaccacaatccactatccttgaaagagaaaagttctagagacactttaggaataataacacagtaaaattgttttaaaaaatgacgattagttgtttcacagacttggaaaaacttcatttaactaccccaaaggtgatatagtagaacaaagcaatgtccctggtcagctctctacattggttttaatatgcattgatcatagaggaaaattgaacagattttctaaggaactaaaaggcaaaatcttccaaccttctgttgggaaatttaaagtaaaaactcaactgatgggttatgacagataatatttatttgtaaacaaaacatatttaattctaacagtttaactttgttgatttaaattttacccaagtaaatcacatcaaacatgtctattagagccaaatgaaaaatttataaaattcacccaaaaaacttagaaagtatttaaaaatttaagttccttctttaatttctaaaatacatacatatacacaaatatacacacttaaaatgaaatctgaaacctactcattggtattaggttattttttagaattatgcaagcagattgttaaacagattaacttttccatccccttacctccttccaacactattactcccacacaaaaaggaaaaaagaaaaagaaaaatgcgacaaaacacacagacacttgaagtaaaggattagacatatttgcccaagatgcagataacaaaagcaaaagtgaagaaaattgaagagacagccaaacttcagcaacaaaatggttaaagaatctgaagtattgttcccgttattcttaaagtctgctatattgtagacagcgcaaacatcagacaagttaagattactgaccattatctccttaattttctccgctttccctcacattccctcttgctatctgggcaccatttttctaaagctttatttctggtaagaagtaaactttccctaatccatctattatggaacctttaattggattgggagcagggtggtgtataaaatagcccctattcactcaaaaggactgtagttttagagacttaaaggagaaaggtattgtgaaacaaaatcctcagggaatcaaggattaaaatgtggctctcctaaattcatcaactccaggacacaaatgaattgcttccttaaacaggtaactttccaaatacatggcatagcaaaactgaaattaaaattataattttactttaaggaaaataatgcatttacactaataatttttcgctttataaatgacttttacttgctgtttcttcaactcagaattacaatgccagggaacaaatggaatgccttaaacatatttatttatattttctctacatacatattttccctgtaaagtaaggagaaaagcaaaagaatatgctttaatcaattaagtcctgtacgttatatttgtgcagccttaaagcagcaagcactgccataatacaaacatttttttcaaagtaaaaatacatttcgttcttatcagatagtgtcagatacataataatcagcagtcactcttcttccctcaatcagttatcctctctgttttcttcataaacatccccaaaccactctttgttaggctgtagtacttttgtcttctgtcccgccacagtgcacacccaactatttgggatgtcttcaacagtaagatgaggatacagctcatactcagttattctcttactgaattaaatatatttaaagtgccaaacctgctatctaaagtaaaatgaaatccagaatgtatctaccaactctaaattaatctcgcaaatgtctacatactctaccaaaacaataggaaactgaggaagagaaatgttaggagagttcaagattctaatgtaacacttaactctgcatagtttactagtctatattaaaatataaaaatacatcaatattagttatttacctaatggtgctgttaaaaacagatttaaaaaaaaatttaagaaatgcaattaattttaagaaaaccctcaaagtatcccctctgttttggaacctgtatcacaactcaataagtgctacttattattgattgaacccttactaattgtctgacattgtgctaactgctattacatgaattatctcattttattctctcaacaattgtatgaggtagttgctattacctgtttttccacaaatgaggaagctaagtttttaaaatttcaattaaattgtccaaggttacatagctgcaaagaaaataagctctgtgaaagcttttcattactatattataaatgtttagtataagaaagcaggctcatttgccaaagtcaatctgccaaaaaataaatgtgcctaaattatcaaaatcacctatgttccaaccgtaaatatttaaagaatattcttcttgaatgtattaaatctataactatattcttctaatgaatatattctaagatatatttaatactttttaagcaacattttaagaaccactgtttttcaaaactaaagtcatcatagggtagctctgtcctattaccaatataactaaaattttaatgtttcatatgacattttttagttcgtactgatttctatttgtatattttttctatttttctaacattctgtcatgtagaataattgttgctttattttattttattttattttatttttttatttttttttagatggagtctcgctctgttgcctatgctgcagtgcagtggcactatctcggctcactgcaagctccgcctcccgggttcacaccattctcctgcctcagcctcccgagtagctgggactacaggtgcccgtcaccacgcccggctaattttttgtatttttagtagagacagggtttcaccgtgttagccaggatggtctcgaactcctgacctcatgatctgcccgcctcggcctcccaaaatgctgggattacaggcatgagccactgcacccagcctcatttgtcacttttacctatttataaagtattatatcagttgagaattattttaatacttttcaaagtgtatgaagtcttatttgaacagttttcatcttgttttcataacaaccttggagggaacctccatttgtctgtcccaaatcactacagttgaagctgaagaaagcttttttagaggaaagatggaaaagaaagcaaatattccagggagagattctgattcctgaaagtattaggaatgagtatcagggttgagtactaaatggcactatcagagaaagaagatgagggaactacgaatcctggccataggtttcatagtctcttaggccacacctcttaggctcttttaacccatacaacacatagtgtgtaaataaaaaaatacaaactagtttagggtaattttaatatagcagagaattcattttctgtaaatttagctcattagttttagcaaattcctagcacaatggcatgcatatttagtagggcattaaaaatatgtgtggaatggatatattaaaattttatgtaaagtaaaactttaaacactgtattttgatttcaaaaataatctttaattggtcagttaaagtattttaaataaatatatttttaaagataacatgaacatgcatgctccactttaggggtagctaaaacaacaccccaaaacaacctcatactaaaggattattgaattttacatttaaaaaagagcaactatagggaaagaaccaaaaatggatctaggaaaattacaaaatacagcaagtatcttaaaaatgatttaattattaaagcatatttagaatacaaatgagtatttactattttgagagcccattaaaattaagatacccaactattctttttctctgatgccattttactaatagctaagtgtgtatataaatatctcagtcactggtatgtaaatgtcataataaagtgtaatgtatttcatcacattctatctgcacttatgcttccttatgacttcagctaagtttctacacacagtggtttagttttaaatggttgtccccaaaatatgatgagttagaaattatcttgcatttgtgtgctcattcataataaatcactgtttttaggcctcaaataacatcaggtctctatttgctgcttagtaagaggcaactaacatttcacggaaaatagttctttaactaaaagattatatcagggcttcctcatataagattactcaaattttgtataacattggatctctgttgtgttataaaatatttggtacaaaacaaactgctatggtttgaccatatcccccaaagttcatgtgttggaaactgaatccccattttaacagtgttgagaggtggggcctttgggagtgactgggttatgagggctctgccttcataaatggattaatgtgattattgctagggagtgttaattatcacaagagtgagttcctcataaaagaatggagcttagacccctcttgctctctctgtctcacatgctcacttggtcttctgccctgggatgactctcaccaggtactggcaccatgctcttagatttcctgcctccaaaagcatgagccaaataaattctattctttataaattactagtctctggtattctgtaatagcagcagagaatggattaaaaaactaatgaaatgaatatgtaaattagcatataaatatatcaacttgtgtatggataaacatattcaacgacagctacataaaaaagactaaaaagcaggagtggtggctcacacctgtaatcttagcattttgggaggctgaggtaggtagatcacttgagcccaagagtctgagaccagcctgggcaacatagtgaaatcctgtctctacaaaaaacacaaaaattagccaggagtggtggaacatgcctgtagtcccagctactcaggggaggatcactaaaaccagagaggtcaaggctgcagtaagccatgatcatgtcactgcactccagcctgggtgacagagcaagaccctgtctcaaaaaataaaaaaaaaagcaaaaagcttaggaatacaccctgattgaaatatatgatactcataagttatacatgagagagccattttaaaccactaatgaaaatgactgttaagtcccatagaaaagtctattaaaatatatgtatgtgtatatatattttttacacacacacggatatacatataatttcttacatcatacttaccctttagaatagcagtcctcaatcattttggcaccagaaactgatttcgtggaagacaatttttccacagaccaaagtggggtggggggtaggaggtatgattttaggatgaaactcttccgactcagatcgtctgacattagagtctcataaggagcacgcaacctagttccctcatatgcacagtacacaataaggttcgcacccctatgaaaatctaatgccacagctgatctgacaggaggcagagctcaggtggtaatactccctcacctggcactcctctcctgctatgtggcccagttcctgacagggaaactgggtagggaacccctgccttagaagacagaatacaaaaatacagtttatgccaagatccaaaaaatagtcaagtcagaaagttaagaatattatacttttcataccaataaccatatcctgtacaattctcctgtacaggagtgtatcttgtacaatttctcaaaagaagacatttatgcagccaaaagacacatgaaaaaatgctcaccatcactggccatcagggaaatgcaaatcaaaaccacaatgagataccatctcacaccagttagaatggcaatcattaaaaagtcaggaaacaacaggtgttggagaggatgtggagaaacaggaacacttttacactgttggtgggagtgtgaactagttcaaccactgtggaagacagggtggtgattcctcaaggatctagaactagaaataccatttgacccagccatcccattactgggtatataaccaaaggattataaatcatgctgatataaagacacatgcacacgtatgtttactgcggcactactcacaatagtaaagacttggaaccaacccaaatgtccatcaatgatagactggattaaaaaaatgtggcagctgggcatggtggctcaagcctgtaatcccagcactttgggaggctgaggcgggcagatcacgaggtcaggagatcgagaccatcctggatagcacggtgaaaccccgtctctactaaaaatacaaaaaaatagcctggcatggtggcaggcgcctgtagtctcagctacttgggaggctgaggcaggagaatggcatgaacccgggaaacggagcttgcagtgagccgagatcatgccactgcactccagcctgggcgacagagcgaggctctgtctcaaaaaaaaaaagaaaaaaagaaaaaaaagaaaatgtggcacatatacactatggaatattatgcagtcataaaaaaggatgagttcatgtcatttgtagggacatggatgaagctggaaaccatcattctcagcaaactatcgcaaggacagaaaaccaaacactgcatgttctcactcataggtgggaattgaacaatgagaacacttggacacagggaggggaacatcacacaccagggcctgtcgtggggtggggggaagggagagggatagcattaggagatatacctaatgtaaatgacgagttactgggtgcagcacaccaacatggcacatgtgtacatatgtaacaaacctgcatgttgtgcacatgtaccctagaacttaaagtacaaaaagaaaaaaaaaataacactccctcacctggcactcctctcctgctgtgcagcccagttcctaacagggaaactgggttgggaacccttgccttagaagacagaatacaaaaatacaatttatgccaagatccaaaaaattgtcaagtcagaaagttaagaatatcatacttttcataccaataaccatatcctgtacaattacacacagacagatggggggtagaaggagtcaaatcccacttctgacaccagattgtgtcaacctaaaaatagacactagagaaatttgtctccaaatatgttgagtttgtttgggaatgacaaatgaggattatgacatagaatggcaagccaccggtgcatctggtgagagaagggtaaagggaagcttttattagcccaaagagattcaagtaaactacttagaaacagagttcactggttccagaggcttaaagtcagagttatcatcagttcattggtgaagctgctattactggtcaagggttcatttaagagcatcttctctgaattgctatagttctaaaggatgtctagtgataaaccttgccaaaactagtgagaaaccttgctaaagcaggagatacatgcaggacatgaaggagtttcttgtgggatttctagaaagtccttggaaatcattcttatctcagatatataagcaagagcctcctctcctttctgccttcctgtaccaattttgccagggtctgacaaaattgatttcatccccatatctgtaactttcacaggggaaagaggggtaagatagttaaattaaacagagtccctcaaaaatcacccttcctttcttccccttaatttcaaagagccaatttactttacatgttggatactgcgctggagcaagaaggtaaaaccaggaagtaggatcagagagacaagagttactaagccaggacagaaatcagaaaccaaaatgtaataatctgctagagaattaggccataaggaatatctgttattttgcttattatctgtaagaagaaataaaattatagcacagtgatgaaagcacagtgaagagaaaccctaaaatgtttttagtaaaagaatgataaatgaaaattgacaataaagaatcaatcacaactaaagtatagaaagatgctaatatttctttattttacaagcttcatcaatatatattagtaaatataataataatcaaaagggcttttatagactcctttctgacctcatttctgcttactttttccaaaataatcttaaattcttcaacaaaacattctattaccaaggaggcttttcaggaatgttatctttagtataaggtattactaatccttcttaatgatgttctatgccacttataaaaaactcattaggatggcaaacaaaacagccttttgttacattaaactcagtgtttaaggaaaatagttacatattcattcattcaaaaaataagtattttttggaaagcctagagatacagaaatcaacaacaaaaagctgggggaaggaaggatacgatagttgtaagggttagataactactataaatctgtttcaatatgtacctttagcagtaatatttatagaaaataagattcaaaggcccttaaaatatctagggttactctttaaacaaggggaggaaggaatctgaaaacaggtgactccaatatcaattctttccatcaactctaggtcttgtggtgaacacttcagttgtttaattgtataaagaaatgctatcacccacacacatataatactacaatgctactacctatcctcaaattgtatattctactatttacttaaaacacagtagaccttaagactattctgttcaacccataacaattcaaatctacaatcaagttttagtaaagacagcatacttgcagctaatctatattcataaacgacactactatgctagctcatcaagtataaagaattaaaaacaattatatcttacaatacaaacagaattggctgggtgcacgcctgtaatcccagcactttgggaggccaaggtgggcggatcacaaggtcaagagatcgagaccatcctggccaacatggtgaaacgccatctctactaaaaatacaaaaaaattagctgggcatggtggcgcacgcctgtagtctcagctacttgggaggctaaggcaggagaatcacttgaacccagcaggcagagcttgcagtgagccaagatcgcaccactgcactccagcctgggtaacagagtgagactctgtcttataaaaacacacacacacacacacacacacacacacaaacaaatagaatctaaaaatattctctttttttgagacagggtcttcctttgtcacccaggctggtgtgcagtggtgcaatcgcggctcactgcagccttaatctcctgggtccagccaatcctcccaagtcagtagcccaagtagctacacagcaggagcacaccactatgcctggttaattctgttcattttttatagagatgagatactgttatgttgtctgggatggtcactaattcttgggttcaagagatcctcatgcctcaatctcccaaagtgctgggactacaggtatgagccactgtgctcagcctagaatctaaaaatattctagcaaaatatataaaaaataaataaaataaaaattttatgggacctgaaaaatgaatatggagaagccaaataaacatgctctccaatagcttttaatacagttaacacttatttttatacatttgttctaaatattcaaaaaactaaatttaaaaactatctgatggatggtaatcaaaaacatttttgtttgaaaacaaatcatattttaaacagcaactatgtttgaagtttaatatattcaaacatttgattatatggttaatgtctaaagctctacgaggaaccaaatcagagctattcttacttattgctgtaatctcagcatcctacatagttggcatactggcagataatcaaaagtgtttgtgaaatgaataattatatacatagttacacagaatgtgaataccttattagcctatttacttatttattttagtgccataactccaatctctttacttaaaagctcattgattgcttctgcattaaatgtgaaccttctaacattacaattttccctatgaaataagcataatattacttataaattatacaaatactgtgaaaatgcagattgacatattatatagtttggattttgaaaagacatctttatgcatgcacaaatgcaatttgtcattaaatttacaaatgttgtggtgtataaattggatacttcttcctaaatgtcttgcaatgttttaatatcaatgtgacagcaaaatctgcaatcaaaacaaggcctacaaggaaaatgcaacctttttaaaaatatgtagctgaataacaagatgtcgcaaaaatagggctgccacaattaccaaagaaagataattaaaaggacgtttgttatgtgctgtgtttcacccggtacccacatcttggtttctaatagcattcttcactgaaaagaattaaggctctccaaagtaatagctgattctagagctgcagaagggaagctacaagatgagccttgagcctcttgccatgtcagaaagtcagaaagtgctcaagaaaatgaaggggtaagtaaaaaaaacataagaacaagcttgaaaggcttcccactggcccaatctggaagaatttgagcattaaagtaattatgaccaccagtgaattattaaccattgaaaataagaaaaattcatgagtccatagcaataatagatggataaatacatggggaatgcagaagtgtataaagttaaggcataatgtcaactgataaagatggaagaagacgcgatatgggaaaataatcattttataaccatcatcactgtagagattaatacagggaagaactgttaagcggactccatatttcattcagatttcatcagtttttctctcaagcttttttttttttttcttgtcccaagatcccatccaagacaccacattatatttagtcttgatgtctccttaggcttctctggattttaatggtttttaagacttttcgtggttttgatgacctttgacagctttaaagagtactgaccagggcatttgtagaattcccctcaatttggatttgtctgatgttctcatggttagaatggggttacaggttttaggaaggaagtccacagaggtatagtgccatccgcatcacatcatatcatatcatagctacatgctatcaacgtgttttgtcactgatattagccttaattacctggttgaagtagcatttctcaggggtttccactgtatagttattttagttatttcctgctgctctgttccatactgtaccctttgtttttttgtttgttttgagacagtctcactctgtcacccaggctggagtgtagtggcgcaatcttggctcactgcaacctccacctcccaggttcaagtgattctcatgtctcagcaccctgagtagctggaattacaggcacataccaccataaccagctaatttttgttatttttagtagagatgggtttttgccacattggccaggctggtctccaactcctaacctcaaatgatccacctgccttggcctcccaaagtgctagaattacagacatgagccacagcgcccggccccatattgcactctttggaagcaagccactaagcagagcccacacttagcaggtggggagtaatggtccatttcttttggggggagtatctacataaattatttagactccttctataagggagatttaactcttctctcccctactaatttatttagctatttatttcagtatggactcctatttacttcatactttaggttataaaccaaaactaagttatttattttgttgttcaaattattttgactttgactattgagagctctttcatttggctcttgtgtccctttgacctaatcccattattctattcttcggacacttatgtatgttctggcactataatatgctccaggctcatcttgtgtagtgttggcctcagcaacagattcaaccatttctctggggagtcctgggttccttttattggagcatggtattagaaactaagacctgggcattgagtattctcattgctactggagtgtcattacttctagacaccctggtgaacaaagctaataaatgtatgcatatataccaatccatgtatacacacctattctttatttttctatgtatccatttgtatttatattaagctaaatatgatttaagactctgactctaatctagtaccacatgatttattctagccttcagggaggcaattttgatgagaagcaggatattcgcatggtatcattaaaggctgcttaataattacaaaggaaaaaataatacatagactagcaatatcagacaacatactgactggctgatcaaaatatcaccattgaagggcaggtagacatcctgtgcctctgtaagtgaaactctcagacagacatatcacttacatagtataacaactagacgtataacctgaatccaatcataaggaaacatcgcacaaatccaaatgaagactattctgttaaaaaaaggagagaactacattcttcaaaattggcaatgtcaagaaagacaaagatagcctgaagaattgtttcagatttagtcagactaaagaaatatctaattctaaactagattatctactagaagttaaaaatattggcagggcatggtggctcatgcctgtaatcccagcacgttgggaggccaaggcgggtggatcatgaggtcaagagattgagaccatcctggccaacatggtgaaaccccgtctctactaaaaatacaaaaattagctgggtgtggtggtgcatgctggtagtcccagctactcaggaggttgaggcaggagaatcgcttgaacccgggaggtggaggttgcagtgagactccatctcaaaaaaatatatatacattatatataagataaatatatatatttatataaatatataaatatataaatatttataatatataatgtatatttatatattgtattattttataatatatatttatataatataatatataattataatatatatattatataatatattatattatatattatatattatataatattatagattatataatatataatataatatataatatatataacattatagattatatatattatattatattatatataattataatatgttatatataataatatataataatataaaatataatatatataataatatataattatatataatatataattatatataattatatataattatatataattatatataatatataaatataaatatatatatatctatataaatatatatataaatatatatatttatataaaataagggacattatttcgtccatcgatgaaactcaagtatggatggcaggttaaagtattatctcaaagcaaatttcataaatttgattactattatagttatataaataagataacattcttattcttaggaaatacacactgaagtattcagggggaaaggagtataatgtgtacaaatggctcagaaaaaaagtggtgtgtgtattatatacacttgtatgtatgtgtgggtgtatttactaataacatacattatgtatgtatagagagagacaatgtcagagagagcacgaatgataaatgaggctaaatattaatggcaggtaaatctgtttttaaaaaacatgtgatccttgtttcttatataataaatgtgataagcatgtgatgagactgagccaacattagtgaaatatgggctttaaaatgttttccagaagcagttattctatcctgtgatgtcctctgtgaccaaaaactaaatgaaggatgtctttggaagactctaaagctaactggacaatttggaaactgacctctaactatactttgattaataccactggcgaatcattcatagggtatatacaaatacaaatttggcctcttgtttaaagggtttctgtagttcaatcattatgaactcctaactgatacttagtagaacagcatataggtccatatttataattcaaatcattggcaattaaaagcgttactatcggccgggcacagtggctcatgcctgtaatctcagcactttgagaggccgaggcgggcagatcacctgaagttgggagttcaagaccaggctgaccaacatggagaaaccccgtctctactaaaaatacaaaattagtcgggcatggtggcacatgtctgtaatcccagccactcggcaggctgaggcaggagaatcacttgaacccagaagtggaggttgcggtgagccaagatcacaccattgcactccagcctgggcaacaagagcgaaactccatctcaaaaaaaagaaaaaggttactatcagtaaatgctagctgaaactacagtaacaatttataaacagtaattctctactaaaatttaccaaaacataattctttctgagaacattattgtcacaagttttattacatgcttatattataaacctaccaataatatatttattaatatgataaatactaatttaaatctgttcttaatatgacaaaactgtgttattctaaaatccatgaagatgagctattccaaatgagaactttttctaaataactgaagggctagtaacactgtattccttctaaaccacaaaggtatagtgtggtatgcagaatgatgctccctcccaaagatgtccacattctattccctggaattcatgaatatgttattaataccataaaaggcaaagaggaattacagttgcaaatggaataaggttgctaatcagctaacattataacagagagattaacctggattatctgggtgagtccagtgtaattacaagagtaccttaaagtacaagagggtggcagattaagtcagagtgatgcaatataagcactcaatctgtccttactgactttgctgaattaaggaaggaagccacaagccaaggaccatggaaaacatctagaagttggaaaaggtaaggaaacgaattctcccctagacgctctagaagagaatgcagtcctgccaacaccttgattttacttctgtgaggcctgcataaagccattacttttgtggaaatttgttatagcagcaacagaaaattaatatatattctattttcttttctcttacaaaaagtgtaataaatataatttgatcttaaaacttcctgtagcaaatcattgcaggaatcaattcctgtactaaacaacaccctaccaatccctacctccaagcatatatagattcccacatctatgctttagaatataatatagttttcatgtaatcttttgataacagagatgttctatctattatctattactacccttcatctactgtgaatggctgtgctctctctaccctcagcaccactgactaccctagatgtccactattctctttcccccttagcctctccttcaattattttatatttgctcacacagtatctcctgagcttcttggctctagcagaagactgtccttaaatacatgaggctattcaatgccttttacccttgtctacaaatctaccaatcaacatataatattctgtgcacctcagctctttccattgttgctgagtattcaccggttgctttccagggatatttctccctctatttgcaataagcattaaatttttctttagaaggatatacatacatacatatatattcagcctatctgcaaaatgtaatgggacagcagcaggaataatgatagcgtagttacaagtatactctcattgctatgggcaactatgataatggcaatgtaagtacatattcattttctctatacataggcatcctcccacaccctgctatgtatgtatgttctcagtaaatgtttagaggacagaggagaaagtaaggtcttaacctcctggtatgcaaattataggaagaagagagaactaagcaaacaaacttaagttacataaagtaacagaagaaataatacatatttaatccataatatattttctaaaaatttatctgcattcaagacattaaaggccttcaaatatttaaatagtagaaacattacactgagagttattagacgacaaaattatgtcttactcattttcatttctctcatgcccacaattaagtttgctttgaaataattttttttttaataggggtcttgctctgttgaccaggctggaatgcagtgggatgatcatagctcactgcagccttgaactcctgggctccagcaatcctcttatctcagcctctcaagtagctgggactacaggcacacactaccacacccagctaatttttaaaatattttgtagaaatggagtcttactgcattacccagactgggttactcagggctcaagtgattataccaactcagcctctaaaagtgctgggattacagaaataagccaccacacctggttgaaataattttttttaaccttatgacaaatttgtatatgagcctaggtacacagacccttgcaatctaacaataagacttactagtattagcatcacataatcacaaggctgaaatattatagtgttagactctctttaaaatctatgtttttacacaaatcaataaatgtaatctatcacataaaaagaaccaatgacaaaaactatatgattatctcaatagatgaagaaaaggccttcgataaaattcaaacatcccttcatgttaaaaactctcaataaactaggtattgatggaacatctcaaaataataaaagctattcatgacaaacccatagccaatatcatactgaatggacaaaagctggaagcattccctttgagtggccctctctcaccacttctattcgacatagtattcaaagttctggccagggcaatcaggcaagagaaagaaataaagcgtattcgaataggaagagagaaagtcaaattgtctctgtttgcagacgacatgattgtatatgtagaaaaccccatcatatcagcccaaaaactccttaagctgataaccaacttcagcaaagtctcaggatacgaaatcaatgtgcaaaaatcacaagaattcctatataccaataacagacaaacagagagccaaatcatgagagaactcccattcacaattgcaacaaagagaataaaatacctaggaagccaactcacaagggatgtgaagaacctcctcaaggagaagtacaaatcactgttcagtgaaataaaggaggacacaaacaaatggaagaacattccatgctcatggataggaagaatcaatatcgtgaaaatggtcatactgcccaaggtagtttatagattcaatgccatccccatcaagctaccaatgactttcttcacagagttagaaaaaaagtactttaaagttcatatggaaccaaaaaagagcccatatagccaagacaatcctaagcaaaaagaacaaagctggaggcatcatgctacctgacttcaaactatactaaaaggctaccgtaaccaaaacagcatggtactggtaccaaaacagatatataagaccaatggaacagaacagaggcctcagaaataacaccgcacatctacaaccatctcatctttgacaaacctgacaaaaacaagaaatggggaaaggattccctatttaataaatggtgctgggaaaactggctagccataagtagaaagctgaaactggatcccttccttatccctcatacaaaaattaattcaagatggattaaagatgtaaatgttagacctaaaaccataaaaaccctagaagaaaacctaggcaataccattcaggacacaggcatgggcaaggacttcatgactaaaacaccaaaagcaatgacaacaaagccaaaatagacaaatgggatctaattaaactaaagagcttctgcacagcaaaagaaactaccatcagagtgaacaggcaacctacagaatgggggaaaatgtttgcaatctacccatctaacaaagggctaatatccagaatctacaaagaacttaaacaaatttacgagaaaaaaacaaccccatcaaaaagtgggcaaaggatatgaacagacacttctcaaaagaagatatgtatgtggctaacaaacatatgaaaagaagttcatcactgatcactagagaaatgcaaatcaaaaccacaatgagatactatctcatgccagtcagaatggcgatcattaaaaagtcaggaaacaacagatgctggcgaagctatggagaaaaaaagaatgcttttacatcgttggtgggaatgtaaattagttcaaccactggggaagacagtgtggtgattcctcaaggatctagaactaggaatttgacccagcaatcccgttactggataaatcattctactataaagacacatgcacatgtatgtttattgtagctatgtacaatagcaaagacatggaaccaacccaaatgcccatcaatgacagactagatgaagaaatgtggtacatatacaccatggaatattatgcagccacaaaaaagaatgagttcatgtcttttgccaggacatggatgaaactggaagccatcatcctcagcaaacacaggaaccaacaccacatgttctcactaataagtgggaattgaactatgagaacacatggacacagggaagggaacaacacacaccggggcctgttgggccatggggggaaggggaggaagagtatgaggacaaatacctaatgcatgtggggcttaaaacctaggtgatgggttgatgggtgctgcaaaccaccatggcacatgtaaacccatgtaacaaacctgcacattctgcatatgtatcctagaactaaaaataaaataaaaaatgtaaaaaaaataaaatctatgttttatattgatcatacacaacattgtagaatagattttacatatataattagtatacattttaaatatagagatttaacataacaactctcctggcaatttcagctgacaatttccatggcaaagtacaagctgcacacaatggaatcctgacttacttctttaacacataaaacacttaataaaatgtggaaaagctataccacctaagagttattctaaaatattttatagtgtgaaatacatttatatgtatgtatgtttaaatttactgaataaagacaccaattaagaaaattaaacccctaaaagctaactactattcacatactttaatttagtttgcttattcatttcaagtctttcttcattaatataagtttaacatatgtaaaatcatagcatagaggccaagcccagtggctcacacctgtaatcccagcatctggggaagcgaagataagaggatcacttaaacccaggagttcaagaccagcctgggcaacacggcaagatcctgtctctacaaaaaaaaaaaaaatgtagtcaggcatggtggtacatgcctgtagttctagctacttgagaggctgaagcagaaagattgcttcaaccctggagttcaaggttactatagcttgctactgggctccagcctgagagacagagtaagatcatgtctctaaaaaaataaaaataaaagtttaaaaatcatagcatggaaataaccttgtgcttttatcttttgaaatactttaagtataactaattttattactacataaatctaccatttcaattctcctttaagaaatctacaaagaaaaactcacatgatactttcatgacctctgaagattaaattatatctggattgtatctgaatcaaggatataagataattcatgaatgaataaaataggatttaataaagtaaaatataaaataaagactgatttcaaaataacaacttgttttaggactgtagcagactttcttttaattatagatttccaattaaactatttaggaaaagctatactttaattttaatcttaaaagttaaaagaagatcaagtaactgatactaacttcacattaaaatgtatttcactaatacaaatagtaataatgaccatcacaaaaattttagctaaatattaattgacctttatctgtatactttgactgtatttagttatttaaatactcacaatcaaaatatacagatacaacttttaaaaatacacagaaagtacttcagcacttatgaaatagaatgccatcatcttccgtataaaagctgaaatcaaatcagaaattgaaattgatgtcagtttatttctgagagcttaatatatttggtaaactgcttcctctttgataacagtggtttcagttttgtataaagactcattataagccacaatatttcctaagtataaaatatgcagcattttattaacttcatttccatcttttatgaacagcatggatataactaccaatcactttaaaacaaaatttaagtttcaagtatttttcatgtgatttgctacaaattattttggaaatttcctgactatataacattgtttagactgcaatcattttattaaaacttacctaaaatgataataacaactgctacttggccctccatgtatttaaaaaataaaaaacgtgagccagagatttccagatctctatatattatctgatcatgtcgcaacatttcagagtaggataacaagatgctcttttgaaaattaatgggaaaaaggaaagctttggagcttcttgtgaaaacaagaaaaagtgtaaagaaaaaggtaggtgatataacggacactatttaagttgtgggaaggcaaaacttacttaagaaactgtcatggacaactgcagacagggcattaaaaaaaggacaatggcactgatgggataccagtaaaaatctgatggctttaaaataaactgccaacatcttcacaaattatgctttactgcttctgagctctagcaaggtttctatacagatagggataataatagaatataagtcattatagatttgttgagaggattatgacaattaaagtgcttagcatagtggttggcacagaataagagttcaataaagtggtgtgttattcttatcatctcatttcaattgagttttgcaagactttcacatctctagaaatgtcatactgtaaatttgaacttgctgatagaaatctgttggaaaaagaagggtatcaaatttatcactctataaggatttatttagcatgtactatttacctaggcatgtggtgctaccaagtaaataacttgatatctgccttccaataacttttcacattggtaggttaacaaagggagaggaatacatggataataagaggaaagaacaaaaacaacgatatattagagtgtttaagatcaacggtaactgaagcatcagttcaaagagagcacttgcccgggcactgtggctcacgcctgtaatcccagacctttggaaggctgaggcaggaggactgcttgagtccaggatttcaagaccagtctagtcaacatagtgagaccccgtctctacaataaataaataaacaataatattaaatttaaaaaacaaacaaaaaaaataaatcagagagagctctctgtgtggcatccaatgatagatgtaagaaagctagcctggaaagacaaagacttcagattgggggccaatgtgaaacaaagttgaataggtaggactttaaggattttaaagcactatggcatgatgacagtgttttattctattcctctaagtaaaaacctgccaagggaactagaataaagcatgtatttaatgaaatcatttaattattaaaccactgacaattttcccttcttttattccctccttctttctataaatatttattgaatctccactgtctagcaggcagcacgtaagtggtggtaataaggaaacattaagatgaggactatacctggtttgaagagaaaaactttagtgtaaataatcccaaagaaaactaaccaagattattttatcagcactgcacctgcacttcattttcttttaagtaggtagactgttttcttattacaacttaaagattttagagtttcaagattatatcaaattaacacatttattacattttagatatatattcatatcaaaagcattctaaaactccatcctcaaagctctactcacttaaactagtattctggaactgcacatgagcattcggttttaaaatgccttacaattttgtcagatgccagaaaacaacaatgaaaaattaaccctggttgaaaaaagggataacttataagtagatttggttcagaagactataaaactataactaacttttaccaggcaatccaagatttataaaagcatgtaaccttgagcaagagacccaaccttcccatgcctcagtttcttcatcagcaaaatggtgacaatacctacctcaagggcttgctgtaaaaatgtaagagttaatacaggtaaaacacttaaaacattgtttgccacacagtaaatgtttcatatgtgctattatcattgtagatgcatctttccaacatctgcttggagaaaaaaataccgtgacaaaagaaaatggctctaaagagccttcagatgtaacacaatagaaggacaaacaggtagtcgcagaattgtgttagattagtgacctaagtgtgtttaaggaacaagaggtaaagcagaggtcacaatgtgtgtttaactttaaataaatatatgaaacaaggaaaattatattctagattttaaaaatgtaaataactttctattgctttacattgtccaaacaaaagctgtgttaataataaagagtatacttctgaatctggagtcccatcaatgatttgttcagcttgcgtaagtcacaactgattggacacagtccctgtgggcttgccatttcatccagactggacggttcattagtcataactactataactgtacagcagagactgcagttttatctcatcgtacatctttgatcaagctgcctcaattctgcttcatcagcatatgaagttacattattggagctttttattttccagtcggtaattaacagagattatgctttttatcaaaacatgtatttggtcttcacatttaatagtgagggcccagatctgaccaccatttgacctctgaaatttctaccacctaaataccatgaatcataaactgaaatccagaataccacagagaaaattaaacaaagaaaagaactgacctgtgttaaaaagcataagatgattgcacttatctaaattgagactaaccatatttgctgcagcttctcattaaacattaaatcgcacaccagaagaaaacatcatacatatttattgttttgcactgtcactttcaaaagactcataccacaattagtgtttctctcaaactataagctacataaagaaatttcccatgaagcctgaagacaaagtaatgtaaaagatggttcaagaaggttaaagaacagatggataatagatttcactgaacactaaagcataatacacttacttcagaaaagaaaatgttgccaaaacttagttcaaatataaaatactgaatgaaattgatgtgtcgggaatttttttttccttccaagttcttttggagaacaatagggggctaaaaggcctgtctcactatttttgcatctcactattttcgtgtgtaaagtgtccccactgtaggctgcatgaacaatcataatcgacagttacatgcaggcactgaggctgcaaaaatcccagagtaattagtgttgtctgaatgcaatgacatctgtgttctcatggttctcgagacatgtcaggccaataagatgtatatgaaaaaatatgacaagcattgcaaatgcccttctgaaaggtcttacactttaggggaaagctgaagaaataacacatgtcatcttctctttgtaagcaatatatttaagattacaagatctagaaagatcttttgagtcattcattctctttttgtaactataaagcatttgttcagaatacatcactagggtatgaaaaaaatctgttgtaagttggcttctttttaaaactttctcagcacatgtgattctgtgcagtgcaatgtaggtgcccattcctgtaagtgacaaaacagagagcatatcttattaacattccttggtttcgttaccttttaattaaaaaatattacctcttagtactgaacataaaatagttcaaaatttgtggttaaatgccttagaattatgtttgtatttttctaataatacagagtgtcaaattgactgtattaaaaagtctttgttttaagacaactaatgcttttgcttactgatgcctattactgaggcctctccctctatatgctgtagcagtatgtttgagcatgcacttgctccaagaaagacattagtcatcattaacagaagcactgacaccaaatctaagtgcctctccacaatgaccaagtggcaatcatctttctcttacactgtcactgctgattaggattttctttcatgaaaatttaatttgtacccctttctgcagcttcttttttttttcattcctgaaaaagcaacgtgttcaggagagattacagataaagcaaagaagctctacctataatatagctaatgatatagagattgcaagattctcaggtaaatcttttctctaatccaacagaaaaacacagattaaatcaatgattaataaacagaagaaaaacaatgattttaaaaggaatattgctttattgctttaagaatccataagcctcaaaaggtaactaattcaaggaatccaaataaaacttccctaaatattaacataatcccaagcttctttaaaactaagataacactttgatagttgccatctttcactaggtttcaaatttgtattctccattttgtaaacaaaaagacaggggcattcacacagaaatatcactataaactgaagaaaatacttaagcattcatacctttagtatgcattaacctactggttagttgtttttttttttttttttttttttttgagaaattttcagttgcactggacaaatgaaagtgattcatttggccaagcagggtactctacagctagatgatactacagacaaactctggttctgtacaatatcacaatgttaaacaagatatcatagcaataagttatttaaggaagtttttaaaaacatttacttttctgttttatttcaatctgtttaaagtttttttttttaatgtaagcatgtgatagtttgcaagggtcctggtacgacccaaactcccacttctagttataaatattatcatctcttcgtattacttaggtattataacaaaatagagattggtttaaatttaaattatcttgaaattattttatatcccttttagaacatatgtacttttagtcaaaacatgtaacacttttgtgtttacatgagcataaattgtatctttttaaaatgtaaataaccacatgaaatgctctgaaagcaaaaatcaacattatttctttgtaaatcagaagcaagtacaattcatcaaactttagtcattaaacgatccttctactcctattttattctgaaaaataatacagaaagtcaaacagcaactgcttagtgccatttacaaatggtttgttttttctttttttctatttaaaattggtctgcaattagaacatgtaagaggagattaggaattaaaatggattctgagaggcaatttctaactactgaacttttataacaggagtatctttgattaaataaggagctagtctaaactaaaagcaaaactgtaccataataacccaacttaattatctttgcagaatacatttataaatgattggctcatttctacctttacttgactaagtaaatatgcctcttaaattctcaaacattgaaaattctgattctcacagttgcacagacttatctaaatcaaaacttcaaaaagttacaatataattactgactccattgctagatccagtacaagttcaagtaaggaagtttagctctgtaacttccactcctcaacctaaacctccaagtcacttgtcagttaaaggttgggcgatttattgaccgcctctggatgcatactgtcagtgctgaaggaaatatgagggagggttgttgctactgttctggagctcattgataatgacatacctgcctctgtcacccattacccatactacaaactacttagacctaactgaaaaatcaatagcctacttgcactggttcctgtggctgcctcctttgattgtcagctcctgtctagggtcagcacttacatgaaaggggctgtgactgcctgatgctttcaggacaacctaacgatatgaaactagccaacagaacagtaaattctgcctccctgccctcctcatcaattaggctttgactaggcttgcctgtagaaacctgaccttttaagtttaggtgaatatggactagctgaacacaccattgccctcagcactgagccaggaaatctactgacaggttaaacaaaacagaaggttgtaactgtcataatttgcattgcactttcacgccaacaagggtgttatcagtaggggcaagccctggaacacacaactccagcacccttaagccacgctactcataaattttcaagtgaagtgagataaaacataaattcacaaatagcaatgcatttctcatctctcagtcttttaggtttgcactttgcaaacccacagagtgcccatcaacaactccttttggtcacctggcactcccattgcactaattagggactttcaatgaccataacacagaagtaaaaataacaatgcccatttaagacctattttagagagactatataatatagcagatagactgactggtatatatgtcaaaatgagaacaattagatctcaatatgctatcttttcttgcctcaattcactctctccaaaagtatccacaagcttagacaaacaataagttatcacgtaagtgaaaggaggtgttgaaattatttcctaccaagctactctgatatagcatcttttacagtttgagggaaaactaagaacatctgtaaaataaaagatgttaacacttttatgcttgtcagatcttctgatgaaaacaagtgaaaagcatgagaaagcagtataaaactttcctttgtttagtgactcatgttttgaaaaccacttccctgcttagatctatcttttaacacagtaggaacttggtaatatcatagttgcttagcacaatgtcatttctctaaggagaagaccaataatttatttttttaagttaattgtgaatgggaacttactttggcttcaagaactaatatttacacaatacccaatgttcattaaaatgtccaaaacattgacagtccattaaatatttaagggaaaaaaacatattgtttatataaacatatattatttttctatatacaggaacacatactgcattttgttttataattttatgattcaacccctatcaagcaataattagtatactcaggatttttcccaagttgctacttcattgtccctcacagttgtctccaaactatattttgtaaattttttccataaatctaaaatatctataagcttattcttgtctgagtttaaaaactttcatatacctacgttagagcagcactgaaagcctaaacatctgcagaaagatttctgatagaaataaacaaagatgtcaacaaatttagtcatgtaatggtggaaaattttagacttttttaactagaagagatagaaaagattacctagtccaacccactcatttagcaattgagaaaataatggataaagatagtgacttgatcaaagtcacccaggtaaccaagccaggacaaaaatttgggactttttgtttcctagattgatgctttgctgatacgttcacactgtctccttttatctatccaggtattctggatagcaaccaccttacatttaaaatacatatctatagatttgtatcattcatttttaatttataaagtttatagaaagctttgattagcagaaaagattagattattcgtagagcatttaaccaaaaagttacccaacaaatattagaaatagaaggcccaattaagtatggttggaatcctttactgaccaaatatgatgattaactaagcatctggtcatctttctgctcctttgtgtgtacatagctgatagcaaagtgaaagggtatggatagtgtctgatcccagcaagcaaatcatttgaaaacagtcatagctacaggtcaaagattttctactcagtctagatggatctaaacgtactaacctcgattttaaacctaattacctatataccaaatcagtcagaaaataagagaatgactctttatgatccaaagataataagggaagataggaaggaaaaattcaggaaagagactggcagaaccttgatatccataggccaagacagctgttttatatcctagctttatatcagatggttaaaggaaaagtttccattccttagatcattaaatattatttcatttatattacacagatgtcttccatacatagattacaaccaatgaagcattttgttgttgttgtttaaccactacaagcaatcagagaaacctctctgcacatcacttttactctaattcataacatttaaaggatgaggcaggctagatttttaacatttccattaaaaataacacaaagtccattaagtatttcttgtaatcttagcagatgatcaatgccaaattactactattcataataatatagagtgctacagaaccaatacatttttaaataaaatgtttaaaatggctagtgctcctaaagtataacaaaaacctacccatacgatatgcttaactaataattttaaacatagacccacaaaatgtctcatatgacctgaaagaaatagcacataatgccaaatattatattttgaaccaagtacagctcaacactagcataatctacgtctctaatttcactcatctgttttgttaatgtctggcactgatcacaagagaaagtagaaagggagtggggatggatttaatatcctaagaaacatattctacacaatttttgtttcacacacattgttttggctcacaatgtgagtcaataatattatcttcataaacaaaagatatcacaccttgaaaccataaggtcagctttcaattttctttaacacttaaattcattattatctgatcctggtttttctgtctaccttctggaagtgatgttaaaggccagcaaaatttggttctccaggtagaaaagtcacaaagaataatccacaaattatacaatcatttcttaaagttaacagttggctctaccaaatataccctttcatgtgaagataatagtgacttatgaaagtcaaagttatttggcaggtaaaatttaatatttatctaatagtacattaataagttcaaactggtttttaaaaaaaaaaaaaggaggaggggagaggaaaagaaggaaggaacaaggaagaataggaaaagaaaatttttaaaaattttgcttcaacttttcagaactgcttaactatgtatgtaaataaaagaatgtagtgttacaactcaaaaatgtatacatttaaaatgagaaaaagatacacgatttcttggtaaggtcaaaagacatatgccaatataagtgtgaatatagcaagttcaaagaaactttctaaaaaatacttgctgaattaacttggatgttaacattgcacattctagcgcaataatataatggcatttacttcttagtcaggctaaaagctgcttactttaattttcctgagcacaagtcccttactctatcattgtatatttttggtgacatcaaattatgtatagtttaataaagtactcatttatgcagttgctattcaacttgggggaaaaccctgatatacagcatactctcaattttctcattccactatataatacaagaattatatttgtaaagtctaataggtaacaaacatctctaatcatatatattatctaaggcaatccaaacaaatttaaaaggcccacaaacaatactcatcaaaagtacataaaagcattttatttttcagtacagtttgataggcttactgtacaaaattaaagctactgcttttacctgacataaaattatctgaagttcaacctgttcaaatgagaacaatacccttgggttactaatcaaagagagtaaaaaaaaattttttttattaaggctattttgtgaggggggaagaataacttgtttcaacagcatgcttgaccatataaaattattaacaggcactatggtgaactgttcaaggcaaacattcaattactggttattttagattgattccagaataataattacaagtagcttagaaacaatctccttaacactttggaattttagaaaattaaatcctttgacagagaataaaagagaatgtagttttactgtgacttataatgtggacagtataatcttgatgactgtcattaacacatcttacatatatttaaatataattacttcaataaaatttcatcaactagaatacactaacaaatcatatctgggttatttacttttctttctgtttttagtgaaataatttttaaattcagagaacttaatagtgttttatttcctcatttacaatttgaccaaaaataaaaatcaatgttcatttttttaaaaaaaaaaagcattttcataagtatgtagaatgattaagtatataagaactaaaaatgtagcacccacatagatgtttcaaagttagaatttagaggataagactatataccagtaaacacgtggtcctttgttttccaaaaagtataaatcctccagaaatgctttcttttcttaagtcaataatctgattattttttgaaagcttctaaaatatttcctggaaaataagatcatgtattctaaaatttgtttactctttagtaaagattattgagatacaatatattatttttacagataataaaataatagataccttttaagtctcgttaacatgataaagtaacaaatgcactgacgttaactcagtaaatacatttttaagtaaagatcagcaaaaaataaaacagtttaagaattttgtattctctggaaacataaacaggattataactgtcagattacagaagcactgacttcagccattagtttggtttggctcctgagaaacacaacatgaactactgcatcatttcttttcaaatccatacattccctgcagccgttcaagcttcatcagcagtgcaggaatgtataaaaatgacaggcaaagggcattaggtttttttacttccatactgttttcctataaatggaagacaggattctttctcaaagcacttaagctcaagctcagtcaatgctgaaggaaaaatacaactgaattctctatgcaagaaagtatcacaattggattatttactacttttcaaggacatgttgataaatctaatactgtattattatcttagaataaaacattgtaaggttagcattctagcttaattacccattattcttcaattagaaatattttcactttttaaagtactctgtcaactcatcaccttattttaacaccaagtattcagttttgcttctaattttaattataaaaatttccttaaaatatgccaattttttttgaaaatatatttgtataaatagttaattttttatttccaagtttctgtactcataaaggtttcggtgaaataggaaattccattaataattaaaagtttatttaaccatgataagtaaaaataggatgtaatgagtaatctggttatttgactggaccttaaacattcacattgctataaaactagtaccgtaattactacaacctgactcaattttttgaagaaactgggaaattttcagactaaagttttaaacatcctcatattttagtttatagtaactaaaaacatgcccacttcagtactatcacctacattctttatgttcctaatgtaatgatgcaagaggtaaagcctagagaagtctgaaggttacggactacctgatatccaaaacaaaaaattcagatcacaccctgaatgtcctccttccctttttaggaatgtcctgcagctagcccagcaccacagctctgggctgaagcatgccaatgttggcactgcctaagccaaacaaacaagatgtttaacagtcaaataaaatgtcctgcagcctccctaatgaatttgtcaaggaccatcagatttcgcaccccctcctttgcctcattaactcaagtatgatgagacggattataacaagagaatacagatgaatcggtctgaagacttgaagtggcttttagcctctagagtttctttctctcacttggtctcctttaatagaatatagtatctcctgcagaaggagctgccagttcgttttaatacaccatcaaggagctgctgatggacttctatactaacatacataaaagcagaggtgacaggggctcttcaattacagcctcctcggataccgtttcccccttcaattattcaaccagaggaagagaggaccgcaaaggcgcagctgaagctgctcttagagcagaggcagccagagtgagttggggtgggggaggggggagaaagagaaccagcaagagggagcattatttgctggaagtgtttaagtttattgctcgaatgatgtttctaattagtaccacggccataaattaaagtcgcctttgtttaactgatttattatttactagagcatctacctaagacagggtaaattggtaatgaattgtttttaaatcaaaacatttgtaacgttttatcatccttccctctgtatgtaaaagtggagaagcgtaggggcaaggatgcgagaaaacttagccgagcttgacagagccgccagtggaggtgcagcggagtgtccggcgagtggtggcgcgaaggtccgctcggcctgggacgccccacccgagagaagaggagaaggcgcaggacttgcggcgcggcggcggagccatgcgaaccaactccgccacccctgaggctgtttgcaaacactcactctcgggagcgtcgcgggccgggccattcgcgaaccagacgcaacgacgaagcgaccacctcgagagtggggcgggaaagctccgcaccctctatccccgccaccagtctccgcccagtaactgcccccggagaagcaaccacggagcccctcccggccagtcgcgctctcccggcagcgcagtgccctccggcccaggcagttcccagagcgccggcaaggcctcccgggttagagccgggctcccacaggcgcgaactccgagggcgcgaggtcccctagatccttaggcggcgaggcgttccgggacgcacgcggcctccccggagaaggctggaggtcaagcagcccaagtctctgccactccagagaagttaactaaagctctggagtccaagagtcgcgcggacacttaattctgactcttcttcctaatcgcgggaagacaaaccctaagcaacaaatccgagatagtttttttttaagcaaatattccttagaaagggacttatggcaacgagagaggaagggtgacaaactgcctgtggtccgcaccaggtatgtaagaaagaaccaagaggcccaattgtctgataccaagtagatagaaagaaattaacttccctatgcaattcaattcaggttcacccggccggactttaagagggtaagtcaagccctcccaaggggttttgaaaaagccgaactaccaggtttctaaaacgaagtcttcacccaaatggacgcatagatttttatttttatcgcataacccagggctggaatataacctcccaaatcaaactaaaaataatcacatctacctgaaatacgttaaaaagattcagaatccagacatcttaggttcatacataaaccctcagtatcaagcaaatcagaaacaatgttctagctttttttttcacccaaaagtatggaaaggctacagtgggtacaactcgtttaggataatacatatactaaaagcacatgcatgcctttcattgaaatgcctagggaggagtgaagccatctgtgtaatcaataacaggatagttatagatttttgtggcagtgaagtcttttaaaagcaagagtcaattatgaaaataaaatcattttacaaatgaaactctgtacctgtaccccctaagaatacattcacaattagatttacaacagtaagattttaagaaaactttaggtttacatttacttgccttgtttttcattaagtttgaagcaattttagtagcttattttaaaagtatatcctactaagttctacgacatgtaagtttgcaccatttctcacaacttagatattttctctctcgtaactagttaattcttgtaacgataaaataatggtattaaatacatgtgaatcttaattatgaaataattatcaaacaaggtgcttggactagtttttgccctgccctgtttttaaacagcatatcgaaattactaaaaagagatttataaaccctcaccttatatccactccaaccctcactggtgcacatatacagcaactgctctgattcttggcaacaatgggaggggaggggaagagaaaggaggatgactttaaaggaggaaaaaacctggaaaaattaggtcctttcccagattcccctttcgcttcccatttgccttcaagccaaagtaattttgttacagtttgcaccttctactacacaatgttgatagaatcatttaaaaaaaaaaaaagtgaacctttctgaaccattgctactctccctcgcgttattccagccatctccaggagagtcccttctatataaactctttttcttctttgctactgataagagaggaggataaagaggaacggctgtaaaatgtgtgcaagcatttgactcccattatctcctcctattttcttacttctctctttaccctgtttctttatcaagtgcagtggtggctgctaccgttcgccaagcgtgcctgtcttctctctcggattggctaaagcactgacagctcggatagcgattgtaggaactgaagctccaccccctcatgatggccctgggaccattcataaactaaataactccaggaaacagcgagggagagagagaaagaaagagagagggagagagagagacagagagagttagaggaaagaagagagagcgagcacgaggaaggggggcgggggagagaagcagggggagagcggggcgagaaagaggtcggaggggagaggagggggagagacgactcagaaagtggaatctgtaaaagcaagctagaggagaagaaggaaaaccctgaatcgttataactacaccccagatgcaacgcaagcaacgacttcgtcacactaaaacggattttgtgagggccaaaagtataaattacgaagcagaaatgattatcaaacaacttccagcggtttgcacctaaagaaacacaaggagaacccactacaaacaaacaaacccagtccaaacaacgcctccagtaggaaaagaggaaaactgcgataacacgaccccccgagaagagacgagaccaacacgctgagactgtggggcgtcagcaaacctccaagtgcacggcggactgagttgtacttcgcagctctctggacattaattacctcctgcaccttccatttgggggagggtgaggaagaaggcactcacctacactgagcgaagaagtcctatcagcgtggaagagaagtttaagaatgaaccactgaatgtttcgcttttatttttaaatttactttggcacttaaaaaacctcatttccagatttctggacaatctcggctgcagacatctaagcctaaccttttggtatcctgagttttttccctctccttctccttcctcacgcccaccccgcttctctcgcacacggtcatctttacatatcaagagaaagcaaaaaggttccaagaggtacttttctttttagaaaatcaccttttctcccctaattcttctgcagaagaaaagaggtttcgaaagagggaaaaggaaaaaacaagccggctacggtatcagccggtcagcccaggtggaaaacgagagtgaaagtagggcttaacggggagcgcaccgcctctttcgaaagccgctgggccaccaccagtgcgtgagccttggatccctcaacgtattgcgagacgccggtgtatagcccggacctgtgccccaacatgatcgccgctcaggccaagctggtttaccagctcaataagtactacactgagcgctgtcaggcgcgcaaggcggccatcgccaaaaccatccgagaggtctgtaaggtggtctcggacgtgctcaaggaagtggaggtgcaggagcctcgcttcatcagctccttgagcgagatcgatgcccgctacgaggggctcgaggtcatttcgcccaccgaatttgaggtggtgctctacctaaaccagatgggcgtcttcaacttcgtggacgacggctcgctgcccggctgcgcagtgctcaaactgagcgatgggcggaagcggagcatgtctctctgggtcgagttcatcacggcgtcgggctatctctcagcgcgtaagatccgctcgcgtttccagacgctggtggcccaggcggtggacaagtgcagctatcgggatgtggtcaagatgatcgcggacaccagcgaggtcaagttgcgcatcagggagcgctatgtggtgcaaatcactccggcgttcaagtgcaccgggatctggcctcgcagcgcggcacagtggcctatgccccacatcccttggcccggccccaatcgggtggccgaggtcaaggccgaagggttcaacttgctctcgaaggagtgctactcgctgaccggcaagcagagctcggcagagagcgacgcctgggtgctacagttcggggaggcggagaaccgcctgctgatgggcggctgccgaaacaagtgcctctcagtgctgaagactctgcgggaccgccacctggagctacccggccagccgctcaacaactaccacatgaagacgctgctgctgtacgagtgcgagaaacacccacgagaaacggactgggacgagtcgtgcctgggcgaccggctcaacggcatcctgctgcagctcatctcctgcctgcagtgccgccgctgccctcactactttctgcccaacctcgacctctttcagggcaagccccattcggccctggagagcgctgccaagcagacctggaggttggccagggaaattctcaccaatcccaaaagcctggacaaactatagggtgctggggactgcttgaaaagcgacacaaacgggcgtgctctctcagacacacaactctgctataaacagcagaaactctggacacaaacttttatgtaagtcacctgaaataggaatccggcagaagaccttcattaattaagaagcaaacaaaaagagagcaacccaaccaaaacaaatcacattcttgcacaaaagtgatcgttttcttccaaacaatgtgaatttaaaaggtcacacaaaagaagcaatcgggctccgccaccacaaaatgaaacccaaggtacattttcaaatcaatgtatagtagttccccccccttttccttctttccccctatcctttttctctccaccccatccccccccccatttcgttttgcttttggttgcctgaatgttgtcaccaagtgaaaaaattatttaactatatgtaaaatttctcttttaaaaaaaagttttactgatgttaaacgttctcagtgccaatgtcagactgtgctcctccctctcctgaacctctaccctcaccctgagctgtcttgttgaaaacagtaataaaaacattactttacattgtaattgactgtttgtggattgttcttaagtgaaggcaggtgagatcacagtttataatttccaatgtaaagatgtgacgaggaatcaaatgcaagaagcttccacttgaactgatttgcaaaattttaaatacagtacattttgtagaattgactgtataagttccgacccaaatccttagaaaatagaaaacactaattttactcaactataatatatatttgttctgtagatgttaagattaaaagtaacatctacttcacgcttgggaaaaaagtatgaaagaaaatattttgatcctaatttttaaaatagaaaaaactttttcacattaaaaattaagagatgtgctttcttatgccataatttcaaaaaatccaatctgaatccgatatacaaaggaaatatttatggatttttctgaatagttaacaaagtcagttgatacttttccttcaaccgtttgtcctcttcaagctttgagtgataaaaatttaacaattaaataaaccacaacaaaaaatacaatggttatagcaataatcctctccccaagcatatggtgatatgaaccattcagatttataaattacttccattttaaaatggcttagttgtaaattccataagtatgattattttaatcaaatttcaagaattattctgaaactgcttatatgcaattcaaacaaaaaaggttttcataccatttttataaccaaagaaaaattattattccaggatttagaaataggaaaagtaccttcctcctctttctgtttttctaaggtaacaaaccaatatactcatttcaatgtttcagctttaacaaaggtttctttttaatgcaagggaataactgattagaaaataatataattagtcaaacagaaagtatcccaaaggaattggtttgtcttgcttatgttgaaggtaactatatactccattcgctatgctaatgatgagacacaggtacagaatatatgtcagatgttaccctttaatatctaacatttattctttgtattagcccaggttttaatttattgagaaaatgcacaaatgagaggtgtagagaaaaatgtttttaaaggcaattttaaagatcagaggaagaagtttgagagggggaagggctgtatggagggatgagcagcaggatagcagaatagatgaaaaacaagaaagccactcaggggtctgaagcctagttcacttgacaaacaggcttaagttgtgtaagattccttggtaaaaacagtcctgtgttaaaaatataaactttgatcctatcagttctgaaatcatctccactctttcaactcaacctctattatatctatttttctagttgctcttcctgtattcttcacagtaatattaagtggctcaaacaaacaaattcttttaaattataaaaaccaatttattctctggggaaaatgttctgaattttaaaaacattttcaaacaaacagtaggtgcttacatttgcacaaaatgatttaaaggaatagtgtttggtttcaaagataaaaagaatatctataagtgaccatttttctcactcacaaaagtatttacagcagtagacatacatctccctccaactattccagaaaaaaagtttttaagtcttgacaaaaagaaacaaaaatatccccaattcagcatattttcttcttccttatttaatttaatgcaggtatcagttaaaaaggaaaaacactgcaggaacataaatgtcctcatttacagaacaccttaaagcattaacatctatacaaaattaaaacttctcccagtagctgactgaaaaattgtttttaatataaattggcaggagttttaacttctggaatataaggaaggttgcagtgatacagaccatttcttcattgagccaaaagatctccatatttcacaagcaacaagaaaaaaataatttaatgatgctgtacagaatcagatcagagagagacaaaacttgtaacttctctaaaaggagcaaataacttcaaagaacctaatctcacacattggcagagattctaattttcagaacaattaattagacacttttaaattaaatcaaattttaggctttgctctatatgtgtttaaaagcatgatagaatatcttgaattaaatcccagtctttcttaaattcagaagttaccagaaatcagagagtttaattttggtaaccttcctttcctaaagaaactaatgcattttcagacatttcagtcatgggacaaagtagaaaaaatttttaattgatagaatttcagaattagcaagttttctctacattggattagttaacttatcaagctcaaaacaatcagtttcatacaatctaccaagtcctgtcttaataaaggcagcaatattgaaacaaagtgctagaaatatgtgtgagacatgatttgtttgtatagttttaaacaaaattataatattttcatcaagagctactactttgaaatacttctaaatcattcagatttaaaaattcacatgattacaaaatcaaagaacctaccaaaaaactcaaaatatgtgtatgtatatacatgtacataacatatgctatcagcctgcaaaataaattattccactttttaagccacctttttctacagattgcttattttgctcatttttaaaagaaactgtttcctctcagagcaaattataccattctttttcttgaaataaacctaattttggtttttatgactgtgctacaaatgtttcttagtaaaaacaaagttgccagggtctgaaaagtaatgagaaatatattttaaaggggaaattacattttcatttaagaatagaaaattatgcagtgccttgtaaaatctactataggtaatgggaaacagaggtatctcacacacaaaacatgcttgcatgcacgacagagtagtaagtcatggggacaaagcaaggagagtgatatattggcatcatatccagaaaacataaaggctaaacaaaataattccactctcaatctcactgaattttgtatcttaattcacccttgaccctttgaggcaaaatatatttatagacaatgttctcggaggttccttcccctcctcacaaagagctaatgataaatgtcattaagtagaatttgtttttgaatctaaatgaacttcaataatctaactaactggtagggaatcataaactaaagaagataatgacattgcatataagccaaggcaacttagaagaaattcaaactaagcctgtcagatttaccaatcccaatcctatccaacagcacccaccatcccatcataagaaaaaatgaaaccccttcatcttctcaccttggggtcgatttttttgaagttaggatcctcttcatccacctcaaaatagagttcggaggaggtgacagaaagagtgccctttactacaacagagggggccacaagctgagctggtgtgctcaggctaacaggacctgccaaaaggaaaagacaagccacacaagttggaatgacatttttcaaaaaatcaaattcgaccagaaattgtatttaatcttttcattctcacgtctagtactgaactgcctgccaactacttctacagttaaatattctgtccaccccaaatcttcctctgaaaatgcaaagtcaggattctcatactacaagatctataacaggcggttaatgataacagtaaactaggatgcaattattttacagggagtctgcaaagctttggtctaatctctaggtaagaagtggctctgcctaaataagtccatccacattccatttagaaaacaggcctcaggctatctaacaacatgaacaacaaccaggagcaaagaagcctcaataggcttccaaggccagcagttagcttacagtatggtagaggcatggctacaaaaagatcactagcttattaatgaagtgggaaatgttaaaccatattttctgatagagattttatgccagcttgacacaaaacctcttccataacaactttaccccatcaatgactggtaaaaatacttcttttctaagccttcctttccactgttaagtattgttcaatgcttccaaatctaatattagtgtagttcagggactctgggagtaaacagctggagggtgggtttccaagtgaatgaatttttattggaataatcaaatctccacagggcttatcaaagagacaaatcagactgctactgaaaacaatagattcactacagacagaacagcataatgtgtattagagctaaatataaaatatgaactaaaaatgttacatatatatgtctgttatgtctgtgtgtgtatacacacacacacacacacacacacacacacacagagagagagagatcgacgtagaaagaatttgaaattccattatcaattcctcatggtataaatcctataggggaagaaaacagcataagagaagattggcacttatagttctgaattaatatagtgcctataaacaagctgtgcctattcaggtaatcaatgggtgaataagtgtttcaaaattcagatgaattgacatttccatcgattgttagaagggtgatagtgcttaatctcacatcaatcttaatgtgtgccagtaggacaatagaagggatgctctgcggagatcagagcaggttttgccctctattcccaatgtacaaatacattgtgtttgcagatgggcagcagatagctgcagaacagccatgatttcccaaagctcatccttataaatggatgaaataagaagctatgtgttcttttgctgtctccttttgccctctgtacattagcatgtaatactgagaagaaataacattttttcaatcactctcagacattcaattacagggtaagcagacagctgcaagagctagggcagcctaggtcctacagaagacccctgacaatttccacttcatttctaacccacaccactttattagtgtggattacttcttaatcctattgccattgtcaagattatataattaaactcccctttcacctctattactgtatgaatgtattactagtagcaagaatagaagcaaaataaaggaagaaatgggtaaatggatgtgaaggaaaagactacagaatagcagtatctaccttactctccactcccaccaattaattttattttactttatagagaggtttacagttatcagagaagataccatcttctctttttgcttttcattaccaagtggcatagtagcacaggttgcagatatgtcaccaaaagcaaggtttttaatgtcttttctcttaaaattatcaaaatggaatactatgtaattttcacctattgaaattatagaacctttcagactttcttccttgagggacagagccacaggtattaaagtaaaaaagccatttaatgaatgactaaaatttccggctaaacaagagaatttttcccataagggatgtaaaactgagaatctgcagagtgcaaatcaaaattcctacatcaggcaaaatacgtgaatgttgtgaaaagccatggcattctcggaattgatttgagagagttacatgcatatacagcatgttcactaagacctgtatatcaaagcaaatagcttctctccttccaagctttatttacaaaaaaaaaaaaaaaaaactggcagaattttacttatagtcttactttacagagatttggtaactcctatgggatgggtgaagtaattttgttcttttgttgctgcttttaaactttttctttttcagtgaaaattattcacaaaagaaaaaaatgaggagagtaagaagactgaatagaatagaaaaataaaggagaaactgtagaagggggggaagtatttgaaataaccaattaatgtaattgtgggtataaacttggtagtcctagtggtcacagctgaaaaagtaagtaattatatgcttattgtcccagaggtagctgaaatatctgcacaaccaccaaatttaccggcaagattctctaaatctttctcatccacggatgacagagtatcatcatcgccttccaggaggatctcgttttctgagttctgatttcctaaagcctgactcctgatggactgttttcctttagcaaggatatcttcatctgtggctgaaatgaaaaggaaacaaagctgtccatcagttctgggaagagcacttcggcagaggggtaggggcttaggtaagggtaggtggccaaagatggtcaatcttttatacacagtgtcagctacagtggagaaagtgattgggatggcacacatgcctgatctgacaaactcgatcccccaacctagtctaatgttaccctaaacaagcaccctaatcccattaaatttgacccctgcactgctcaccaaaccatttatttacttatagttagggtaggagtggttcaaaagcagtacttttattgaaaattcattaataggaacaatcaaatcccagttttggaaacaatatttaacagcaaaaaataaggactgattcattcctccaaacaatgttatactgacaaacattttggaatggttgaggagtggctgtggagaagaatccagaattaaaaagggttaaagctaagagacattcacaagccagtgaggatttaggcccagatactgaagccatatctgacactaataagactacagcagctcctcaaagctgcaatctcttctttatccaccctccctccttccttccttcacattaccctcgtccacatgttcacacatacactcactcctccgcccttttgtcctttatacaaatatccaggagcaaggcggtgtggaaactaagtggaagctcaaacactacctcctctgcatgtttaaactaaagggctaaggcaccccgggggcaaacataacagaaagcctgggatgagaggcatgtgggcaaggggcctcatgcggcctgaactggagcagcttgtggagagcagcagtaccagactcaggcactatgacaaggcagcaactgcaggcagatggaggaaaagagaacacatctagggagggaagaagcagccctgcagagcacctacactcaacaatgggatccgaaaggagagcaaagacgcaaatgaaagtggaaaaccctgaaattcaaaactctgattcaaaacccacatccttccagggctcctcctgttgttttgagcagctttctccttacgacaagcaggaaggcagatgctaacttctaaattgtgatttgtaaaacttcatatgtgtatcttttcctaatctttttttgaatggtgtcatataagggaaagttaagaatcttcacctgaccctcctggcttccagctagataaatcccagaggtaaagcacctgatctacccaggctgcggcttttgatatggaaatcggatggctagggttttttttttttttttttttttttttgctccactgcagcttctgcctaggcataaggcccaaaccccagaaagaataaagcagtcaatttgcagtaacacgactaatatatatatatctatataatttattctacatagttaacctgcacatgtgttacctgatttggcagatcaaaggttcttagggtttgataagtacgtttacggatgatgttaaaggtaaaaggttttttttttctcatatttattgcgaattcaccatgtataccatttatatacaatacttatagtgctactgaaacataggagttttctatttaataagaagtcatgggaagaagctttctatatttacctttaaatacactctatgggtaaataaaatctttcatactcacaggctgcattgtaagctacacacatatgatggtctggacatatgtttgaaaagattactttagtgtatctaattaaagtggctttatttattttttatttaatttttttgagacaggatcctgctctgtcacccaggctggagtgcaaaggcacaataacagcttactgcagcctctaggctcaagcaatcctcccagctcagcctcccaagtggctgggaccacaggtgcttgccaccatgcccagctaattttttaatttaactttttgtagagatgaggtcttcccatgttgcccaggctgatctctaactactgggctcaagcaatcctaccacctcagcctctcaaagttgctgggattacaggcgtaagtcatctcacctggcctattttttttttaaaggctaaaaagaaatatacttacaattaaccaataatttttagaaaaacagaactatgttctaaaatcacttatatttcaagtatttatagttccttactctaaaatcagaaacactgccctgaggctaaacaagatcttttgcagtttgctatcaacattattaaaaatatattggccactgagaaatgcaaatgaagcaccatcttctaaatgtttttataaagtaaattataataaattattattttccagttagattttagtacagaataagtataccacattctttttatttcttggatttataattccttcttcaaagcagaaataataataaggctaatattacatatcattttgcataagtcagggagtagtgttaaaaatactttacatagttaattcatttaattctcataaaccttctgcttagttctaattttaagataagaaagcaggctcaaagaggttacataaattgaccaagttaacatgcgtttgacaattagagtcaggatttaaaaacaggcagcacggtgccagaagctgggctcttaaccacgatgccatattagctcttagatgtaagaaacagaaagaaaacaaaacaaccactgttcaaatatgaatgtgtatataattaatttgtttactaattcttgtttttcatagtgcattttaaaaggttaaatgagaataataatcaagaacaaaaaatattcatttccaaatctaaaattgatgaacatgccaaacacatcagaaacaactaaacaccctgctcattacttcctctgattattgccatacatgtcctaaagtacaccaagcttatgtgaaaggaaaaaagaagaaacctctttaatctgcaaacatttacaaaaaaatgagagtccccagtggcaatatgtaatggtttaaaatagctcaaaaaataaattcacattcatttataaatgaccacgagaaatataattatcccttccaattgcaattaaaaaatttttaaatatgttctaatcatgctgcctatattaaaacacagtaaggtaacttctgaattaaagtttcattaaaaattttacatactataggtgtactgtatgcatacacacacccactttaatttatttatttacttatttttacaagctcagattctggaattgttcaagctccactgaaaaacctcttgtcatggaaaatatgcagcttactgatatttagaatggttttcctgtaattaactcccccttgaggattttaagttagcagcagtaaaattaccaacagtactctaatatacaccacatgcgctggtgttcaattctcagtggtctaatagctttctgctaaagaaccttaaaaaaaaattagaacaaaacttttccaagcataaaataaaggattattatcatgtttatatgtactggggaaaagtatatttttaactttcatttgccttattctcaatcaaccattataaacaagtattttgatatcttctgtgagcatattctacacacgtctaaaagttaattggatgaagtcagaatatactttgggttccattttaaagctcaattcagatatttctggctaataaaattgttactaacatgattgctgtttaaatttttcatatcattattaagaaatgccttttattctggtttaatttcaccttttattctagtttaatatttatcctaacttaatacttaaactgcaattgttacataaaattggagaaatctgtcagaaatgtcatctttaaaaatgatttgattcactgaggctaagaacaatgaaaggcctaagagagagaggctggtccccaaaatgtaaaattcaagttcttcagagctaactctggacatgagttgatttatctatccaccacaaaacaggtaagtagaattaaaatataaaaacagcaaaaacacacacaacaaaaactgttccacctttgatataaatcctttttaacatctactgagcaagtgaactggaatcatcaatagtctgtattaaagtaaaagaagtttatactttaagaattagcatttttaaaaaagactactattagaataacagagtgccttcaaacatacataaaataaaaatgggtatctacttatgtgatctgaagcacacaccataacagcattctgaacaggacacataaagaatatcttataatcaactattgttctaattgattcccctctatagtttatgccatgtccatagcattccaagtcaagaaaactgactctgtaaaaattaatgaaactacaaaggataattaggagaataagccaggtgcatctcgtaataatcatgggctaaccaaaattttagatagagaacctagtatatgttgatcctaaaaaggaagcaacagtatctggcattattgaagttatgagacaatggcacgatttaagatctttacatgatctgtcatccctagaaaaccaaatgagttacttgtatcattccatatgcttacaagatacttttaaaactatgttaaattctccttatatatttctattagcaagcacgttctctaccaaataaaaatgtcttgaattcaataggattctctgctaaactgttttagcacctgaattaaaaccaatctttctaccgtttaaaacattttttacatgtctttaatttaaatataaaattcccgttatatttaataatgaattttagaggacagcacagcacactgatatgaaaatctgggtttcagtcagttaacctgggctttagtcctttatctaccaaaaattatactggccctttgtttcctcagtttccttatctgtaaagaataaagttagactagatgttagccttaggttccttctacatctaaaatgctctgatagtaagtaacagctaaccagggctctggcattaggaaaatgttacaaatcattgctaccaatttctaataaattttaaaactataaaatggaagaaaatgccctcaagaataaaatgcccagctttgcttgagctgctaatttccataaagaatacttaatcataagaggaagtattaattttaattttaaaatatgactcagtttctgcaaagttaaagaaatctcccattacagcatgacttttataaataaccactttggagggtctctgcttgaaaaattacctaaagcttttttccccaagcaagttaatgtgaacttgggaagggcaattaaattgtcagaattaaaaaatttgtttttaactagaaggtagccagaagtagagtcatggggctggtattgatcgcccaaacagagaacatcactcttcaggtatttactctgccacctttacactagaggctttccttcaaatcaaatcaatctataaaaaagatggctcttactactaaaatacgtaactgatctccaatggcacttctatttagatgtcttcctttgataatgataatatagttcatggtgttctaagattctgcatttttaaaatgtcctatctccttagttaaataaattataaataaaagtgagaagtcataaaaatataagaatgacatactatcctcattaatatatattttaaacatttaaattcaacattgaagcacggtatttatccatgttaaaatctgtaatttcaactgctttttgatcacattaacaattttgttttgcatacttaattcttaataagtttattttgattagcttctttaatgctccaaaatttttaaacaccaaattaaaattgaatgtcaccataaaatatttaatacaccagtaaaaaattaagctctttgtttacagaatatattagcataaattttctaacatcgaacaataccataatacaatctatgtgctgaatttattccctttttatttaaaataaaataaatatgaggtaggattagaatttgtgtttttttaaaaaatgttatagtaaatattaaatatgatatatctctgaaattgtaagacaactgaagaatctcctacacatttagatttttaaacatatatttcaaacgcaagttttgtttttaacattttggagtatgacaataatcataaaattactataaaatattactcaatgcttacctttgctgttctctctcaatttaaaaatgcacactaaaacatagataattaacattggattaacctttcaattactatcgagagtaatcagagtgaaatctacttctatacaagtcaagagtcttaggatgatagtaaaaacatgttaataaattcttttttgtcaaactttaatgcagatgcttagcattaaaaaagctgacaaaacaatatgattttaagagctcaacaattaaaatttattcattaaaaatcctgtaactcttcaaaatggttaaatgtactatttttgataagaatattttaataaattctatattaaatctataccacaaattttaaattgaattattgatatctaaggataaaagattaacagcctatctatgtgcaattttagaaaacaaatcctccccttccagatataaaaggaaaatgtttttacgaaaacatattgccatgtatagatctcagaactcacaaattactgtaaatgatggtttagaagacagaaaaataattaaatttcaaattttaagtggacatggtaatacattttgttaaaaattgcaaaaaaagttcaccttctccatgtaagcatcattaaccaaaacaaaccagaaaatccaaaaaaacacacaaaaaaagaaaaaaaaaccctctgaaatctgttatcaccacctaaaaactatatgtactctaaaagcaaaagtggcctaattaattctacattttatttctctttctccacctcctgtagttgaagatgtagggccatgagactattattgcttttagatcactttgttattgactattctctgtatgatcatttattttaaaggactgatgtaacatgtggtgttatatctgatgacatattgtggacattttcttccagaaatggctctttaaggctgagtgcaagaggttaagctgcctgactgaggccaaacctaagattacagatttttaatctaaattcttaatatccttattgaatataaattaacatttattttgtatgctacatatttccatttaatcacaagctcctgcatgttaaaacaataccctgaaaaaggaaaattaaaagtacttctgactttattaaaaaccaatttatattttataaagtcaggataattttaatgtggggaggagcatttcccccttaaccaatatatcttaattgactttcaaaaatcataaaataagtgaaattttataaaaatttatagtatcaaatccaaaggaaattttcagtttttccaatttacttataagacttttacctaaactgaatcatagtcatatgcattgtatcaaaaaagcaaaaatgttttgttaagctctgataacaaaataatatagaataggaacgtatgaaaataatgtttattctctttttccatgagccatctatcataaccatcttcaaatcaaggctcagaaagtatctaggcaattggacatttattattatctttcccagttcatgatctcatgctaaaataccaggattgggcgaaaaccatgtatacacaacagaacctagaaacttatctggtttgtaaatgctgtcttcctgatattcatggatttaaggcatgcctcctggattcatttactcaaagctgaatgtgtcgcttaaaaggagacatatttaatctttgtactctgaaacaaagggtctatgttaagtaagttttgtatgtgtaacataattaataaatatacttgacaccataatttaataggactctatagtaactataaaaaaatttaacttctctttctggtatgaacaaccataaaatgtggtgttggaccattttacagtgccttgtaataatgaagttatgctcttcattaccaagtcctgtacctgctgctattggcaaggaatggtttatacactgaccatgttccacggctgtttttagtgtcgcttcaggatgtgtcgatcctagagggttacgcacaaatcgtcgccggcgccgcaagtcatcttcccagtagtcaaggcgccagaactcaagaggacgactacaatgaaacagagaagccacatatgttagcaattatcaaacagcgtggtagcactgaatttctgcataaagctctccttgtttgctctgcctttttttccctctccttccacttaattctccctccatctcacactcccctttctgcaatctttaacttaggtatgtccttgaaaataacaatatcaccttctagtctaaggaactccttttccttttcttggaaggtgaaatgagcactaaatacatcattttgaaatgaattgctgacagtgtgatcagtttccccacactctagtggcatgtgctctgatttcagcctcatttcagcctcagcagggcacctttctctgtagctgcatttataaaccagaatagggaaaaggctattataaatatggtatagcattacctatattaatcaaagtccgtcccccttcatttttcttcctaatttgtgcctttttgcacaaggtcagtaaatcataccatgaattcttggtccagaaagtgttaactttaatgaatatctcagttacatggttatgtatgtgataataaaatattactctgtttagatgtgcaggaatttaattaaaataatctcttaaaatattcattacatttagcccctgaggcttagaacaacacaagaaaatgcatttcttttccatttactgtttttaaataaaccattcctgtagagtgaaatagcaatctattttcaagcaaatcagattggatttctgttttatgtactctgtttttatatttaattaaaaactacatgctatatgatgtgcaataattgctatatcaaaagcatacttttggaaatgtattttttaaaaaaaggtttgctcatttcaaattctatatttcccctattacatacacattttatatggcaatatataaatgtcagctttctctcttgttaactaatcatgatctagcatgctggaaaaatattttataaggaaaatactaaagtgttttcagttatagtaagaaaaaagtctctgtagaatacattaattcaataaagatatacagcaggaacacctgtaagtttcaataatgaaattaaaaaattattcataatcaaaacttcttcaggaatgactaatacaaaatacaatcttacttatatttcgggagctaataaaattgtatctgtcagctttgacaaattagtagtcttcaacaactgacagtcccaaactacccaagtaaaagttacctttattttgatgttttaaagatgttctctttaaaaattcaaaataggtttataaataagtacttttatcaattaaaaactatcttgtattaataaaaagcataaacagtacgttatttaaagaaaatctttttaaaacagtagagactgatctctgaaaatgctgaagggataagaacatcaaatatttccttgggtgattttggtcaggagaaggagatataatgtaatcaaaatgtaatacaaaaaaagtataagaattgcagttctcaaaaagaaaaatttaaaaagctattattatatatttcttcattattctgtctaaatttgaataaaaacatgatgatattatttaaaaataaataaatacccacagaatatacatacaatcaaaagacaacagttgttttaactcaattaataaaatgaaattctccttaggtgagaaggaaaaaggcagtacacagatggctgtgtgtatggctttgatagtcatggagcttggataggcacttcatcattctgcctacctacatttatctgttaaaattattatcaaatatcagccaggatgcagtcgtgaatcacaggctgctcctcgccttcaggggaatgatacaatgagggtctattcatcagtgcggcaatcggcacaagtaattagttccctagactgagatctcctacaaagcctatttcagtcagcaccacaaacatatgacgatgtaaagctaatgaaagctgctcaaatttgttaaccttttctgccatctatccttctaatactctatgcttcagtattatgcaaaggtagtaaattattaatttgtcattcatccatccttctacattttgagtcaaattaaatgatgtcattcttcttgataacaattaaaattataagagatgttaagctgctatgataaaattatgactaaattaggtaacaatagattctactataatgcaccacagtgaagtcaaattcaatggctattaagcatatgcacaataacttttatcacacagcagaaaaaccagaggaattataaaattattcacaaattatcaagtaactcaaagataatatctatagcaaaaataaccaaaattaggaggaaataaaacgataatatttatttttataccttgacactaaaaaaaatggtcaaaatggtgacatttggctaaaacaaaaacaccaatgcatcagggaactgagaatttgttcacataatagaaatgaaagttgtttcatttctgctaactatatatatatatgcagacatacatactgtcttcaaatatattctatcaatttttttttctttttgagttggagtctcgctctgtcacccaggctggagtgcagtggcactatctctgctcactgcaagctccttttcctgggttcacaccattctcctgcctcagcctcccgagtacctgggactacaggcgcctgccaccatgcccggctaattttttgtgtttttagtagagacagggtttcaccatattagccaggatggtcttgatctcctgacctcatgatccgcccgcctcggcctcccaaagtgctgggattacaagtgtgagccaccgcacccggcctattctatcaataatttttttaaatacttaaacatggtccaaatagaataaacgacctgtaataccacagcatgataatatttacaatctcctgaagctatgtcacttaaggactatttttccaacacaatccagttacaacacaattaaaaacaatctgaagacaaagcaaatatcacttagttcagatcacatatctagaaagaattataaaaatcatttcaaaagaccaacaatttcaatatattttttgagagtctcttcatataaagcactgctccaggtgctacagtgtacaaagttctcatgtaatagacttataatcaaacagttagctattagtctcatttgagaaaatagcatttatcacccaatttcagattgtgtaggtaatacatgtttttggagaaaaagccacacacccacttatttgagatatatttaaagtcatttaaatatatttaataactagcatatttaaagtcatttacacagtaacaaacctgggcctaaagtacaatgttttgtttccctaagtctgctccctccaacaacacatactctcagtataacgctctaccacacacacacacaaaaatgaggccggctttgtcattttaaaacagtattataaaggagaatgtgtaggttttggtcttcaacttactttcttcactctcatttaagaaatactgttccctaccccgtcccttcctcaaaagcctcttccaggcaaaagaggatacaaaattggcaaatttattaataacatagtgatccaaccctcttcccaaaaggttataaagtaattaaaagattatacatttttgtagttatcaccatggtacgatcagcaaaatttaaaagacttcatgtgttcagaaacagactgttgaccaaatataagcatggataagatcagaaatcacttattctggcaccttataagtacatatctagatcacattatatacctatacctttatatatctgtatctatccccaaaagttatattaatactacacaacaccctttcacaaacttcactcatatccatttccactaagatcctcaaaatcttcaaagtaaagaggttagcctaagttttagatctggaaatactatttccttcagaagacataagcccttctctacaaagatgccctacttagggctcctcttaggacacaatctccaggtactaaagtctttgactggtggaacatatgtctttaaaaagttatggatggcactgaagttaaatattataatctttctaattattttttaatttagttttttcgttctttggtctaacttcagagtctgaagttaaaattaccatgtaagtctattggacttttctacatatacgtcatctaattatgtttctactttttaaaaaactttcacgttatgtgtttgtatacacacacctttaatacatcactataatctacataaaataacataaagcaatgtcatggcttttttgtggttgttgttgttttttaagatggtagagtgtcacccaggctggaatgcagtggcaacatgagggaacagaacaaagctcactgcagcctctaacttttgggctcaaaagattctcctgcctcatcctccccagtaactgagacatcctccccagtacaaaaattagtaatctggctaattttttttattttcttagagatgggatcttgctacattgcccaggctggtttcgaactcttggcctcaaatgatcctcctccttgagcctcctgagtagctgggattacagacacaagccactgagcttggctggcaatgccattttaatacatagaatatatgttttatgttctacaagaacagaatttgatagattattaaatttttagaaagaaatataactcaaacatcaatagataggctatttattctatttcctaggccctttatggttactgatttgatcaggtagaacaaatgaataagaattaaacaaatgagaatcatttggaagaggcagaagtattaaaacaaaatcaacaactaaggtacgattcacatttttcctctaatagttaaatgatacaactatacaaatttgactattatttttctcatgttaattgtaagaatttttaggctgggcactgtggctaatgcctgtaatcctagaactcagggaggctaaggaaggaaaactgcttgaggtcaggagttcaagaccagcctgggcaacatagcaagaccctggttcaaaaaaaaaaaattagacaggtgaggtggtgcatgtctgtagttctagcttcttgggaggctaaggtgggaaggtttcttgagcccataagttggaggttgctgtgagctctgatgatggcaatgaactctagcctggctgacagagggagagactatctccaaaaaaaaaaaggaattataaagtttagattttttgaaacccaattagccagttaacatggtatgaatggccaaatattctaataaaataccaatatattttctaataacaattatttattatttacctgagtcagctgtggcaatacaaggattattacaatgttgtccctgatgtcatggaaaaggcagatgcaaaaacaaataataagaattcaaaaaagtatgtgtaacagaacagagctttactacatggctattaaggtgcacaactccagggggcacttttcacatcaaaatttttgtaaataacatgccctggagttatgcaatgctcactgtacattactatatgccacagcccaagtgctaggagaatactacctttacccacacatcccccagttcccctgccccacaattcaatgctcaggctcctttctttctctggaatccaaaagttaaatctaaacttgggaacaggaaacagaacaaagcccttcagacactatcagtggcagttgcacagtcagtatttccctgctgtaggaaaaagtggacatattaggaagatgcttggttgtcaaaacacaagcaaaattcaataaaaagaatgaaataattaagtacataagagaaatattaacatttatttaaccaaaaaccattaagttcgcattgctatattaaagtagataactttctggatattgctgtattaaagcagagtagtttccagaacaatgttaattactgaaatcagtggtagctatgtaagtatcccagttattctacaacctagatgaattggcacctattatcaaatgagtcaaatgtattcatgtctatcatctcactggttttagtgtcattttaatgtaacttaaatatgtcaataaaagtatatgagttttaaaaagaaaacctgtcaaaacacaatcatattagaaaattttcccattttccatctcgcccactttgctttggcaatacctgataaatcttgataaccttaacagaagtcagtaagaaattctcctagctaaagttccaaatcctagaacattttagcacttcatattttgttcttaaattttcacattgcctgttttttaaactcctatatctgactagcttctatttccatatttttagattaaaaattcatagtagacattagttacaactgaaataaatggtaacccctaaaaagcagtaaacattttcagagcactgtcagcttgaagataaaaagcacttaagttctagaaaggtttcacattctgtataaatcttggtgaaataatgttcaggtactataggtatcatacaatataagagaatgctttacctcacaaactgaaatctatggtgccttcatgcaaataaaaagaaaattaactaaaacctctgtttaccaagtaccaactataaatcaagggcagctgatctatgcattatgctgtcttaatgaaaaggacaaacaaaaacaaaaacaaacccttcaattgtgtggattccagcagagaagacacatactaaagcagaattctttctttattgaggcctgacattgagacactggagtatcatatattttatttaattatgtaaaatcaaattttatgtaattaggaatttctgcatgtcactattcaatgtatgtctgtatttgttttttaaagccatctagatatccatcttcaattaattattagtttggacatttggcaaccaagttaattattcaagaaatgatcccaagcttttcctgtctgttgttagccagttgaccatttctttcttcacttagaatttttaccagggattgagtaaagttatgagactatcaaaatctggtgttatactaccagttaaagctctaacaaaagacatctaggaaaaaaaaccattaaaatgatgttattaagaaccagaagccttaaagctcacctcagcctcactatttagacaaatctattatactgtccccaaatatctaatttaaaaaaattcaccaaacacttgttgagtgccaactatgtaccagattgtggtacatacaaatgaatgatgctgggctcaacctacacaggacaatggggacaaggaaattattaaatataaaaaaaataagttaaaatagactatattactttaggctactctgtgctacacactgttctctgttatatacagtaccgccaagcctcaacaaccctgccatgattaaatactgctattctcattttaaaggtgacgaaagtaagttttacccattggtagtaaataataagtctgatgacgtctaagccaatgagcttttcactacatagcatttcctcttgaacatcttattcgttactattatagctatgatcaaagtactaattaaccctgcctgggaggactcaggatttcattaagatttcaatgaggatctattttgtaagttacatgaagagaagggtttatgcgtaattcactgaccaagcacagtaactgttacaaaactgccacttaataaataattgatcaaagagtaaaccgatgacttttaaacagaaacttaaatgataaacaggagtctgctgaacaaaatggaaaaggcactataagccaagaaatagcatggataaaggcatggaaatgtaaaagggctctgtaatttaaggaagttttggtaagaaatcacagctagacagccttaggatgggaaaagctaaggtaaaaaacataggtttagaaccagatttcaaaagaccttgtagagttaactaaagtaactacctgtacatcctagagtctacagagacagcatcaggctttcacaagaggtttaatatgatcaggcttgtatgctacacggcagcaacatacagaatgtctggattaaggcagtgaggatggagcctagaagtgaagggtttaaagacatatctgaggtagaatagataagacttcacatgatattcaaatatgggaggtgaggaaaaagataatgagaataaaatcaagggctgtaacaagagggaagttagaagataaagatgctatttaattaaaataaatacaggttaaacaggcctgactgggaaaaataatcgcatcctagatgcctaataacatccaggcaggtatttctaataggtaagtaatataacactggaattgaaagagaagaggcctgtgctagagatttaaaatagggagattgaccaggcatggtggttcaggcctgtaatcctagcactttgggaggctgagacaggtggatcacttgagccgtggagttcaagaccagcctggccaacatggcgaaaccctctctctacaaaagatacaaaaattaggcagacacggtggctcacacctgtaatcccagcactttgggaggctgaggcgggcggatcacgaggtcaggagtttgagaccagcctggccaacgtggtgaaaccccgtctctactaaaaatacaaaaattatccaggcatggtggcatgtgcctgtaatctcagctacttgggaggctgaggcaggagaattgcttgaacctgggaggcagaagttgcagtgagccaagatcgcgccactgcactccagcctgggtgacagagaaagactccgtctcaggaagaaaaaagaaaagatacaaaaattagccaggtgtggtggtgcacgcctgtagtcccagctacttgggaagcagaggtgggagcgtcacctgagcccaagaggttgaggttgcagtgagctgaaattgtgccactgcactccagcccaggtaacagagtgagatcctgtctcaaaaaatatataagaaaatagggagactggttagtcttgggagtcagtagatttagcattcatttaacaaaaatgtactgagtgtttattgtaagcctgggtattttgctagacccagagaagagtctattgaaagggcaggagaaagatggggatgaatattgcagaacagaaaaggatcagtaaaagaaacagggaagtaacagtgccttacagtcaataagataatgggagaaccaaaatagaacggtgccaaaaaagacaaatgagcaaaaatgtttcaaagcagtcagcgggcaccattatttaattctgcttaaacatgctcaaaaggatgaaaaatgaagagaagtctttgttcatgttttgtgtttttaacagctttatgatatataatgtatacaccataatgctcacccgtttaaaatgtacaattcaacgttttttagtatatttacagagttgtacaatcatcaccatgatctaatttaaaaacatttttatcaccccaaaatgaaactccatacccattacccgtcattccacatcttcccttcctcccagcccctggcaatgatgagcctaccttctttctcaacatatttacctattctggacattttatataaatggaatccatacaatatgtagaattgtgtgactggcttctttcactcagcataatgtttttgaggttcatctatgttgtagcacatattggtagctcattctttttattactgaatgatatttcattgtgtagatacgctgcattttgattatccattcatgtactgatgaacacttgagttgtttccattttgtggggatctttgggttttacgatgagaaaactgaagtacttggttagctatctagcattcacttctctcctctttcctaataactgaattacaattttgttcagatatctatcactttttaaatgtttctctgactcatggaaagctgaccaaattatgataaatccggtcattctcagcagcgattggttcaggaatccagctttaagaggatcactgcataaattctgcctagcaaccacttttcaccaatatgaaatggaaaccttctattcagtggttgagacaagagttctttctttttcctgatggtctgacacaatgaaacatgtagatccagttgctggcagtcataaggcatccatgagagaagccagattggaaatagtttatacatccggggacagagaactgaaagagttacaggaaaatggagccagaagcctgccccaaagcctatacatatctgtacttcttataagagatattatacttcttcataatctagtgaagtcaggaagttcacttggtgcaagatttcttattacttgcctttgaaaccacctaacagatacatggattactggtgatgctgtgagcaatttgattacagtggctggaaggaaaagtagagagtaaaacacttatgctttggtggcaatggttaatattgatctcctcttcaaaaattttgacgatgaaaggaattagagagctaggatggcggtttaaagaaggtaaagaacagacttaagcatgtttgcagaaggaaaagacaaagtccaaagaattcaaagaagctgaagatggcattgggggtaggaggtgggtagcaggagcagggtttgataaagacagaagaggtatgatcccataaaaagataacatgatgaacttggaagtaactaaggtcatctctttctttgtggcaaaatccaaggatgtaagactctgtactttaataaattcagggctgaagagaagaaaaactaaagaccagattttcacctgattgtttgttttttttctattacgtagcatatttttgactaaagaaaagaatagaggaggtaaaattagaagaggtgccttggggaatacagaagaaagctgacaaaggaaaagtttaaggatgattaaatagcttatgaaggtccagctgagtttggaaaccattgaggtagcatcgatctgcagaactgtgtgatttttcctataccctgaccctgaccatacatagtaacctgggagaaagagtaaaaagagcagctgaggccaggtgtggtggctcacgcctataatcccagcactttgggaggccgaggtgggtgaatcacgaggtcaggagttcgagaccatcctggccaacatggcgaaaactcgtctctactaaagacataaaaaattatctgggcgtggtggtgtgtgcctgtaatcccagctacacgggagactgaggcaggagaatcgcttgaacctgggaggcagaggttgcagtgagctgagattacaccactgcactccagcctgggcgacagggtgagactcccatcacaaaaaaacaaacaaacaaacaaacaaacaaaaaacaaagcagttgaccagactcattcaagatttaggactgatttggttggcagaccaaaataaggaaggttaaggaaaatgagtaggctagtaagaacgcctgggatgactatgggtgataaatccatgatctttctggactttaataaaataaataacataggctttatagacattgactcattgggaaatcaaatttatcctgcatcccaagctacttatattgatgataattaatcaatataactggcttatgatgcagtataaatttgattttccaatgaaacaatcagtaattctatttaatcaatatatccagtccccttatttactgctgctatgttttcaacttgtactaaaacacatatagaataaaagaatggaagattatactgtacttgaagactttcttcagtcttcaaaatgataggatcactagccaggagatgaggatagggaggagaaggttgttgtaaataatcatgggactgaacaatctatacgcagagaccatctgaaggcttagggaggcaggacctcactcttttaagaagtatattacattatgctcctggaaagaggatgggaactaaaatttactgactgccaataatgtattaggcatgctagtacgtattttacatgtgatctcatttaattctcaaaacaaccatataaattagagatataacacctatttaacagttgaagaattgaggcccagaaggtgagtgattcagttactaagaaatagcgctagaccctcccaactagaactacccattaccaaaaattttccaggctactttggctaagacattcatatgaggttcattaatatacttcttatgacagttcattatattggtatgagtttaaatatctctttcataaagtgacagatataactataaacaaaaaattttataaattatatgaaaacctatcaacacacatttcaataaagaataactagaaaattcataatttttccagcattagcatcactcaaaattcaaatagcaaggctattagactaagggtaaggagttacaaggctctatcgcttttcaatgtataagtataactaagtactgtgtagtgcagggtcagtatttgtaagtaagtagcctgaaagctattaatattcagaaatatgtttagtaaccacatcacttgccccaaatttggaagaactacataagcatctacatgaagcaatctcatatccaagaaccactgctttggcatacagaacctttatttctacgcgctctctctctctctttctctctctctaagacaaggcctcactctgttgctcaggctggagtgcagtggcacaatcacggttcactgcaacttcaacatcgcaggctcaggtgatcctcccacctcagcctcctgagtagctgggactacaggcacaagccaccatgccaggggaatttttgcattttttgtagagatggggtttcgcccctttgcccaggctgtatttctctcaaagtcaagtcctataccacatttgttgctgttcttcttaagatactttgtaagtaacaggaagacaagaaaagaacaaaaaaaaagtcaccctccatagcataacatttttatctttaaataattttttaaagtttacatgaagaaaaaccctgcataatccatcacttcctctttttaaaccaaaactctcaggaaaatactgagagtaaataactgattttaactaacataaaagaaaaatatatatactgtactttgcaacctggataaattaaagcgttagcaaaaggtatgtgctttttatccactggggaaaacaaggcttattatgttacacttccaggtttttaagacagttggaagccggttctctgaatagttgctgtcatctcctagatactttctagtactttcaattttgaagcaattatttacattctaaagtgatttattttcctctctttctttgctacatttcatttcttctggttctcaatgaccatctctactttggcttaattatattcatttacaaatattttctgagtacctgctaccgtgtggaaagaactggttgaggtgccttaagaaatactcatatgaagaaaacacaagtctctaatctcaaggcacttaaaatctaataaatgggataaaataagcaaacaaaaaattatatgacataaaatccacaccataagaaaagtaaaaacccagagtgatagaaaggcaaagagtaatcacatttgttttaaagggaccaagaagctttaaagagcaagagatttttgagaaatacccttaagaagaggccaattttcaattgatacacaaagaagacgatgacattttaggcttttaggagatcttaagtaaaagtatagaggtctgaaaattggaagcagtctcatttagccggtccaatagaaaatgagatatgaaagataagttagagccataacataaaaaatcaggaatgaaaaactaataagcttatatttcactcatttactcacttgttcatttaatcaaaaacacatactgaataccaacaatgagtaaagacaggagattcggtcatttggtgatagaaagtcattattctcaaggtcctcaaaatccaataagagaaacagatatatgaagagataattacaatatatgcaaaaggtaccttagggacacagttgaagggcattatccaaagtaatagaagccttcttagaagtgagtaatccacaaattgagtcaaagagttaacagatgttaaccagaataagaaaaggaaaatcattctttctgagggaacagcattagcaaagccaaacaagtaagaaacaattgggtataagctaaagttaaatgtttccagaatttttggagcggcataaagcaagaagtgcccaaacaagaggctatagagggcaggggccagatcatgaagaatcattttaggagtctggctcctggtttaaaacctatgtgtgatttttttcaggccttaccatgggtagttacaaaacctttacctggcaggcctcacagagaaaagctgtactccccacatcagacttgatgtacagcgaatgctttgcatctctggcgggagttgcagctaaggtcttaggcctctctggccagttatgctctttgcacatttacattcctagccctgatgaattgattcttgggtctgtatctgaaaccttggcctaagatcctctccaggcatctcttcctagaactccttacttggagaggaagggaaaactctgaagacagtattccctactctgattcagcctgttccaagaccaccccgctagcccttcctctgacctcgtgtccataaaactaccagagtctttagtttcaagtttcttcaacaataagatgactctcacatctgcgcagatccacactaacccttgaaaagcatgccattctatggcgggaaatggaatggggagtcaaccccttccttcggatttagactcttgctaataccatcatagttaatgattaaaggcttaccctttcatttttggcttgttactttaattggctactcctacacctgacagttcaactctcccagctcagcttaggccatggccatgtcatgttaaggagcttgggttttaccctatagcaatggggagatattgaagagttttaagtaggtattataactgcagataaatagaaaattagactatagggaagaaatatcttaaatatcactttcacaagaaagtggaaaaaaaagtaagaaagttattggaataaacaacatgtaatgagagccttcaatactaatttttaaatttctatttttcagatttatcctatcaaggttttattgaaacttgcctaaaattgtctatgatacaaggtaggcaataaatataaatgaataagggtatgaaagaaaagctcaagcatacagccattttgttcacaacaaaatagtttccaaaccatgtgatgtacaaagttaattaaatgttacatggaaaaagtagacctataattgaagtagagatcaaagtcctaaagctaagtgtagagatgaaaaaagaacataggaaaggtccaataggtgatatatcacctcagcccagaaaggacatacatgtaatctactcacattccactcatctccctaagtcatgtaacactgcaaaagcaatgtgttccctggctgggtagccatttcccagcaaaactttaaactatacaaagaggcatgaaactatggttatcagctggccatatctgtgacagatgacaataagtaccaaagacaaaacagaaaaaagggacagaaaatacaagggaggtaatagggaacatgttaacatctcaagtaagatgcttagaaataattttctgaaagcaacctttgagcaaagacttgaaggaggtgaaggtgtcagttatgcagatatcttaaagcaaaaggatttccggcagggaaaacagtaatgcaaaggccctgaggcagacacacttggtgaaatgatggaatgtaggaggccattttggatacataaagaataacagagttaagtagaaatcaaatagtttctaagagggccaaatcatttaagtcttcataggttataacaagaatttgacttttattctctgtggaatgagacattagaagattataagcaaagaattgatgagacctgacatgttttaacgtgatcactccagctcctgcaagagcctggctgtgagtggaaagagtgtccagtttataggcttttgcaataatccaggagagagagacgatgtctgggaacaaatagcagcagtggaagtagtaaaaagtcattgaattatggatatatattgaaggttgagtcaaaagaatatgctaacagatcatatatgggatgtgagagaagaggaggcactgatattacaagtactttgatctgagaaaataaaagaactgaccctgagaaaaaagagaatgtgagaggaataggttttaataaagaaagtctaaaatttggttttaaacatgttttattcagggtgcctattagaaatctggggcagaaaagggctaactatttgccaaatcccttttcatcttcttcttaggcacacaactagaccatatttcccaatctcctttgcaattaagtatggcaatatgactgagttgtagccagtgacatgcaagcagaagtgattgaggcacacttccaaacccggccaataaaactttccacatacaactggccatgctctaccaccttccactgttttgatgcagatgaatggggcactcttggaagccaagaactaaggataatggagctataagatgaaggaaattatccaccagaaacatgttataaaatttatatgaaacagaaattatgttctattatgatcggacactgactgagatttggaatctatccactaaagcagttaccactgcccaaactaacacagatatccaagctgagatattcagtaaacaactgaatataagagtgtggagttcaaaggaaagaacctgacaggatatataattcgagagacattgatgactagtgtttacataatacaggtgtggactggctcagactttcaagcaagtgaccaaagctggagaagaaaatggaaaagtaaaagtacaaagagtaaggcctgtaccagctcaacaataaagagattgaaaagacgaggaagaaccagcaaggaattttgaagagaggccagtagtaagaggaacacctgtttactcatctcatattggcagtaagaagaaaacaagaaaaatacagtgtcccagaaaccaaatgaaaaaaatgtgtcaaggagaaggtagtaatcaaccatatcaaagggtatcaaaaagtcaagtaagaagaaaactgagacttgactattggatttatttatttatttatttaaagactagtcaatgactattggatttaacaatattgatgtctctggtgaccttgaaaagaacagcttcagtatatggtgggaaaagagcttgagtgaagcaagttcaagagagaataggagaagagaaactcagcaagtagaaataaatctttcagttattcaactgtagtacagaagtcacttaaattatatactggatttagtacattataaacatttgggggggaaagcatgaatgcaaataatccaccaaatggtactttacaaatgccatagaattttacaacataaagagattctagtagaccctgacacatcgtaagaatacactagatatagagaaatataatttgaaaagataaaaagtcaaaatcacaaagcctgcaaacttctaagggcttattcatgttcagttcattaacctgcaaaggcaagtttagtacattttgtcagcaagcttgtcaactagggtttatacttcaaatactgacactcaagtatcaatattcaactttgaggagaatcaaaaagttaagagaaagattaagaaaaaatggttcctgaaaaaaaattcattgatgggagctgaaatagctctaacaagcagcaatactatctatgttaatttcaagaactaaaatatgaactatctcaaaaaacctcataaagaaacaaatatgatttaacgataaaacacttaatctagacatttaaaatgaataatctggacatttaatctagacatttaaaatctagacttttaaaatgaataacaagtagcgctggctggacactggcctcacgcctgtaatcccagcactttgggaggccaaggtgggcagatcacctgaggtcaggagtttgggaccaggctggccaacatggtgaaaccctgtctctactaaaaattcaaaaattagctgggcatggtggcaggcgcctgtaatcccagctactccagaggctgaggcaggagaatcgcttgaacccgagaggcggaggttgcagtgagcagagattgcaccattgtactccagcctgggcaacaagaatgagacttcgtctcaaaaaaaaaaaatggctctatcaattcaaacaacttaatgtctatgtgagagctttcctatattccgcctgaggtacacagaagccatataggctacgcatcaattttcttttaccagttcattgctatagccactaaacctcgtctattaatcacaaagacacattaaaatgcactgttcggctaagcacagtggctcatgactgaaatcccagcactttgggaggccaaggtgggccagactgcttgagcccaggagttcaacaccaacctgggcaacatggtgaaaccccatctctacaaaaaatacaaaaagctgagtgagatggtgcgagcctgtagtcccagccactcaggaggctgaggtgggaggatcgattgagcctggggaggttgaggctgcagtgaggcatgatcatcctactgcacatccagcctgggtgacagagcagagcaagatcctgtctcaaacaaaaaaaaaagaactcttagattctgatagtttctcttcttgcctttataatcacacagtataatcagcttctgcaaattactattgttgaaagtttacttttcattattctgcttcattcatttagttatatgtgctcggctagggatatagcatggggaaaacaaatgaagaccctgctctcatatcacttatactcttgtctatctgaaagactctctgtcccaaaaaggatcttgcatggaaaaaaagtcatcttttagtaaatgaggattatgcaggctaacaaaagcataaatgaaatgtaaaaatattccaaagggttcatgagattccctcaactttgtttatattaggaaacagaaaaattaagttatttgagttgtagctcttctctttcaactcctaatctttggaaacctggaatagttttttattttttaaagttaaaaaagtataaagccctaagtttagaaataatttatataaaaaattagttgcaccctctcaagaacaagccaatattttcagtgctaatctcttcaaacagcaataaactatattatgtcctagtcagttcattagttttactgcaaatatatgacaagtaagctttctggtctgctatagcattttctttagctacagaagtgttaaaaatgctgtttattttaattatgtagtaaattcacaataaacattatgtatacatatattatgtatatgtgtgtatgtatatatatatatatatatatatacacacatacacacacatatatatatcctaattcagcagttttaatcaaaagacaaatatgcacttaagtctactaaaagaaataatcatgttagagagagagaacaccaagaataacctctacattttaatttgctggagaaataaatgcagccatacctggaaaaaatgcattaaattttaaaagcaaagtcattatttctaagttttataagtttattatcaatgcaagtttaaaaagaaaataaaatcacagagaggtacatgtttaaataccttatggtttcattttacacttctcatatcaggatgaagtcttaaaagtaattcaaaaggaaaatgaaagtatttgcccagacgatagagtccatatgttcttcaatctggaaatccattgggaaaaaggcttgagtttttaaaaactgaattttgacaattggaagctgatgtggctttttttccctctccaggaagatttgagtcattctcagagggaatgaaatagacctttatcaagtattgcaaagcttaacacctgtttaactccaaattacttagaaaacatttagttagtcttcagaatctcaaaataagggttgttataaacacttttcctaacagtaagatgttttttaagtttagcaagaaggcgtatctacatattcaagtctgtttatatttcatattctacagatatcaaccatcttgtaacagtctatttgttattactatacagattcctatataattttgttattcctaagattataagtaggctgtaattaaataactagttgaacatccatcataccattaggctccacaactgagggcagtctggttcttccccactgtttgtatgaatcccaagcttctagcacaagaagaagcaactagtatgcacttaaataaagcccatcaaaatgataaatatgtaccctactctgatcattctttcatagatctaaaatgaagctaacatattcaaagttaaaatgagtttgctctcaaaatcaaggtagaaaatagactggagttcttacaggagcctcagttttacacaacatagcacaaattggataacttgtgctccactactaatgtataaaattcctaaatgaatgtaatttaactacaaaaaatttattgtattcctattatgtaaaaagaaatttgctaaactatactgacatattaaatacctagattaaaaacgttaatgtttcgttaatggatcaaaaattacatcagagttaaagtaactacaatagtgtatttttaaaaaaaacatttctcaaaacatatacaaatggccaacaaacatatgaaaaaatgctcaacatcactaatcatcacagaaatgcaaattaaaaccacaatgagataccaccctactcctgcaagaatggccattattaaaaagtcaaaaaacagtagatgttggcatggatgtggtgaaaagggaatgcatatactctgctggtgggaatgtaaattaatacaacctctatggaaaactgtttggaaatttcttaaagaattaaaagtaggtctaccattcaatcaagcaatcacactactgggtatctatctgaagggaaatcagtcattacatcaaaaagacatctgcaagcatatgtttattgcagcacaattcacagctgcaaagatacggaatcaacctaagtgcccatcgaacaatgaatggataaagaaaatgtggtatgtatacaccatggaatactactcagccataaaaaagaatgaaataatgtcttttgcaacaacttggatggaggtgtaggccattattctaagagaagtaactgaggaatggaaaaccaaataccacatattctcacttataagtgggagctaagctacgagtacacaagggcacacagagtgatataatggactatggggactcagaaggggtaggaccagtggagaggcaaggaataacaacctccatattgggtacaatgtacactacttgggtgactagtgcactaaaatctcagacttcacctctatacaattcatccatgtaaccacttgtactccaaaagttgttgaaatgaaaaaaaaacttagagccacatattagttttgaaatttttttggagaaatttaattgtactctgctgtttgataaaaagtgctcaccagcaatcttatgttctggctcctttgcctccaacttctttcccttcttcggaaaaaaaaaaatgcaataaaataaaggataaagagtgcaaaagattttttaataagaactctcagtaaaagcaattgcatgaaaatggaaattactggcagtaagtggtctccaaacatctgctttgaaagatattttttataatgattcaaatgctctttttatacatgatctcccttatcatttaagctaatttttttaacttttaggagttgtatttttaaaaactgtgggcttcctatttttctttattcctcaacaaatgtttgtatattgtaagttgtgctctcatacatacttgttaaaaagcttaattatgtcactacataatagtactataaaagcaacacagtgtgaaaaacagcactagagtactagttagagcactagttagaacagcactagttctgattttataattaaatacctgttggatctttagcaaactcatataacctacttgggtctcagtctccttttcaataaaataaatgagctgaattaaataatctttacctccctaacaccttaaaagtgctaccattttgatatactacttaaaaaatatatttcatttttagttatactccatacacttgcctgtatgttcaaaatcattacttccagttcctcagaaatctcaaaaaatactgctgaaggaaatggaattaatttttactttcctattatgtatttctcttgggagtaaggaggacagaatgcaataaaatacaactatttgtgcagttgtgcgatgtcttagcttgtactgagggcaatgctgtatgcacccttttgatcaatgtaaagaaggtctagcatagataaacttccctacatggaaaccaaaacagttgggttgactttttctttctccttgccacctaaaactgtgggacatactagagatgaagaagtaagggtaaattaaacttttgtaagcatacaggaaagcaagcagcagcatgtttatttttctttaccctgttgaatgtcatgggctagaaagacactgaagttgtgaaggaagggaggcaacatgtttaaaaactcaataccaagttttataatgcaatggcctgtttagaatatttaaagatatggacatgagatgtactgagcacatgaaaataagtagaccatcaaaagagcagaaattatgaggaatttctaaaagacagatcatgtgtaactccagcactttgggaggctgaggcagaaggatcacttgagcctagaaggtcaagaccagtctaggcaatatatcaagatcccatctctacaaaagttataaaaagtagccacaatggtggcacattcttgtagtcccagttacttgagaggctaaagcaggaggatcattgtgcccaagagtttcatgctgcagtgagctacaattgtgccactgcacaccagcctgagcaacagaggaagaccctgtctataaaaaagaaaagaaatctagtaggatcaactggaaggtaaaatcccagacacatggaagataagtactcttccgggggaaaatgcgggagcttcagcctaaaggcaacagatggaaacggtgggtgaagacaacagtcacctaaatcaatcttttttttttttttttttttttttttttgagacggagtcttgctctttcaccaggccggagtgcagtggcactatctcggctcactgcaagctccgcctcctgggttcaggccattctcctgcctcagcctcctgagtagctgggactacaggcgcccgccaccgcgcccagctaatttgttgtatttttagtagagatggggtttcaccgtgttagccaggatggtctcgatctcctgacctcgtgatccacccgcctcggcctcccaaagtgttgggattacaggcgtgagccaccgcgcccggccaacaatcttaaggctgatttcctctctccccttcccttacttctgctgggctgcaagcaagattgcccacccttggctaaaggcatatgtactcttggattagaagaagggcagattcctagctagctactgatgaccaaaaagaataggaagcactgctggtagaagaccattactgacaaatctttcctggcggtacattcaaaccttgccccacaagggcattctgacagtatttaacaaaatttgtattgcaaataactccttttgacttagtgacttcacttctaggtatgtatcctaatagaaatgctcacacatattcattcagaaagatgaatctgacaagattgcagcacctctaaataaagaaaaattagaagccagctaaatgtccaccagtagaaaagctaaaataaactatatattttcatactattaaatagtatatgcctgttaaaaaataatgaggtagatatacataaaatagcattgaatataagaaaaaagttagtagctaatatactatacacagcatagccacatttatatttttaaaatagtgtgtttataaatgcaaaagaggaaaccagaagactatacatcaaactatttacctcctcaccactaggagactttctgggtagggataagtactaaagagaattttcacataataattgaatattttacaatgagaatgcatttctatataccccttatacttgaaaaagaaaaaaaaatcttgccaatttgaatcgtgaactgagaagaatgttccccacctagataagaaaattttatacaatttatctaacaaaaattttaaaataatatccacagcactctattttttattttatgttattattattatactttaagttttagggtacatgtgcacaatgtgcaggttagttacatatgtatacatgtgccatgctggtgtgccacagcactctattaactttagtatgttatagataactgaactaccctctaccacaacatacacataccaaaaaggtacaaactatatgaacagattacattattgttttcatttcgtaaacatattcaagtaaaatgtttttaaaatctatttctttttaaaatttaaatgtcattcatgcaaatacttgttttgtgacaactatgaactaactgcattctcatggtttcctagcacaataacaagaaatatacatgtttgaaaccctgactgttgctcaaacaatttgaattcagaatatgaaaatgcagtcattcactgcctttcctctgtataacaatgccaaaccctacctccctatcaaaaaaaaaaaaaaaattgaaacccaggctgggcaatggagtgagagactctgtctcaaaataaaaataaaaataaaaataaaatccccacaaacacaaacactattcccttttcactcatacaagggcttatgtgtttcccttctctaagttctgctttctcctgtcagaattctattctctcccttgtcactatatgaacaggaaaaacatatcaaacctaaagttatccaaagagaagaaaaatttctaccataatcttgaacaacaaatgtgtttaaatattgtttagtagaattttatactaatgtttatacatgtttataaactacacatatttatacaactaatgcgtatataaaaataaattttaattaaaactagataaaggaattaaaaatgtcagatccacaaaaaaagcatgtgatgtaaagcatatctttactcaattttgccactccacattgtatatatatttcaaaacattatattgtacataaatatgtacaacttttgtcaattaaaagtaattaaggtttttaaaatgtcaaacacattttttaacttacaagtttttagataacaaagaatacaataataattcaaacagatgatcctgaagtgattttcagaaagaaacactcattttatattggattgtttggctttttctatctatttataagagctctttgtagtcaaggaaaataactagaaaataggtttttggaagacacaaattgaaaaatgtatgttaatactttagaacaattaccaggagtaggaaatagtgggtgagaagtgctattactttagaacaattaccaggagtaggaaatagtgggtgagaagtgctatgtcaagtatggaatgtgtcgaaatctccagaagaggttttctaactataaaggccacttgatcccccacaatcaccttttgaaatctactacaagcaaatttaccaagagatatacatcatacaagtgaccagagtggaggcagtgtggatgccaactactgcttttagactacaggtgactgataaaataaagccgtatcttcaaagctttttcaaggagcaggcagaattatattttatctcaaatgagcaaaaagtaacatttttagaatagcagaaaatctccaagttatctaaaattatttgtaaaatattatatgcagctatgctcaatatcttaatctaacttgaaaacctgctccactgttcacaaacaatcttgggtttcacagaaagagatattataatttaacacagtgcctctcaatcttgcatgagcattagatttacctgggaagctttataaaaatattcatgcccaatcagcatctcttgtggtggaatcctggtaccgagattatatatatatatatatataattattattattttttttttgagacagtttcgctctttgttgcccaggctggagtgcagtggcgcaagctcagctcactgcaacctccacctcccgggttagagtgattctcctgtctcagcctgccgagtagctgggattacaggcacccaccaccacacccggctaatttttgtatttttagtagagacagggtttcgccatgttggccaggctggtcttgaactcctgacctcagccccccaaagtgctgagattacaggtgtgagccacagtccttggccggatatattttttttttttggaagctttccatgggattctaatgtctagccaggatgaaaaaacaattggattaatcaaacgaactggcctggatgctatatattcgtctttgatttttctatgctactgagcagctgtggaaacttgggtatttaacacaatattctgcatcttaattctctcactctgtagtatgaactgacctggcttaacatgatgcccagggatccttttggctttaaagttgtttgattagacccttcaaaactggcacctacatttaacatctaaaaagtgcttcaaataaaagttaaacctcataacatatatactaaaattttacagttaaggttttccacatttgcaaatcccatgtgcagaactgtatttatcaaaataagttttaatagcttgttattaagatgttgttactatgtgtttatcaatacaacattaattcctatgaaatcctatccttcactgaaaaatatgaagtcatcttcatactctaggggtacattttcagtatcacataccattaagagttattctttgtggtaacatatatcaagaaaaaaacaaaaaagaagagactgtagtttttatgtaaagggttttcatcaaaaccaataactaatttatagaaaaaaatggcactagactttagaaattaaatacatatgtaaagaagtattcatttaaaaagccatttttaacaaattaagatttcactgccacatattagataagatttaaattgcttctgtttaaacacttggaaatgggattaccattagaagagcaagaaaaccttaattccgtatcaaaaactttaattaaagctatataacttgtgattaattacttatatttgattcaaattgaaagacaatacattcttttttaaaagataatattctttttttaaaacagtaactcacttcttctaaaatcatacatacatcaagatggcaacacttatgttaatgtaaaataatcacctttcatttatcagaacatattggcaagggcaaatttttcagtcatatagttttgtaaaacaaaatgtaagtttatgctcaacatctcatattagccttaggaaaacaaatctgaaaaaaaactaaagcacattttaaagctacatacaagtcattttgggctgctcagtattcctggtcctatttcaacaaaacacaaaatgagagcctgactgtgtgctgaaaattaataagtatgcaaataataaaacttcaatataatattctaaggtactcctgactgtgtgctgaaaattaataagtatgcaaataacaaaacttcaatataatattctaaggtactttgacaaaaaaattctacaataaatgacatataacaaggcttaacttagttctatttttatggtataaatgttaaatcattattagtataaacacaagggtagttaatcttgaaaatattttctatagaacatcacttgaattttgaattattttcaaacatgactttaaaattaaggtcaaaattagcaatctaaaatactgtaattaaaagaaagcaaattcccaaaactaaatagaaagtatattcagccctcataagacatatgaaatatttacataataatatgtaagatatatttcttgttgcaacaaattatgcaaggttggaattagtcttgatgcaaaatgatattaccaattcttttcaaatattacagttcttacattccttttacatttccaaatcataagactacttaatagatgtaaaaatataaagtactggaatgtcttttttgccctaatatttaggaagaaaagagaattctaaggaataaaacattcagttaaaaatatgtttccccttctactttgaccctctttgaagtcaacttttcaaggtccattatcagatggaatgcagtagtaaagattttatgacactatactaaatttttattatttcattgagaaaaattgtaataataaaaaggattaagatctatttcctttttcgccatgttaagcttttaagctttttttgctttcatcaattccaatataccataaatcaaaagtattcttcttttaatcccaacagttgacaaaataatgcattttacacttgaatatgctcaaggaaaaaaattaacattctttatcatttcccaacagagacagttaatactctaaggccacattaatagaatctttctgccattgtagaaagtttgatagcactcctatttcaatgtctgaatttttctcctttttttgacaaagacaaatgattgccatcaatcaagatccaatcgggtatagagagagtcaggcaaatgcatcactctttactggttttcttgttatttgagcaggctttgctccatattattttatagaatgatcaaaaaacagccataagatagatcattcacacccactgtaaaattaactttcacgaataatgagttttaaacctcagataatgtatatgttataccaacgatattactgagttcattcctggctagagattatgtaaatgataccatatgacctttatcattacaacaggacatgcaaaacacatattatttcatacatcattttaaagcaagtcagtttctaaaggaaaaatcatcatttataatctgcatggtgaagtgttaaagttttgaaagaaagaagtatctctgaaccatgagtccttcttttaacctgttacttccattgaacataaggcaataaaacctactagttcaaaaagatgtacttgatttctgtatttctttgttgagctactgttaatgtcatttcaaaaactcatatcatgttggctaatcaacactaagttttaaatggataacaagtattaatatacacttctaagtcattcctctcaaaatttttgctgttgtttttgagaaagggtctctgtcacccaagcttgactgtagtggcttgatgatagctcagtgtagcctcaaactcttgggctcaaatgatcctcctgcctcatcccccaggcaactgggactacagctcaatgtcaccacagctgttttgtttttgtttttgttcttttgtagagaccagatctcactatattgcccaggctggtctcaaacttctggtctcaagcaatcctcctgcctcagcctcactacgtgctgagattacagttgtggtccactgcatccagcctcaaaatgtcaatgtaatgggttaaggaagtaaaggaaaacattccaatactgtttctttagaactatattctgccaatcttaaaatactaaaaatgtaagtataaactacaacggcccaccaattataaaatagctcctttttttaaaggtataggccaggaacagtggctcatgcctgtaatcccagcactctgggaggccaaagcaggtggatcacttgaggtcaggagttcgagaccagcctggccaacatggtgaaaccccacctctactaaaaatacaaaaattagcagggcatggtggcacatgcctgtagtcccagctacttgggaggctgaggcaggaagatcacttgaacccaggaggcgaaggttgcagtgagccaaggtcacactactgtactacagcctgggtggtgacagagcaagaccctgtgtaaacaaaataaaacaataaaaaggtatataaagaaatacatattgcaagccaggcatggtggctcacgcctgtaatcccagcactttgggaggccgagctgcatggattgcctgaagtcaggagttccagaccagcctggccaacatgatgaaactccatctctactaaaaatacaaaaaattagctacgcatggtggtgggcacctgtaatcccagctacttgtgaggctgaggcaagagaatcacttgaaccctggaggcggaggttgcagtagccaaggccacgacattgcactccagccagggcaacaagagcaaaactcagtatcaaaaaacaacaacaacaacaaaaacatattgcaaacccagctcccttctgttgtaattccacccccatcatgttgacacagttatccacagaatcacccaagcacaaagcctgtatatcatctttgaaccctccctctccttaagcttcttacaatgaactttcaattgttttttcctaaataattttcaatccatgcccactaccacagttctgccatatctcatgcctagtctactgttattataacacctatgatttcactattggcagtgtttttcttcttcaaatctataatcaaaaagaactaccagaatgatctatcctaaaaagatgtgttgacatcaatagtttactccacaaatttcaatagcactacatcccttacagcagcgatgcccaaaggggatacataacataattcatctggatgttggaagataattgcagagaaaaaagtcagaaattgagctttattaatatttaatatatagtttaattctggcatccttattcagtctgaatatcagtaatcatgtcatatgtgatatgcaattttctcatattaacacatactgtagtttatgtctacttaaacaggtttacagattacactgttttaaacaaatacagtatttagaatactttgcaataagataaaaagtgaccagaaattacctaataatggttgaatagtatgataatactcaattatcttaaaaagccaattattccaaatttgctaaacttttctgtggcagtgcactgcaacaagctctgaaacagctatttgaaaataaacacataaaatatatacctttaacataaaggtagcattttaactctaaggtaactaccttagaaaaacatactatggaaagagatgtttagaaatatttccatcattatgtgatttttgttgcctaaaactatcttaaccacctataaaaactcttaaatttgtattttaattaaaacaaattagaaacagtgtcataacctagtgtgtcaatgggttttgtacaaacataatgtctgtaaaaacattaaaatattaatacaaatatttgaagagaaccaagagttttgtaaagttagatagtccttaaaatattttctttggctttattttatcctttaatttctcctagaaatagtggcaatattcaacacttgctttaaagatttcagagtttagactattcttgatctttaaaaaaaaaaaagtaaatgcagagaggataatattatctatcttataaggtaatttaacaagatatatggacttagtaaagggatctctaactagtaacattaagttgctgctgctactactaccattcctaacatttttattagtatgtagtacaccaaaaaagggacttgtttctcggaatgagagtataaaacattaggagtaatttatgagaaaattggagtggaaggcatccaatttaggaacatgttaagttatataggaaaaattgatttatcattttgaagcaaaccacaagaccctctgcatgaatggcatatatgaaaatgttttaagatgagaataaattgtcttaaatttcgatatgtattacataatcaccttccaaaaatgtaccagcaatatactcttccatatgagaatgtgtatatcccaaatgtcattaacactgagttaatactggccttattaatctttaccaaacttacaggtgagggatatgaaagagaggagactgttgaatatgaatccaaggttttaagttagattccaatactgatgccattaataaaaacagaaaacaccggaaggaggagagacttgcaaacagagatgaatttagttgggacatgttgagtttgaggggccagaagtacatccacatggaaaaatcaaaaaggttctgaaaacagagatgtggaactaagaagagaggtaaagatcagagtgttgatttgagattcctgtatagaagtgatggttgggctgggcgtggtggctcaagcctataatcccagcactttgggaggccaaggcgggtagatcatttgaggtcgggagtgtgaaaccagcctggccaacatgttgaaaccccttctctactaaaaatacaaaaattagccaggcatggtggcaggcacctgtaatcccagctacttgggaggctgaggcaggagaattgcttgagcccaggaggcagaggttgcagtgagcagagatcatgccattgcactccagcctgggagacagagtgagactctgtctcaaggaaaaaaaaaaaaaaaagtgatggctgaggtgctagcagagattaggatcacaaaagaactaatttagaaaaagaaaaataccagcaacagaatttttctgggacaactctaaatagcagaattaggcaaaagcaagctccaaggacacaatgctcatcttgctaatccctgttacagtgatgcctggcaaagagccttgctcagagtaggtattcaataaaaacttgttgcatgcactatttaataattaataagagacagagtcatcagaacaaaagagaactagaagcaaacaagtcaaataagatttttttaaaaattagacaccattaggcttggtgctcccaaaaacattattcaaccacaatgaactactttccatcccatgggcttatcctagctctcctcctatctctctctcatgtgtactctctcatgttgcccctgtcctgtggcatcttccccaccaaccatgtttcaccctatctgcctgctaccaattatcatccaacaactaagtctcagcttagatgtcagctcctacaggtaattttgatctcagcaatttatacttgctgcatcatagcagttattcaactactttatcattgcctgtttatatttttccccctccaagtctataagctctgtagtttttatacctaatcatcttagccactaagttagagtttctttctaggccattccttttctcaccctatattctctcatcctatgatctcatccaaacttttggctataattacccacatgtatgtgaactccaaaatttatatacccagcgaaaatctccttttgagttctagagccatatatctaaatgtttacttgctatatagtttagcagttaagaacatgaaatcaaacacagtatttttaaattctgggtttgccagttattagctatgttattagctgtgtgaacaagacatttaacatctctgtacttcaactgccttacctataaaatgagaataacaataaaaagagaacctaattcataaggttgttgggcagattatataaaacaatatttaaagtgcttacaatagtgctttgcatataagaaatacttcttgagtgctaaatattgtaataatgttaattcagtgaaggcagtgattttcatttcttttgttcactgtctaatccccaaatctttagacaatggctgacacactactgaatagttgttgaataaatgaatgaataaatccatctcaatttcaacacagtcaaaaccaaattaatgaccttccccacaattagtccccttcaatgtgaaaggcatcgtagttcatccagttgtgcaagtctacacaatctttgttctacacactgcagtcagggggttctcagagcataacactaatcatgttccccatcctttccatcataaaatctttatggctccttattcctctttagaaaagcacccaatatggccataaggcctcgtgtaatctggctactatcaatatctccacagtacacacatccactcactatccacgttccagctatataacctttcttctggtccttgtactcaggcttcttgtttaaatacctctgctggtcggatgcggtggctcacacctgtaatcccagcactttgggaggccgaggtgggtggatcacctgaggtcaggagttcgagactagcctggccaacatagtgaaaccccatctctactaaaaatacaaaaattagttgggcgtggtggcgggtgcctgtaattccagttactcggatggctgagccaggaaaatcacctgaaaccaggaggcagaggttgcagtgaaccaagatcgcaccattgcactccagcctgggtgacaagagcaaaactccatctctgaatggagttttcccgtcttcatctagctacctcctactaactcttcaaattccaattgaattgttacttcaaagataacttaccagagctctttaactagatatcaattgaaggcattcatcattcagttttgtcattcttcatagcattttcacaacagtaaatttgtatctgttttataatattaatagctgtctctccttctggataatgaaatctatgtaaactgggaacatgtccacttctgtttattatgggagctctgaggcatagcatagtgactggcacataacaggtgaatattcactgactattcaatcaataagataaaagccaattaaatttttttatcttattcaatgaacaagataaaattcaagtaaccataggatttaaggaagcagtatgaatagggatgaagaaggtaactataaattcaattcatgacgtccatttgaacagtaataagctatcccacacaatactattgtgaaggatctgacactacctgttcatatatttcttctttgcattcttttttcagattccagaatatagtctcacctgtttttctccctcattttcctttctgaatcttggcttctgttctgcagtggacaggcatttgcaaacatacccctaaaggtggaggaagctaactgaccaaacaaagaggctgataaatacagtttctcagaaagaaacatttaatagggacttaaaacagaagccgtagtcttaagcagtcataagactctagagggtggatccctgcaccactgccccctagacccagggcgtatataccatagagaaagaatgtgtaggacaattgaagttgacctctcagggaaaggcaagcatgctatgtgaatctgcctaagcgggggatttatgatcaaggttgtttggacctggggcaggatttatggtaacaatagataaaagtagaaatcttagaggcatttccagaacagaggttaatcagaagtcaacatggcagattagcatccgagacggagtttctttagcctccacagcttctctacttttcctttcaaattctgctcctagattctaccataaggctgtttttcttacaaaccaggaatatcagcatgactcctgcaactaaaaccatcacctatgtgacaatggtaccaaatctcaactctttactccagatttttctcataagactgcgttttcaaactgtttaataacatttccattttgcttacccaaatatatgttaatgtgtcccaatattaaaaacagtatcctatttctaacttgttccttcttctatatttccataccactatcattattctctccaccattttccctctctgcctctaacacataacacccccaaccatctctcttcttcctaccagggtttgtctttcatctccacaggttttaaggcttgttgtatatgaacttgttaaattcttatggagagggcaaaccttatttctttttttattttgaaaatgtttcaaatttgtagaaaagtggaaaatggtaacatgatgccccattgacaacagatactttctataaacaaggactttgttctacataataataatataactgaaagtcaggaaactaaaactgatacattattaccttccgattttaagcaccactcaaattttactaattaccccagtaatccttatagcaagatgacacagctgagaatcatgtctggcattgagttattatgtctctttattctctaacaatctggcagaatagttctatagtctttcctgaaattttaagacactgacatttagatgattacaggtcaattattttgtagaatgtccctcaatttgggtttaactcatatttcttctacatttcttctacatgattagactcagactaggcactctgggcatatcacagagtgatactatgatcttcttaatagatatagcctaaaaggaagcacatggtttcagtttctctaattactaatgatgtccattttgatcacttgatgacatggtacctaccaagcttttttttttttttttttttacgtgaattactctttctccctttgtaattaatgaatattttttgaggaggtactttggaactatgcaaattttctgatcttcatcaaactttccatttgttcatttatttatattagtatgatcttctattttattcaacggattataatttattgctatctattagataatattatctattttgacgtttgactgttcactgatttggccagtgggattcttttcaagctgattctttttccttcttacatgtctccatcattctttgagcacttctttacattctagcacaaaaaggtgctatgagctcatcttatagtttccctgccacagtcctggaagtagccattgctccacagagccctggtttcaatggagaagatcaaggctttaggtgcattcattgctaccaggatgtcactattcccaggccccctcagtggacaaagctaggaaatatatccagctgggcacgatggctcatgcccgtaatcccagtactttattgcccagctggagtgcagtgacacaatcacgattcactgcagcctcagcctcctaggctcaagcgatccttctgcctcagcctcccaagtaattggcaccacagacatgcactactacacctggctaatttttaaattttgtataaagatgaagtattacttttgttgctcaggctggtctcaaacttctgaattcaagcaatcctccacctctgcctcccaaaatgctgggattacaggcgtgaactatcacacctggcttaagtttattttttgatgccaataatatgtctagaagggactagactaaaacattaacagtggcttggaaaggatggtgtgattaaaggtaattttttgttcttcttttcatcttacgtgtatttatattttctacagtaaaaatatattattctcataattatataataaatacctgtaggaagcatatggatctctgacattagtaatgaagttgaattattccttctaaaaaaaaaatctaagctttccacatcgtgttacagtggtacattggcaagtatcagtttgccacaaaaaactggggtttattttgggattatctgttctgttccattgatctatacagctatcctatactaatagcatggtgtcttaattactgtatctttaagttttggaattaggtagtgtatatactgaattttgttgtgctttttcaacattgtttcggctgttgtgacagacagctccaacatagcccgtaaatgctccctgcctcctagtgttcatggtcttgacaatccctccttgagtaatttgcttctaaccaatgaaatatggcaacatcaaggggatgtcactccaaaaattaggttacaaatgactgtgatgtccattttgctagatgactcctctctcttgatggctttgatgaagcaagtaagccaccatactggagaagtccctgtggcaaagaactcagggccttagtccaagagccctcaaaggattaaattctgacaacttcataagtgaacttgaaagtggatacttcccagttgagccttcagatgagaacccagcctgcggacaccttgactaaagccatatcagagatggtgggccagaggaaacagctaaatagtgcctggattcttgacccattgcactatgaaataataagtgcatgacgtgttaagctgttaagctttagagtgatttgtaacaaagcaacagattactaatgcagctcttctgggacctttgtatttccatttatcttttgggttccgactaccaatttctattaaaaaaattctgaaacttacataggggattatattgaatctatagatcagtttggggcatactagcatcctacattatactgcataatattctatttgtttacaatttctttaattattttttttttttgcaacctctgcctcctgggttcaagcaattctcctgcctcagcctcccgaaaagctgggattacaggcaagcaccgctatgcctggctaatgttatctttagtagagacaggttttcaccatgttggccaggctggtcttgaactcctgacctcgtgatccacccgcctcagcctaccaaagcgctgggattacaggcgtaagccaccacgcccggccaacttctttaattattatcaatttctctttaatttctctcagtaaagctttatagttttcagtgtaccaacattatacttcctggtattttattctttttgttggcttaaagatttctcacctatatttatgagggacctcatttacttttaacaataaaatgctattttcaagaacacaaaactggggttcagagaatacttaagaacacataaggacatgaacagacacttctcaaaagaagacatttatgcagccaaaaaacacatgaaaaaatgctcatcatcactggccatcagagaaatgcaaatcaaaaccacaatgagataccatctcacaccagttagaatggtgatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgcggcattattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaactatcgcaagaacaaaaaaccaaacactgcatattctcactcataggtgggaattgaacgatgagatcacacggacacaggaaggggaatatcacactctggggactgtggtggggtaggggaaggggggaggggggagggatagcattgggagataaacctaatgctagatgacgagttagtgggtgcagtgcaccagcatggcacatgtatacatatgtaactaacctgcacaatgtgcacatgtaccctaaaacttaaagtataataaaaaaaaaaaagaaaaaaaaaaacaaagaaaaaaaagaacacataagcaaaacgtgggaataatgagatctaaattaatctatctaaaaataatgcactttctaccccacccgtggtactcaacagattcagaactgttccctagagtgaataatagaaatctgcaaggaaagttttggttgtcacaaatgactgagtgctacaatgatttagtgggcagaaggagcaaaaaaaaaaaaaaaaaaaattctagacattccacaagaagaatagttcaataataataatggtcctagatcctacattactttagaatgttctactgtatatcagtgaaagtgacaaactagaagataatctgagcctatgccccaaatatatatatatatatatatatatatatatatatatatatatatatgtgtgtgtgtatatatatatatatgtgtgtgtgtgtgtatatatatatatatatatatatatatatatatatatatatatatatatatatttagatggagtttcgctcttgctgcccaggctggagtgtaatggtatgatctctgctcactgcaacctccccctcccgggttcaagcgattcttttgcctcagcctcccaagtagctgggattacaggtgcctgccaccatgcccaactaattttttgtatttttagtagagatgggatttcactatgttagccaggctggtcttgaactcctgacctaggcaatcgacccgccttggcctcccaaaatgctgggaatacaggcatgagccaccacgcccggccccaatttatttttaatttcaaaaaatgcaatcattgtgtaaagtaaggtaaaaatgaatgttgtctgcttagtactacaccagtatctattcaccacttagaaaaatcacattatagacaatcacacatcccttgtagcaggacaaatcatacatcatacctctatcagtctgatttgtacctgtcacattcacagtgacctatatataaatacaagcatccaattatgtcttttagcatagttatgttcgtacttatggaacaatgaaatgcatactacatatatttttaaatattttatttctcttgttatggtatagagcactgttgattaatattatttatctagaaaaggtctatttactattcaaaaataaaactcatagataaggaataattgcaaactacctgtgatataaagagcatgttaaatttcagagggtgaagaactatagcattacattatgctacctcctaaatatatctcctgctcaccataatttctggcactgccatagttaatactccttttatctctggtctagtgtcttttgacagcctcctatctagtctccatcacttgaacttcccatccaatataatttacttattgtcgaaatgttactgcttttcctttaaaaaaaattattatccaggatataaaataggatcaagatacttaagttcctactatcctacagaaaaattccaaattctccaccatggcatttaggatcgcttatgacctgcttttatctgtttctagatttgtctacaaccactctctatcacatattatatgtctaaaccatgctttctggactttctcaaaattttcatattttctcatggcaatgccttgcatcacctactccctattctaccatgacttcccatcatcattcctgtccccatcttttgtccgtctggaattcacatactgtgtgacatcctactctagaccctcctcaaatctatgtcctatttcacagagatccaaaagcttacattcagactttttaccatacacatttcgcagtaatataattaattatatgcttaacattcccatgaatcctcaatatcctcaaaatgtaataagaaatttttatattccctaacaatttttatcattggtttttcatatttgttgattcaatgaatatttaactaattttccactctcttcatattctaactttcttttctgaaattctagacattaattacatatatctaaatacataatggcatcaaattctaatttactccacaaaaacacaggaatcacaactcttctaaatatgtcatgatggaaataatgtagtcagtcttgacattcatttctttattaagcagaatctcagcatctttcacacagttaaaataggagaataaatttgcaaataaggtttcatttgcctattttcttttttttctttgcagcaaaaagattaaaaacattttagcccttcaatgtttaagttcaagtggaactatctaaacatcacatcaatcaatacctttatatgttcttctttatatgcacaagggcaagaattagtttaggggtataggagttggttacagtcattatgctctaatgtggcaaacattagtgtcaatttaagtaaactctaaagggttatgaggtcaaaatgcaagactgcataatttatcagatcaagcaaatcactttgaaagtacagaaataagtgaagcatgaggctattactgcctctcatgaataaaggttaataccaatgtttatttattacacactggatggtatttgctatctaaactttatttattaaaataagtattttgctacactgtcatattttaaactactgagtcaaatttaatttacagcactgtcttatactaatacaattaatacagtattctaagttttaaacaaaaaattgaaattgctttggacattttgattagtaaaatatgttacctgtaaaatatgaaatctcacttttgcatcaagacacaccaatgagcaattcaaaagcacaagaatacattcatatgtaaattctgcatgtatttcaaagttgtggtttattatttgttcttgttgtttggtatttctacatagtattttcttatgcacaaaaaatagaaagttgcgggagaatggtataacatactaggccatcaaaaaaagaaagataaagataagcttttaaaattagttgttactctttcttttatgaaagaaaagaatggtattttggttttccataaattaatactaaaatattcatattccattttctaaggtaaacagtaacatgtgaaatgatgtaatagacataatagctgtgaagagtacaggaaaatatattaataggaaagaaatgttacttttccagaacaaatcttaaatgaaatggtgtaattagatgaagggttatgtgaaacatggcaatatacacaagcaaaatcacaatgcagatcaattctgttacttttacattttactctgcatataatatattgaaaaatattatttaatctaaattcaataagatatcaagatttcctcaaaatcaatgttttgtagtcaaatcaactcaaataaaacttcacagttataagacagataattaaactgtattgaagtagatgttttatatagcaaatgttgtttattatggttacaaacacacacataaggaggcaaaagaattactctcaaagaaaaaatgttcaaattctaaagcattggaatagaaaaatgtaatgttatattcgcatcattattgaaatgtagctttaacatgacacttaaaaaaattaatattctagtgatttgtgcaggacctgtatctttcatttaacccacataaaaattttgtacatagactctcttgaagggaaatttaaagttccccctattttatccatttcaaccaacataaagatttcaaataacaacttcaacgcacaagtagtccaattccaggctgggcatatctaaatgaagaaaaaaattgatctgtcatgaataaccattccattttaggaaaatgcagaccattagagttcatttatttattccacaaatatgtactgaatatctaccatatgccaagcactaaggagacaccagtaaacagaagaaattagcaatcaaagaaaaaattaatttataataaaatgtcataaaaagtattatgaaaaaataactttaccatgttaatgcaggctaagagatagtgatggaggcacatagatgataagaaaaggctgacataggaaagtaggtggaagaagaatgggcaaagatgacatgtgagtaaataacctgtatgaagaggatatgtaagctatattgacatttggacaaaaatgctgcatgcatgaagaacatgtgcagaagttctaatacaggagcatggtatgtttactcaagtaatagcaagcagtccagtgttgtcagagcaaaatgatctagtgctcatctaagatcagatcatccagggctttgtacatttcaaaaagatagtttagctgtaatataggataaagagataaaagtggcattaggaaagtaagaatcagcaaactgttgctgcatagcctatgagctaagaatggattgtaaattcataaataattggaaaaaaagatatttcatgatgtgaaaattatataaaattcatatctaagcttccatgaataaatttttattggaacagagccatactcatttgtctaggtactatctgctggttttgcactacaaaagcagagtacgtggtgctctcatcacttagcactgatgctcagcacatttcagatcatactaatgtagctatagatgaccgtgtttcaaatgtcacacatatagccataccacattttatttttattttcttattaccagtgtgtacccatggtattaaaacataaaaaagagaaacgtagactttaaataacatgtttttaaaggcatagtggagtctgaattattttgttttagaattaaatgttaaagcatttttgtttagtatgcagtaacacgatagctagtgattttaaaatataatacacatcaatattaccaaacaaagcactcattataatattgctaatgcataggaatgcagcagtgaaaaacttagaaaatttaaaacaaattatctcatcaaaacagaatctcttcagaaaaattaaaaatgaaaataaggctgcaattaaagcaagcttctgagtgattcttttgttagtcaagcaaaaaaagtcatttacagatggtaagttaattaaactgagtttcatttgacagccaaagaactgtatccagagaaaacaaaattgtttaagaatattatagcctttcagtgaaaacagttgcttaaggagttgaggacattgaagcaaaatcaatagacaattaaaaataaataaataaagcaaatgattccaaatggttttccttggctcttgatgagatcacagatgttacctacataatgttccattgttgtttattcaaggagtaaatgactattttgaagtgattgaaaaacgagcctctgaataatctgcatggaataactatacggatgattttttcaaagttgagaaaacaaaaatttagtaccatctgaagtggaatctgctaggatgtcttataacaaatggtgttaaaagtatgtatgggggagaaaattgaacaacttacaaagtttgtgaaaatatacggtatttaaagcataagcttagtcactgtatcactcagtactctgtattactcaggtaccctgcaaaaaatattggaatttatcatgttttatcgaaccaggagtgtcatggtgaacttcattcacttttttttcatggtcttaaccaatgtcatttccatgcatttttctcagaaatacaagtggaatatactaacttgctcttccacacagcaattcaaaaaaaagtttttttttcttgagatcctgtctcaagaaaaaaaaaaatcttaacagtggtaaggttttattatgattttccgctaagggcatagactgatttttttttttttctgagaaaaaaataactactattatcacacactaaatggttttagaaattagcttttactgaagacataataatgtttcttaataaattccatctaaattacaaggcaaaacagcccatatatgggaaatttacactgcagtaaagtcatttagatgacaacactgtttgaatcacaagtaatatgaagttactttatatacttttctgtgctattaaaagttaaaaagaagtgagattgtcattgtcatacaaatttgcagctaatacattttccagctcaaacttcaatcccagaagtatttttcagatactgatgcaagggcaaaggaaattcccatatttcaaaatccatttaaatgtggtactgcggagcttctactcaaatatcaattgcaactaattaacctataatgtaacggtatgctaaaaggcaaaatcaagagaaaaatctaacaattatataaatgccttccaagagataaacatgctcaattaacatcccatgtccatagatggacattaataattgacaatatttatctgtgtgaaaacatattttaaaagatgaaatccataaaatattatagatcatattaacaggtgaatatttgccatctattttgatgacaggcaacagtaactatgaaccccaattaagtaaaatgttacccgcccccctcccaagaaaaagaaattcttctcattagaaaacccattacagaaaattgtactcaatagatatattttaaattttatcaataaaaatatattaaaatttgctttctgtcttgttacacaggtatttatataatatcctttatcttgccttttgacccaaaaatctaaaatatttactatctggcccattatagaaaaagttttacaatctctgatataagaaaataatgatttttctctagaccaggcaaagcagatgatgggaaatgtccagattctggctatatttttatggtagaaccaataaaatttcctgacatattgtggggtatataagaaagagtgaagacaaagatgacttcagggttttagcatgagcaacgagaaggataaataacagttattgccatgaactgaaactggaaaggctatggatgaataggctggagagtggttcagtattgacatgttaagtttaataaatctaccaaacagaagtggtttaggccaattagatacagaaatctggaattcaggagaggttatcttagcataagatacaaatttgggagtcactggccaataggcggtttttgaaacgttggaaatgaatgagatcacaagggatacttggtaaataaataaatgtcctgagaactgagtatcagggcactaaaacattcaccatttgggaaggtaaggttgatcaggcgaagtcaacagggtgtggaacaatgtctaatcaggtaggacattatgctatcttgaagcaagataaccaaagtgttagcagaaggagaaaatgatcaactgtgtcatatgtcaatagataagcatactcactataggttgcacataccaaattcaaaaatctggaatttgaaatgctaaaaaatccaaaatttttgagcacagacataacatgcaaaagaaatgctcattggagcatttcggacttttggattaggaatgtttgagcggtaagtataatacaaatattccaaaatatgaaaaaaatatgaaatctgaaacacttctggttccaagcatttcagaaaagagatattcagtgtgtatgtgtttatataaagcatagacagtagtgattaacagaacgaagaacatggtcctgaagcaccagaaatgtttctcctttaatctactaatcagtaaaactaatattttagtaaaaatcaggattttagtagtggtgctcctgttcatatttttccatcacatataataaggacagttctggaaaccttgtcaaatgccttgcagaatatgtcaatatgtgtatatcaagaattaaatgttcatattttttaacttagtcattctatttctgggactatagcctgaaaaaaaaataagctaaagtaggaaaatgctttatgactaaagataaaaacctttttccagattatatctgtaaaaagtaaaatgattactttttctttttttttttttttttttttttgagacagggtctcatgctgttgcctagactagagtgtgcaaggcataattattgctcactgtaacctcaacctcctgggctcaaataatcctcctacctcagcctctgtagtagcagggaccacaggtgcataccaacacacctagtagcagggaccacaggtgcataccaacatacccagctaatttttttaaattatgtgttgtagagacagggtctccctatgttgcccaggctggtcttgaactcctgggctcaagcaattttcccacctccttaaatgctgggattacaggcatgagccaccacactcagctcttactttatgctttacactgaacaactcaaagttccttaaagatgtgatgctgaattgttttcctggcaccacactctcagcctaactaaaaagttagtcattactttcaaagacccctccataatcgagatatttatctacatctattattgtggtttatcatattatatcagacatattattaatacgtctttctcatctattgtaagtatccttcctgagagcagggccctgtgcctagcagagtgtgaggttcaataaatgtttactatattcaattatccagtgagtaacttgtaattcaatgttctgagaatagcaggtatttttgctttgtttaggacataaggcaaatgtagagaagtaatagaaaataaagagatacccaagcagcatcaacatttatgagctaggagaaagaaggaggcagtgaggacatcagaagagaaaggaacacaagtagcaaaaaaaaaaaaaaaaaaactagaaaagagcgagatgtgccagaaaccagtggaacaaaataacttgacaaggaagtggtctacacaaacaaatatcataaataaacaaaaattgtaatacagtggttttgacaaagaagagctcacaagacctctgccagagcagtttctggcagacagcaagaggctgacggatgaacaggttgaggccgcagaaagttcaagatctaagaaacctgactgaaggagaaaaaaagagagactatgcagcagactactgttatttagtggttgtacaggaactctacttaaatatcacaggatatttaactacctggattccaacaataaaagtctgcaagctttccagtcattgtgacaatcaaaaacatgcccccccaccccacatttctaaattaccccagaaaggatagagtactgcctctgattgagaacccttaaatgccaactcatgctaaaacaggagtctctttcccatgagattgtttttatggtttaagatgaagcttattagcattttagaaaacgttggcaatacagttacaggggacagtaagtttggggacaatgccaagtagttgagggagctgaaacagagccacgaggcctctattttttcagagatgagttctgctgagagtatccatcacactatagtttcaagtacaacttcctactttcctccacataatcaaatttcttaaaagagatcttctctcttactcctctttagtaatcactcactcattccctaaacctttataatctggcccccactttctccatgctaccaaaacagttctatgataaccagtaccttcttggttccaaatctaaggcccttttcttagacaattttgcttctgatcaccttatagcattggtcactgctccttcttaagaccacttcttctcccaccactgtcctagtttgggcacttgttatctcttaaactataaaatacctctggcctctgccttcccttcagtttctcctaacatttacccattttacaaatgacaagatcttcctgaaacatagttcttaaactgttcctggctcagtaattttaaaatggttgagagaacagaccaaatatcttggccccaatatttaagatccttgacaatcaggtccctgcctatccttctcattttatttctcaccaatctggtttacataccactcgttctagatgagcaattagaactgctgagtgttctctgtacatgctcttctatctgctttctacgctttcacttatcttccttcaacctgaagtaacgcttttgcatcgcatggtcatatatccagttcttcttcacactttgatctataactcctatgtcaaggattccctgacctcatagctacaagcaatagccctacccttcctaaacttccaaagtactttatttgtaccttttttatgtcacctttaaacctgcattatacatttcatataaacatcctgcctctccaataaagttcactaggaactattacttactaagcattaatatcaggtacttacatatatcacactgtatcctctcaatataattgagttaccccaatttaataaatataaaaaacagaggaataggaaatctgtataaactagcaaatactcaatacatattttttaatgaataaattattattccaagatgaagtatcattcaaaatgtttacaaatatgcgggtgtgtttcactttaagtgaaccaaaggtagagctccaagaataaaaaatatttaagaaaagagccaataatagataagaggttgcgttcaaatctaatattaacagttactacttaacttgagcatatatgatttttcaggcacacactttctatatgctaatttattttattctcataacaatcctttagaatagatattgttttcactggccaatacttggtgaggttaagtgactcgttcaaagttgcaaagccaggatacacataaagccagcctttctggctttaaattctttgctctagagtagttagtgagaaggcccaaacagcttaagcttgaaagaaatacaaatttgggcaagtgcttctttttgctttattaatattaacatgtggacatctacaaaacgtaataaggcatttaaaaactgagaaaattttctacttttcccaatttctataaaatgtaatatgttatttaataaccaagaaaacattctattttttcctaatatctctaagcagacattaaaacttgttatttggaatgaatatttgtttccaaatgaacaatgaaagtagtatataataagtaacaaagcaccaaatagagtaaggaatctcaaaactcaaaactgaaaagcattgtaaacatcttcttattttaaaaaacactcacagagtcagcaaaaggatacaacaaaatgtataaattgtaccaacccactcatgctaggactttcctataaaagtttctggtcagatagtaaactgttaatatttgaattgaagtttatgttaaaatgctataaaaaataaaatttatgttggtaaaactgaaattaactgccatgaatgtcagtactacttaccatgatgttttacttcattagacaaaaagaccaaaaaaaaaagtctacttctatttacaataaataaaactaatccatattataatccttccacatgaatcattagaacttggggagagaactaaagaggagaaaccatcatgtctattattactgtgactaaatgggattaactaatcctcatgaggtaaagttatgaattaagtggtgctcagaacactaagaaaatttgtggggagagaatgcaaatagctccctaattatctacagcctattaacaagcaaaccttattacttgcaattaaaatcctcttaaattttatggcaaaagttcattgaaacgttgaaaattatatgctaattattatactgtaaagcacatgtttagtgtatacttttactatgggctcaataaataataaaatatcaaattcaaggtgatacagtaactaaatattttactagatggaaaacaccttggtatgaagccagtatgggctcctgttacaatttcacagcactatagcaccagaatatccccaataacaactaagttctatgtgcacggtgacacggctatcctgttaaccactgaatggaaccccaacaccatcacagtacctggcatagataagtacttaagtattaattgaagaaataatgttgacggatgaaaatatatatttggtgataatatcatctactttcaggttctgaatctttaagcgctaccacagagttcattcattcattggtttctgtaccaattcccacacaataaatctataatatttatgaaattatttatgtctaaaagctcccatggcaacctagaccaagtttgtcttgttcctaactgtatcagagcacccagcacaaataaagccatcaataaatatttgtgaaataaatgaatgaataaatacaagaaaaaaaaaggatgttactacagtttgcaactgcctgggacacaatattcttcagtaggcaatgtattatgttctaagaacaataagcccatgctacaaatggtgtgagtcatgaaacagtgcccacagatgggtcttttaactgaggactcccccagctcccacctgattgatgattgattgattgatttagagacagggtttgctctgttgcccaagctagagtgcactggtgccttgatctcctgggctcaagtgattctcccacttcagcctccgaagtagctggaaccacaggtgcatactaccacactcagataatttttgtattttttgtagagatggggttttgccatgttgcccaagctggtcgcaaactcaagcaatccagctgactcggcctcccaaagtgctgagattacaggtgtgagccactacgcggggcaccaatatcattttcacacctatacaagttaggggaaaataccttaatacataaaggaaacaaccaatattcagtttccctcaatgtttctctctctccctctcctcttcccctttcccccacctcttaacagctagtttgttcaaatcaggatccaaggtccataaaatgtgcctgttgaggtatttcataagccttatcatatacattcctcttttatttttatatttttgacatctatttgttgcagaaactaagctgtttctgcatgcatccagcttttttgcattctgaatttttctaattatgctcttgttcttgtaacatgttccccctttccttttgtttcccataaactggttattagatttaaaacagcaatttctattagaaatacaatgcaaatcacatatacattttaaagttttctaacagtcacataaaaaaggaaagaaacagataaaattaattctaataatatatttttaacaatatattcaaaatatcatttcagcacacaatcaatataaaaataaaatatttagattctttcatcatttgaatattaatccaaatccagtgagcattttacaacttatggcacatctcagttgagactaaccacatttgaagtgctcaacagccacatgtggcaaccatactagactgcacagtaatcgagacttgatcaaattgaggttagacacctaacgcctgcttgtttcctttttggtgatgttaatattggtctgtgaatctaggtactgtcagctttgtctattcattaggaaaatccatatcagcttctttcctaatgattttagtagctattaatgattatgcccagatatcaatttttttttgctattctaattctattattccttctgcatttattagctgcaattcttcaattaaaaagaactggccaggcatggtggctcacagctgtaattccagcactttgggaggacaaggcaggaggatcgcttgaggccaggaattcaagaccagcctcggcaacatagcgagaacctgtctctacaaaaaataaactttctctcatcaatgtggttatataagttacagtacatatagaaaaatgagataaacatatgattctcaaaatattaggtttttgacattaaaacctgcctccccagaatactctgaaggtaatccataaagattttgtaatgagtatcattatgaacacatggatttaaacataatttgccatgctttaatctattatactttcattcttttacttttagactgtctcatcttctggatagtaaaagctacttcattttacctcctgcaaccctttttacctcaccccaggaccctctggcctctgacatagcaggttggtccaggctgaccttgcccaatcaagccaattattttcactggcaaatgatatttagagacaacaatctaggtgtgagagggcccgctgctaccagattgtttgtcatttctaggccattccagtaggcaaagcaagaaaaaatactgtttaactttaaaaaatgagttttacagatatttccaacagaaatttaagataaaaggggttttcgcttctcgatttttaatacatgttcccattttctcttgctctgaaaaatcttagtttccaataccattaacataattacttatttgctttacactatagggtcataactgtatttcagcatgtatcaggaattcattccgtattttttcataaatacattgaaagactgtcattttgggaaaattattagaattaagttcagagtaacaatagcaatactactactaagaataatcaataatactccttctctggagagaaagaaggccccactgggaatcttcagattactgagttctaaagttacctgaaataatttgcctctatgtagtatataatagcaaattaatttatttcctttggcttccaattcagccattgatttaaaaatttttaattctattttataattatatattaaaagtaaaatctagaaaacaaggtttattgagaaaagtctgttgtcattgttttttgttgttgagacagagtcttactctgtcacccagaatggagtgcagtggtgcaatcttggctcattgcaacctctgcctcccgggttcaagcaattctcctgcctcaacctcccaagtagctgggattacaagtgcctgccaccatgcctggctaatttttatatttttttagtagagatggggcttcaccacattggccaggcttgtctcgaactcatgacctcacgcgatccacccatcttggcctcccaaagtgctgggattgcaggcacgaggcactgtgcccagtcaagaagtctattttcaattcctatctctctaccttgtctcttctatcgccttaaagtcattttttttattatactttaagttttagggtacatgggcacaacgtgcaggtttgttacatatgtatacatgtgccatgttggtgtgctgcacctattaactcgtcatttaacattaggtatatctcctaatgctatccctaccccctccccctacccaacaacaggccccagtgcgtgatgttccccttcctgtgtccatgtgttctcattgttcgattcccacctatgagtgagaacatgcggtgtttggttttttgtccttgcgatagtttgctgagaatgatggtttccagcttcatccatgtccctacaaaggacattaactcatccttttttatggctgcatagtattccatggtgtaaatgtgccacattttcttaatccagtctatcattgttggacatttgggttggttccaagtctttgctattgtgaatagtgccgcaataaacatacgtgtgcatgtgtctttatagcagcatgatttataatcctttgggtatatacccaatactgggatggctgagtcaaatggtatttctagtcctagatccctgaggaattgccacactgacttccacaatggttgagtcagttaaactagtaaagtcatttttattagttttaggttaaactttccattttaaaaatataagcaaatataattacatttgcccctccccattccttaaaggattatatattattacatatatccttttctaccttgttttgttcatttatcctggtgatcacttccaaagcagtgtatattcttcattgtgtaaatgtaaaacagattattcagcttccaacactggatggacatttttatcctttttagacttttgctattatagatagtgctgtgataaatagccttatcatttttgccaccaaatctttaagacagattcctagaactggggttgctgggtgaaggaataaataagtgcatatgtaattttggtagatactgctaaattgctttcactacaagcttgtgttttctccagcaatgtacacctttttagcaagagcaatccactcaatgggcattgactgaaaaactgacacttggcaaaccaaaagtttgctgtcaagatatacaaatggccagtgctgtttctgtcttttcacaccactgacaagagcaatgcttatcaatttatttcactcaggacagaaacaaatagcaatggaaatgaaaaataattatcatttaggattgtctaatgataaagttttcatatgattttaaaataccaaattctatttaataaaaatcatggtgacatggaacctcaagggtcttccaaatagctactttccaaaggttctatattactgtattgtgttggggggtatttatcgccaactgcccctcctaaaacatctttttgtattctctcccatcgcaaacctagtctaacttgtaggatcttcacatttgtggggaggaggttagagggtagggtagaagatgtgtgatcagattctgggttttggaagggttttttgcttctatttgttcacttctctattttcaaaacgtctgccatttgcactccataccactcatcctaattgtagctgccattgctgctaaaatccactacacttccaacttctatgtttgcttgtttttggtgttgctttcattttgttaggcttctcagcccccaagtgaaaggtctaattttcatatcaagagcatcagccaaacctttgattttaatccagtagcaaaatgatgaactgaatgtaatacccttctcaggaatgctcatttctggctgggtactcaggagttgcttttatattgttagagaaggcttattttgtttgtgttgttgtgggttttgttttctttcttttctttttctaaatccagaggttagataaaaccagtcttcaaagtttactactttgccatactaacacagttggcgtaaactgtctgatctctgcctgcacaacaaagctaccttttatcagactgtgaaaccacctttcatggctgccacagaactactcagaacaacacagtctacaaaaatattcctaagacatttactatgataaaattcccttgattgcagaagtagtcattcagacaactgtaagtattactaaataaatgtttattgggcactataatattatactaaaatgtaagacccatgaaggcaggaaattttgtctgttttattcactactagatattcagtgcttagaacaatgttgcaaacagtgaaactcaatacctattacaaatatttattgaatgaataaataaatgagcattattcataaggcaccatgaaagtattatgagtagaaacagtatctgccttaagaagctgctaatttgattagactaggttaaacatataaaaaggcaaatatgtaacatatataagccaaatgaatggagttgacatcaatgttgtaagagcccatagaatgggaatatcatcacccagtggaggaatctctactcacatttggcttgtcataaaaagtagtactcagcttagcacagaagggggaagtacaagtgtatgaactaatgtgagcaaatatacaaaatcaggaaatgatgaacagcaatccataagacagacttcccttacgaaggagacatgtttttgtttttctagttttgtttttaaagcaaagaacattttacgcttaaagtgtattttttaaaaaaacaaaatataatttttctttataattaataattatgctaaaatgcttctatatcatataagcaaacaaaagatgtttttagtaataacctctaggggttaccattttaatatcaacatgacttgtttcttacatgtgtaagcatttaacattgtgttcacaggtaaagaacaatatttattccatttattctgaagatttacacctcaaattatagggaaaaatgattaatttccatagaaacatgggttaaaaaacaaattttttatcctttcaaaatttctgagatgtggaagcatttaccattgtatttatatataaagttttaaaaaaatacaagaattcatagtacagtttccccaaaactaagattattaatattttaaaagggggttttaagattcttaaagatataatagagtagaacaaagtactttaatgtttcgtttcccaaaaatattaaaaaactgagattttttaacttaatagtaataacacatgtatgtttactatgtgcctgacactactcttaagtgtttaacatacatttttaacagtattaataatataagatttaacagtttgctttttttaagttattttcttaataattttaaggtgcttagttcttacatttaatgttttatgtgccattattttgcttttactgcaaaagaaagatctggctcccaaagataaaggagatttttggtaaatggtgaaggtaaagaaataaatgacccacttgcctagtgtgtaattacactgcctgagattgtaacaatctatcacatgaaggaggatgacaccacgctaaggggtgagtcaaaggagatagcctttgactaactacgggaccctgacgatcgatactccacagatattgtgctctcaaaaacaattgaattctaaaaaagtttgaaaatagattcccccccttcttttgatactgatcagagacctatcttgaccttattctggaagagtaatactttcttaaaaaggtatatgaaatacataaatcgtttctatctctggactgttctttcaaatggatatttaacacattcctattaaaataacagtctgcaagccaaaaaaaaaaaaaactgctgaaatctttccttattagataaatatgccttcctgattggctgttatcaagttatcataatacttagcacatgacaggtaagtactccaaaggctcaaaacttgaaaaacctatcagaaaataaaagtctccctctccctctccctctccctctccctctccctctccctctccctctccctctccctctccctctccctctccctctccctctccctctccctctccctctccctctccctctccctctgcctctccctctccctctccctctccctctccctctccctctccctctccctctccctctccctctccctctccctctccctctccctctccctctccctctccctctccctctccctctccctctccctctccctctccctctccccacggtctccctctcatgcggagccaaagctggactgtaccgctgccatctcggctcactgcatcctccctgcctgattctcctgcctcagtctgccgagcgccgccacgcctgactggttttggtggagacagggtttcgctgtgttggccgggccggtctccagcccctaaccgcgagtgatccgccaacctcggcctcccgaggtgccgggattgcagacggagtctcgttcactcagtgctcaatggtgcccaggctggagtgcagtggcgtgatctcggctcactacaacccacacctcccagccgcctgccttggcctcccaaagtgccgagattgcagcctctgcccggccgccaccccgtctgggaagggaggagtgtctctgcctggccgcccatcgtctgggatgtgaggagcccctctgcctggctgcccagtctggaaagtgaggagcgtctccgcccggccgccatcccatctaggaagtgaggagcacctcttcccagccgccatcacatctaggaagtgaggagcgtctctgcccggccgcccatcgtctgagatgtggggagcgcctctgccccgccgccccatctgggatgtgaggagcgcctctgcccggccgagaccccgtctgggaggtgaggagcgtctctgcccggccgccccgtctgagaagtgaggagaccctctgcctggcaaccaccccgtctgagaagtgaggagcccctccgcccggcagctgccccgtctgagaagtgaggagcctctccgcccggcagccaccccatctgggaagtgaggagcatctccgcccagcagccaccccgtccgggagggaggtgggggggggtcagcccaccccggccagccgccccatccgggagggaggtggggggtcagcccccccgcccggccagccgtgccatccgggagggaggtgggggggtcagcccccacgcccggccagccgccccgtccgggaggtgaggggcgcctctgcccggccgcccctactgggaagtgaggagcccctcagcccggccagccaccccgtccgggagggaggtgggggggtcagcccccccacccggccagccgccccgtccgggagggaggtgggggggtcagccccccgcccggccagccgccccgtccgggagggaggtgggggggtcagccccccgcccggccagccgccccgtttgggaggtgaagggcgcctctgcccggccgcccctactgggaagtgaggagcccctctgccaggccagccgccccgtccgggagggaggtgggggggtcagccccccgcccggccagccgccctgtccgggagggaggtgggggggtcagccctccgcccggccagccgccccatctgggaggtgaggggcgcctctgcccggccgcccctactgggaagtgaggagcccctctgcccggccagccgccccgtccgggagggaggtgggggtgtcagccccacgcccgccagccgcctcgtccgggagggaggtggggggtcagccccccgcccggccagccgccccgtccgggagggaggtggggggggtcagcccccctgcccggccagtggccccgtccgggaggtgaggggcgcctctgcccggctgcccctactgggaagtgaggagcccctctgcccggccagccgccccgtccgggagggaggtggggggggtcagccccccccgcccggccagccgccctgtccgggaggtgaggggcgcctctgcccagccaccacccggtctgggaggtgtgcccaacagctcattgagaacgggccaggatgacaatggcggccttgtggaatagaaaggcgggaaaggcggggaaaagattgagaaatcggatggttgccgtgtctgtgtagaaagaagtagacatgggagacttttcattttgttctgcactaagaaaaattcctctgtcttgggatcctgttgatctgtgaccttacccccaaccctgtgctctctgaaacatgtgctgtgtccactcagggttaaatggattaagggcggtgcaagatgtgctttgttaaacagatgcttgaaggcagcatgctcgttaagagtcatcaccaatccctaatctcaagtaatcagggacacaaacactgcggaaggccgcagggtcctctgcctaggaaaaccagagacctttgttcacttgtttatctgctgaccttccctccactattgtcccatgaccctgccaaatccccctctgtgagaaacacccaagaattatcaataaaaaaataaattaaaaaaaaaaaaaaaaaaaaaagtttccaaatgagggttacagtgtataccctgaacctgatacagtacttaataaatagcatgatttgactatgtaaaaagcaaacagaggccaggcatggtggctcacacctgtaatcccagcaatttgggaggctgaggcgggtcaatcacctgaggtcaggagttcatgaccagcccgggcaacatggtaagaccccatctctacaaaattggcctggtgtggcggcaggcacctataatcccagctattcaggaggctgaggcggaagaattgcttgaagctgggaaagccaggaggcggaggttgctgtgagccgagatcgtgccactgccctccagcctgggcaacacagcgagactctgtctcaaaaaaaaaaaaaaaaaagaagaaagaaagaaagaacttttacaaataaaaaaaacttttatgtccattaaatattttacaaaataattctacaggataaataatcacattagaattgtcttaaaacagtgcatcatgttttattttatttttatttttgagactgagtctcactctatcgcccaggctggagtgcagtggcacaatctcagctcattgcaacctctgccttgagggttcatgtgattctcatgactcagcttcctgtgtagctgggattacaggagcccaccatcacacctagttaatttatttttttatttttttatttttagtagagatagggtttcaccacgttggccaggctggtctcgaactgacctcaagtgatccacgagcatcggcctcccaaactgctgggattacaggcatgaggcaccacgcccagcctcatgttttatttttaaatacttgaactgtatctccacatgattcctattaccatagttataattaaattcattaagctatatcaaaaatttttcaaattatattttacataatttctgggatgtttgtatacagcattttaagtatctgtaactacaagagcaagtgtctaaaatacactttaaagtctgaaagagattaagtggaaagtaaaatctcatctaaatcccaataattattttcttttcacagaggctaatattaacaaatataatgtaatccatgaaaaatcatgattattataatatgaaagattataaaattaaactttttagaaagttcagaattttgtattgatactatagcatttgctattcgcagaggatgacaggtatttcgcaaaaatgtcagtacgagaaggatattacatgaaactgcaagatgtcacctctattctagagggttgtagcaacccactccctcccaaagcacacccttgttaggataaaagaagaattaccagataaataggctgtgcctcaaaccaattaaatccctgggggtgcaatccaggcaacggaaattttttaaaagcttcctacattccaatatgtagacaaggttaagaactactgctgtatggtatagatctgtttgcaaaggtgaagaagtttgaaagaagtaggcaaaaagagtgaaagtgtaagataagaacactattggataacaaagatgagtatatttcactccaaaatctacaaaggatttgtgaggccagtacctcaggcctgtaatcccagcatttaggaggctgaggcaagaggcctgcttcaggcctggagtttgagaccagtctgggcaacacagcgagattctgtctctacaaaaaaattaaaaaattagccatgggtggtagcagtcttagtactcaggaggctgaggcaagagaatcatttgaccccaggaggtcaagactgctgtgagccaagattgtggcactgcactccaacctgggtgagagagtgagaccctatctcttaaaacaaaacaaaacaaacaaacaaaaaaaaacagataaaatctacagaagataaaaggggttagatcagtagaaagccctcacaaactttacaaactagcaatttaattacattaacaaattattctgttaaaatacaaatacaacttgaggaaatttattgaattgctcacattcagaccttgatataaaatttatttaacaaaatgtaacctagctaaaataagtcacggttaatgagaattctgattgtctatagggaactaccgtttcagagaataaagggatctagggtgtagatcttgaatttccagaaaaaactttgaagtcactgtatatatatgaaggcaaaggagtctacagaagaccaggctcaagtaagatggcaaaaattatatcaagtaagatgtcaaattgatgacagaaggtgcacaaaagagtatcatttccattactgtctaccaaaatttggtaggatgtcatatgatataaaaataccagacttattttgaatataaaaaatttcataaactcagtttattcctgtgttttcaattgaacttaggacagttctactcaccccacttatgctgaaaaaaaaaaaagaagagaaaaaataaaagtacaaaagacatccatggaatctcatatcaatgttccttcttttattcagtatcaaatatttaagaccctggtagtatatatcaggtattggaccagggatgaaaacatcaaaattaatgttacgggcttctactctacaagtactttatagtatactgggaaaaaataaaatgtgtaccagactataagtgctttaatacttgtatttatcaaacgctatgagaacacatataagcaaagaaatatctaccaagtaatgcttctgagagaaagaagaggcaatggctgataaagtacttggacacagtcacatttcggaaggattctgaaagacaaatgggaactcaccaagaagataacatgggaacagaactgaaaacacaaagaagagcatgagaaaatataaagaaaaaataaaaggtatgtctggatcgcaagttgcttggtgtggttagagatgcacgaaaaagatgaatggcaaggaagatttaaggaatggcactaacaagccttgaatgtcatgtcttaggtttttcaatgaagtggttttaataatggtactaggaaggctgcaatagcattgaaagagagtaaagacaaggaaacccactggtagactacttgcagacttctataaccaagggtttttcaatgaatctaggttgtaatcataaccgattgttataatggggtatagatatagatcatataaacaatggaaagctgttctgatctcagaatagacccttgagttttctcttttcaatgaatacctaattatggcttgacatattatcgaaaacagaccaggaaatgtataatggcattacctaatacaagtgtatcataaagcataatagcctgtcactgacatttcacttctttatttctccatttatatatcctctaatcacatgcagtgtggatttcatgccaccggttcacaggatgtgttccctcaaagtatatataatccaaaaactcctaaatccttagcccctaagcttttccctaacatttcacatatgacacaggaattaacattgccatttaagattgagtaaactgaggtttagtgcacattatataattccaaggccaaaaaactactaattaaaagtgcttattttcaaaaacccagaactgtatgaggccaaaaccgatgatcattcttctatgccaaacttacctcatgagataattttcttctactcatgaatagattacaaccttaagaagcctagcaacttcaagttcattttcttttataaaataaaacattacataagttgagaactttttgagacataactcacatataattttatgagttttgacaaacacatacaattatgtcaggacccctaagataccatcagattcaattattcacaaggaatcacaggattgagtcatcttcatggctatgacttcctgaatcttgtcttagtacaaacaaaatcaacaaagggagtgccatggtacaagatctagagaaaccaggtacaagcttccaagagtcctttccttacgcaatcacacaggatgtgtctaattcctccaggaatttcacacatatcacaatgtgtgaaatgtttgtcaaaggaaccttatttagagactcagctcccaaggttttcatttgggactggttgcttagggaccctctgtctagtacatgctgtaattctagactcccagaaagaaaactgatgtttacaatcaactacatcgtttggacaaacagtctaagcacagtgagccactcatcatttatgtaaagttctatatcagtgtagggacctgtttactattcaaattcccagatgccagccaagggtccaccttgtaactgaccctttgtaaaggatgagacgctacgttaacacttttctgcaaagttatataatcaccaacacaatcacgatacagaacagctccatcatgccaagaaaaaaaaaatctttgcacccctttttaatcaacctctacaaccactggtctaatttctattcttataatgtgcctattccagaatgtcatacaaatggaatcaatcacatttgcacatagccttttgagtctggcttctttcacttattgtaatgcacttcagattcatccatgttgttatatgcaccagtaatttgttcctttttattgctaaataatagtctactatggatataccacagatattttcatctgccacaattcaatatggttttctccggtaaactgtatttctacttcacttgagtaaacatctaagaactatatgaggccaaaacctacgatcattcttctatgccaaacttccctcatcaaaacacgcagtagaatggaggaacctcaaattactatgctgagtgaaagaagacaaaaaagaagtacaaattgcataaaaccatttatataaaattctagataatgtaagcttatctagagtgacagaagatcaatgactgcctaggggcagggagggtgggagagagtaatcacgaaagggtaggaaaaaatctctagattatgatgatggtttcatggatagacataagcagagtcaacactcggtatcctcaggttctgcatctgcagattcaatcaaccacagactgaaaatattcatataagaaaacaataaaaaatagcaataaaataaaaaataggtcgggtgccatggctcacacctgtaatctcagcactttgggaggctgaggcaggcggttcacttgaggtcagggattctagaccagcagtctctactaaaaatacaaaaatcagtcaggcatggtggtgtgtgcctgtaatcccagctactcaggaggctgaagcaggagatttgcttgaacctgggaggtggaggttgcagtgagttgagattgtgccactgtgtactccagcctgggcaacagagtgagacaccatctccaaaaaagaaaaaaaaatgcaaaatttaaaatatagtaaaacaaccatttacatagcatgaacattgtattcagtattatatgtaatctagagatgatacagcagaaggatatatgtaagctatatgcaaatactataccattttatacaaggaacttgagcatctgtggattttggtattcatgcgggccctgcaaccaattctctgtggatactaagggattacatgtcaaactgtacattttaaatatgtacagtttattgtatgtcaattgtaccacaaaaaataaacaaagccttagtcacatccattaagttttcattctatttttttatattattgatgtcattttttctgtacccaggactatgtaatacatttcctatttcacatttgatattaaaccatgtgaagaatcatccttatttaactaatgaaaggaaaatatttaaggaagctgaaacccagagagactaagtggtactgaaaacacccaaaaaccaagtgctctgccagtgtcacgtatctgttaagtaaagagattcaaacccatgtctgctttacttaaaagctaacggtcttaatcactataccatacaatattaatatatcatcttaaaggaaggattcagaggatagacactgtgctaggctgaataacagcctcccaaatatgtctaaatactaatccccacaacctgtatgttactttacagggactttgtggatgtgattacattaaggatatagatatgagggcattatccaggattaacttcgttgggcatgtaatcataagcatccttataagagggaggaaggaaggttagagtgagagaaggcattgtgatgatggaagcagaggaaaaggagactgacaacagagaagcagagtcagagagaaatttggagatgctatgctgctagttttgaagatggaggaagaagccatgaaccaaggaatgaaggcagcctgtagaagatagaaaagtcaaggaattttcccccaaaaacctgcaattgattgaatgtttgtgttctctataaattcatatgttgaaattttaacccccaatgtgacaatattaggaggtagggtcccttagtcagtaattagattgtgagggtaggaccctcaggaatagaattagtgcccttagaaaagaggccccagagaactctctagctctccttccaccatgttaggatacaatgagaagtcagtagtcttcaacctgggagagggctctcaccagaatccaaccatgctgactggcaccagatcacagacttccagcctccagaagtctgacaaataaatgtttgtactttaagccactcagtgtacggcaatttattataacaacctgaatagactaagacaagcctccagaggaaacacagccctgccaacccatttcagacttctgaacttccagaacaactgtgttattcaagccagtaaatttgtggtaatttattacacagcaataagaaactaatacaggctctatagtcaatgtagtttctttcttccctatcataaatgttctatgcatttggcctacagtaaaagttcctgataatgatggaggtaaaaatggcctctggaagtttgggtatgggagaaaatataaaaggcagtacactaagcaattattcttgtggactctagatatctatgagtcttagtaaagtccaaaacccagtatgtgccaatagctttaggtcttcctttgcaaattttaaaaactcaaatgatgccaaagtaaactattccctaggctgacttaagacaatacaaattcattagtgggtctggagggaaagagtggtatcagagatctcacagtcagtctgagaatgatgtggtgttaccaaatcatactaaacacagactaggaccaaacaagctataggcagtgtgtaaaaagcaattcactctagactttattttattttgtttttaattatccatgtggcctaaatcccacaaaagagaatgttaaaacaaatttcaaacctgagacttgatttttcagttcatttctatcatctatagttaccatctttaaagcttggaacctgtaattctttcattcattcaacaagcatttattgtgtacaattcacagcacatcataatgaacaaaaataaatatcaccctttccctaatggcatttataagttagaagggaaagattatttcaaaaacaattaataaacagcttaacaagtaccataacatgggaagtagaagttgatgtgaggggcatggcgggaaacctaagttagtgagggaaatagaatatgaaaatgcttggagactagagatggaaaagagcataaagaaagagtgtgagagtatgtaagtggctgtgtattagaggggaagtgtcaaagggagggataaggagagataaggcctgataggtgagtaaaagccagccatgaagagactgcgccctggtcttaaatcccagtggtacatatagagatagcaaaaccagtcattgtgatgattctcaatcctggctgcaaatctaaggtcgtccagtagagtgcttctcttctactgtggcctggcaaacacagtttataaaatctgtgaaaagtgagagtaactgaaaactctaagaactgagactaatagtttcatgcatatgcaataataatagctattaatttttaaaatttgacaattttataagttacaaatattagagttcctgtatacccttcactcagcttcctctaatgttataatcttatataaccacactacaattatctaaatgaaaaagtttacagtgatacaatactattaactaatcttcagagtacatttgatttttgcaaattttcccattaattttcttttcttgaccaataactaatacagaatcccaaactgcagttagttatcatgtcttcttagtctcttcaaatctggaacaattcctccatttctccttgtttttcatgaactttatatttttggagactactgaccatttgttttgtgaaacatccctgagatttgagcttgtctaatattttctctttttttttttccctctggctctgtcacccaggctggagtgcaatgacacgatttcagctcactgcaatctccacctcctgggttcaagcgattctcctgcctcagcctcccgagtagctgagattacagtcatgcaccaccacgcccagataattgttgtatttttagtagatacagggtttcaccaagttggccaagctggtatcgaactcctgacctcaggtgatccactcacctcagcctcccgaagtgctaggattataagcataagcaactgtgtccggccaatattttcacttaattaaatggaagatttgtatttttggcaagaagaccatggaagtgctcttgtgcacttctcagtgcatcacatcaggtggtatatgatgtcaagaagtcttcttactgatggtattaagttgatcatttggtgaatatgatgtctgccacgtttctacatattaactatgaagttaatatgtttcctgcttgtaattaataactatcttgttgggagatactttgaaacaatggaattatcttttttctcattattccatcgccttaagtttcagtattcactgattattgcctaaactgtattgtattgtacagtactgtggtgtctgccaaaagatgatttttctacatctattaatctttttacttttaaaaattgacattctactgtaaagaagagctgtctcttacctcccatttataaattattgacttcacgataaactaaaaaatatttattctatgggtttttaatctattactgtcaatattataatgttgctcaaattgtcacagatttagctatttaaagatctttgggatttatgtccttttgacatgctgctacccatttttgagtacttccttaccttctggcaccacaagataatcttatagttgccctttcctagctctgaaatcagccatttatccaaaaagatctagttttttaagttaacaaatggcatacagaaactaagatttgggaactaggtttgcattttatcattggttgtcactgcttctatgtcttctcaggagacagggctaggtgatataagtatgtatgctaattgtgcatactaacacatgtatatgtaattgtttatatcatctttctatgtgtgtacacataacaataaattcacattgatatttcattccaatcaatcaccacaggattcattctagagtttcctctccttatttgtaactcctttctccaaaagaaagaaatcttgcttttactatccaaaatatatttacttatttgctctaatcctaggatacatataaaggaattttagattcattatctttctcccccacaattattggagcaattatgctgttcatttgtaatgctgttagattttcactttgtcccacaacatagctgatgtgtgtgtgtgtgtgtgtgtgtgtgtgtgtgtgtgtgtgtgagagagagagagagagagagacagagagagagattaggttctaagagtccaaagcatacaaaaggtatagtcagagaactgtcactcccctttcattgcttgtactctgttcccattccccagtcctttccagcacattctcacctacctgctgcagataatcaatattattagtctatgattcaacccttcctgtatctctttttgtacaaatcaacagctaacagttattaagcatttacatggtatatgtcagacactgttctatatgcctttctacatattagctccttcacctttcacaagcacctaagcttcaagagtgtagatgctctgaaacatcgttttcatctaggaatcttttccttttcgtaggtgttcttgattgcctcagatatacccaagagatattcattatagaattagagaactaaatagtacattgccaagtactagattttgttctgatgataatgatttaacatgtgataacaatttttatttcctcaggtagttaattcattacaaatcagtcactaagtacccataaaagtacatacaatttctcatttgtcacatttattctcacaatagcacaaggagacctgcatgtaggacaaatagcatccttactttacatgagaaaactgaagaacctataaacataaaaaggacttctgtgctcccactaaaaccctggtaagtaagttcatagaaggcttgagtcttcaggaagaagagagagacagagacaagggcagccagcaagaaagggaggagagtgaatcaacacagggaaagcaaggtctgaaatgaatgcctgagtacagacaactgacaatagacaactattgcaaattgttgattagcaaggcaatatgaaggaactgtttaaggaaattagcagtgtgtaaaatgcagcagaggatagagacaacaaggtgtaacatttctgggaaatctgaatgtataatataaagcattaaagtacctttctaacatcaatttctaggaatgctcattttgttagtcaaaagcaattacaggaaaatccaatctttgactatttaaacacagtgatttttaccattgaccatattaggataaaatggggagcttcttaaaaatactaactaccaagccattttccagaccaattaaatcagaatcctgggaaaggtgtacaggcgtcagtactttttttaataatcccatggtgattctaatagacagctatagttcagaaccaacacatcagtagtaaacattgacaagaagatgcccatatgtaataaagtttcgattttttcttttttttttttagaagatactctctgttgacagtgaacattctgcttttgcagaagtatatacttactaaggtaccataaacttcagaaatgtaaaagtaaaactaagaaaatgtacatctacaatttcctaatgcatttttataaataattgtagaaaagcaatttttcatatatcaatcctttagtattctaaagttattataatttattttttttaattttttgataataaatactccgtattaaaaataccctctctggaaattttccaaattatcatctggatcagagatataagtaacaacattctaaacacacaatgctataggactggtttagcatgataccaggggaagcagaaaataaaaggaaatctaaactacactcaaagcaacaatctgttaaattctaagctacgtgaggacagtatccaagtctgtctattctactgttatatactcagtaatttgcataaagcctggcacataataggtgtccagtaattcttagttccataacaaatctattttgaaaacttatttagaaatgcatcaacggaaggaagaatgaaaggaaagtagtaaggagaagggaaggaaaagacccttggaatgacgaacaaatgactgactgatttagtcagtcattctcaaaatggtgaagtgggagtcaggagagtaggattctgagtcttggctttgccagaaaaccagttgtatactcttaagcaaatcatttaagttctccacaataacttgctcatccataaaacaaggagaggcataaatgacttctctcatgacctacagtgttgaaaatctctatatatcactgtatcagatattttgaaggaaagtatacattaatctaagtattattttttaagacagaaaaaaattgacaagaatttactaaaccgaaaattttaagtaaaagaatttctaattcggcatatacaaccaaaatttctaattacatatttggtgaaaaaagataagtcattgtatatccagctatttcatatttaactccaagttttaattctcagttatccacagatagaggaataaaacataaggaaaactcataacaggaattctctcagtattttctcagatgtatttttcccagcaaaagttaaaaactaaaggaaaagttgcaagaacacttaaaaaaataaatcctacatctaaatttcccaccttgcttacatttcagtacatttgctttatcatgctacctcttagtctctcttggcatatgtgtgatagacattattttttttctgaatcaaatgagagttagttacaaatatcatgacacttcaacctttatctatatttattgactaagaacaaagatgttttcttatataatcacaacacaattattacacttcataaacttagtattaacaattcatgtggttggtttttaatccgggtccaatcatgtatcactttcatactaatatttgaataatattgtgttatttactaaaaattaattatacttttaaacaagataattcaatacaagacaatgagagttatagggaggctggacaatgccagaaagagtcatatattatgatttaagaggttaggttccacttcccttttattataacaagctgccattggaacctatctccttaatgggctggggagtgattttcatattgtgagatgccttgagcagcagtgagtaagaaacccatgagctttcgatgtcagctaggatggttcctttttatccattttatatattggggttctaactaagaacagtatttacaaaaaaaagtaatttttgtggtgttttggttttggggttttttttttgcataaaaatgaatttgaaaacaggctaaagaagtaaaggtaaaaatcattaggtaaaagagtagggaaaggaaagagaaatcaaattctcaacagaataagaatgatcctgacccaagtatttcagaatacaaaaagtcaaacagtcacagccttttattgttcaccacagttgaagtagcaaacagtaaagtctaaaaaaaaaaaagctttattacttgaaaaaccaagaatgcttctgaaccttcatttattccactgcaaaacagaaataataatatacacttcacagggttgttgtgaggatttaatgaaataatgtttgtaaagggctcagtaaatccctggcaaattgtaaacactcaaaaataaaaattaaaaaacatcctaatactgttgggtgaagtggctcatgcctgtaattcccagcactttggcaggctgaggcaggaggatcacttgaggccagcagtttaagaccagcctgggcaacacagtaagaccccatctcgacaaaaaaacttaattagtcgggcatggtgtcatgtgcctgtggtcccagctacttgggaggctgaaggaggagggctgcttgagccctggaggtcagggcttcagtgagccatgtttatgccactgcactccatcctgggcaaaagagcaagacccagtctcaaaacgaaaaaaccacaagaacaaaaaccaaactaataccaactactaatattaagaagttgactgggtgtaatggctcacgcctataatcctagcactttggaagccaaggtaggtagattgcttgagcccaggggttcaagaccagcctgggcaacatagtgagactttgttgcccagaaagaaaaaaaaaatagccagatgtggcatgagcctcagggaggctgagttaaaaggactgcttcagcccaggaggttgatgctacagtgagctgtgatctgcactccagtctgggtggcagagcaagaccctagctcaaaacaaaaaaacaaaaaaacaaaacagaagttgcatgatagttatgagtacaggctctagagtcagaatgcctgggttcaaatgttaactactcaatatactagcctttggatcttggtcaagtaacaaacttttaaagctctagtttcttcatttgtaaacttgggacaattaatactacctatctcattgctctgtttttaagatacgatgagataatccttataaaaatacttggcacagggctgggcgcggtggctcatgcctgtaatctcagcactttgagaggccgagacaggtggatcatgaggtcaggagttcgagaccagcctggcgaacatggtgaaaccccgtctctactacaaatacaaaaaatcagccaggtgtggtggcacgtgcctgtagtcccagctactcatgaggctgaggcaggagaactgcctgaacccgggaagtggagcttgcagtgagctgagatcccaccactgcactccaacctgggcgacaaagcgaggctccgtctcaaaaaataaataaattaattaaataattaattaaataaaaatacttggcacagtgtctggctcaaaattaattgctcagtaagtatcacctattattcacatcactattattataattatttaaaatactagcatatctagcctagatattaacatataaagctctaaattttattttctaattcttgaataaacttttagaatcacacaatcttagaggtgaagaggaccttactatccaatgaacttattttaatagtaagattgcccatatatttgcagtaagttatttgtgttaacatctcccctctttaaacctcaagctctatgcaaacagactattactttcttctcacttgcaatttgtctataatgaatgtatatgaaaattatgatcttatttttttttagcttattcattgtcacataaccagttaatgacaacggctgagaatacaaaggcatcaaactgcacagtgctctttccataaaatcacactaatcttgtattagagaaagacaacattttaaaaaagcccttttataacctccaaatatatccttgtttatgaccatttacagtgaaaaattataatcattgctttttaagctatttatttatagtttttcacttttctatttcccctattagagaaaaagttacatgaaggcaagcgatatatttgtcttattcatattgatttctacagtgccaaaatgtgcatagtaagtggtatacagccagtactaaataaatacgaaaagaagaattgttccaataggcaggagaaacaaaatttgaaacgtcaaatatcagctattataacagcctacagggtcctgaagtagaagcagccctgtcaacaaacttcaaggctgggctaaattattgctgtggttctcaagtgattctcatattgggattttttttttaagactgtttggtttcactctagacccatataaaaccataatattttctcaaattccttaaataattttatttgctcccaaccctttggaatacttctgaaaatttctggttatagcaaaaattactacagagacttaaaagttcaagcacccccaaactacaacttctagttatctgctgaatctcaaaattttctcatctactcagaacttaattgtcaaagaaaagtgttctttacaaacagaaaccaaaattcccaagtctgtattatctatagtacatctcttttcagacatactctacttctattacactcctcttaatctctgaatcaatcttatccttcatagtttacaactagttatgataaaatattttgaattttatttttcaaaatttattactgctttggttgaaacaaatatttctcagttcatacagcataatgaaaattttaagactaatagtttacctgaccccccaacccccaaaaatgatttctttatgacatactgtaggttcagtactatgctaagaactacagaaataacataaggctaaaatcttataatctacacacaaaacaaagaaatagaacttactgtcaagtactaaattctgcaatataaattgattataaatgccacagaagataggaggaaagaatatcaagaaaaactggagacttgaagaaaaactgcataatgagacttgcaggatattccaaaaatgctacaaattttttaatgtttcaatgagcatatgtgcaacaacttgaatttatttttcaatttgtttttatttacttttgtaatatattgactaatgctgacacttggatgccataagtttattttattccttatgtctttgaaattatacaaaaatattttactcagaattataaaaagcacatattcaattttgaatatggcaaaacatgttacttgccaatgaaattatgtggttttttgctttatattcattctttgaaaatgtagttaacctggcatggtggttcccatttgtagtcctagctactcaggagaggctgaagtgggaggattacttgagcccaggagttcaaagttgcagtaagctataatcacgccactgcatccagcctaggtaacacgacaagatcccatgtcttaaaaaaaaaaagaaaaagaaaaagaaaaaagaaaagagaaaagtgtatagttctctgattcccatatgttcagtatcaggcctgtaattagtacatcacaaatatacaaaagataatattcatacatttttctagccattaaaagtagaaataggccaggcatggcggctcacacccataatcctagcactttgggaggccgaggtgggcagataatttgaggtcaggagttcgagaccagcctggccaacatggtgaagccccatctctactaaaaatacaaaaaaatcagcttagcatggggcacacacctgtaatcccagctacttcaaaggctgagacaggataactgcttgaacccaggatggggaggttgcagtgagctgagatcctgccactgcactccggcctgggtgacagagtgagactctgtctccaagaaaaaaaaaaaaaaagaaagaaaagtacaaataaggtttgactaataataaaaattcaaatctagtgccataagtatgtataattatatgacacaactatactgtgaccatataatacatactacacaagaaaaaaatggctcctcagtatcagtactgcaatatgcctctgtggtagagacagatcccagaaatatcaacttactagaaaaatgagcatataggtgagtctcattatgtatctggccacaggcatttaaagtacatagtgtttaaaactaaacactaagtcatgcaaagactttcaaaaatatacctgttttctttaactaacatctccattgattcttccatttgttttgttagctattgattttttccctctccttcttatgaaaggggaacaaggaggggatacatggggaaaatgttacctttattaagccatcttacaatgttattgtcaggaatggctataaagaatttctagcatcgtcaaagtcccagagagagcaatgagtggtgcctgcactgatgtcaagtactagctcctaggcatggcttaggaataaaaataaacgcattagaaagaataagaatgggtgtatattgcacttatgagtacccatttgcttgattatccacatagcgtaacggaatcaaatgcctaagatgaactcttagtaagtaaggtatattagcattttagtatactaatttcactacaaattcattgatattacttatttagtaaaaaaaaaattagaggtaaaggatttttttaaagataggacatgatatacttcttttggaaaagaaaatacgtcaagatgagttcaatattgaatttcaccaatgagtatatattaaaacatcagaaattattttcaaaacaatctttccttaggcttaaaaggagaacctgatttaaaatcaacaccaccctagccatagcttttaacgggtcaagtacattagctactcctttctgcaaacaatggtacataaaaacaaagtgggatatttcctacaaagaagattaaaaattctttaggcctgcctttccttggactctggattttaaaatgacatactacaagataaaatagtaatgctaatattgatagtttgtccattacaggtcagctaactgtccactggaacagttacaaagctgttagtttcgatttcacaaggccaatcaatacagaggcatactgtttcaattttgtctgcattgatttttttttataacactccaaccttacagcattcatctttctgaaagaaggaagatttgatttactgaagaaaaattggagagagcatcacaaagattttaccggcaagcctgtgacacagaaaaaagatgaatgtctttcaggaagagacgcctctagcttgagggcatccattagaacacactcaagcaatctgaaaaggagtttcttaaagcagcagaaatctaaacctaaacagtctcctaaactaatcaaaagcattcaagaattttgatatgaggttccgttaaaaattcctaaaccttattacttctaaaataatttatgtctctagctctacctatgcattttttagagatgagaaccacctctttcccagactaataccaagagtgaatttccatggtacattagtcagcctattagaatgcaatgaaggacgatatgagaaaagggtagtatgtcctctgagacttccatccagtattctccatcatctctcctcatccttcttacattcagccactttaccaggtgtcatctacatgaaagatgatttgtctcctgacccaaataaacacaatgcctgctccatgcaccggaaaaaaattacttctgccactctgttcatttgtggcttctttcttgcttattccactattcttatcaagctctctcagttttcacctgagcctcactccaggtgacagtaatgtatggatgaacaggtacttgtctgtcccattatttcctgaaatctctaagcatttgaaaaaatgcaatgacagtaaagggcacagttatcagagctccaagggaggaatactttcctttacttaccaatgcaatagtctaggcatcaaagaaaaaagagagagagagaaagaactctcatggcaaaagctggtgtaagcgagatattaagacacaaattgcattcaggcaggtcactaggtgtcaaaagatattagatgcctgctgtgaggaaacaacaattcccatctgcctctgagaaaataatattttcattttcagtttttattgaatggaaacttttgggaatatgtctttataaagggtattaagtctaccaactataacatgttcaaaatggctataatcatcattgtgttatccataaagcagcagatttcatttggtctctttagatgggataaattggattcttttttccccggcttgcagttttgtcgcaggaccagatgtttctcaaatgccacatgctgaggctcctatactgaatgtagcacctgaccttctctataattgactaaaaatattgatgtaatggcatgggtctgattgtgatttattaaaaccactgccgatcccaggccagctgccagcattgcagcccactgatcgtgtggcattagaaaagccatcaatagtgaaacaaaataaatgacattaatgggaaagtatcaggcctacataaccatggctacaagcaaattacgtggattccaaaggagggtcaaaataaaaaaaatgccacaaatgaaatttctaaatattctaatatgattgagttaaaagacaaaatgctactataattctttagataaaatgcaaagaaattatacttaatttaatcctcttcactagaattttgctcattgtgcatatttcttttagcaggcttagcatagttaaatgcattacagctacagtatgactctgatttctctctaatgccatttatgttttctagaattatgctaagtgaagaacaaagtacactgtgttattcccatttattacaaccatgtccataatttacaagctgattatgcaagcctcatacaagggaaatcagagaatagttaaccactgtcaaagtatggtgagccagcatacatttttgtcagctacattttcttacatggaccttaaaaggaacattaagatccacacttcacattattgggaattaatattgaaaaggactatttaaagataatttttaaaaatgcattagggagaaaccaggtattctaaataagtaacagttgaatatgatacagaactaaatataatgacaaagaaatatgaacatacaggcaatgtgctttgttacatattgttttttaatgtaagatgagatttatagagaggaaaatattaatttaatcatgtccattttgtgatggtacatcctttcttgttgttctgaatttaaaatgtacacattagaaagctaataatttgacagctattttcatttgagaggaaaaagtaagagatattttgttctgtggacttgcagaaatattaaaatttcaaaatttatttcagttgtttctggcttaatgaataatagagttgataccttagaacaactctattactgaaacactaattatttctagataaatacatttcatggtccatttagctctccaagatattttattacaccaaaatcacttcaggaaaactatgttttccttttgataccacatgtatatactatgctatacaaaggtacagctatcaacagaaagaattttgatcccatcaaaataacccatgaaacgcttgacataagttatctaaatgtgtttattttaaaactgcaaaaccttttgggtgaaaagaataactttttaaaaagattcaacaaatgcacattgggttcctactgtgtgtcaggcactatgcatcagagtaatatcctaattcattcagtatctgatgtcaaaatgatatcaaatctgtaataataaagcactttgaaactctaaaaccctcaatacaacactcctccattctcctcgccatgggcttttagatgttgcaagataaggcaccagagatcactgacccatgaatagatgttatttccataaccactcttgcacctgcagatcaactgaaataacattaaaacaaacaaacaaacatggttcctgttggctgtccttttgatctcaagaccttgacttgcctttctttctctgaatatcaaaaattaggtacccagaaatataattcattatatgcaaatattctttgtaataaatatcacacgctacatttattctatattagtgaatactttatacaaatagctttcaatgcaaatttttgaagtttacttttctaaaagttaaaatttttttctttatactggaaaatttctaacactggattttgatgtctgatagacacataagttgattaaaacacaaatggaagcaaattacactcttatataatatacaagtaatttactatttttgtttttgttgtcttctagaaaaagttggtcaaaaattagaaattaaaatataatgttttctaatagcaaaataaaaactttctgtcattaactttacttaaaagagtcaacacatgttcctgaaatttgtagcataaaatatttcatggaggatatataatttgtccaagttccttagtcttaaaggcaatttaattaatttctataaagtaaaatcaacaacagcatgtccagtttggctatcttaaaagaaggtagatatattgagtaaaactttaaagaaggcatttaaccaagtttatcatcacagtcctgaaatttgcaacataagaaaaaaaatcattttattgtattttcaaaattatactttgaaaatatggttactttcaaataactaaaaaatataaaaagagcatagttttttaaaataaaatgttatatacgtaaaaatttggctataagtgtagatagtaagatagtttaactgcttcccttaagaattcatttcaaaaggagtaagtagataaagcaaatatgattttggaagtagttgaggaaactgatctacaaagatccataattgtacacatactgattggataaatatggatctataaagatccataattgtacccatactgattttctccttccctttggctttaaattcatagagatgatgaaagacaaaattaaattactctcttcttcatctggctttgatcatatccaaagtcatttatctaaacctaagccatctacagaaaatcagtggccaaatcctaaaggtatccctttacctcactgcagaatttccccaggctccatgcttgtctgtgagaatgttgataattttctggattagttgagttgctgtcacgtggtcacgatattttgctgctcttatcaaatgatcacacatcttctcatcttctcgtttgtctgcagaatactgggcacacagtgacttggagagaaaaaaaaataatactataaaaaatgtgaaaaaaacctttaaaatccattatgaaataatctttaccctaaatcaaaacaaccaaaattttaaatctacttttacattcctcattcacctaactgagatttagtgatctgctgtctcaataaaacatcccacaagaatttacttctgtgaagtcaatcatgagatacactcagaagtggtaaacattcaagtagagacctgaacaatgagacaaagacagtcttgtaagaagcaggggcccagcacgacaaacagcatgaagtgaagttgcaaaggacttgagacatagtgaataaggagaataatggttaagaaataattttcaaaaggcaggccagggctacatcatttgtattatggtaaggagtttagattttattcaaatgtaatggaatcccagaggaaagttttacgcagtgaagtgataaatttacatattaaaatgatcatatagctgctatttagagaatggattgtagtgggacaagagaagtgaagttggcagttatgaggccactgcacagggccagaaaagagacaatagcagcttacaatagtaaattgagctagttctaaatacctttagaacatgaaactgtttggtcttttaagtcctagcaaaatgtaccaagagctctgggattgcctgggatcttatttcaaatgcagagtctcaggccccaccccaaatctattcattttgtgtttgaattttaattcccaggcaatttatatacatcaaagtctgaaaagtactgtcttagatatcatcaattttaccaaaaaacaccttagaattatttgtcagtaatcagatacactataattgctagtctccaaaatgcttatttctcttcttttggaattcggatacttgtggtgtcatgtttatgatactgtagttaaggcattgtttaaaataagaaaacaaagatggatgtagacttggtcctttgttctattcagtgtctactggagtcctctcccccacccccacacacatatcctttgatagataagtaacataaacttgatgttgggataaatatttctagtttacatacggaatatgcattgtggatgcttgcctctcctacagtataccagtttcgatagattgctgccacgcactactcccaccaccaccccagcaacaaataggagtcctgattgtcctgaaccaatcgtaataatcacacccacactggcaaactggattagggaaggacacttgatgtaactggtacaggtagggcaaagttcaagatttagttggacagttggttccctccttcctctcaaggtgtaaaagaagcagcaaattctaggagtattggaagctctctgtaccatgagggaagctggcctgaagatatggccaaaatgagagcagaactatgaaaattgtagaaaaacagagctcactccagaatcatgaacttccagatcaatcaaattctcaagaccagccaacccctatgagactttttaaagatttttttttaagagccaataaactcctgctcattgtaaaccagtaaaaacatccaaaaaaattggttttttttgttccttacaccaaaagcaattcatcctttgcatggtgtatatgtacatgcataaggaatcaaatatatatatatatatatatatatatatatatattttttttttttttttttttttttttttttgagacagtcttgctctgtcgcccaggctggagtgcagtggcgtgatcttcttggctcactgcaacctccgcctcctgggttcaagcaattctcctgcctcgacctcccgagtagctgggactacaggtgcacgccaccacacccagctaatttttttgtattttagtagagatggggtttcactgtgttgcccaggctggtcttgaattcctgagctctggcaatccacctgcctcggcctccaaaagtgctgcgattacaggcgtgagccaccgcgcctggccaagaatcaaatatcttagtctgtgcaaaacactatgctagggagatgaaaagctgaattgtataaagaggaattttagaagttagtcttgggtgggaataaaggaaacctttaaagcaaaggcaaggcagaaaaacgttaatcaatttcagggagggacaaagcaagagagtttgacccaagtacaaaatacaggtagaacgagtaatagtctgaagaaactctggaatgcagaatgagtatagaaaaaagtcacaggaatcatagtatacttatatgaatgactacaagattgggaagcaaaataaaaaccaggttacggtatcacccttgctaatatctcctgtcagtcttgatcaattcactcatttacctctttaggtctaaatgtcctcatctgcaaaattagcaggttatattagatctaagattgggtcaatccgaagattctgggcaacctctgtgagggtacttgagagtacctgagttcaacctctgagagatgttcactggtaaaggcaaactgtttatttaatctaaacactgatgtggagaaaataaatcctactaagaactagaataactcatgagaaattaaaagcaaatttcatacgctatatttttaaaaaagattgacccaaaccacagaagagttcactttgtcaaaaatatgatttgagcaaataaaagaaaatgattaagaaatgtatgaaagggcagcagtttaagtgaagataactaggaaattatttcattgtaacaaaaatgtcaactgatatgtcattttttatatattcattcaagaactgagaagcattctataggttatttcatatctaacccaaccatacactaaaacaaatagtacgaaatgacagacattcacagaactgtaaactttcaacattctctactatatccatatctgtccttgtctaacttcacctaagaggaaattcaaatctactgatgagatttagaaaatcaccggtttctgaaatgctatgaaccaccacataccttcatattaaacagcattaaaagtaaccaaaaacacattattaaatagcttgtcatttctatctcttattaatatattaatttaaaatcaaattatattttgtaaacatttgataagctattaaagtttgttctaaaaggcataattctaaaaacaagggctcaaggtaagctaaacggtaaaatggtttaaagtgttctttaatggatccttctttacaatttgaacagcaacttttcatatctgacataaaatctatagatataaatcacattaaagggctattctttcctgattatcaatctctgtctctttgtggaaccttagggtcacatctgacctaaaaacatgataaaagaaaaccaaacaagaatgtttcataaagatataatgaacttgtaatattttttaaatgtccttataatgtaatttgaagatgttcttatttaaaaaccaataataaatcctatgtatgaaatattgttcaaagtcatgtggagataagaaatatttactctagaatcaaatacatattatttatttgtagtatacatatttgtgtatgtatgtatacctgtatttggaggttgagtggaggtacaagagaccttaacaaatattgctatttatcggtaacataaacggtcaaatctaaaactttcattcaactttaaggcagaattttttatgttttatatcaacttttctgtgttcctatttgtaagcactatataaactagataatataacatcacaacatggccacaaaatatttgactataaaaagaaaaaaataagcatttggggaacaattctattttatgtgattattgctaaagaaacctaagatttataaccaaagaatgaagaaactcaatataggataaataaacctccacagaagaaattcagtcactcacagtaaatagacaaagcgaccattttagctctttaaatgtaaatgaatagagacaatatttaatttttccttccagatgtcatagctctacctaattttactattcatcctttgcatgaaagtaagagaggacacaaacaaatggaaaaacattccatgctcatggataggaagaatcaatatcatgaaaatggccatactatccaaattaatttatagattcaacactatccccaccaacctaccaatgactttcttcacagaattagaaaaaactactttaaatttcatatggaaccaaaaaagagcccatatagccaagacaatcctaagcaaaaagaacaaagctggaggcatcacactacctgacttcaagctatactataaggctacagtaaccaaaacagcatggtactggtaccaaaacagatatataaaacaaatggaacagaacagaggcctcagaaataacaccacacatctacaaccatctcatctttgacaaatctgacaaaaacaagaaatggggaaaggattcgctatttaataaatggtgttgggaaaactggctagccatatgcagaaaactgaaactggaccccttccttacaccttatacaaaaatcaatccaagatggattaaagatttaaacgtaagacctaaaaccataaaaaccctagaagaaaacctaggcaatgccattcaggacataggcatgggcaaagacttcatgactaaaacaccaaaagcaatggcaacataagtcaaaattgacaaatgggatctaattaaactaaagagctcctacacagcaaaagaaactatcatcagggtaaacagacaacctacagaatgaaagaaaatttttccaatctatccatctgacaaagggctaatttccagaatctacaaggaacttaaactaatttacaagaaagaaacaatcccatcaaaaagtgggtgaaggatatgaacagacacttttcaaaagaagacatttatgcggccaacaaacatatgaaaaaaagctcatcatcactggtcattagagaaatccaaatcaaaaccacaatgagataccatctcatgccagttagaatggcgatcattaaaaaatcaggaaacaacagatgctggaaaggatgtggagaaataggaacgcttttacactgttggagggagtataaattagttcaagtattcaagtattgtggaagacagtgtggcaatttctcaaggatctagaactagaaataccatttgacccagcaatcccattactgggtatacacccaaaggattataaatcattctactataaagacacatacacaggtatgtttactgcggcactatacacaacagcaaagacttggaaccaacccaaatgtccatcaatgttagactggataaagaaaatgtgacacatatactccacggaatactgtgcagccataaaaaagaatgagttcatgtccttttcagggacgtggatgaagctggaaaccatcattctcagcaaactaacaccagaacagaaaaccaaacaccgcatgttctcactcataagtgggagctgaacaataagaacatatgggcacggagaggggaacatcatacaccggggcctgtatggggatggagggcaaggggagggatagcattaagagaaatacctaatgcagatgacaggttgatgggtgcagcaaaccacaatggaacatgtataactatgtaacaaacctgcacattctgcacatgtatcccagaacttaaagtataataaataaataaataaatatttttaaaaagtcctaaaagatttaaaaaaaaaacagaaatggaaaatgttaatagatatattctctattaaagaaattgaactcaactactttaccataaagaaatctcaggcccacatgtttatatcggtgaattccaccaaacatttaagaggaaataatactgaggccgggcaagatggctcacatctgtaatctcagcacttagggaggctgtgacaggaggatcgcttgagcataggagttgaagaccagcatgggcaacatggtgaaaccccatagctacaaaaatacaaaaattagcccggtgtggtggcatgcacctttagtcctagctacttgggaggctgaggtgggaggatggcttgagccctggaggcagaggctgcagcaagccgagattgtgccactgcactccagcctgggtgacagagccaaaaagaagaagaaataataatgaaaaaaaaatttacaacagcatgaaaaatatgaaatacttagctatattttaaaatttatacagatcttataaaaaataaaaccataaaatagttaagagaaattaagaagctagataaatgaagaaatatataatttatgtatacaaaatatacagtttatagatttaaagattcaacattttaaaaattgattttatatattcaacacaatcttaataaaaatttttagcaatttttataaaactgaaaagctgattctaaaacacatataaaaacagaaggtaggccgggcgctgtggctcatgcctctaatcccagcactttgggaggccgaggcaggtagatcacaaggtcaggagatcgagaccaccctagaaaacaaggtgaaaccccatctctactaaaatacaaaaaaagtagtttggcatggtggcacacgcctgtaatcccaggtactcaggaggctgaggcaggagaaacgtttgaaccagggagttggaggttgcagtgagccgagatcacgccactgcactccagcctggcaatagagcaagactccatctcaaaaaaaaaaaaaaaaggtaataacagcaaagtaactttagaaaacaaagttgtaagacttcacacccttcccaccatattataaaactagaaatgaagagcactggttattagatgaagaaagagatgacaaaatgaagaaacaactggtactgaaacacctggctatccacatgagaaaaaaaaaaagacgaatcttttctttcacctaatatcatacaaaaaatacttaattcaaactggatcaaggatataaatctagaagttaaaactataacatttccaaaacacaacagcagattttttttataactttgggataggcaatgttgttagactggacagcataacagaaagcatagaagaaaatcacaagaatttaaaaactgacaaaataaactttatcaaaatttaaaacacctggtctttttttttttttttttttttagacagagtctcgctctgtcgcccaggctggagtgcagtggctcaatctcagctcactgtaagctccgcctcccaggttcacgccattctcctgcctcagcctcccgagtagctaggaccacaggcgcctgccaccatgcccagctaattttttgtattttttagtagaggcggggtttcaccatgttagccaggatggtctcaatctcttgacctcatgatctgcccgccttggcctcccaaagtgctgggattacaggcttgagccaccatgcctggcccaacacctgctctttaaaagaaccatttataaaataaaaggtaagccacaaattgtgaaaaaaaatttaacatacatctaaatgacaaatgaattctttacagaatatataaagaattcatacaattcaataagacaaacaacctaattaaaaataattagcacaggatttgaacaggcatttcacaaaagatatacaaatggctaataaagcacatgagaagatgcttagtcagtagagaaatacaaataaaaatcacaataagctatcactatacacccactagaccggctgaaatttaaaagagctacaataccaagcactgacaaggacatggaacaactggaactctcatacctaccttggtggttgaattgtaaagtcgtcaactactttggaaaatagtttgtcaatttcttgtaagcttaaacatatacttacagtagcatgtagcaatcctactcctaggtatttcctcaaaaggaataagaacatatttctacaaaaataacttgtatgaaaatgcccatggtgcatttagtcataaaagtcagacactgaaaacaacccaatgtctgcctatagctgaatggataaacaaaataattcaacttagtatttaaaaaaacaaaccaataatacacacaacaatgtgaacgaatatcaaaaagtttatgctgaccaaaataatccagagtacctactatttgattccatgtatataaaattttatagcagataaaactatctataataacagaaatcagatcactggttgtctgggattggatatgagtatatggagaggaattgaccacagtggatcacaggggaattctctaggatgacaaaatttcctatatctttattataatggtaaaatcacagatatacacctttatcaaaactcctcaaattgtatacttaaaattttattacatgcaaactatacttcaataaagtttatttaagaagtgtttgtttgtttgtttgtttgtttgttttttcaggcaggatttcactctattgtctaggctggagtgcagtggtgtgatcttggctcactgaaacctcaatctcttgggctcaagtgatcctgccacttcagtcccccaagtagctgggactagaggcatgcaccaccatgcccaactaattttttcgatttattgtagagatgaggtctcactatgttgcccacgctggtctcaaactcctgagcgcaagcaatccactcacctcggcctcccaaagtgctgggattacaggcatgagccaccatgcccagcaagaagtttttaaaaagtggatggacaaggtatagatggaggaagcagttaaaatgctcataccaaaaaataggctcatatagcaaataggtaaataccttctacaaatcaatgaggaagagacagataaccaataagaaactgggtaagagagcaacatgtacttcacaaaagtaaaaaatagataatatataacaagcaggagaatagactcaattcttttaaaaattcaaaataaaagtacatcagaatgccaaaataaaaatcaccagtcaactgttgatgagaatgctgaataataaagaacaattctacactgaggctgggagtggtatatacttttgcaagatagtgtgacaatatctattaaaagtgaaaatatgaacattttgtaatcaagtaattccaccatacagaaatgcacaaggatgtacgccagacatataaaatattcaaagtgcattattcataatagctaaacactgaaaacaaccaaacaaacagaagagattatttaaaaactaatggtctacatattcggaatagctaaaaattggaaataatccaattacctatcaacagtagaaagaggtaatgaacagctagcagtctatacataatggaatactatgtagtaatgaaagagaagttgaaaaatgtaagaaaataattaaatgttggaaacataatgttgaaataaaatttccagaataaaatacatgttttataattccatttatataagggtcaaaaattgggcaagggccgggcgcggtggctcacgcctgtaatcccagcactttgggaggccgaggtgggcggatcacgaggtcaggagatcgagaccatcccggctaaaacggtgaaaccccgtctctactaaaaatacaaaaaaattagccgggcgtagtggcgggcgcctgtagtcccagctacttgggaggctgaggcaggagaatggcgtgaacccgggaggcggagcttgcagtgagccgagatcccgccactgcactccagcctgggtgacagagcgagactccgtctcaaaaaaaaaaaaaaaaaaaaaaattgggcaagaaattacagtgctaaaagaaacatacttaagttttgaaagaataaaacaaaagcaaatgtcaaccataaaattcagaacagtggttaccttaacagggcagaaaggggttgtgattggaaggctagaaaacttctcacaaactcttcgtttcagtatcacaaaaaaattaaattaatgatgttaaacatacattgtttctaaagttaggttttcagagtaataagttttttaagaaataggttataaaaagcaaatttttattaagtttgcaattaagttcttgttaagttttgaaataaaaataaactacacacaattttaatgctaaaatagcaagcccttttcctaaattaataatgtttaatgctaattaaacaatttgttttggtctcacaagttttgtatttaaaacctcttttaaagacttttaaaagaaacatatacttgcttttaaaaacaaatcaaagaacgacataaaaaagaaaaagaaatttctctcttctacctcctccctgtttggtcagctgctttctacagaggtagtcactgtttagagtaagatgtcattcctatataatggaatcaaactgtacatcattccatgtcaggaccttctttcttttacatggctacaaacagatgattacatttttagttaaccaagcattgcttctgctaaacacgtttaagtgtagtactttccttctcaatttgtctcaaaatcacttacactataaattacttgtctcactgaaaacaatttaaaagtgaaatcacttcagggacaataaatgaagaagtttctcagtatttcacttttggaggtctttgtacttgatcccttaccttaaagtgtgatctttaacaaaaaaaaaaaaaagctatctacagaaactcagaaagactcatagaaaagacagaaaaatgaaagcttagaaaatctcaacagcaaacaaaagtcaaccaatgacaatgtgtgacagccacctttaattctgtagtgattcctctgtcatgcaacgactcaaagtattgatttctctcagcatgaaaaagcctaagccaatgaaacagacagagcagcaaccccctcctcccttccccccataacagcattcaaggttaaaacaggcagaacacttatcaaagtatctcttccatttcttcttgttttaatagactggatacaacatgttgggttcttatcgttacaaactatagtcctcagacaatatttttaaataatttgaagattaatataggttattctatttttttgcttcacacttttggtaataaaaaacttgtttcaaatgctttttttttctgtgaactcttaacagaagtatatataatatttgtaaaaacaagccgacactaataagaaggctatagtttctacttgtgtgccaattccacacataatattttgttttcattatttctttagagtacttattaacaataaaacccacaaatacctaagcatcttccaaaaagacaaagtgaatccttcaacaatgcaaacacacatcatacatctgtttggaaaataaagtaaactatggctgctatctgtgttcaagaaaatagtaataacataaaatgtaagcaaaggatagggttgaaaccacagaattatattttaaaactatagtatgagacaaaaataacaatcagctctctgtatccccaggttctacatctacagattcgaccaaattttttgttttgttttgtttttgagtcagaatctcactctgacacctaggctggagtgcagtgacatgatcacaactcactgcagcctccatctcccaggttcacgcaaccctcccatttcagcctcatgagtaactgggactacatgcacacatcaccatgcccagctaatatttttctgtagagacagggtctctcagtgttggccaggctggtctcaaactcctggcctcaagtgatcctcctgcctcagcctcccaaagtgcttggattacaagtgtgagccactgcaccaggccttgaccaatttttgatctgcagttagtcctggaaccaattccgcatggatccagagggatgactgtgtatcttcacaaaatatgtataaatggttacacacagagaggtaaaattaagaagctttaatttcttaaactttactttctgctaatctgcaaaagagttagatgatcttaagcaaatcctatcatcttttaactctacctaaccaatggatttttaaaagcataaaaaactagggtcttttagttgtattagcaaggtctcctacttatgaataaatatatttgctactacaaataggtaaatcttacacttaaatatcaaggccagacatggtggctcacacctctaattccagcacttagggaggtcgaggccagcaaatcccttgaggccaggagagttcaaagccagcctgggcaacatggcaaagtcctatctttacaaaaaatagaaaaatcagctgggcatggtggcatgcacctgtagtcctagctacttgggaggatgaggcgggaggattgcttgagcccaggaggttatgctgcagtgagccataatcaggccactgcattcctgcctgtgtgagagagtgagaccctgtctcaaaaacaaaaataaatttcaaataaaagcagttcaagaacaagcatgaaaaccagaaagaaaataagcaattatgtataaaaatcataattaacaatgtagttaagagcaccaactctagagctagatgacttgagttttaactcttggttttgacacattcatgcttaagcaagttatttgaaaccctgtgcctcggtttcctcatataaaagaggagatgatgtggtatgcttttcaggaggatcaagaatagacataaaatgattagaacattgccagtcatataaaggtaacacctaacatttattgtaggcttaattgtgatgttatcaaaatacgtaacaaatagtccctgtcttccagcatctcactgtagtttagtaaaataaatacaatatgagaaagaaataaactatgagataactgctcaaagagttatagacagtatgtttggaaagagagaaaaagaaggaactattaggaatcagggagaggctgggcacagtggctcatgtctgtaatcccagcactttgggaggcgaggcaggcaaatgaataccttgcactcaggagttccagaccagcctgtagagatggcaaagtcccatctccacaaaaaaaaaaaatacaaaaattagccgggcatggtggcacacatctgtagtcccagctacttgggaagctgtggtgggaggattccttgagcccaggaagttgaggctgtactgagccgagactgcagcactctactccagcctgggtgacagaagagaccctgcctcaaaaaagtaaaaagaaaaaagaaaaaaaaaaaggccgggcgcagtggctcacacctgtaattccaacactttgagaggccaaggcgggtggatcatgaggtcaggagttcaagaccagcctggtcaagatggtgaaaccccatctctactaaaaatacaaaaattagcctggcatggtggcaggagtctgtaatcccagctactcagaaggctgaggcagagaagtgcttgaacccagcaggtggaggttgcagtgagccaagatcacaccactgcacaccagcctgggtgacagagtgagactttgtctcagaaaaaaaaaaaaaaaaaaaaaaaaaacagggagagtttcacagaggaattaaaggctaagtacctgttcaccaagaagaaagggatagaaaaaataaaatgtagaaaataaaagaggtcaaaaactaagagaacaagctcaaataaatgcatttttttaagcaaagataggaataacagaatgagacatgtaataaagagccttctctttttaaatatcctgatacatgtttatatttttcttgggtaactaatacattttttttaccaattaccttcataaaggaattattcctcaaaggtttatataaatcatttaacatacaaaatattaactagatttgtatttctcagctgatgattgttataatgttataatttctttaattcatattcaaatgtattgccaacacagaccatttcaaaacaacacacctgaatattaactgggttataaatactgtttctcaaactacctgtagggaagggccagttttgttttttttttaacctttttaaacacctttagcactgatgcctttgatgacattgccagacattcaagctataaaactttttaaatattcaatttctgtactcagctctttgtggattactaagaagtaatttagtcagcagaccatacttaaacagcactaatataaaaaggtaagtagaaggaaactatttttatcaactcaagtatttccattttgctttgtatggtaaaatacttgctttgcaaaataaaatactttgtattataaaatgcttggtcttatattcagtgctttaatttttattaataaaccagaaacaacaatagccaatattctaagtgcacatgagaaaagtctaaattataaacaaatgttgtataaaatacactgtaaagatttttaattagcttagtttcttattaatctttattttaaaatccattaagaaaaggaaggctttacattagtacataatttggtctatggttaagataaccagaagataccataaactgaaagcttaagtaaaggcttgatatatctatgagggatatattcagacattttctttgaagagattttcaatgcattaaaaggtctggttttcaaaatatattttacaagaacatactgagaagataatgaaaaaacactcttccagtttggatttaatttgatcaacaatgcctgcaacagttttacctacatataaaccttttgctttttctagcttgctagctttaatagaaatatagtaatagtaagcatccgagtaaaatagctgtttttttaacctggtgcagcatcacttaacaatttgcaaacaaaatctcatcgattcacttttaagtggtcttcctttatcccaccaatgatagttcctttagtttcacaaacagctcaaaaattattatttcttgttatatgtatgtatatacctgtcctttatacaggtaagaatatgatgttcaaaagatacctacagaagagtaacagcagaaaatattgaggcctttcttttaacctggtcattttcaaaaagctaaagttgagagtatgacaagtaaaacacatcatggaagaacctctaaaaatagtgtgttccagactaaatacacaagactttggatatgaaaactgaaaaatattattactgcatagtccaggtctatagacgctacaacatatatgataaattggggtaagagtttccttaaaaaaatttgatggtgccgttgtcactcaacctgaggcaggaaaaaagggtaacactggactgaggaaaaagcaagattcttctctaagagaggaagcaggtgatcctgaactcgagaaagaatctggtcaaaagagctctcactgttggagagctaaactggcttctgcagcatggcaaagggagacgacctggggaaagagggagacagagtcaagaaaaactgcctgttcaagagtgtggcctatgaatcctaggagatgcaatatctagtattgttttgttttcctcttctgcactgtgatgcccttctatcattgcaaggcccacaaaagagaaaaggagaggtctatgtccacgctttgggcaacaggataaagaaaaacagctactgcctggaaaagttgtttgtaagatgggaagaggtattctccagagctctgatacaactctatccagcaatagtgtagataggaacctgatggcagagataagagtcctagattcactgtggcacatataagcattcaatttccagagattacttgaagaaaaaaatagctgttattaaacacttaatatggattcagagtaatgggtacattaggtttatcaaatcccatttattcctgacaacatagctacaggtaaacatcattattatcctgatgtaaaggtgcagcagtggtgtcttacttcacatggtttagtgaatgacaatgccaagactagtcaacaattttatctgatgaggtagtcagagctaaggtcaactgctgcagagtaatcatgtctcactggttgggtattcaaaccctagcaatttggacattaaaaagaacttgaatacttgtcagttggttatactggtagaggttgagtatcccttatccaaaaattcaaaattcaaaatgctccaaaatctgaagctttttgagcaccaacatgaccctcaaagaaaatgctcattggagcattctgatttccaggttttcagattagagatattcaaccagtaatataatacaaatattccaaaatctttaaaaacctgaaatttgaaacacttctggtcccaagcattctggatacgggatactcaaccggcattttatctttcatatttattgatattatttttatcaaaggtgaagaaaataacaatgatagaaaacagaaaagccacaatttatatttgtatatatagtcatgcatggcttaatgacgagggcatacatcatactgtttatagcctaggagccatacaaatatgtacagtatgttactgtattaaatgttgtaggcaactataccacaatggtaagtatttgtatacctaaacacagaaaaggtatggtaaaaatgggtataaaacaaacaaaaaaaatggtacagggcacataccatgaatggagtttgcagcacttgaagttgcgttgggtcagtcagtgtacaagtagtgggtgaatgtgaaggtctaggatattactgtatactactgtagactttataaaccctgcacagttaggctatgctaagttaattagaaattattttcttcaataataaattatccttgctcactgtaacatttttacttcataaacttaaaattttttaaaattgtttaactcttttttaataacacagtttaaaatgcacattgtacagctgtgccaaaatgttttctttctttatatccttattctataatttccttttttttttttttgagacagagtcttgctctggtgagacagaggctagagtgcagtggcacgatcacagctaactacagcctcaactcactgggctcgagtgattctcccacttcagctttctgagtagctaggactacaggggtgtaccaccacacccctggctaacttttttattttttgtagagacaaggtctccctatgttgcccaagctggtctcaaactcctggactcaagcaatcctcccaccttgaccaaagtgctgggattacactgtgcctgatctataaaccttattctagtttcaaatttcattttttcaatttttaaattttgttaaaaagtgagacacaaacacacacattaggctaggcctatccagggtcaagataatgaatatcactgccttccacctctacatcttgtctcactggagggtctttggggcagtaacatgcatggagctctcatctcctatgatgacaatgccttcttctggaatacctcttgaaagacctgactgaggctgttctacagttaacatttttttttaataagtaaaaggaatacactctaaaataacaagcatagtatagtaaatacataaaccagttacacagtcgtttaatatcattaccaagtattatataattgtgctgcactttcatacgaatggaaacacaagtttgcttctgccagccttaccacaaacacgtgagtaatgagttacactatgacattacaatggctacaatgtcagtaggcaacaggagtttttcagctccattaaaatctcataggaccaccactgtacatgtggtgcgtcatttaccaaaacatcattatgtggtgcatgactgtgtatatataaagcaaatattgtcaagcttagcatttcgtggttcctatgctagagatgcagaaatataaataaagacattaactaaaatgtccaaaaccgccatggtagtagatatcaaaactggaatgagaattgacattctaatactttgctatcaagctatgatgacacaaaatctatcaatccatcatctcttcactaaatgacaaaagtgatcaacacaaagtgtatatcaagggaggaatgtgggaagagaaaggggtacattaatcactgaggcagaaccatcctgggccaaagaatggtattcttagttttaaaaaagttgtccttgactttgaccatccttcttctcactaagggtttttaagataaggtggccaactagaaacagaaaactataggggaaaaagttaggagaaaatcaagcgggagaataaagaagaaaagacaaacaggaaagcataaatagcaggttcacataaaattacttttgcactatttcctaattatgagtttactttaaaagctagtaagaaaaaatagtattataagatttcgtttgcactgtattttaaccactaaatgagaaacaaaatggggagttcaattcagtaatggtaaaaatgagataatggacaaaggtgggaaaaaagtttgtcatttaactaatctttacacagctcaagacattttgcactctaccaatttcacatgcacataggaaaaaacatataaagtcattagaaaagagcaaggtaaacagaaataacaaatattcaaggtgtagtttcaatcatcgacaaaagtgaatgaaaaggaaataccaagataattacataggtgagactccaaataactaatactgccattttacaacctatgttttagaataaaaatattacaagctacagatttgagactacactaatgagctttaaggaacctcatattattacaaagaaattaagtatcctatccaacactacatagttaattagtggcagaacaatgcctaaatcctagttcttacaaatcccaaatctgtgctttctatcatacactacagactgcaaaaacgattttacaacttacgtgtaattaaatattttaaattcatgctcttaagcatgaatttaaacatgctttaacaaaccaactcaacccttaaaaaaaatccaagtattatacaaagtccatatttcaaccatcaaattgttaagttcagaaataattttcatagagatttaaattccggccgggcatggtggctcacacctgtaatcccaacactttgggaggccaaggcagggggatcacctgagatcacaagttcgagaccaggctggccaacatagtgaagcccccatctctactaaaaatacaaaaattagccaggcgtcatagtggacgcctgtgatcccagctactcgggaggctgaggcgtaagaatcgcttgaaccctggagacagagattgcagtgagccaagatcgcaccactacactccaacctaggcgacagtgcgagacttcgtctccaaaagaaaaaaaaagtatttgcctttatacatcattaaatgctcattaagaaaaacagcgacaatccagtaagcaatgctagggaacaaagtgattactttcttacttgctgtatctactaggatacaaacagaaggtaatttttaatgaaacattatcttaatattaaagaatctaggatctcaaatgaaaaaactgattcctcaaatttatgttagctggatatggaaatcttctttaatcctaacatatgtcttctattactgacaatttcattcattcagcaattctttgggagcttcctatgttccaagcctataccagatgttgaaattaaaataaaacagaaccttttataaagaagtcaatatgtaatatttgtttccctcagtagtcaccaataatttcaaaacatttttaatggttaaaagtaattctcacaagttgtccaagaagaatataatccagaaattgctaatgtaacgtccataacaaaacaaaaggtagtaaaggtcagcctttaacgatttctcctacatgattgtaataagagaagtgatacatacaaaccatacagacccttacataagaaaatctcaagacagaatccataaacatgtaaaaattacatgtaaaatgtgttatatttgtatgaatttatcaaggttagattctcaaagagtccattagcccaaaaaaaaaaaagaactattaactcaaaatataaagaacagaacatttcacctaatatcccatttttgagccagactaagtggctcatgcctgtaatcccagcaattggagaggccaaggtgggaagatcacttgagtccaggagtttggaactctcctgcacaatatatagcaagaccccatctctacaaaaaaaaatttttttaatgttagccaggaatggtgaggcacacctgtagtcccagctaaccttggaggctgaggtgagagggtcacttgggcccaggggtttgaggctgcaatgcaccatgatcccaccactggacttcagcctaaaccacagagccagacgccgactcaaaacaattatgtgtgtattttatatttgttttatattatgaaatagatacacaaataaacactcataataaaaagcctaaaatgctatgtgccaaaacattgtcttgcctcttggtggggcaaagatactggagaaggttctctttttattattatcattattattattattatttactgttatatttttcttcttttctttgctacagtattctccagctcaaaaattaatgaattaaaacacaaaaagagccactgatctaaatcaaatttttcttaggtcagggtatttcaggttaaccttctgggaagtacctgaattctatttttaaaagaatttttgatttcatttatataatagtgccaataacaatagatttgggcatatctacattatacatatatagaagcatttcatatgcttatagttcttatacaaacacaatgaaataaattacaaaataagttgaagcagcagcacagaatttatattttttgtgattgtgtaaaatgaaatataatttgtaataaattgataatcactagattggactatcatgtaaaaatagcatcaaccaagccatgaaaattgttaaattcagtctatttaacaatgataattgataatgacaattaatgacaaaatttcttttgcataataagaatatgtgactcaaagtcatttttatagactaagatttcagtatttacttaacacatacagcagattctatactacggaaatggcttgttgtaccgagtaatgtaataattgtaatattgctggttacataaaaaaatgaattcacatgaagtgatgtatcatgtactacatgaataaaaatttgacagaagtttaaaaatagaaaagtaaaggcagattatggcacagacttcaagttatttgcccaaatcctcttcccccttcaatagtaccaggggctcctgattcttaagagccggtaaccgtctagaatgaagtgtatatttcccaatttcataccattttgcttttattaataaagctaatgaaaatctgggaaggaaaaacaatgaatttaagttttagacaaagtgaatataaacgggtaagaagacacctaggtaaagaaatatggcagatttttgaaaatgtgaaactggaaatgaggtctgcattatagtcagtaacattaaaggtgaatcccaccaaacctttaaaagagggtaattccaatgctacccaccctgtctctgggcatgaaaaaagaatggaaattgtaaagttattcacaagaggcaagtataacactgaagctaaaacctcacaaatgactaagattgcatagaaagttaaaacaaccacaacccaatttaagaatagaacatgacaattacaaacaaaacattagcagatacaatctggcaagattaaagaaaaaactaagaccaaaatatattggcataatattgacatatgtaacatcaaaaaaagtatactatgaatatcaactccactgctccacttaaggatgacaaaattgaacattcttcatttacagaaaaactccataaaaagtactaaataaatatttcattaaaatgataaagcatatatatatacttcagatcaaaggctatgtcatacttagtagggaaacactgaaacacctctgctaaagtcaggaacaagaaaaagatgctattattttttaacatcacactggtgatagaagtcaattcaattagacaaggaaacgtaattacaagaattaaagttggtaagttgataccaataaaagttggtaaaactatcaatatctgcagaagatgtgagtgcatgcctgaaaagcccaagagcatcaaatgaaaacactcttttgaatcagacgagctgaatctaatgttagattaacaagccaaagaattttgaaaaaagaaattcaaaagggcaataagaaggaggaagaggaggagaagcaagaggaacatagacctattagtatcaaaacacattgtaaagactcaataattaaattgattaatatgctagcttgacactagtatatgaaatcacacacagactaatgggaaaaaaatcaaactcgaaattgaccccaaacatacaggcatttagtatataacagtagcatcttaaatgaaaacttagactaccgggtaggtggcatagggaaaactaggtaggcatataaaataaattgaattaataacacaatctgtactaagataaattccaaataaattaaatatttaaatttaaagcaataaaactatagaaatattagaagaaacatatgggaattcctttataatctatgtgtttctacccttccaactaccaaacagaaattgagatccatgagagaaaatatccacacatttaacaaaaaaaaaaaatttaacttctgtaaggcaacaaaaaataccatcataactaaacaaacaaacaaattggtaaaaagaaagaaaaaattctaacatatatcacagagttgattccttaatacatgcagagcttctaaaacaaaatcaataagaaaagagacacaatcaatggaacagctgcaaaggacatgctcacagaaagggaaatactaaggttcagagatcatcaaactcactcataaaaaaccaaaaatgtagtttaaaacaacactgagaaatacaaattaaaactctacactaccatatataacctatgcaagtgacaaaagtccaaatatgcttcataacacattctataaggaaacattcacactttgttgatcaaagtataaaaattcttcagaaaataatattaagtttaaaaagcaaaatacagaacattatttataatatgctagcattcatacaaagaaagataggaatatgtatctctatttgagtgcatatgcataaagaaaccctgaaaaattcatctaacagtggttttctgtaaggataaggggtggaaggcatcctggaagagattagaaggagatttttcactgtgtgctttcttataattttttattttaaattacctatagaaaaaactaaatgaatagattgaaaaattttaaatacttaatatcttctatataaaagtttcagataaggtagacatgagattgttaaaacagcacagaaaagttaaaactacaaagaaagtattcctgtgaaagacctatacttttaaaaaagcaaaagaaattggatgaaactaataaaagattcatgagaaataaaaaaccaatcagaaaaacatcaagaaagtcaagcaaaaaaggagtttaaaaatggaagggtctgtcatcagtgtcaaaaactgcagagaccaaggaagataagaaataaaaaaggaccactgtatatataattagtagatcagtaatgatattgaaaacaacaagtttaatccatttgtcctagaattggggatgaaaaggagaggagagaagccaaactatgacactgaacagtggaagggggtgagacaataaagaccattctagcaaaaaagtctggtagaatcaaaaagcaagagagaaaatggaagcttgagaattccagcagcatttaaacaaggttatcaagctctagcatatgataattagacagaggcatgaatatataaatagtgagaagctgcaacatacttccagaaaggtcatttaaaataaaaaaattttcagtgtattaaataataacttcattcaaaataatacacaatttgctaaagaaaaccagacattagtcaataaatacaaaaattacctatgacatcaagtaaaagaaaataagtcctttcaatcaaaactactcttaacaataagcagcctatttcatacttaatgagggcctgcaactgatagttcataatattctggaaacaggtatcaaggcaaatctcacaagtaacaggcgcatcatctaaggatctttttcacattaagaatcctattagaaagaaaacactaaaaggtaattgaatttccctcagttatcttcatctctgtcagctcctgctacaataacttactctccagagcagagataactcaattctgttcagcaagcatatgttatgaatctccaaagcaaacttgtctaaatcattctggtcttctatcaaggttgcctgtggatatgaactctgacagaaagcaaacaaatttatttttatcttttcaataattcacttctttatgccttgatagaagaaatcatgagataaatatatggtctacagttatgttataaagtcgggctgaaatggtttccatgacttaaataaaagacttaatgaataatccttcttaaacacaaagaaaatggtatcaaaaaatagaattggtaaattacctgaagtttcaatttgtttatactgttgccagatccttattatgatctcacaaatgctagtttgactatttcatttttgaagctttatagtaaaacatgttttataaaatgctagaaaattgaatttttaaaaaagataccaacaaaataaataatagttcatatgagaaaatgcatttcttatcggtattttaagccagctggcattttataacagaaaagaattaaaaaggctatataatagagacaaaaattctatgagtgtgagtttcttaagttggggtatacatagatcattgctattcagaacaaaaaacaatccaaattcaaattgttaatgaatacaaccctttcagtcataatccctttcctttaacacaggttaaatttctcaaagattctggcttggctattcatgacctttaaattctacactagtggtcacaataatagcaacaatgataatcactaacacacttcataatgtgttttaacctacattatataattttactctccacaataaaccttttattaacgtttcattatatccatttcatagaagggaaattaagactcagagaggttcaatgaattttatccaatattctccagctaataaattgtgaagcctagaacccgaacatgtttttggaaaccatgttccttctatcacattgtaacacactgtttcaaaattaagttacccttaaacagcagagaaaatgtcaaaaaatgtagccaacaatgcgccttgaaattttgatgtaaagtgtgctaacttgtatttcataaatcaaatggcttatttcttcatttcaagcacaatcagtatgtttttggattgaagacctaaagcaacccattgcagtaatttgagacgctattattaacctataactcctgctaataataggctgaaaataattctaccttggcctttctcatgcataatccatttgtttccatagagaaccatccttactacttttaatcaggtaaaaaagaaatcaaatgtgtggactgtaattagtactcatttattgaataattatttactgagcacctactatgtataggcaatgtacaagtctctatggatatgttatgaatagacatagagttcttaccttcatgaagcacacaaaagaacgaggcaggaaataatcagggaataaaatatataattacaaacaattattaagtgctatgagatattataacagaaagatcttagttagatttacattgggtgattggtgggggtaaaggatgagaggcagagaaggcttctgtgtaaaagtgacacttgaaggaaaatctaaaagatgagtagaagatgaataaaagggtattgtgactaggagcaaaggtaaatggagaatgaggttttgtggttgatattaaggattgtaggtttaacctaagagcaatgggaaggaactggatgtttctatgcatgaacaacatatactaaatttcagaatgactacactggctattctgcgtaaaagaaagaaaatataggtggggaagaaaaataagacaagagattactccaaatgttttgaactatagatgtgatggttaagataacaaaacacagtattgataacaaatgtttttggaggcaaaataaacagaacttgatggtggacagacattaagtgtgtagtaagggaaaaaatgggtaatgggtgatttatgtaagcaagtaagtaaatggaagtgatatttctcagatgggaaaaaatggaggagtagttaacaggggaatatacagttttagaaagtctctccccaaaagtggggcttcttataagaaatttcaagtggcaattacaagtatacagtggtatcacacaggtttgaagctcggaaaagaagtcacaaagacaaaaatcagaaagttttagataataaacaaatgctaacaaaaatagggggaagaggtcctcagaaatattgggtcaaagtgaaaaaaaaatactatatttaattaccttaagataattttccattcacagaaaaaggatatattctggcccagctcttgattacaggtagtaaacatgagccaaagagacgtaccaaattccctatttttcttctttttcagataattagctaatctttatatattacttacatgtgaattactttgaccctaaacaaggcagtgaagaatgagtgctttacctcctacagctatctatcttcatgtaccaataacgtgaggaaagatgtagactcattaattagaagaaaaagaggcccttgtttattagaactacactttacgtctctgcttgcaaactcaacatatcagttcggttggctaaaggatactattattcaggctaagtttacagttctatctctgactgagagctaaatgtcccccaaaaagcaagttcatgaccacagattgcaccactaattcccaggagctatctcataaataagtaacagacgtataaaagaaagctacatcaaaaaaaatttgaaagtttcagtatgaaccccaatgaaaaaaaattgccttacctgaatatcttattaactagagggcagtgatatttgtatgcacagagagacccttttgtggttaaaaatcacaggtttcaggtataacataggaaacatagtgacacaaagaagtcaaatctaagaagttaattttttttttttttttgagaaagagtctcactgtgtcacccaggatggagtacagtggcaaaatctcagctcactacaacttccacctcccaggttcaaacaattctcctgccccagcatcttgagtagctggaactacaggtgtgcaccaccacacccagctaatttttttgtatttttagtagagaaggggtttcaccatgttggccaggctggtctcgaactcctgatctcaagtgatccacccacctcagcctcccaaaatgctgggattacaggtgtgagccaccacacccagctggaagttaaatttgcaaccacaatataatttcaagagttgtatttttaaaatagcattgtcaggtatgtcaaagcaaagtgccaagtttatttagtaagattcactaccttctagagaatatgtaagaaaccatcaataactataaataactattaaaaaacccatcaataactataaaggtacttatgtccagcagttgtaaaaattacttttaaacacatttctgtgtaacttctcctaccagagtaatgataattgggacacaaagtgccaaagtaaaaattatttgtgcaatgtaaaaaatacaggaacagaggcaataatatcaataaaagaccttttaaaatgctcagtatcatcaatgggtctcttctgaattcaaaagtttactcactgatgtttccaaggtttatgaaggtactcatttagaagagctcatcattatataatgacaccctatctagtccatttcttatcattaaggaagagaaatcattttttactcaattcttctggtgcaactcaaggacaggcagtatactgtagcgattaaaagagcagaacataaagttttgagttgaaatcactgagcaatttattaatcagtctttgtcttttcttcatctgtaaaacagagataataaataatgcccacctggctcatgggttatttattgtaaggattaaatgaatcaatgtatacctgacccataaaatgtatgcaataaatcatagctactattaatgttattagtatccccatcctcaacgtttgagtatccagttagggccaggccttgtaagtaatccttaaagatttaatgactacaaattccctaagttctaagatagtccagatacattaacatgttgatgactatattataggaataaaaaaataatgtgctcacaattgtttgaactaataaaaaaccctttagctgtctaaaggaatgccaatgtcctaatcaaaacataaagtgaggtaaaagtttacaattttttctccagaagtaatattttcatgtcatgttctctcctcagaaaattccttaacttgtcacctgacaaccaaatttcacatttactggcaagaacgaagcaccaaaaaagttcctgaatatagcaaaatatttactgccaaaaaattacgctacgattacaattctactggacaagacatgtaaaggagagaaaacagcaacatccctaaaaagcctttatcaaagaatactaccaagctacaaaacggcaaaacccaaagagattcctacttaataagcaaaataaggagtggttcttttccaatatatcacacacacatttaggaggaaacacaaaaacacacagaaacattatgtttcgaaaagccacaaagaaaaccagttttttggttttttggattttgtgtgttttgagatagggctttgctctgtcacctgggccatggtacagtggcccgattacagtgcactgcagcctcaaccacctggactcaagcaatctgcccacctcagcctcccaagcagccaagactacaggcatgtgccaccaagcccagctaatttttaaatttttgaagagatggggtcttgctatattactcatgctggtctcaaactgctggggtcatgcaatcctcctgctttgacctcctaaaaggctaggattataggcatgagccactgcatccagccacagttctttataattcaatcacaaaatgttgttggtatgatcatctgtaccataaagaaatataatcaatgacatctcagttcatcagccattgtcatacaaggcactgtttgctacacataggtagagaaggaaagttggcatattacattattctgtcctatgttcaggaggcaacattccttacaatttttcctgtgaagaggatttcaggaactcggaaaaatcactcaacaaaaggaaatgacaagcaaaaagtccaggagattgattttcaaacttttggttttggcagtactctttttgcctatgtaactgtaacgtggcaaagtataatgaaacctattcttttaaatttgtgttttaacaatatttgtctaataagtgaagtaaatttttatgcaagcccaagaatgtaatacagataaaatcatgtggcctatccctgttcacagtattgcctgagataccgtaagtgatgatctaaagcaatgagttttgaacatatcacttctagtttgatgaaattagggaggagttaaagggatttacaatgctaacagtgaaatagagacacttttattaaatcgacaaatacaattatcacattttccccatataaaaccaaagacatgaggaacagaaggatctctgggtaaatatgaaataaactttgaccatttgtggctgctgatggagatcagatgagtgtgctcctaacaaaaatattcaattagtttgtgagccagtctgatagtttagaggtgtgctattcaagaatggtcgatcaacgtttctgatgcaagtctaagtaccacttctttacactccacaatgagataagtatagaaattgagggaatttagaaaggtttatagcaagtagacatggccacagcatccaaccacataatcagtggactcatctcaataaagtttatgtcttactgaattccctttatgtggatactagttatgtacagtacaaatacattatgtctaatatttcaagaacagtttataatttgtaactcaaatgtacttgtttatataacatttttacaattattttaatgaaagctattattttaaatttatgttttaacagtatttgattaatatgggaagtaaattttttattatctagttttaacgatgtttacaattagcaaaacaaacttcactagacttatttgacaaaaaagacatgccttttcataatgtatcaatagtagcaaacaaatcataactgaagtaattacaagaaaagattccaatctaactaaaattttatatcctaaatttcaactaataggaggaatgagttcaagaaatctattgtacaacatggtgactctagttaataccaatgtattgtattcttaaaaattgctgagagtagatttcagtgttctcaacacagaaaaatgatatgtgaggtaatgcatatgttaattagctatgtttagccataatgtatacacacttcagaacatgttggtataatatttaatttttgctcattaaaatatatttttttccaatagaatttataccagttttagtctaaattaagattgctaatatagtgagttcagttttgagaaacaaggccatccacattcacctaacaagcagggttaaaaactgagacaccagagtcaatattatttcaccatttgtttcaggaaatcctaccccaggaagataagattgcaaagaacaaataacttcactgtttgcttcaggaacaccaatgtatttgaataataaactgcttatttagacaaacagtctcattttcagaacaataagttactcaggaaaaaatttcacttaccaactgtttactaatcaacacctacatcagaaccgttgcctcactttctcccaatcctaaaatcttctatgataaatttatacccaaccacaatcagacctcgtattgaaagacctaagatgtaaaccatttgagttcatacctagaaactctataaatacccaccccaacctctcaccctgagatccttctaagatactgtcaaggttgcattctcatttagtgcagtatataatcaacttagctttgccaggctattctggtggtggtcctgaacagttgagagatggcagtagttttgtagccataaataattaagaattaaaaagaaagtgtggctatgtgcaaagatgtaataaataaaataataaaaacaaacagtttaaataaaaactgcaaagaaaaatgttcaaagtcaaatgaaatattgaaaagaatactgaataagccaacaaaagcagacatttaatatttcacataaaaactacattgtttggtgtacttataaaataccacatcaggttgccaaaatttaaatatgtatattttatttgtatgttttgtgtgtgcacaattgccaagtgttagtgaaagactacatcataagcattttcttcaaaatgttggtgagttacagacacttgccaatgagaccagaactgaatgtattcaggaactgattaatgaacaattactaatagaacccaaaaactagctaagtacttttcattacaacttaaagactgcattgatattgctaagagaacattttgtttttaagaataagtgatatttgaacatgataatatgaaggaaaaatccttatgttttttagatgcactagtgacaaacacaactacattgctctgaagaccatccatacacccaagaagaattatactgtgagcaaatatgatttggagtctgactttcgtttaggaaatgttctgatgatatagctcgaaacaaacatcgtgtggtggttaagatttaagaagtggaaccagtttccttcatcaacaaagccttgataacaacaaaaaaaaaaatcacttacagtgtattagtgacaacataaaaattgctaattgggctgggcgcagtggctcatgcctgtaatcccagcactttgggaggccaaggcagatggatcacgagctcaggagttcaagaccaacctggccaagatggtgaaaccccgtctctactaaaaatacaaaatctagctgggcgtggttgtgggcacctgtaatcccagccactagtgaggctgaggcagagaattgcttgaaccaggcaggcggaggtttcagtgcataaaaaaaagaaaatagggtaaaaaataggtatgacctttgcattaccttcgcaacttgttttacatctatagttatttcaaattagtcaaaaacaaaaagcaaaatccaacgaagataaacagatgttcaagctaaacaataaatgactttcactctttacattttttattttctaaattttctatattaaaaaatacttcatttttataattagaaaaataaacacgtttaaatttaaaaatcgatcaatgaggagaaaagcagctacttaagaggaaaattgaataatttctcatgattagctctaaaattggtatatacagtaccctaaaatacataacactaaaatatgtaattgttaaaatgtttcacattcctttagaactgtcaagaatatgttcaataatagaatatattattacaatagcaaaacactgccatgaagtcgacagaggctatggggacagactgtactgggttattgttatgaaacctgggttctaattcagaatcatggatttaattgttctgtgatcaaagctaaatcacattctctcaatctaccttgcatacatacatcaaagatgtgttgtggtactgaaatgagacaatgtgtactaaatcacttaatagatgacgttaggccacatagcaaagagatcaccagtttatactgggtatcagactaccctggttcaagtccaagcttcatcatatactagctatatgacctaaaacaaaccactgagcctcgctgtagttttcttatctgtaaaattgggctgaagataataacatttacctcagaggactgttatgataatttattttatatttgttaagaattcagaaaaacaagtggtactatagaagtgtttatttttaaaaatttataagtactcacaaaaatgttcactattttaataaaaatattttgcttgctaattggaaaaaaatctttgaattcttcacctaaaaaatatatagattgctatatttgccagacatagtggctcatatatgtaatcccaccactttgggaggcttgagctcaggagcttgagaccagcctgggcaatatgacaaaaccgatctctacaaaaaacaaaacaaaaattagccaggtgtggtggtgtgcacatgtagtgccagctactcgggaggctgaggtgggaagatcacttgaatccaggaagctcagtttgcagtgagccaaaatcgcaccactacattccagcctgggtgacatagtgagactctgtctcaaaataacaataatagtaataataataataataataataataatcagtgctttcatggtctttatttaataaaaaaaaatactccatttttattacttcaaaaaaaccgagagaccacctggtttgcagttccactgaagctagcaacaagtgagttctacagtatgttagataaaattcaaagcaacattggcccaaagaccttttgaaaattcttactgaagttgattttaactcacatagattcctaaaagaaaaatcattaagtgataatcatcagtacatatgttttacagatatatcacattagtttaaagaaactaaaattctaaaagacaaccttctttacaaaaatgattgccaggaaacttgtatattcacacatgcacaatgtttacaaggtatgatgtttctgcatgacataatttttttcataaatattctgtttataaccataagattaagaaacaaagttaagatgtacagctcatcaatgatgtcatgacattcatggaacctctctgtaaaccaaaagcataaaatgtcaaggatatcccactccaatgataagcatgcaatgaactaaatagatgcacattgcagatctacactgtcatcaatcctctgataataaatgaaacaagtcagctactttacacacaaatcgtacattaaatagatgacaacatctttttttgcagaagaaggtaattagcagtagataaaattcagttatattatttaagaatgtacagcttgaattcaaggctgaatacagataacctctaagatataagctgtctcaaaaaaaaaatgcctcatcctgcagagtattgtttaagagcaatacagttagaacatgagcatacttcaaccaattgaagtttgttgaaaaagggtaaagactagcagacataagaaaaaatatacgtttgctctcttaaaattgactctgatgtagaagagatgaacaaatatattttctctgctaaaattttaagtaacaacaatatttatttggaaatatttcttgttttatttagaaattttattataacaccttaaaatactacacaatattgcaaatctcatagcacaatgattaaaatgaaaaactatattagacaaaacataaaattaaatagcttagaataaagctgcaatgtattcgaggattagatcctattcacacggtctttagaaatctaataaaatttgaaccaaattcatagattagtaattgggaaacagattacctggatctggatccaagttgtaactctaggttatttctacttcatgctattttcaaacttataaaatgagggataatatcagtactatctcagaggtttgttgtaagaattagttgctacttatatatacctctaatagctactgaaatagcataaggattcatgaaatattagctactgttggcaccatcattcctcaccgaaactgaaaatatatatacttttcagatcaaatcaatttaatctctttcacaacagagttttagaaacatttcttcaattttcaattccacatttccaccttcctcgttctctctcattcatacaccaattccacgtttactccatcattctctctcattcacacacaaaagaacacacactacccaccaccacaatcactaaatttcaaatttaaaaaaagtgcaatcttaacccatagttacaacaaagaaagcatctccataattaattagaaagtacactaagaaatagattccaggttaggatggtaggctgatattgcaattacatattttttccttcctcatttcctaaaaacaaattagcaaaaaataaataaataacaaaaaataatttttaaaaataatgaaacaatgtaaggaatgtaccataaatcaccaaacattaaaaaattggttgccaaggggaacaaaaacaaactggttctagaactgagggagcaacaaagcttagttcttaatcatgtccccatgcccccaaagcaatattggtaagttgacaaaattctgataattttcttaacgccttcaaatacagagagaaacaaactgagtaggtaacgttacctctttcctcttctacctggagatgccagaaaaacttacagaacaaatactggtgaagcaagaaattgaaaaatgcggctgattcactaaaacagaagtaaactcgactctactctcttaaatgactgagggaaatgattcaaagcctaagcacatcttcccatgagaactgtctatagtctaatgagatagaatgaacttggtagaaaatatttaacaaaatcttagaaaaaaatgaggatttctaagaaagactcctcacctatttcaaataagctcttcctcttcatgataggccataggatattctacaaaaatcaaactgtagctcaggagagggaaatattagctttacacagagaatggagagggaaataagtcactaagatatcctgttgtctaagccaacagaatatctgcacagagcattctaagaatgaacacaatggaacaaaaaagtatggtagttatacaaacatatagcaccaatcaatcaacaaataagttaatacataaatttaaaataaaacgttaatatagaaaagacaaaacatctgatgaaaaagtatctcaaggagtaaaagaaaattattcatgattattttttctaatgaacaacataacaaaaacataatgcaaataagataaaactcaaaataaagtgactaaggaaagaggctgaagtcctaaataaacaaaattaggaacaaaacataagctttatagacataataaataaattacaaataaatatcccggacaaaataaaacattaaaaatgtacttactggtggaaaaataaggctaaggatcaaagaaagtcaagcaactaaggaataactaatagatgtgaaagacaaacatatatctaacatattattaagtgttactaagcaagaaaaaacaaaataaagtgaaagtggtatttcaaagtataatctaaaaaattttctaagaactgaaggaaaaatcagaatctgctgattataacaagaaactatgtcccaggataatttgataaataatgttcaatactgaaccatattcctcttaaagaattttttggacaaagaaatcacaggcagaagacacaaaaagcaaatcagaaattaagggaaaatatcagactgtcctctgaaagcaacattcaaagtcagaagataacaaagcaatgtctgcaaagttctaagggaatttaagtgttacccaacaatattaagtcaagcaaggcagtcatggcacagaaagagggagatgttagagattacaatttgactgaggaacagaaggcgatcaaggccaactatcctccagttaataggaattatgagtatttggatcatacagcagatgtccagttacacacatggggagatactctggaggaagcatttgagcaatgtgcaatggccatatttggttacatgatagataccaggactgtggagcctctccaaacaatagaagtagaaacccaagaagtttctacttttctttttcactttttagatgagtggctttataagtccaatgctgatgaattcttcataccctgggaagtgaaagtactttgtattgatcaaagacatttccaattacaatcaattgggtggagagaagaattttcattgtccaatcaccctcagggaaccgaagtcaaagttataacatattcagcaatgcaggtctataataaagaaaacccagaagtttttgtgatcattgacatttaagaccaaaaaagaaaagactcctaagaagaactgggttttttttttttcctcttccttttgggaagacaatgtgaattaaattctatagtatcttatgaaatacagaaattgtagaacaaaaacttataactttatttatttacttatttttcctgagacagagtattgctctgtcccccaggctggagtgcagtggcacgatcttggctcactgcagcctctgccttccagattcaagcgattcccattactcagcctcccgagtagctgggactacaggcatgtgctacctcacgcctggctaattttcgtatttttggtagagatggggtttcatcttgttggccaggctggtcgcgaactcctgacctcaagtgatccgcccaccttggcctcccaaagtgctggaattataggtgtgagccaccacgaccagccagaaatttacaacttgaactgtgactttccaaaatggaaaattagggcatgtccttggtctgtgttccccaaatagtcaatctttaaagaattcttcaattcctacggggcagttatggtccttcatttgttgatcatctgctgtggcagcaagtgcctcatgcccttccattgcaatgcaagccttccaccctcccctcagaacagaatgctgatgtcagcagcagcctggtgctaaatccaatttggaaaaaaaaataatttgagaaaatatatttccacacccagaaaaaaatatataaagttaagcagaatgccattcaaatataaagatagcaggcaaatattcttaaacatggaagaactttaagtttacaacacatataagccccttgtggaaaaagaataaccatgaaatgcagccaattaagaactgagtcaaaagaaagaatctggaaattaagttccaactaataaagttggggaaaatgaagagtgagtattgaattcacttaaataaagaacaaatactcaagtactataagaaatgtgattataaacatgaatgttataaatttagacaatatgaaaattaaaatataactaaaaattaggaggtgaggggagagaaaataaaaggaacatacaagtgactaatatcctcagcctccataagagagtgtgaattgacatatgtaacataaaaatcaacatcagaggagggcagagcacgatggcagaatagaggcctatcccgtttgtccaccctgctgcaacaccaaattttaacaactatctgcacatagcaaagcaccatcactagaaccaaaaatcaggtgagcgatcacagtacttgtttttaacttcatatcatggaaagaggcattgaggggggcaggagagacagacttgaatcactgatgccacctctgccccatcgcccagcagtggccatgcactgcagacagaaactgcactttggggaaggagagctcaacgactggagaactttacattggtctcagtgctgccctgtcagagcaaagaataaagctatgctgggctccttccatagagggagcatgaggaccagccctagccagaggggaatgacatatcccaggggacagaacatgagtttcttggcaagcctcgccacgcaggctaaagtacactgggttcctagataaacttgaaaggaagtctaggacacaaggacggcaatttctaggctcctcctagtgctgggttgggctcagggccagtgaactagggtggcacatgacctagagacacaccagcttgcgtggctaaggaagtgcttgcattagccgtgccctaaccccagggagtgaagctcatagcaatgaaagttactccttgcttctgcttaatgagaggagagcaaagagtaaagaggactttgacttgcattttggataccagctcagccacagtaggatagggcaccaggcagagtcatgaggccccgttccaggccttagctctcagatgatatttcatttctagacacaacctggaccaaaagtgaacccagtgccttgaaggtaaggatccagtcctggtaggattcatcacctgcagattaaagaactcttgggccctgaataaccagcagtgataacgaagggaatataccatgtgtcttgggctttgagacttactagcttcaggggtgacccagcatattcccagctatggtgcctacagtgaaatactactaatgtttcagaaaagcagagggaaaaataaagggaactttgtcttgcatcctatgtaccagctcggctacatgggggtagagcaataagctggctcttggggtcccaaagtccaggcttaggctcttggacagcatttccagatgtgctttgggacagaggggagctcactgacctaaagagcgagtctcaggcctggcagcattcatcacaagctgacagaagagcccctaggctctcagtaaacatcagtggtggcctgaaggaatcccctgtggaccggtggtgggggtggccacagggaaaggcagctctgcctgtggaaagtgaagagtaggaaagactttgtattgtggtttgagtgcaggcataatgacagtagaatagaatatcaggaaaattgctaagctgtttaactccagtccctggctcccagacagcactttggacattcccggagcctgtgggaactcacggccctgaagggaagaaactggggcaagacctagtgctgtgcaggtttcaggtctaacccagtgcagccctagtggtggtggccacagacttacttgcatcaccacacccccagttgcaggtggctcagcaaagagagacagaccctgtttgtatgggagaaagggaaaagaacaagagcctctggctggtaatccagataattcttccacatcttatctaagaccaccaaaatggtacctctacgagtcagcaaaaaacacagccttattggggttggggtccaagtcctttcaaatacctggaaagccttcccaaggacaacagtcacaaacaagcccagactgtgaagactacaataaatacctaactcttcaatgctcatacactgaagaacattagcaagtataaacatcatccatgaaaacatgacctcaccaatgaactaaataaggcaccaggaaccaattctgacgaaacagagacatatgacaactaagatagttaattcaaaatagctgttttgaggcaactcaaagaaattcaagataacacagagaagaaattcagaattttatcagataaatttaacaaaaggattaaattttttttttaaatcaagcagaatgagtagggaggtggagtttacagtgagttgatatcccaccactgcactgcagcctgggtgatagagccagaccctgtctcaaaaaataaaataaaataaatttaaatatatgtatatatatacatatatatatgtatatatatacacacacacacacacacatacatatagcagaaattctataattgaaaaatgcaataacatgctgaagaatgcatcagagtcatcagagtctcttaatagcagaactgatcaagaaggaagtagtgagcttgaagacaggctatttgaaaatacatagaggagagaaaaaggaataagaaaaaatgaagcatgcctacaaaatcagaaaacagcttcaaaggggcaaatctaagagttaatagctttaaagaagaggtagataaaaagagaggggtagaaagtctattcaaaagaataatcagagaactttcccaaccttgagaaagatatcaaattcaagtaaaagaagcttatagaacagcaagcagaaagaagattacctctgggcatctaataatctaaaggtcaagaataaagaaaggatcctaaatgcagcaagagaaaagaaatcacatacaatggtgcttcaatacatctggcagcagacttttcagcggaaaccttacaggccacaagagtggcaagacatatttaaagtgctgaaagaaaaacacttttactctagaatagtatatccagtgaaaatatcctttaagcatgaaggagataaaaagactttcccagtcaaacaaacgctaaaggatttcatcaacaccaggcgtgtcctaaaagaaatgctaaagggagctctacaatctgaaagacaaggatgttcatgagcaagaagaaaccatctgaaggtacaaatctcactggtaatagtaagcacacagaaaagcacaggatagtattacattgtaattggagtgtataaataaaccaagtagaaagactaaataatgaaccaatgaataataactacaaaaacttttccagacatagatagtacagtgagataaaaagaaaaacaacagaaagtttaaaactagagagacaaagttacagcatagagtttttattaggttcctttttgtgtgtttgtttctttatgcaatcagtgtgaagtgaagttgccattagttttacataacaggttataagattgtgttggcaagccttgtaataacctcaaactgaaacaaataaaatgggtacacaaaatataaaaagcaagaaattaaatcataccaccagagaaaaccaccttcactacaaggaagacaaggaaagaaaaaaggaagagaagtctgcaaaacaaccagaaagcaaataacaaaatggcagtagtaagtctctacttatcaataataacattaaatgtaaatggactaaactctccaatcaaaagaaataaagtggctgaatgaattaaaaaacaagacctaatgatctgttgcttgtaagaaacacacttcacctataaagttacacatagactgaagataaagagacgaaaacagatattccaagtcagtgaaacaaaacagagcaggagtagttacatttaatcagataaaatagatttcaagacaaaaattgtaaaaagagacaaagacggtcattatatagtgataaaggggtcaatccagcaagaggatataacgattgtaaataaatatgcactgtattagtccgttttcacactgctataaagaactacccaagactgggtaatttataaaggaaagaggtttaattgactcacagatccatgtggttgggaggcctcaggaaacttacaatcatggtcgaaggggaaactggcaccttcttcacaagttggcaggaaagagaagagtgaaggaggaatttccaaacacttataaaatcatcagatctcatgagaactcactattacgagaacatcatggaagaaactgccccccagtgatccaatcacttgcctcccttgacacatggggatcataggtccctccctcaacacgtggggattacaattcaagatgagatttggatggggacacagagccaaaccatatcatgcacccaacactggagcaactaaatatataaggaaaatattatgagaactaatgagagagatagactccaatacaataatagctagacacatcaaaatatcccactttcagcattgggcagatctcacggacaaaaaaaaaaaaatcaaaaaagaaacagcagacttcatctgtactacagaacaagtggatctaaagttatttacagaacatttcgttgtttttttttttttttttttttttgagatggagtcttgctctgtcacccaggctggagtgcagtggcatgattctcagctcaccgcaacctccatcttccacgttcaagcaattctcctacctcagcctcctgagcagctgggattacaggtgcatgccaccacactcagctaatttttgtatttttagtagagacggggtttcgccatgttggccaggctggtctcaaactcctgacctcaggtgatccacctgcctcagcctcccaaagtgctgggattacaggtgtgacccaccacgcccagccagatatttacagaacattgcatccagtagctacagaatacacattcttctcctcagcacatgggtcattctcaggaacagaccatacgttaggtcacaaaacaagtcttaaaacactcaaaaaacctgaaatatcaagcatcttctctgaccacaatgaaatataactacaaatcaataataacaggaatattaaaaactatacaaatatattgaaattaaacaatatgttcctgaatcaccagtgtaatgatgaagaaattaagaataaaattgaaaaacttcttcaaacaaatgataataaaaacacaacatactaaagcatacaggatacagcaaaagcactattaagaagagaatttatagctataaatgcccgtgtcaaaaaaaaagaaaatcttcaaataaataacctaataatgcatcttaaagaactagaaaagtaacagtaaactgaactcaaaattagtagaagaaaagaaatacttaagttcagagcagaaataaatgaatttgaaatgaagaaaacaatacagaagagtgattaaacaaaaagttggcttcttgaaaagataaacaaaattggcaaccttttagtgagactaagaaaaagagaagatccaaacaaatgatatcagatatgaaaagggagacattacaactgatacggtagaaattcaaaggatcattagtggctactatgagcaactatatgtcaataaatttggaaaatctagaagaaatggatcaattcctagatacataaacctaccaagattgaaccattaagaaatctaaaacctaacagaccaataacaagtgacaagagtgaagccttaataaaaagtatcccagtaaagaaaagcctggggccagatggcttcactgaattctaccaaacattttaagaactaataccaatcctactctaagtattccaaaaaatagaggagggaagaattccacactaattctacaaggccaatattaccctgataccaaaatcaaagacatattaaaaaaagaaaactataggccaatctcactggtgaatattgatgcaaaaatcctcaagaaaatactagcaagctgaatttaaaaatacattaaaaaggtcattaatcatgaccaagtgggatttatcctaggggtggaaggatggttcaatgtatgcaaatcaatcaatcaatgtgatacatgatatcaacagaatgaaggataaaaaaatgatcatttcaattgatgctgaaaaagcatctgataaagtacaacatccgttcatgataaaaaccctcaaaaaaaaaaaacgtgatacaaatggaatatgccttaacataataagccatatatgacagacccacaaccagtatcatactgaatggagaaaactgaaagcatttcctctaagatctggaacatgacaagaacatgtactttcaccactattattcaacatagaactggaagccttagctagagtaatccaacaagagaaggagataaagagcatttaaattggaaaggagtaagtcaaattatctttatttgcagatgatgtgatcttatttttagaaaaacctagaatccaccaaaaaactataagaactgataaacaaattcagtaaagttgcagtatacaaaaaccaacatacaaaaatgagtagtggccagacatgatggctcatgtctataatcccagcactttgtgaagataaggaggtggactgcttgagcccaggagttcgagaccagctgggcaacatggtaaaaccctgcctctataaaaaacacaaaaattagccggacatagtggcacatgcctgtagtgacagctactcaggatactgaggtgggcagactgagcccagaagctcaaggctgcagtgagccatgactgtcactgcaacccagcctgggtgacaaagtgagatcccatctcaagcaatcaatcaatatcagtagcatatctatatgccaacagtgaacaatctgaacatgaattcaaaaaagtaatcccatttacaatagaaacatacaaaattaaatacctagaaataaattttacaaaagtggtgaaagatctctataataaaaactataaatcactgataaaagaaattgaagagaatataaaaaaatggaaggatattctatgtttatggattggaaaatcaatactgttaaaatatccatattaaacaaagtaatctacagattcaatgcaatctctatcaaaatactaatgacattcttcaaagaaataaaacaaaaccctaaaatttatgtggaatcacaagagactcaaaatagccaaagctatcctgagcaaaaagaataaaactggaggaatcagattatctgacttcaaattatattactgagttatagtaaccaaaacagaatggtattagaataaaaacagacacataaaccaatggaacaaaaagaggacccagaaacaaatccacacagctacaggaaatgaattttcaacaaaggtgccaagaacaaacattggagaaaagacactctcttcaatatatggcactgggaaagctagttatccatatgcagaagaatgaaccttgatccctacacctcacaccttatgtaaaaatcaaatcaaaatagattaaagacttaaatctaagacttcaaactgtgaaactactacaaaaaaaactgaggaaactctccaggacattggtctgagcaaaaatttcttcagtaataccccatagtcacaagcaaccaaagcaaaaatgaataaatgggatgatatcaagttaaaaagctactgcagagcaaaggaaacagtcaacaaagtgaagagacaacccatagaatggaagaaaatatttgcaaagctacccatctgacaagagattaataagcagaatatgtaaataactcaaacaactgtataggaaaaagtaataatccaatttaaaaatgggcaaaatatttgaatagacgtttctcaacagaagacatataaatggcaaacaggcacatgaaaaggtgttcaggccgggtgcagtggctcatgtctgtaatgccagaactttgggaggccaaagcaggcagatcaattgaggccaggagtttgggaccagcctggccaacatggtaaaatcccatctctactaaaaatacaaaaattagctaggcatgatggcacaggcctttaatcccagctacttgggtggctgagccatgagaatcccctgaaccagggaggtggaggttgcagtgagccaagatcgcatcactgcactccagcctgcgtgacagagtgaggctctgaaaaaaaaaaaaaaaaagaaagaaaagaaaagagaaaagaaagaaaaagtgttcaagggccaggcactgtgactcacacctgtaatctcagcactttgggaggctgatgaaggcagatcacttgaggccaggagttcaagaccagcctgaccaacacagcgaaaccccatctctactacaaatagaaaaattagccgggtgtggtggcacaggcctgtaatcccagctacttgggtggctgagtcatgagaatcgcctgaaccagggcagtggaggttgcagtgagccaagatcatgtcactgtacttcagcctgggcaacatagcaagactctgtctcaaaaaacaaaacaaaacaaaagatgctcaaaatcattgatcatcacagaaatgcaaatcaaaagtaccatgagatatcatctcactcgagttaaaatggcttgtatccaaaagtcaggtaataacaaacgctgtcgaggatgtggagaaaaaggaacccacatacactattggtggagtgtaaattagtaaaaaccaccatgagaacagtctggaggtccctcagaaaactaaaatagagctaccgtatgatccagcaatcccactgctaggtatatatccaaaagaaaggaaatcagtatattgaagatatatctgtactctcatgtttgttgcagcactgtttacaatggctaagatttagaagcaacctatatgtccagcaaaagatgaatggataaagaaaatgtggtacttacacacaatggagtactagtcagccataaaaaggaatgagattctttcccatttgcaacaacatggatgaaaatggagatcattatgttaagtgaaataagctatgcgcagaaagacaaacatcgcatgttctcacttatttgtgggatctaaaaatcaaaacaattgaacttgttcagttgaactctgaacaattgaactctgagttcaaaacagttttactcagagagacagtagaaggatggttaccagaggctaggaagggtagtgagggtgtcacgggtaggtgacgatgatctataggtataaaaaaaacagaacaaatgagtaagatctaatatttgatagcacaacaggagacaatagtcaataataatttaattgtgcattttaaagcaactaaaatggtgtatctggattgtttgtaacccaaaggataaatacttgaagagatggatacccaatattccatgatgtgattattatgcactgcattcctgtaccaaaatatctcatgtactacataaatatatatacctactatgtacccacaaatattacaacgaaaagaaataataaaaaatcaatgacataattacactgaaaataattaactaaaatggcttggtggaattctatgtcaaaactcatgtttaaaaactgaagccatcaacctcttaattttttcataatttattaaccttctattctttcagaaaataattttcctttacttaaagaaacatttccttgttttttccataattattattttgctaaattttatacaatactgcaataaatagccatgtatacctatctttaaatactattatttttaattcctaacagatatattcacaaaaataggattactcggtaaatgggtatttgcatgtttgtgagtgtcaatgtaattttttaatagctatgactatactgctttcccttaagactaaaaatgtactttctgttaacaatacaaaagaacagcattgcccatttcatctctcttattcacttcaacagtacgttatcattctttttactgtctctcaaccgaagaacggaaaattgatagataataatttatctaatttacataggaatccttttcatatgtttactggtcacttttaggttcttttgtgaatttcttattgatatcatctgagtttctgtctattgggttgtttttcttataagaattattagtacagtgaatatattaatcatttatcagtcataggcattatgtttttccaagttgttgatggtatctttcctccacttaatgttataggtagtaatagatgtctacttttttatttctactttctaaatatcctacattttggttatcaaattcacacatatgcccaagttctacttttacagttttccaaatatgtttctgaagtatttatcatgtcatcttcctccctattgcttatttcatctggaagaattttaatatatgctgtctttttagtgatgttttaatttctggagaggcaagtatatcccattactttttcacaaattgtaggactacattaaagcatttattttcccacattaactgaatatttaaatatccaaatataatagttgtgtcttaaatttgttataaagaatatttaaatgtcaaatcaactctactgttattttaatggagtgctttactaatggatattgcactgagtttacatactgacttgagaaaaatgaacatttttgtgacgtaaaattttctctctttggctataaaagacagtgtggagtcttttttccagttggaaaactggaaaaatacaagtaatgttggtatattaagtaacagcatcctgccaatgttaattttctgattttgataactgtaccagattaagacagagaatgtgcttaggaaatttccactgaagtattttgaggtagaagggaatcctgactttaacttactctcaaaattcagaaaaacaaagcataaagagaaagagaataaatgtcgtaaaaatttaacaatcacaagatctgggagaacagtgaataggagttcctgctttattcttacaactttcctgaaagcctcaaattatttcaaaacaaaagactgattctgtctctctctctctctctctctcacacacacacacacacacacacctcaagaccccaagacagactatccagcatggaattagtttatattttatcttatttgctttaataaaattttgtagcttcattccaaagagcatgtgtacttttcttgcagaatttggcccaaaacattgtttttgtcatatttatgaatacactgtatttctgatttccattcttagctggttactgactgtcaaagaaaagctattaattttttgcataactatctcatacctaataacctcaccaaattctcttattaactctggtagaaaaatgttcaagatccaggtacacctcaggacacaggaattagattttcctagaccacagcattagaaatttgaaagtaatcttctttctttctttactagcatttatattagctgtatcttgcacttgcaagaacatcaaaaaatatgttaacaacagtgacagtaggtatcactcatttttcctgattttaaaagagatgactttaatcatttaaaatgatatttaatagtctttaccatatttgtattgttttcttatataaatctttttctgtgagttttaatacggctggcagctaacaatcatcatatgctttttttctacctttactgatatcttcgtgttttttctatttttaatttgttgatataatttattttgcaggtagatatcctaaagtaaacaattttgtaattccagtaaaaattttcagtcatcatactatataattcattctttatattgatgaattatgttatttaaagttatagtttaaattttgtacttatattcttaagtgaaattggtcttctagagttttatttttctagaataattttcagatttgctggttgtataaaattcacttggaagatttttcatcttttctaatgtaccagaaaaatgtcagcaacatatgagtttatctgttcttgatatgttagaagccatacagtgcttttaaatatttttccaattctatagcaaatgtactacttgtcaaattttctagttcaccttaggtgaatttgggtcatttctatagctacaaaaccattaatttcctctagaaatttgtatttcttatacatgttcaggcacaactactgagataagcaatggtcccaggatgagtttatcacttagtcctctcctatgagaatccaaggagagaggtgtgtgctccctcatttcctcagctacaaatactgttacgctctcaaaccctaaagacagagaaatttcacacccctgtgttcagctcctctctagaaacctggatgatcttacctttgccatagagattttcatttctggctaactagctctgttttgtccagaaagggccaactccttcaccagttttctttataggaaaaccatcagagccaagatttacctctgattattaagattagagcagccaaacaagaagcttctctgatcaagcttctgtggtagctcaactacaattgagacaagagggctaaagagacatgtactatctcccagaacccccatgactctcctataaacctagattttaattttttgatgacatatactatgtttctttggacctgccattttaccgggacaatttctcatgattatcattaaaaaacggtaacttccgcacaccaaccatatgtgtaacctacctcaaattccgcatgtctgtgaatatcttctgctctctgcctgctcaggataaattcagcttcatttgctactcttactagatgatccttcattgtctggctaagcaacctgtaagaaatgaatgttatcaaataaatatatgtatacacacacaacataaatgattattcactgcttacggtggagaggaaggaatacttactttcttcttttgacatcatacacaatgaggtaccattatttcatgctaaataattgaggaatgtaacaacagcaaaaggttacccttctggcaatagcagattagcttctatcagactagccatgtaacaaaagcaactaaaaatactggattaaagttgtgttttaatcttttaaaatgcactggaaagttaccaaggcagccaaaattaaccagtgaagatcacagagaagaaagcacacaaaggacaatcagtgtgactttttacattaaggcatttgctattcccaagtgagaacagaaaagctacacagacctgtcactagtctcacaaagataaatagaaaaaaattgaggttcacagtctgtcaaggtggaggagtcccggtagactacccaagagttacagcaggaatcaagtgtaccccagaaagcaagaaatagaccaggcctcaaaacactgaaacagaccttcagagatttggtgattggtatttaggttaactggcagccaaaaagctaagcaaagctttcagggtggggagaaaaaaatcagaaataccaatgcaggagggccatggcaaaaccccaggttttcagagtacctcagaagggctacacactaggagaaggcaaacaaaataggccaaactctcacaagaacttaaaaataaaaacccagccttgagtcagctcagaccctaaattaatacaatcggccattagtctaactgctaatcagaaaccaaaaggaagtcctttctaaaggaagataatatcatagagacttaaatttacccttgccattttaaaatacaattttcagcattcagtcaccaattaataggcacaagagacaatatcatacgaatggaaactaaatagaaactggctcacatctggacattgaaataaatatagttaatatgtttagaactaattgtgtaacagagaattccagtaaagaatgaaaactgtagaagaactgaaaaaaaataaataaatataaaaatagatttactgggttattaagctcagccaaaaaaggaaaaatttactgaaagataggtcaatgacaactagactgaaacatagtaagaaaaattaatgaaaattgaacaaaataaataacagacatataggacatggtaaaagaatctaatgtaagtgtatctgtagtataagaaagagtagatacataattagaaaaaagcaatatttgaagagataatggccaagatttttcaaaactgggaaaaaacactgagccatatgttgatggagtgctacaaaacccaagcagggtttttaaggataccctgcttaggcagtaatagtaaaactatcaaagaaaaaaattcttaatagcagacagcgggagaggccttcaaaagagcaacaataagcctaatggaagccagataagaatgcaatgacctatttgaaatactaaacaaaaatactacctaaaaggccaggccagtggctcacacctgtaatcccagcactttgggaggtccgggcgagaggatcacatgaggccagtagttcaagaccagccttggcaatgtagtgagatcccatctctaccaagaaagttttttttaattagcgaggcatggtagtgcatgcctatggtcccagctactcaggagcctgaggcagaagcatcacttgagtcaatgagtttcaagttatagtgagctatgatcacaccatggcacttcagcctgagcaacagagagagatcctctctcaaaaccaaccaaccaaccacctaagaattctatcctcttcaagaccagcctgggtaacatagtgaaaccctgtctctactaaaaatataaaaattagccaggcatgatggcaggtgcctataatcccagatactagggaggctgaggtggaagaatggcttgaacttgggtggcggagcttgcagtgagcccagattgcaccattgcgctccagcctgggtgacagagcgagactccgacagaacgaatgaacaaacgaatgaacgaacgaaggaaaaagagagagagagaaaggaaagaaaagaaaaaagaaaagaaaagaaagacgaaagaaagagagagagaaagaaaagcattctatcctcagtaagtatccttcaataatgagatttaaagggtcaagagtataccactgtgggaaaaaaaaaagagtatttttctgaactttctttatccacctaaatgaagaagctcccaaaagaatttagctttcatcaatcccttcccagggagttttgcaaccaaggaagattgactattgtcagtaaagatgagaagttagtaccaggatgagaaattatctaaatagacattgatacaaaactataatatcacttaactattctcctaagggcccacttactgttcacaaaatcattagctttcccaaatgtgcccttcattacttcacttttaccctattaaaatggtatgtatataaccccaaattctaaccccctcctcaagtcacatttttctctgaatcttttttttttttttttttttttttctgagacgaagtttcgctctgtcgcccaggctgggtataatggcacaatctcgggtcactgcaacctctgcctcctgggttcaagcgattctcctgcctcaacctcctgagtagctgggattacaagtattcacaatcatgccaggctaatttttgtatttttagtagagacggggtttcaccatgttagccagggtggtcttgaactcctgacctcaggtgatccgcccgccttggcctcccaaagtgctgggatttcaggtgtgagacacagcagccggccgaattctgacagacttatgactaaaaataggtcttttttcttgctaagctgtgtttgtctgtttaattcacaggtccccaaacaacaaacctaagagggtagaggaaaacttttcctcatcatcaaaagcaaaataagaacattccatgacaaataaaatagtgagaatttgtcaccagccaaccaacatacttcacaaggatgaaaaataatataagattgatacaagtcaaggaaaacaattggagcaatgaaaatgacaaacgtgggtaaatctaaaagtatactgaatgtttacaataattatgtaacttctagaattaaaaaatactgcaatctaaaatatataaccacagcatacaaggcaagagaaaccaactgaattagtgttataagtttcttgtgtcatacatcaattggcaaaagaatcagtttatgtaagatgttaattataatattcatactacaatctctgggtaaccactaaagttatttaaaataatatataaccaacaagccaatgggaaaaaaattaagcaacaaatacttagctcagaagaaggaaaaaaaaaagaaacacaagatgtggagcaaatataaaggacataaataataagatgataaattttaacctaaacatatcagaaatacatagaaagtaaacatttagtagtaaaattattgtcaaatcaattttttaaggcatatgatgcttgtaagtgacacaatttcaatataaggttaaacaaagattgaaaagtataatttcagaaaacatgaacaatttttaaaagctaaaaggtaataaactttttttagtatgagaagcaaacagaaataaaataaacctgttaaattaataaaaggataaatgaactagagatacagaaatttagtattttgagattctaaatttgtatgctcttaagaatatggcctactaccagatatagaatatataaagctatagaatattttttaacctgacctgactgacatatcgagaacattatacccagtaagtgaataataaatattattttcaggtaaacatggaacatattaaaaaaaacaggcaaaatgcggggtcacaaagcaatttacagtgaatttcaaatgatggaatcatactcagtatgttctttgatacatttcaattaaactagaaataacaggatacagatcactctgcaagaagctctaagctgaccactgactttcctaacctcctggtatccacagcattatgtaatcttcccctttagagtgtaagaaggagatggggcttgcctcgaagcaagaaaatatggcaacaatgaaggaataacacttcaataattacattaaataagatggtaacttgcatcttgctagcagactctattgacgctctcccttaatggcttagctaaagaaagctgtcatgttatgagctgccctgtgtaaaggcctccatggcaaggagctgagtagagccccagacaacagcccgcaaagaattcagactctcagtctaacgactcaaaaggaagtgaatcctgccaacaatcacatgatcatggaagcagatcctttcctagtcaaacatcaaataagactgcaactctggccagcacctcaattgcagccttgtaagtgaacctgaaggagaggcccagctaagccatgcctaggattcctgaccaagaaaaattgagataacaaatgtatgtttctttaaggctaagttgtgataatattgttaacacagcagtcgctaagtaatatcatttcatgtctaaaaattaaagaatgcacctctgaaaaaaacgcacacataaaagaatacatcataatggaaattaggaaacgtttgcagtaaaacatagtaaaaacaatgtgccaaaatctgtggatttagataaaccttaaaccaatgcttagagggaaattgatacactgaataaaaacactaaagaagaaaaaaattgtcaaaataaattatgcaagtattgaactgaagaaatcagaaaaagaacagccagtgaacactgaaagttaaataaggataagaacagaaattaaatagaaaataaaaaatacactttagaagataaagttaacagttagttatttgaaatactgaaaaaatccaaaagaaaaatgtaaacaattaaaagtaataattgaatttaggagggtcactggatttaaggcaaatacacaaaaatcaactagattatatgtataggttactaacaaagtaaaaatggtttttaaatactattttgaaaagcattcaaaaccatcaaaatatgtaggaaaaagaaacaaaaatgtgctagaattctgcatgtcaaacagaaagaatggtaaaaaaaaaaaaaaaagttaaaacttaaagaaaaaagtataccatgttcatgaaagggaaaggcttgtattaaagatatcaattctccacaaagctatttatagatacagtccaatcaaaatcctagcaggtctttctgcataatctgatgagttcaaatttaattctaaaatctatagaaaatgtaaacaaacaagaatacatgagacattcttaaagaggggaagagagatgataataatgataatgatattaaaagacttataagtaagatggtcttttccaaaaactggtcttagatcaatcaactgatgctcatatggacaaattaaccctgacttctacctcaaaccatacaaacaaaccaattccaaatgaatcctagacaagacctaaagatttcaggaagtttaaaaagtttctagaagattacataagagagcatcttcctgactgggtcgatgtaaagacttactgcaccaaacaaaaatacacaaaacataagaaaaatagtgacaaaatgaactacatcaaaatttaaagacttgtgcttatgaaagccaccactaagagaattaaaagccaaacttcagagagagagaatatacttggaaaaattacaaccaacgaggaactgctatcttaaatatattaaaaagcctcttacaaataaaagaaaatgatcacaatttttaaaatgggaaaagtacacaagcacttcacaaaagaagatttccaaatggtgaataagattatgaaaagttgttcaggattactagtcatcaaggaaataaaacttaaaaccataagatatactatactccacagaatggctatatatgtttaaaaggctggcatcaccaagttatatcaaagatgtgaagtaacagggactcttataatcacaaaatcgattaataaaaatgttcatggcaattatttacaatagccaaacactagcaactacccaaatgtccattaaaaataaaactaatttttaaaatgttggactttcataaagtaaaatgctaagtaggaaaaaaaagaatcaatattatgcataacaatatgaatttcactaacaatatgaatttcactaacaatattgagcaaaagcacacaaaaaatataaaatgtatgaattgccttgtataaagataaaaatttttaaaaacaaaactatggtattagaagttaagagattaagaaatggtaaccttcagtgctacctctccatatgaggactcacacggaacactgataatggccacggagttctaaatattttaataaaatgtcttagatgtataaacaaacgacccattctgattagcgcttttataacaccatttacttataaacatatcaacagaatgattcactttatgtaatctggaacatttttgatatgtataggtcttctaaacttccttctttaataggagttgagaacatagagcgggcagggatagaattattattattatcattattattattattattattttttttttttagggacagagtctcgctctgtcacccaggctggagtgcagtggtgcaattatggctcacagaaacctcaacctcccaagctcaagtgatctgcctacctcagcctgctgagtagctgggactatatacatgtgccatcgtaccctgtaagttattttggtggtgttgtagagacagggtctcactatgttgcctatattggtctcaaactcctgagctcaagtgatcctcctgccttagcttcccaaagtgctgaaattatgggcatgaacatacatggcctgcaaggattatttttttaaatttatataacaaaagtggctaaactgccactagaaaatgcccacctacaaaagttacacctagcagtcatcaacaatgacatgaacttactcccattccacagggcacttgcctcactttgtagcaatgttttcatttaaaatataaataaggccaggtacagtggctcatgcctacaatcccagcacgtagaaaagagactccttgagccccaggagtttgagacaagcctgggtaaaataaagagacttcttctctacaaaaaaacaccaaaaacaacaaaattagctgagcatggtggtacacatctgtagtctcagctactcaaaaggccaaggcaggagaatcacctaagcccaggaggtagaggctacagtgaaccatgatggcatcactgcactgcagccagggcgacaaagtaagaacctgtctcaaaacaaaaaacaaaacaaaaacaaaaaaagagcaaacataaacttggatccaaagcaattgtcacaaaaattgtttttatttttttggagatagagtctcactctgttgcccaggctagagtacagtgacaggatctcagctcactgcaacctccgctccctgggtacaagtgattatcatgtctcagcctcccaagtagctggaattacaggtacatgagtcaccacccccggctaatttttgtatttttagtagaggtggggtttcaccatgttggccaggctggtcttgaattcctgacctaaagtgatccacttgctttggccttccagggtgctgggattacaggcgtgagccaccgcgcctggccagcagtcttaataatgcgctatatgaacatgttcccacaatgcagaaaaacatgtggaaaatattcctcatgaatcaattaatttcactacaacactatttatgaaagtgagaatcttaaagaatcaaaatatacaatcatataagtagattgttccaaattgacaaaataatgtccacaatatacattaagaggaaaaataaacctgaggaatattatgaacaatatgagcttggggaacatataaaagaaaatacactttcttttaattgccaataatctagaacaggggtcagcaaattaaggcctgtgtgccaaatctagcctgccaacattttttggttagtaagttctataagagcacaactaggcccatttgtttaagtgttatccatggctgttttcaactcaccatactacactgagttgaccagttgtgaaaaagaccatgtgtactgcaaggcctaaagaactatctggccttttacagaaaaagcatgcacatgtctgggctagtgagtgaggcttaagtcctcctccttacatgtctctgttctttgaagctttacaacaatcaataatcaaaagaaaggaaaacagaaaatccttaaagaaaataaaaaagctttctgccattctatcactttgtttcgatctctattaggctcacatacactattttaatttgactccagctctgtcagactctctcttctatccccaaactgtcttccagctactttagaagttaatgcaatttcttatctatgattttggggtgacatcatcagggtattttttttcaaatgctattaaacagtactcatttaggcattacagacaaaaaccatccctagtgtaattttaaaacccactaatgaataacttcctctgattctacgatagaaaaaacaagggctttcaagagtacagatgtgaaatactggtttgggttcttaatttccctctagagacctaaaaccacattgtgaatttaacatcaatatattgccttgtactttcaaacattaattgaattgattagtcaatggcacactatcctactagtccccaaacaagtaacctcaaagttattctagtctcttccctcttctctaccaccttccttcaggcccctaatcaatcaataagtcttgtcaatatttcctttgtaatattctcagctttaatttatgctgttttatagccaatgtcctaaaaataaaggtttcatcatttcatatacattataactgaataaatcttctgagtgctaattctgatcttttaacatttttgtgcctctgccttttaaaaacactgtccaacatctgttcaacacctattacattatagactaggctaagcagcaaagatgacctttcattatattttagttggggaaaaagagaatccactggagtcctttccagcttgaaactcatattaacataagtgctatggtggacacaccctaatgtgacctccagtgagtcgtggctttaaatgatcccaaccccttgagttcaacctgggcagaatctggcacttccttctagcaaacagaatatagtaaagataatgggataatcattccttaattagggtactttacatgccaacggtgatgggataatcactctggtacttatgtaataaagttctgccctagcatactgcagagattctcctgccacccctgaagaagaagtaagtggctatgtgtgaccaggccatgagacagggaagtatggacagcctgtaggatctgagagcatcctctcagtgacagtaaacaagaaaatgggaaactcagtaccacaacagcatggaactgaattctgccaagaaatttgtgaccccaagctccagaaagaaatgcagtttgaccaacacctttattgtagacttgtaaaaccctaaacagaagatccagctaagctgagtctagacttctgacccacagaaactgtaggatagtaaacataagttgctttgagctgcaaaatttgtgggaatttgttataaaataagcaatacaaataaaattagaacataagaatatgtttgctatcatatctctatagaagcaaagatcacaataatctactaaagatgaaaaaaagctccaatagaaaattagagcatgaagatgagccttaaagggcaaaagcaacaaaaagagaaagatacttcagataacagtatgaacaaagttataaagagaaaaaaacctttgttttttgttttttgtttttgttttggagatggagtcttactctgtcgcccaggctggagtgcagtggcacgatctcagctcactgcaacctctggctccctggttcaagcaattctcctgcctcagcctcctgagtagctgggattacaggcacgcaccaccacgcccagctaatttttgtatctttagtagagacgggatttcactatgttggccaggatgttctcgatctcctgatctcatgatctgcccgccttggcctcccaaagtgctgggattacaggcgtcagccactgcgcccagccgagaaaaaatcttgtgtgttctattttcaagagaaccgaaacatccctttctatcacttagttttcaagatgtccatttactgacatatacacttagataggtaggatatttctgtcttgatgtttcactcatttttctggttacatagcatttaaaaaccatgcaacactttaataatgaagcaacaagtgaaagctcccagcccccttccctgttcacttttcagaatacatcaccaccatgagtagtttatgttcctgtccttacatttatctaaacttatagaaacatatacagtatttatgtgcatatatatgaaacacatacagtatttatgtgcatatatacatatatacaaatgtacatgttcatgtgttttgtaaaaatatttttaaatacttaagaagtcatactataatacttgtatattttacttaaccgtataccattatgtaatcagaacagcttcaagtgactcatgtggatggaatgtaccgtaatttatcaaaatagtcccttatccagagatcattcattctttcattctttgccccattaacataaccattatttatccagttactgaagctagaaatatcagtcatatcttccttcttcatcatcctacagatccaatagaccaagtactgcccattctacctctgcaataactttaaaagttgtttctcttactttttttttttttttttttgtgagacagagtctcgctccatcgcccaggctggagtacagtggcatgatctcggttcactgcaatgtccgtctccctggttcaagtgattctcctgcctcagcctccagagtagctgggactaccagagcccaccaccatgcccggctaattttttatatttttagtacagacagggtttcaccgtgttagccaggatggtcttgatttcctgaccttgtgatccgcccacctcagcctcccaaagtgctgggattataggtgtgagccactacgcccggccaaaagttgtttttctttgtaaccttttccggtgcccttcactggaaactcactggaactcaggatcatgtctttgattatgataatagcctccaatccaacttctttccatgagtcttactattcttgcccattcttcactgggatcatctttctaaaatgaaaatctgataatcactgtattgttgacaaggtatcagccgtcagccatcttcccatgatctacaaaagagactaaacacctttccatggcttataaatcagtctcattgttgttaaacttttatactctaagaactccaggtcaggaactactctctcaaacattacaccctgttactgtacactcctttgcctctgttgctactgtcccaggaatgacctcacttcatattctatctaacctaccttcaaagctaaaccaaagtaaaggttcactacagaaccttttctgatcccacacctgctttccctccacagaagtaatcccctaccaacgtgtatcagtctcttctttagtacttattactttgaaactttctgtataacacaatttcaattatgtatttacaaatctgtcttccatttgacactgcaccaaccatttataatttatctttacacaaccaaagcatagaacagtgcctggggacccagcagtgcttataaggaaaagaaactttgactatccacttctgccagtcacttctaagctgctaactgtaaggaatacaaacatgcataacactgtccacaaagagttcacaatctaatatggaaagttataggactatatacaaacagcaagataactgtgaaaaggttcttaaggttcttaaaacattttcttctcttaacttttgcaataatacatagcactttcttggttttcctcctatctagctgctgcttcttcattgcccactttgctacatcctccgctgcactacctacaaatcttgtaatgtccaagagctcagctgtgtgttctttcctccctctaaattatttcatccagttctatgacttttaatctcacctacatagtactaattcctgtgtttatatctctaaccctatccttggtctcctatatttcagactcacagggccaactgtccaactaaaatcttcacgtggatacccaataaggcatttcaaatctaacatttccagagcagaactcttgattctacctactcactgccaataatacctcttccccatcactacctcagtttgtcccaccacaataaatagcgccaaagtccactcaaactcaagaaataatctttgattttgtcatttcctcacctccaaatcccattcatgaaagcaagttctactgctttaactattaaatacatcacatatatgtttatttctctccatcatcattgctaccacatcattctaagtcaccattccctcttttctagaatacttcagtaatatcttcactgacttatctgctttcattcttgccctgtataccaatcctatcacaattcattcttctaagaatgtaagccatggtgttgggaaagctggatatcaacatacaaaagaatgaaattgagccaggcgcggtagctcacgcctgtaatcccaacactttgggaggccaaggcaggcagatcacgaggtcaggagttcgagaccagcctggccaacatggtgaaaccccgtctctactaaaactacaaaaactagctgggcatggtggtgggcacctgtaatcccagctactcaggaggctgaggcaggagaatcgcttgaacctgggagacagaggttgcagtgagctgagatcacaccattgcactccagcctgggtgacaaagcaagattccatctcacagaaaaaaaaaaaaaaagaatgaaattggatgcttgttgatatggtttgaatatctgtatcccctccaaaattcttgtagaaacctaatctccaatgcaatagtattaagaggtgaggcctttctgaggtcattaggtcatgagggctccttcctagtgaatgtaattaaggcctttaaagaatagtcttcacacaatgtttagcctcttctgccctttcggcttccaccaggtgaagacacagtgctcaaagtgccatcttagaagcaaagacccagccctcatcacacactgaaacctgccagtgtcttaatcttggacttctaagcctctaaaactatgagaaataaattgctattatttataaattacccagtctcaggtattttttatagcagcatacagagactaaggcacttaccttacatcatatataaaattacctcaaaatggatcaaagacctaaatgtaagagttataactataaaactcctaaaagaaaacataaggaaaagcttcatgaccctgaatttggcaatgatttctaggacgtaataccaaaagcgcaggcaataacagaaaaaaaaaatagataaactggactacatcaaaacttctgggccaggtaaactggctcacacctgtaatcccaacactttgggaggctaaagcaggaggatcgcttgagctcaggaatttaagatcagcctgggcaacatagagagactccacgtctatttttaaaaagataaaggaaaaaacaacaaccttctgtgcatcaaaggacaaacccaacagagtgaaaagacaaccccagtgactcatgcctataattcctgcactttgggaggccaaggcagaagggctgcttgagcccaggagctcaagaccagcctggacaacatagcaagtccctatctctacccaaaaaaaaaataataataatagctgggcatggtggcatgtgcctgtggtcccagctactcaggaggctgaggtgggaggatcacattagctaggagtatgtagctgcaataagccactgcactccagcctgtataacagagagacgctgcctgtctcaaaaacaaaacaaacaaataagcagaaaaaaaaaaccctgtaagttatatcatgccactcgtctattaaaaactctgctcttactgaatatggtttaatccaaatttcttagcatagcttatagggccttatatgatctgaatattgaatacttctcttgacattcccaagccttactctttcttgctgattttgttccagccactctggccttcaatttgtttaaataatacacaatactattcactccttatggcctctgctcttgctgtttccttgccttaaaatgttgtgacatacatctcaaaagggttagctacttctcttcattcaaactgtttccccttcacaagatttttctaaacactccacactccctaaaagccagtatgtttactctcataacattatcctgctttgtttccttctaagcatttattactttctaaattgtcttattttgattacttgtttattatttgttctctcctttatgacagcacagacttattcacagctatatcctcagattccagaatagtacctggcacatggattataatcaataaatggatactgaatgataaaaaatgagtgccataaaccactcccaatctacttttttgtcctttccttatatccaaaaccttaacttccttatatccgtttcaatcctctttccctctaaggaatattctgcaattctatcctataaagacctttactttatgtcaatctttatttttaatatcatttttgtagagacaggggtcttgctatgttgtccaggctggtctcagaaatcctggcctcaaattcccaagtagctaggactacaggtgcatactacccaattttttttaaagagataggatcatgctatgttgctcaggctggtcttgaactcctgggctcaagcaatcctcccatcttagtctcccaaagtgctgggattacaggagtgaactacaatgcccaggttattttatgtcaatcttatccctaatgattactgtaggtacggcatatattatacttgtttatagaatatcttataaacattctattagaattatatgtgtattactctattctctcagaagatgtgcttccttaaccagaactgattaaggaagcagggaaggaaaaaggaaaaatctttaaaaaaaaaaaaaaaggactaaaaaaatcttttgcttctttttattttaataaacataacatctaagaggtactgttcaggtaggctataccccatcattatttgatgagtggacagtttgtaaaaatacttcaaaccaaatattctcaagcatctaaatttatctaagcaattaacagcaacaccatggagcttttagacttaactgtatcataaatttaagtttgaaatatttttgctggataatacaaaatgattaccatctaaccttacttatttaaaagaatattataaaaagtgattgggatgtatgtaaagtatttaataatactttcagagaagaagggaagcatatatatcttttccttcacaatttacaaaatgttttaaaatcaaagtttctgagaaggtcctgaatacatacctctgatttttttaaatattcacacaatgttatttgtcctttcattaatgaaaatattaaaatgacttcaaaaattaaactaataagatatctaaatgatttttttttgctattctaaggggtcaatttttcttatctatatgcctattttcctaaatatgcaaattacacaatatttagcaacagcaattttatctaatagctgtgtaaactattctttcaaaaaagaattaaaggtaaattaaagttttaattattataagcaggctcaaaatgttgggtttactgtagattaaatgtctaaatgcagagcataaaatgattcacatattttaatattaagaagaaaaaactatgtataatttacacctacagtgcaagaaggaagaaaaaatgcttgtgtcagccttaggaaacaaacagccctatcaagtaaccaactagaaaagattcatactggaggctcaataaataacagtaatgatgacaaccatctcccataactacattacagcccattgtccacatctgattatactagtctagaccttgggtaagcacatacacattttcaccaagagttttccaatattactgctctgtttcctgggctttctgtgacccccattagcagcaactgtcattttcactactaaacatgaccactgatgagaaaggaaagttactacttttctacactctaataattgagaatgtggaaataatgttcctgaattggcaatccttctaaatatagtaatttctttagaattagctacagagaagaggataaattgcttccaaagattttcttccataatatgagaactactaaagcctcacttttcaaaatatcatctccatatattaacatagcctttattcttatagtgaagaattattgcctaactctccatgtatctgcctccttgcaacatctatctctctctgtctctcacccagcacatccaataattcagtatcacaaaaatccctaaactgttatctctctgcacctttctcagttaaagctctcagtaacaactttgaataagggatgtaaaggttctaacatcacagaatacacatgcctggaacctcagaaagaatagattttgttggtaactgaaaaaattaatttaaattaaaaaaaaatttttaatgggcttcatacacatttaaggccagtctagatctttctcggttgaaatttagcccaggtagtagccactttttctggaaggcagtatccttgatcagagaccacaaggtatccatatgctttattagactttaaatggagatagcaaatactccataaagttatttcatcctgagaatataaaaccttagtaatttaatataaatgttacatcctcacatcaacctgtttttccaaacttactttgcatgataatccctagttgaacattttaaaacaactcatgatattacagaggctagaatggaagcaaaaagaccaggctgcaagcttttatctgattattttagataaaataatttcttaggactatgaaataatctattctctagaatgtgcaaataaaaagagacagaagatagttacatgtagaaaagcaaaaatatagagaaatggctctcctgactctccacttggaattcagtttatttggaattcagcagatttctctgctgcacagtatctaccaccttctatcttcttataactgcctttgtctcttcattgtcagtgacatttccttggcgattcatagaaattcatcttttcagattccactctgaccactcttatttaacactgcaatgtcctctgtatccgactgtacctattctcctcccctcgttttaactttctcatatcacttatctcctgaacatactatcaactttttaatttctttattgtctaactttaccaattaaaataaaccctattaggcaggcatttctattctgaccattgctaaattcccagagccaagaatatggaccagcacgtggccagtatggattaatatttgctgaacaaagtgaatgacgctattttcattttatttttattttactcttctcaaaggttatgagagttccgtttttcacctatccctaatacacatcccttttttctataatcattcttatttaataaatgatcctacgtacatagatgctgttgtagtttttttaaaatgtgtaaggctatgaaacatctatacaaacataagcatattctacaggcacgctatatccaagccatctttcctaaaagtcacatacatttggtcttggtaaaaaaatgtcaaacagcaaatcctatttagcaaaacatttaaagctctgaaatctagtagaatttagcatttttagggggtgaaaaagcacaattcaaacgcagcaccatttttttacataaatcagaacaaagcaagcttaaaaagtagccacagaccagtgtggtggctcacacctgtaatcccattactttgggagtccaaggtgggaggatcacttgagcaggagttcaagaccagtcttggcaacatggcaaaacaccaactctacaaaatgtacaaaaattagttgtggtgtggtggcgagcacctgtagtcccaggtacttgggaggctgagataaaaggatcacctgagccagggagatcaaggctgcagtgagccttgatattgctactgcactccagcctgggcaacaaagttgagactccatccaaaaaaaaaaaaaagtaaccattgaaaaatcatttaaatataaaatcccatataaagtgcacaaaacaagcctccatattcaaaacctattaaaggaagtatattaatgataagctgagatcaagctataaaattaaaaataaaaaatgacctgaccatgtcagtactttaagccaaaacatatgaataaaataaataagaaacatatgcttatcctaattaaggagagaaaattctaatcttctttgataagccattaaaccttcacaaaatgataaacattaatttaaataatctaatctttaagagcatataagagcatatactttattctaaatcacccagagaaacttctatactaatacaatccaggattgaagtaaacagagataaagacatgagcccaggagctaagcggttgcagcctgggtgacagaacaagaccctgtctcaccaaaaaaaaaaaaaaaaaaaaagagagagagagagataaagtctctgctcaattaatccactgttgatctctgactctaccctaaaaatagcatcatttccaaacaactgtttacaagatgtaattaagcagagcacagtaactcacgcctgtaatcctaccaacttgggggaccaaggtaggaagatcacttgagcctgagcgacaaggcaagaacttatctcttaaaagaaaaaaaaattacaataaaaaaatttaattggagtttttctataaagtatcttcccacatatataattttaaaactgaaaccagaaaaagcacatggctctttaagtaacactcaaggatttccaagtgataatctctacctcaattcaaattttatcttccactgatacagataagaatatattctagccacactgtttacttacgtgcaataaatacctttgtctttttatcaaaggataacccagatctaaaatacaagtgctaatggccaacagggtccaaatgaaatattttctggcctctctccctctctcccttttccctctccacctttccttctagtcattcttcttctcattccaccaacattattagtaatcgtgctattcagagaagtgaagaaaaaggatggagcggctaaatgaatgctcagaaagaagacatgcaatctaagtagatgaattttgaagacagaccagtgtattaatactcgaagcattatgtcttttatgtgggctatttatatatttgtatacaagtctgagttactgctgtaataagcagacactgactggctctagaggatgattaagcaacgtgcccaacagtatgcaggataatctgccctttctgtgctttccaaggatgggagaaaaagaagagtcacagcagcacatctaaaagtaaagttgtaagaggctatgaaagctcttaaaatgtgtttttattaaattaaacacaaaactataattataggttgttttaattatttatatatttaacaaattacaagattcaagatgagaatttaaatcttaaaatttttaccaaatattgtacctttaaactaggtttcatagtctactacttccctgatttttactatcaaacatttaaaaaattagccaataaaactatgccggtttttttatttaaagtataaatgaaatagaaacaatgaggagaaactaatagaaacattaataaaactaggaacaagaatgaaaggaggccaggcacagtggctcatgcctgtaatcccagcactttgggaggctgaatgacttaagtccaggagttcaagactagcctgggcaacatggcaaaaccccatctctacaagaaaaaaaaaaaaattaaaaattagccaggtgtggtgtcctcaacagcagtcccagatacttaggaggctgaggtgagaggatcacttgagccagggaggtcgaggctgaagtgagatgagatggtgcccctgcactctagcctgggcaacagagcaagaccctatctcaaaaaaaaaaaaaagacagaaaactctgatagaggatttgcacttatttttcaaaattctagaggttaagaacaaaaagagtaccacctaaacaaataaaatattcatcattctctctaagacacacaagtcataagacaggagaccaccaacaaatcattacaaatttcacaaaataatgtctcagaacagctgacttgatcactgctacctagaacaacatcaggagcttaaaatgctctaaaaaatatttggagggatcacaagcaagctggcaagaagaaaggaggcaacctagcagccagatctatttctgccagcaaaattaacatcaatactgagatactaaatttttttgcaagtaatatcaccaaaacctctaagaaaataagaataaaaggcaaaataagaacttgaagccctttatttatccaaataagaaaaaacattcaagattcattggcaaagaattgagttgaaaaatgtaagcaacagtgttatggaatgtaattaaatatatctttcaattcaattcaatttcaattaaatacatttgtaaagtgaagaaaaaaataactaagataaagacaaatcgaatacacaaataaatgaatttaggtccaatatacataacaatgtaacctacaccacatctaaatttagtataacactgaatcctcagatttcattcaacagggtcaaagggagtagtaataactgtacattattttctattgatgtggtgctacagcatcacagagactctaaaaggtggctttaatattctttaagttctttaaaactattagtttagagaaagttgtgcctttcaagaataagaaaactcttttagatctttcacttgcacatttaaaaagtaaacagaggtgctgataataatgattcaagatatcataaaacactcataaacaaaattagtattcaggaataacaatgttcttgctcataacttgtgaaaatttaattatttaactgaaatcttttattataagtatatgtatttttttctctttaaagtcatcaaggttgtaacaattacgtcagtgattatcaattattctagctctctaaaataaatttgtttaaaatggagtgttgtttacatgaaaaataccaataattgaactcaaaattaccaaaacaatgtatttaaaaatatcttattaaacaaatgtaagttaaagagaccatcagcaaatcactataaatttcacagagtaacatctcatcgagcagctgccttgatcatagctagaacaacatcagcagtttctaccaaacaacaattacttatgtctgaacttagtaattgatttgctaatgacactctacaagtctgttagaccttatgctgtagtctgtctataaaggtcttcatgttatttacacaaatacgacattaatcaagggcaaaatttatagcagctactctataaatgaggtcaaggcaggtcagacttacataataagaagaaaaaaaggttagtctttgcagtaaaaaggaaaatcattattattattcttcctgcccctgggattaagtctagtagtcaaacactccaaactatttcacaaacacatctactcctatgaaaactcatttaacctcaaggcactaaatatttataaaaggaaagccaaatccactgatttagaaaaataaaccactaaaattttcctttaaaatatattctacactgtaaataaagagagaacgaaaatttccaattttacctccactatttcactaatgaatcttagcttccaccactgtttatttcaaacacgtaaaagataaaggctgagtgttctctataggctaagcactgaagtaaagaagacagtttctaactatgggaagctaaaaaatctcaacagaataagaaaagcaaaggtaaaaaatcagagaaagggtactatgaaaatgataacagatgatataaaaataaattattcaaacaactgtttcaccaaattttcagaaatagcaatagcaggagtattagcatttgtgccagtacctccaagtctcagttccacagaataatacaggtccagtagacacctgtatatgcagtaaagtgtgttacaagagaggaactctgagcttagggcacttgaatcttctgtgacggccagtaggcccgttggtctttggcttggagaaagacattattatactagacagtaaacgatcctgctttgttctaaatgaagacactatttctatattccaaagctgtctgctatataaagatctttgaatgataatgcaaaacaaaggcatttggtatctcttcttacaaggccaaaaatcttaagagtgatgcctggctttctctcacaacccacatccaagccattagaatatcctgtcaggtcttatcttcaaaataggttcataatcctaccacttcttacctcctctactgctagcaaccttgtcccagtcaccatcatgtttaaccagaattactacaatagccccctaattgatctctttgtctttttttttttttttttttgagaaagggtctcattctactgcccaggatggagtgaagaggtgtgagcatagctcactgcagcctcgacctcctgggctcaagtgatcctcctgcctcaccctcccatgtagctgggaccacaggtgcatgccaccatacccaactaattctttttattttctgtagagacagggtctcactatgttgcccaggctggtctcagactcttgggctcaagcgatcctcccacctcggcctctcaaagtgctggaattacagacagaagccactgcttctggctatctcttcacttctatccttaaattcctacatgcatcagccatagtcattttttccccacgacagggtcttgctctatctcccaggctacattgtagtagcatgatcacagctcattgcagcctcgtcctcctagactcaagggatcctcccacctcacagctttccaagtagctggtactataggcacctgccactataccaggctaattgtttgcattttttgtagacagagtttcaccatgttgcccaggctggttttgaactcctgggctctaacaagtcacccacctcagcctccgaaagtgctgggattacaggtgtgagccactgtgcccatcccagagtgatctttttaatccataagggagactgtcttcctcttcttctcaaaatcatgcaatggctgtcatttcccacagaataaattacaaagcctctacacaaaatcttgccctatgttatctctctgaccttacttcctatttcattctactttaatcactcttttcttgctatattggcctcattcctcaaatacaccacagaagctctcacttgtacactggctgttccctaggcctggaatgcttttccatacatgcccctttaactgactccctgtgtgcttcaagtgcttgctccaatgttactttctcaatgagtcctaatcctgccactctatttaaactacaaaccataccaaccttttttacttccttcaaaaatttcattcccctcatctgctccatattttttctcacagtactaaccgtcattcacatattatataacttacttttttttttattgtttataatctgtcaatgcctatttgaatgtacaatccacgaaaaaaagaatctttatctattttgtttattgctgtatcctccgtagcaagaataattcctgggacatagtgtgtaataaatagatgaggaactgaagctcaaaaactaaaagcgcttgtcaagtatcaaagctgaaacctgaacccagggctatcttcaaagccaatgctcttaatcttaagtctatgttgcctcatctattaaatgtaacaataacatacataaataagggtagttacacttagtaaagtctacgatgttcaaaatcacctcatataaatttttctttaaaaaagccctggaattatacttcaataaacactaaaaattataaaaaatctgttcatgggtgttttgcattaagcagaacatttgtgtatttaatcgacagctccagtcacctctttttccatatataaacttcaatatcatccaatacctcagtgttgaaatcagtcgaaagctatttttcaataaatatacactttgaaatgtttactaaaagagtaaagaattagtcattatttcattaattgccctatgaattagtaatcactgatataaatctatatcagtttttattgatcacctactacttgccacactctacatgaaaatgtatctctatgtttcatatagatcactgtagtaaccttgctactgttcttcatttcaatcaggtcttccctccttcaacctatcctaaacaattccgccagttatctttccaaacccgaaatatcacaatgactcttttgtttaaaatcttccaaggcttcccacgatcttgagggatctagatgcccaattccaacaacacctctccaacacacacacacacacacacacacgaatatcctgtacaccttcccacattacaatgccttcagatattctgttccctgtgtttgaaatgtttttcacacaaatgtcctccaatttttccataacctccaattttctaatgtttacatgacaaatcgtactgatccttgaaatgcacctcaagaatcatggttcctggttaagttttaagcaccctgtacttacatatttctatcacagaatttagcatgaagtattataattgcaggttactagtctgtgagcacctgtaattatttctgaaggaaaggattttagtagtatttaaaatcaaataaagttacgaatactcttttcgcccttttccataacatttatgagagatagagagcaaaccttgattcctagatgcaagttcaaatagttaccaaaggactgatagggtcaatcttccaacaacattacctaaaacactaatcgaacattgctgaaacagtaagtttgttcagaatactatctcgaaggggagtcagtcacatcttttaatctatactctgggtcttcagttccattaatgcaaaatcagctactacaaatcagacaaaaagtggtccactaatcatttcctcaatttctttttaccttttaatgatttcactcttttacatttgttttctcccttttatctctcttttcatctctgtactttcttcccttctcttacccaccactgaattttctttccttgaattcttctgtttctgttctttaagtagaaaatatacctccttatttcctctatcacctttctcaccacatcacattgcgaaacttgtcccccctcccattatgatcagcgtgtgatataagaaagataatatagacatctaattctaattattggctctacacacataaaataacttgatagaaagtccaaataagtatggcttttccttatacctgcaaatagaattaacagtttacttttcccaaactcagccacactttttgaaaaataaaaatcagaaatgtatcagtaagcttgcatctaaagaaaattataaaatggttaaatattaacatatacataataattgatatatcagagctccattacattactgactgaacaaacagtaaatacagaacccaaaaatatcaatgcctataggaaaaacccaagattttaaagaaaaatacaaaatgaattaaaataaaataaattaccttccttcattgacaagttcgataaaagcaaggcctgcattcttctgaatagaattttgccactcctataaaaaaaaaagcaaaaatagctgaagaaatgtcactcagtaggttctttcttttaaaacaataataatgaaaaatatcacccatatcaatttcatgcctaactcttaaaagttatgttaaaccatatgaacaggtaatactgaaaagtatactgacactaaacaagttagcaacaatttgattctgtgtaaattaaatgagcctatctatatttatcttgcccttttcattacataacacgatatactaatttatctgaaatagttgggagctgggaaagaaggtaacaaagaaaaccaaggacaaatagacattttggttttggctttgtttttccatttattttaagatgtattacccaaaatgaagagaagaaagaattaaatagttcaataaccctaataaaaacagcatagttcaccataaaaattgatgactagcaactgaaaatgaaattagaaaaatcagtgaattgagctaaaccagttttgagttagaaactataattcactgccctatgaattagtaatatctggtataaatctactaactatattcttgatccatttgaaatttacccattaaactttatccactaaaaagcaatccattaaaaagcctaggaatgaaatcaatcaatagagtatgtacaaatgaatattttaatccttaaaacaaaaaatatatataataagcattaatacaataaggaaaggcctacatgaactgaaatatacctagatttgaaaaatgctcgtgaatgccacttgtgtgtatgtgcgtgtgtgtgtgtgcctatataaacacacacacaaagatttgcttttaaagaactggaaatacatacataatcttcatatttcttaatatttaaggagctctttgtattctaactacataatatccctcaactgatctttttttgttctttcataaaacccaaatcaaaaggccatgtctggctacttaccactgctcactataaaccatattcatattttctgagtgtaataactctaagactttcaaattccatgcaatttcaccctaatagctattccgttccactccaaattcttttctttttcattctcatcctttctcttctaccttctcttttccatgtccactttcatacttaccttcttttgtgtttttgaaaaacccaaggtggttcttaagactaaaacaatcacatgacatgattttgtcaaaggattatattttatgaatagtattagtataactatgctaacagaacaaatacagtagaataaaaattaaatagaaaatcagtaaaacgttggagggtagtcactggctagaactagcagagaagaaaaagtaacgtattctcaaggaatgagcaagaaacaaattcataaaatccatgttctcattctgatactaacagaatatatccttaggcatatcgtgctacatctgcaggtcttagatattatcttctaaaagtgtattctaggtataatttttattattctaaaatttactaacatttagaaattcatgacttgtaattgtacaatatatactctctaaaattcatactgaattcatattttaccaaaactgtaaaacagggatactaaattttttccagcgaggtaaaacaaaccaatataaaacagaaatatgaatctaatttaaaagcattttctttccatcaaaataaaatgaagacaagtagtccaaaaggaagcaatcaaattccacaagactatattcttgagagaagggcatgtgccacgaaaaggtaggagaatgatgacaaaaagcagaaacctcaaattttttttttattttggtacagagggtcccacacctaacttcccaagcacagcacagagagataagactcaaagacttaccctaaatctagtaatgcacaagaacagtagaacaggaacaaatttaaagacagatggacctcagctaggaagattcaaaaaattatcatggaaggaggcagaagcagcttaggatttaagaagatgaagagaacataaccatgacctctgtggataggcagcaagtgatcagcaagaagtacgatacttcaagagatgccacagccaaacaacacaagcatatgttcattcctcagctcttatacctaacataacattcttggaaacccaactagaaatttgacataatacaagaataggaaggaaagtgagacctcaagttgagtgagttttcacttagatcatttaacttacagaaaacttcaaaatagaaacttagttaaagaagaaaatgaagaaaattacctttcttgctagaaaaaaagaagtcagtaattacagaagaactaaaattctgtatataaatctttagattagtcattttacttttaaaagtatccactgtcaggaaaacgtcaagaatgtcccctctcaccactatctttcaacatcattctggaagtcctggctaatgcagtaagacaagaaaaggataaaaattgaaaaagaagaaataaaactgtctttgttgatgacataatcatctatatagaaaatcttaaataatctacaaaaaatcctggaataagcaataaatagcaaggttacaggatacaaggttaatatacaaaagtcaaccactttcctatgtatcagtaataacaagtcacacactgggataaaatcatttgtaaaagacatctgataaagaattgtgcaaaatatacaaataactcttaaaagtcaacaaaaacaaacaatcacattaaacaatgggccaaagactttgacacctcaccaaagaagatatacaaatggcaaataagcatatgaaagattgtccacatgtcactggggaaaggcaaattaagactagataccattagacacctataagaatggccaaaatccagtacactgacatcacctaatgcaaggatgtggtacaagaataaatgaaatctcagtcattgctggtgggaatgcaaaatgatacagtctcactggaagacagtttgatggttcctaacaaaactaagcctactcttaccacaagatccagcaatttcactttttagtgtttaaccaagggagttgaaaacttatgaccacttagaaatttgcacatggagatttatagcagctttattcataaatgccaaaacttagaagcaaacaaaatgtccttcagaaggcgaatggataaattgtggtacaaccagacaatggaatattattcagcgctaaaaaaaaaaaagagctatcaagccatgaaaggacatggagaaaatgtaaaagtatattactaagagaaagaaactaatatgaaaggttacatactgtatgatttctactatatgacattttggaaaaggcaaaactatggagaaatgtaaaaagatccgtgtttataggggttagtgggaatggaggggagcacaaaggatttttaggtcaataaaactactctgcatgaaactataatgatgaagacacaccactacacatttgtctaaactcacagaatgcacaacaccagagtgaaccctaatgtaaactatggactttgggtgataatgatatgtcaaaggaggttcatgcattataacacacatgccagtctcgtgaagaatgctgacaagagagaaggctatgagtgtgtaggggaaagggaaatgtgggaaatctctaccttttgatgaattttgctgtgaatgtaaaactgctctaaaaagtaatgtcttttaaaaattagtaataaaaaagtatttactagtactatttttctcaaatccatttgttctgatccaaaactgcaatgggaaaggatttttattacataattcagacaaaatgcaaaactccacatggatgaaatagataacagcagaaagacccatatattaagtaggcaggtaaagggtaaacatcatttagattttattttcattatatacagaaacttttaattacattgtcaaatcagaaattgtgccatttagatttcacaaagattttaagtagcattattggggttagactgaaaaccagttaaagttagtataactatcaaaacttaaccacactaaaaatttgtaatctaaacttatcttggtatgtcacaggaaatatttcttttcaattaaaaacaaattagacatgaaggtacatatataattgaagaagttcagtgttttatggaggctcagaaactcaaatttattactagtaatacattatgcttctggttttctcgaggatcatctataaacccatatttgttaaccttcagtaattattacataataacctgaaataaaatgttctcattaattttttcaaattggctaaaattaggaataaaatgaaaatacaaaccttatacttttggttattgttaaaaattatcacaaatctcaggaatatccttatgttttcatttctctataatacagtcctaattactaattattaccatttaataaaataccaaatgccagatatacaaatgcatactaaaaagaatagcctatataaaaagaatctgaagcccatgagaatattttttcaatttgtttataatccaggtgttagtcaaagccaacaagttttctccatactaaaacattctctacagtaattcacagaagttgccaaaactaaaaagaatattcctgaactatgctatcctaaaccatttttctccacttcagaaacaattatcaaggaaggtgttagtctaaacaatttcataaaccacagctcaatataacccttagtgagttttaatagttaaaagaaaagcttaatggtcatcgtctttcatgatcgtttcaatatttcatcacagtatttacaattatacagtgatgcaaaatgcatagtacatttaaaggtcttggttatccttctcccagaggtactgatgaaaaacatgttaaaagcctcaaatccaaccactaatgcaactaagtaatttcaaaacacatttcagcactttggagaggaagaactcaaaacaaaacaagagagtcaataatttcatacctgttcctaagctgtatttaattgactatcacttcctaaggccataattgttgactagtcaatttttactaaaatatactcttagcttactgatgcttttaagtcacacaacaaaaacagtgaagataatacatattagtgaaatctactacatagatctccaccaaatttcaagactgtattcttggtggtaaaagttagttagggcaacaaaagacttcattaacctaacattatctattcctgcctatcctcaacaaataaatataaagaaaaagataccaattaacacactatgcattcaaattattgtaataaaattctaatttctttagacatgaacttgacagttttctataaataatctcctagaacgtattttagtgacgaatacactaaataaatttatctcaattttaaaagtaattcccaaatattagcatgttctaaagcagaaaaaatcaggccacagattaaaaagattacatataatctactctgctatcattttattttgtcaagccatgaatactgattaacattaaatatagtagcatttgattctggtgggcagatctttaacataacttttagtattaaaaaattttttttctgtaatcccagaactttggggggccaaggcaggcagatcacgaggtcaggagatcgagaccatcctggccaacacggtgaaatcccatctctactaaaaatacaaaaattagccgggcatggtggcgggtgcctgtagtcccggcttctcaggaggctgaggcaggagaatggcgtgaacccgggaggcagagcttgcagtgagccaagattgcaccactgcactccagcctgggcaacagagcgagacttgttgcaaaaaaaaaaaaaaaaaaaaaatttggccaggcgcggtggctcacacgtgtaattccagcactttgggaggccgaggtgggcagaccaggaggtcaggagatcaagaccaacctggccaacatggtgaaaccccatctctactttaaaaatacaaaaattagtcaggcgtggtggtgcacgcctgtaatcacagctactcaagaggctgaggcagaagaatcacttaaacctgggaggcagaggttgcagtgagccaagatcacgccactgcactccagcctgggcaacagaatgagactctgtctcaaaaaaaaaaaaaaaaaaaagttttttttttcaagagaggtagataatgagtgacttcaggttaaacatagtaaatctgagaataaagagggggcaacagtacatgagatacattaagaaatttattttacaacctggaaacacatgagttagtagtaataaatgcacttagaggaccaaagaaaacaaaactctacacaacaaagtagaggaatcaacatgaggaaggaaatcaatgcttgtcacaaaaactccagaaaagctaggaattgaaggcactgagtacatacgaaggtggctgagggaaagagatgcaagttggcataaaaagaaagttagaatcccacatcttctccctatgctgtgtagccatcctaccatggtaaacattggaagtttattttccagaaaagttataattaaggaaattattaaaaagctataatgaaaaaggcaagataaattgaaagtatacaaactggactatgacattgtgagtgatatttgaaaacttttctgagaaaattgagaagctaggataaaaggtaatcctctacaaataacaaagggaactcatgcatcaccagtggacaactcatacccagacatatagattttctctgtgttatgcttaggaatgagcaaattgccaaagttaaccagacatttgaggaaaccctcttctgtgatgacagacaccaaagcaaacaggcagaggagaaaaacgactcatagaaaacagacaatattgttaagagggtgaggaaaagaagattaaagaaaagtataattaaatatcataggaaaatttttttaaatttcatctaaaatatcaagatagggattttatcaagtgctgtctccttttttttttttttttttttttttttttgagacacagtctcactctgtcacccaggctggagagcagtggcgcaatctcggctcactgcaacctccgcctctgggttcaagcaactctcctgcgtcagctttccgagtagctaggactacaggtgtgcatcaccacactcagctaattttttattattattatttttagtagagatgggttttcaccatgttggctaggctggtctcgaactcctgacctcaagtaatccacccgcctcggcttcccaaagtgctgggattacaggagtgagccaccatgcccggcctatcaactgctatttctatgccccggtattaatcaggattcttcagagacacagaacgaatgggaagagagagagacagagagagacacagacagagagacacagagacagagagagaaagagagaagagattataaggaactgactcacacaattacattggctaacaagtgccaatatctacaggatgagtcagcaagaccaatggcacagtctgaaggtcagcagcctctagacccaggaagagacaaatttgaatccaaaagtgagaaaaaactaaagtcataattagaaggcagttaggcagaagaaattctctctactgggggaagagtcagccttttggttttattcaggcattcagctgattggataatgcccaacactaacagggagggcaatcttttttactcagtctaccaatttaaacttaaatttcatccagaaaagactctcacagatacagctagaataacatttgaccaaatatctaaacagcctgtgacccaaatgacacacaaattaaccatcacaagtccaccccttgtcagcttggcactcatatacatctcctcaaaccacatttcattaccaaatgaagattaataacaaggttataattctacctaacatgatacaactattctgtatacaaccaaaaccattctaaacctgtgacagtcaattttatgtgtcaacttgacaggactaacaaatgcccagggagctgataaaacatgatttctggttgtgtctgtgaggttgttccacaacagatcagcatttgaagtggtaaagaagatctaccttcaccggtgtgagtcagcatcaatcacccgatttgttgagggcccgaataaaatgaaaaggcagaggaagtgggagttcatctgtttctgttgggaaagacatcctcttcacttgccctcacattagcactccagggtctcaggacttcagactcagactgggacttacaccattggttttcccgggcctttaagttttagacagcagatcatgggacctctcagcctccataattgcatgagccaatccctcataataaatttctttgtctgtatctatatatatcctattggttctatttctctggagaaccctaatataaacccattccccaccttagctgatatgtatactttcctaatatcccacaatttacatatttacatactaggatgtacagttaacaatatgatctacagttaacaatacttaaatactatggtgttgatattataaactcaatacatcttaagttgcatggtgagggattaaaagaggaaagaaaacaaagattttatatatatatatatatacacacacacacacacacacacaaacacatatacacacacaaaataagaaagaaatgtaacaattacatttcttgttctgtaaatggtcatgtgatcacagttggtatctacaactaccttttttcactgcctattctgtattccctttgtcttcagcaagcacctcagctggtcctggtactgtacctaatagggtgacccaaagcttcattcctgaagggtctgggctgctttagtagtcctacctggattgtattaccagtgctcctcaacttaatcacacagtatggtaatactaagatatgcactgaggaatctcttgtattctagacatactcttccttacttttattgtggtatagttcaatttccccacagtagtcaggatcaatcactactcttagcatgataactccatttttgcctgaggattcagaggcaggaggagcccaaagtggctgggaagcaatcttaacttccggttcaatggaatcattgttgtgcctcctggtggaagcatttctccctttggaagtaagacctctaggccagcagactgtaagatcacaggaacaggaagcaaaacttttgctattgggtcactagaggtaataacaagtggtaacactcccatttctacctgttgattcctggaccaatgaatcctacctgtggggagaaacagcaccatatactggatgctgattcagtacacatatatccttctggaaaaccttgtcccagccatataaggtattgccacctacattcagttctatcaagccagctgcttgaggatggtggggaacatagcaaggccagtgaattccatgagcattcatttgctgtgaaatagatttcttaatcagaagcaatgctaagcaatacaatgaaggttgataaagcattctgtgaatccacagatggtagtctgggcagaagtacggcatgcagggaagataaatttgtatccagagtgagtgtctactctgataagaacaaaatgctgccccttctatgatggaaggggtcaaatgcaatcaacttgctaccaggtaacaggttgatcatcctagggaacagtgccttatcagggacttactgttggtctccactgccagcagatttgacactcagcagtggccacagccaggttggcttgctgagtggaagttcaggttgctgagtccttggataacctccatccctgccaccatggccaccttgttcatgagctcactgggcactggtgggcggctggggaaagaggctgactagtatccacagaacaggtgttcccagccactttagtattaaaattatcctctgttgaagtcacccttcagtgagcattcacataggacacaaatacacagtattcagattttttctcccattcatagacatctatacacatacctcttcccctaaactttttttgtcaacaattttctactcatgtcccttccaagtctctgaccatccagacaaaccaatagccacagcccatgaattaataatcacatttatccttccaaaaaaagtaaacaatcaggtacactcctcaaagttctgtccactgagaagattattcttcactacagtccatcagggatgtcccaaaaaagggctgtagtgctccaactgttcactttcaggtggtgcctgcatattgtcagaacaatctatacaccaggcccaagtcttctcctctggcaactgatcacaggactcaccaagagaccataggtacgggctggcaaagagaaggtagtgtagcagaactgaggaccataggatatttgggccacttcatgcaacttacttgtgttttcaagcattgcttgggcctgatcacatgtacatcacttcgatttgatgacagagtgcttctgtgcatgtacaacttgatggcttagtaggacagataacattcagttcataataagcagctcagtcacttgttaatttggtggcccagtgttaactgttcagtctctacttaaacctagtgacaggccaagagttgtttctcaaaaggagaatatttgtctgggaaggatgtcagggccttgctccaaaatcctatgggtttgcattgcaatttacctaaaggggcccgtcaaaggctccaaatagcatccccatctgccactgacacttgaagcaccattagatctcctggagcctatggcttgcacagcagcctgaacctgttacagagccttctcttgttctgagttctactcagaactatcagcttttcaggtaactcagaaaatgggacagagtaacatatccaaatgaggaatacgttgcctctaaaatccatagagtctacagccataccaccctgaaaatgcccaatctcatctaaaagccataaacggtcactagcatgtacctttttggttataggaggggccagatacaacttattcttcacctaagaaggggtatctcgacatgtcccacaacactggagccctagaaatttcactgaggtggatttaccttccaacttctgacatgcaaatgccttaccaaaaagtctggtagttacaacttcttgctcactaagtggaaccagcataatgtcatcaatgtaatggacgactgtgatttctctgtggaagtgaaaagtgataaagatccatgcaaactaaattatgacatacagctagaaagccagatactcctgacatagagcagttaagggacactgctagccttgctagctgaaagaaaacgacttctagtggtccttattgacaagtatggagaaaaaaaggcatttgtcacgtctattaggtgccagggaatgtgtcaatttgctcaagcattgaaaccacatctggtacagcagcagtacttggagttaccacctggttatgcttataataatacactgtcattctcaaagattcatgtgtcttctgcataggccaaataggcaagtgagatgaatatatgctggaaattaccacacctgtgtcaaatccttgatggaggaaaatccttccagaaatacagtattgcttttggcttataattttcttaggtagaggcagttcagtggcttccacctggggcctttcccatcataataaccctcactcaataggtcaggaaaccaatgtggagacactgccaatttctgagtatgtctattccaactatgcattccagaacttgggaaataatgacaagatgaattcgaagactcactaggcctattgtgagagagtgctcacctaaaactctattgatcatctggcccccataagcttccctgatattttaggtctcttggactcattgtcacttcagagccaaagtccaataatctgattatttccttttccccagtgaacagtaaccctggtaaaaggtcacaggtccctttgaagaagagtgaggaaaagattaacagtataaattttggtggcacaccagtgtatagagcacccttgacataacatagacatctttctatcttagaaaaagactccattttatatttcatggagcattttgccaacaaggatgttttgtttaattaaaaaaataaatcaaaacctaaaaattgcatccaaccagatgaggatacaacagacacattcttccactatcagttctgaccagaggactctgtgactatgaaagattaggccttcaacatcttgcagtcacttgtgataagaatttggcatctgctgacaaaggatctaccacctcaaagacttgtcgttgtaagactgactgaccacccagccgagaccaggactccttttgtcttcttcgctccccaaggactggtttattaaccctttctcctatctcttttccctctcgatgttaaaatgttactttgttgtggaatgtttaacttataatatttatacattgattaaatatactattatgtatggtttgcaatactgactgacttgtagaatggcttcagcctgtgtgcccacagctctgactactgagtgaacgggaagtataaggataattgcctcattgagaaatccatgtagcttgtggcttttgtgattaaaatgcatcaataaaagcctgacattgtgaaaagacacatatatgtgtggacctggttacttctaaccttgtactggtcatgagaaaatgagtccttcctcaaggggacccagcttccccttccttcacaaagttctggtcctgtaaattggctcaacttgggaaattgattgaggggccatgactcactgcttttatgattaaagttaggtatttgttcacttgatctagaacttttctgcgtatacaggtaaaataaaaaaattaataggcatactatctacttctcccctacatacaccatgatcaattcaccaatgtcatagatctgctccagtcaaatcagcatcacagttctgcttgctgctttgactctgctgtccattatggtgaccacattcaacttgcctttggtgactgaatgccaccacttggctcctgccagctcaggatccaattactcccaatgcgttcaggttttctaattgaccagctgtagttcctaccataaggtctgatctacaaagaagggtagtcgtagagctcttcaagaaagctgagcctccctttaaaaatttatttctcacagtacacggaagtgtatcttcaagaccctgcagtgtgagtaagtaggtcttacattataaatctactccaaagttccaatctccccaaattattttatttatttagagacaaagccttactacatccccagtgctaaaacagtgaccagtacatatgaattagtgatccacaaatgttcaatcaacatacatttctaaaaggaagtctgcaatggaacacacacacacacacacacacacacacacacacacacacacacacacacagtgattgcagcataagagaggaaagagggaaattctaggctgatgataaaagaagcgtctaacataaaagcttcctatagatctaaaggacaaccagactagattggaataggaaaaaggggactctaggtgctatatttccaagcaaaacaattgaaccaataaatatccagtgggtttaaccactttttccaatgcgttttatgattacagagaaaaatttaaagatcaatttgtggtgagtgcacagaaatataagtaaaggaaaaaggacaaaatcattagttctacaagaaagaatgaaaaaaaaaaaaaaaaaaaaaagaccagcaagcaagagaggggagaggaaggacgagtaagggaagagaggaggagggaaaagagaagaaggagcagagaagagagaggagggcagaagaggagaaaagaggggagaaaaaaaagaaagaaaaatatgtaattcatagtacattttttagctctggcataaatacatgataataacgtaaatactaagtatggttttaacaaatgttattatgaaagtatattagaaagaagcaggagagtgaaagttaaaaggagaggagtttaagtactcaatggtcgtctttcacaaaagattaatgttcaaagtttaaaaatcaagaaacagtaattcatggctgggtgcagtggtgcacgcctataatcctagccactagggaggctgaggcaggagaatcccttgaacccaggaggcagagattgtagggagccaagatcatgccactgcattccagcctaggtgacagagccagactgtgtctcaaaaaacaaacaaaaaaagaaatagtaattcaagcatatcactgtcaacaaccaaaaacatttgaaagatgtggctgcttccaagagttaagaatcaatcacggggaagagggggaaaagaggcagagaactattgtttatctgtttcgtattatactattatttgggtgctttatttgatgaaaaataaattttaaattaaaaatcatatgcccagctgaacacactggctcacgcatgtaatctcagcactttaggagaccaaggccagtggatcacctgaggccaggaattcaagaccagcctggcaacatggtgaaaccccatctctactgaaaatacaaaaattagccgggcatggtggcgggcacccataatcccagctactcaggaggctgaggcagtattgtttgaacccaggaggcacaggttgcagtgagccaagatcgcaccactgcactccagcctggatgacaaagtgagactccgtgtcaaaaaaataaaaataaaaataaatcatatgccctaaatatatagaatagtagatgaataaaaaataaaaattgtaatacacacatatttttgtaactggacaacaggtatttatccaagattattcttgaaaatctctaaaaaatagaacatgcattcaagttttacaaatatgaaaaaaactatgaaaatacaaaagtattataagctaactattaagaatctgtactttttttaaagtcagttttttgaggggttttgttgttgttgttgttgttgttgttgttgttgttgttgtttgaaaaagacagggtctcactctctcgcccaggcaaagtgcaggggcatgattatagctcactgtagcctcaaattcctgacctcaagcaatcctcctgccttggcctcccaaagtgttgggaatattggtatgagccactgcaccggatctaaattcaatattgtaacctaccaaatggaatttgagtttatttccatttctactcgtagtaatactacccttttttataagttttgctctcagaaaccaaacataatttatattaaagaataaagaaaaaaaaaattttaaacctgaactcatgtcaaactgtttcattttccttattataaaaatataaaaatttaaaggtttaggttcttcaatgaaatatccacattgatttgttaagatgtagttatctatgcccttgtaaaacgaagcgaattggatggatgtacctccaattacctaaatagttgacagaaacactcctaggagttcagggagaaagccagggaggatagctcaaatgaggaagggaatgtattaacacaaaactgagaaacacattacacacaagactaaaggtcaaaactaggcaaaactggccaggtgcagtggctcccatctgtaatcccagcactctgggaggccaaggtgggaggatcacgaggtcaagaaattgagaccatcctggccaacatggtgaaaccccgtctctactaaaataccaaaattagctgggcatagtgcatgcctgtagtcccagctactcaggaggctgaggcaggagaatcgcttgaacccaggaggcagaggttgcagtgagccaagatcacaccactgcattccagcctggagacagagtgagactctgtttcaaaaaaaaaaaaaaaaaaaaaaaaaaactaggcaaaactgttcatgctcaagatacagtaatcttaagtgctcaaagtaaactatcattaacttttcaacaatgtttgcactttgtgtcagcactctctcaacatcatatctaacacaaacttaaataatcacataccacaaaagaatatagtgtaacaataaaggaaagattttattctattgtgtctttaatcactctgtgaaatagtaaaatagaatactgcccttcggaaagttttggtttcccttatttttgtgaacatattcatctaatatgtacctgtagcttgtataaatattacaggtcagttagtaaagaactgaataaagagaaagtaactattcatggcattcacaaaatatataaatatcttaaactccaaaaaattaagataaccatgcaaatcaattatgtaattactataaacacatttttaattatttgtaaataatcaaaaaatcctcttgcttttatgtttaggcacatgaaatattaatatatttgcaagtacctctaaaaatctgtatttacagtttttcaggtaaaacatatctccagacaataatgatccttccagtgacttccaaactggcatcaatttactcaagatctttcactaatcaatacagaaagcttaatttccataaaggtgacaaaaaagttgctctaactctttccagctacaagctctcaacagatgatcatcattaagtctgtatcagggctccacatttaggagccatataaatgtgtcctattagtacacggtcagtctgtttggcaactctagttcttcagacatatggcaattgctgccctttgaggtctgaagtcaagtctttagggaatctcaaagcttgcactgaaattacaaggagtgttcattagagacttctggaggggaaacatgaaagacttccattaaaactatataaaacagctaattatttttaaaagatttttaaaccatctaatgttctcaactataataaaaagtatttaccaactgaattatttttagaagcactacttcaggacatgggtgcaaacaggtttcttcctacctcctatctcccacctcaatacatacatatttattttataagaattatcaactcaagatttcaatacttttaatttagaattaaattatctcatacttctaaattctgtctacagaccactataaacattttctaaacaaagttattcttagagacaaatgtttgttttctaatatttagcttaggataatatatagccaacttaaacccagccagaaatacatatgtgtttctttttaaatgtttcttttttattcaaaagtctgcctctattttaatttttattttattttaaactaataatcataaaaaattttaagcataaaatgatataaagtattagtcaataaagtggcatttattagataatattatgcaaaacaggaaaacacatgaaggtttaatgtttactttttttaatatacttaagttgataaggaggagttcaaagaaatctcatatatttactgtcagaattttgaaaaacataaaaagtatattttctaattaatgattgcttccattttaactttttgaatgtctagacactttttaactcgagagaaaatcattatttattaagttttgcaataaaacaatcctactactgaatatttatttcagtaacaaatctttataaacttatataaaattcattagcttgcctcaatcatttcttgaatccacatatatgttggtttctgacagcgtaattccaaaaagtaattacaacctcaatccatttgtaaaaagacaacagaaaacaagtatgttacaccagtttaaaagaataaaaatctaaagaaaacagattacaaatgatttatatgaatgcctagtggtgaagttaattacaagtaacccaataaaatagtgcctttattattgtacagcaagtaaaagctctagatgtaaaaaccagaactctttctgctgacttctgcatgctcaatcccacagcacacaacattaagaattaaacatgtggtaaataagccatatagaaaacagcagtttttaagtaaaagcagaaaactttcctgctgtttaaccatttggggccttctactctgaataacaaccactgtaaactggcactatgtattcatggaataagtttttatggttaatatgaaaatgagattttaatttcagtgctcaaagtttaactccaaataaaacataaataactgtaaaataacacagcattcattttagcattcagtaggagcaaataaggtatcttatgtttatgctatgaaatggtgatatctacagaatttaaattttccaaacctcataatacatctacctataaagctttggtctctgaatttaaacatatattagcaaagacatatacactttatgttacagtaacttcttatggttgtcaagagtcacaacctaaagccagtcatagtatgcttaatgactttcctggtgtacagaaataagacctttcaatccagaacgactcagtaactcttatcaaatatttatcaatgttctcaatgagacaatagctgataccaactatatatatatacatatatatacacgtatatatatatatatgtgtatatatatacgtgtgtgtgtgtatatatatatatgcataccaagtataatacaaagtcctaatacatattatgcataaacatcatgatataagccagcagtccccaacctttttggcaccagggaccagtttcatggaagacaatttttccacagacaagggggtgaggggggggaatggtttcaggatgattcaagcacattacatttatcgtgcattttattttatttatttatttatttattttgagacggagtctcgctctgtcacccaggctggagtgcagtggcaccagctcggctcactgcaagcttcacctcccgggttcatgccattttcctgcctcagcctctcgagtagctgggactacaggcgcccaccaccacgcctggctaattttttgtatttttagtagagacagggtttcgccatgttagccaggatggtctcgatctcctgacctcatgatccgcctgcctcggcctcccagagtgctgggattacaggcgtgagccaccacgcccggccgtgcattttatttttattactacattgtactatgtagcaaaataattatataatgaaccataatgtagaatcagtgggagcactcagcttgttttcctgcaactagacagtcccatctgggggtgatgggagacagtgacagattatcaggcattagattctcataaggagcacacaacttagatcagctgcacgcacagttcacaacagggttcatgctctgatgagattctaatgccgctgctgatctgacaggaggcggagctcaggcagtaatgccagtgatagggagcggctataaatacagatgaagcttggctggctcacctgccgctcacctcctgcatggcctggtttctaacagtccacagactggtactgtggcccaggagttggggacgtctgttttaaaccattgtttgatctacaacataactgaaataataaatgatgaaatacttgataacttggttttgccccagaaataaaacaggactgataaacaatcaacagtgcatctctctagtggtattttattcctattaatttcacctccattagaaatcaatacaatattaatttattttgcacctttttttctgagtcaaaatcatcacaaatctgtctcctcaaccctcctactttaaaagtagggacctctaccctccttaagtcctcaacagtgcctaattcaattttccatacaacaaacatttgaatacttgtttttatttttttaatttttttgagaacagggtcttgttctgtcactcactgaaatgcagcggtgctatcacaattcactgcagccttgacccccctgggttcaagcgatcctcccatctcagcatcccagtagctaggactgcaggtgcacaccatcgtgcccagctaatttttgcatattttgtagaaacagggttttaccatgttgcccaggctggtctcaaactcctggactcaagcaattctcccacctcagcctcccaaagtgctgggatttcaggcgtgagccactgcacctggtcttgcttgttaaataaatcataacttaacactgttactgaaagagggagaaacacttcattaagaatactcagagactttcaaagcattactggatatattagtttcttgtagctgctgtaacaaattgccacaaacttggtggcttaaagtactataaatttgttttctcataattctaaaggccagaagtctgaaatcagttttactgagccaaaataaaagtatcagtagagccattctccttctggagactccaggggagactctgttccttgcttcttccagcttctggtggctgtcagcattccttggcttgtggccaaagaaaacagggtctctctgctccattttcacattgccttgtcctccatttctctgtctgtagcctcccactaacgatctctaataatgatacatacgataacatttagggtgtacccacataatccaaaattatcttttcatctcaaaatctttatcttaataagatctggaaagacatttttccaaataaactaacattcacaggttccagggatttgtcatggctatttgttggggagccatgtctcagtcaatcacgctgaagaaaccaaatgagaacagaaagagcaagcagacgaaaagtgaaccttaccagcaagtgcaaattcaaaatatgcaaaggaaacaaaaacttttttttttaaatttagtgctgtgtggcaagaactggaaaaaaaaattaaacaaatcaagtcaccttatgctccaagtgttggttctaataatgactgcattgtgactggttttgttttcaatgtcagaaattcagcttaatttgttaagtataaagcctatcaggctgcaataaactgaaaggtgggcagctgagcttcttgtgacaagctgatatcacaccgagcaatctaactgcctaatgccagagtacttaaggcagcagtccagatttgctaaggagactggttaagcaacagaaagcttcttaaaagttctccctcattattttactttctcactgcccctaaccaacttctttttccctttttaacttacaatactagcaaatagaatcctgttctcacgaattagtagcacttcacaaacaattataggataatagcgtaccgttccaatggatagaaatacaagacaagtctgaaagatcaagcaactttctaagtgctctcaagtaaagaaataggtaagcttttctgagaaaaagaaataaaaagaaaccaaaattaaatttaacttcaattttgtagtatctgatacactgcaacaagaataaactgacaagccagccagcaaacaaggcagtactgatgtttcaattaaatgcctaattataatctgagcttctaaatgaagaatttacagaaataaataattactaccaaaaagaatgcactgtgttgtatccagtattcaggaccttggtaaacagtttcacactcactatctataaaagcccactgtggaagagaaagtgtcaggagaatgtggggaacagatttagggtcacacagtttggggtttctggttaactacctagaagatagtgtgatatgcttaacacatatgtctcatatatggatactatttgtaagtcagcatggaaataagtataaatgaaaataaaacagctattaagaggccttgaaaataaggcagagaagtttgaatttgacaaaacagtaaacaactacagcttctcctggaaagaaaatataaagacactctactaggaaagtaaatttgttagtatgtactcagagataaaatcaggagaaaggaaaaagggcatttcactaattcaggaataaattggaccagaatctaattcttttatctcactctctgcccaagttttattaaggtataactgagaaaaagaaattgtatatatttatatatccaaggtgatttgatacgtgcataaattgtaaaataattaaatcaagctaattaacatatctatagcctcatatacttatcactttgtggtgatgctgtaggagttattaagaaattattttaggcagatagagaggaaaaggggtcctcgggaagttttcatttttaaagctgcttcagaaacgtttcttgtaaaagtcctggctctttgagcctgatggcaacctttgatatgcaaatttaggccatttgaaactgggtccacccaaacttggtgattatcgctgcctttttgcccttgccccacatgatcctggcaacacagctgcccccacatatccccatgtgtgtagaacatcatggtgccctgtatttgcatattaaaaggctagggtgggaggcccagcctttttgccctacgtgaatgacatgcctggtcaaaccaatcccctgagccctatgcaaatcagacaccacctcctccagcctctacatatacctgactggtatccactgcatttggggttccctctcttggctttggagccccgctccctctgtctctgtacaggggagctccttccttctttctttcccctttctatcttgcctattaaactctctgctccttaaaaccactccacgtgtgtcagtgtcattttatctaaactggcatgaggatcaagaaccctggtgttcctccactcatcggagtcatatcagtgagaacatttaagatctacactcttagccagaatctgattctttacagagggcttttgaaaatgatatttccttttatttctccccaatttgtaaccacccaatgggctcaccttgcccgctgcctagacagagccgatttatcaagacagggaaattgcaatagagaaaaaatcgttcatgcagaacctgctgtgcgtgagataagagttttattatcactcaaatcagtctccccaaaacctgggggtttgtttttcaggataatttggtggggaggaggccagttagtcaggagtgctgattgtttggattggggatgaaatcatagggagtcaaagttgtcctcttatgctgagttagttcggggcgggggcgtggggacagaactggttggcaagttcaggtggggccatctggttgtcagaaatgcaaaaacccgaaaagacatcttaaaggccaatcataggttcacagtagtgatgttattttcgagagtatttggagaagttgcaatcttatgacctctggaaaaatgtctggtaatatttagaattccagcccctctcatcctaacttggtggctggtggcctttcattcattttacaagaacagtctagcttttgggaagggctactatttaaactataaatgaaattccttgtcaaggctagtttggcctacgcctaggaatgaacaaggacagcttggaggttaaaagcaagatggagttggttaggtctgatatatttcagtgtcataatttccttagttataattttgcaaaggaggtttcaaattctactaggactcaggaatcatcataatgaacaactgttaatgataataatgtacttgaccagaaaaaaaaggtggattatcacagaactagattaactactataaaagtatttctcaactacggtaaaacaggaggtacgttgaaagtaacatagtataaacaaaaagcactaaagttgacaaaaggggcacttaaaaacaattagagtagtaatacaagtaacacgacatcagtgttacttgtattttggtacattttgtttagtatcccagaaagggcagtcattaatagctagcacataaaaaccacggaatcatctttgggagcctattgaaaaagtgaatgttatccattatccttgtctacatggaaatgaaggccagaaatggctaatctatgagacctcgtctagctccaccaggttaggaggatgagaagtgcctgaattctgttaagatgtaggcatagttatcagccattgttccagaggtcacaacatttgcaacttccctaattactcccgtaaataacatcactgttgtagaccctaaggttggccaccttttgagatgtcttttaagacttttgcattttgcatttcttttttttttttttttgagatggagtcgcctgggctggagtgccaatggcatgatctcagctcaccgcaagttccgcctcctgggttcaagctattctcctgcctcagcctcccgagcagctgggactacaggcacccgccaccacgcccagctaatttttgcatttttagtagagacggggttttgccatgttgtccaggctggtctcaaactcctgacctcagatgatccacccagctcagcctcccaaagtgctgagattacaggcatgagccactgctcctggcctagacttttgtatttctgatgaccagatcactccagccagactcaagattcatgactcaagggtcctgtagccctcacccagaagtggactcagcaaaagaggaccattttccaccatccaatgattttatccccaaactatcagcagcactctgaccaaaaaaatatgtttaaaaaaccctagtctccaaatttttagggaggctgatctgagtactaataaaactccacagtcttctatttagccagctgtatgtgtattaaactttttccctattgcaattccccagtattcataaattggctctaccttggcagcaggcaagaagaacctattgggcaattacattggaaataccgaataaatgaagaggattttgagtgctgttaaaaaatactcagattcggccaggtgtggtggctgacgcctctaatcccagcactttgggaggcaaaggtgagcaaatcacctgaagtagagagttcaagaccagcctggccaacatggtgaaaccttgtctttacaaaaataaaaaaaagtcgccaggcatgatggtgggtgcctgtaatcccagctactggggaggctgaggcgggaagatcaccgcggaggttgcagggagccaagattgcgccactgcactccagcgtgggtgacacagacagactccatctcaaaaaaaaaaaaaacactgattcagaattcagtaactttaatttacaacctactttgctctgtaaacagtactgcatagttttacatgcactgcctaataagatccttttttaaaattgtttcgagaaagtagtgttagaattatatgtggatcgtaaaaatgtaatttttaacacgagatatagaaatattaatttaaacattaaatttataacaaaggatatgatacgtttaattttgtttaacaccttttactagttaaaaacttcctagcatcttctatctcaatactttttgtttttttctttttaatctttctgggtacataggagtatatatttatggggtacatgagatgttttgatacaggcatgcaatgcataataatcacatcctgtaaaatggggtatccatcccctcaagcgtttatcctttgtgttacaaacaatctaattatacttttttcattgttgtaaaaatgtacaattgaattattattgaccatagtcacactcttgtgctatcaaatactattattttatttataccattaaccatccccacctctcctccatcctcccactacctttcccagcctctggtaaccatccttctctactatctctgagttcaactgttgcttccaaattttgcctattgtgaacagtgctgcaacaaacacggaagcgcaaatatctctttgatatgctgatttcctttcttttggatatatacccagcagtcagattgctggatcatatggtagctgtatttttagttttttgaggaactaaaaaccattctacatagtggttgtactaatttagattcccaccaacagtgtctgattaaatctttttgttgttgttttgagacagagtctcattctgtcacccaggctggagctcagtggcatggtcttggctcactgcaacctccgtctctcaggttcaagcaattctcatgccccagcctcccaagtggctgggactacaggcacacactaccacacccggttaattttttttttttttttttttttttttttttggtatttttagtagagatagggtttcgccatgttagccaggctggtctcaaactcctgcctgtgataatccatccacctactcctcccaaagtgctggtattacaggcatgagccacgatgcctggcgctaataagatcttaatatacccatttcacttaataagaaactgagactcaagaaaggaaagtaatttgccaaggttacacagtaaataagtaatagaataaaaaacatttattaaaattcaaaatctaagagacgggcaaatcacctgaggtcaggagttcaagaccatcctggccaacatggtgaaaccccgtttctacaaaaatacaaaaattagccgggcatgatggcaggtgtctattaatcccagctacttgggaagctgaggccagagaatcacttgaacctgggaggcagaggttgcagtgagcagagatcatgccattgcactccagcctgggcaacagagtgagacttcgtctccaaaaaaaaaaaaaaagaaaattcaaaatctaggtcaggcacagtggctcacgcctataatcccagcacattgggaggctgaggccagtggatcacctgaggtcaagagttcgagacctgcctggccaacatggtgaaaccccatctccactaaaattcaaaaatgtgccagacatggtggcgtgtgcctgtaatcccagctactcggaaggctgaggcaggagaatcacttgaacctgggaggcagagattgcagtgagccgagatcatgccactgcactctagcctgggtgacagagtgagactctgtctcaaaaaaatatatatatatattcaaaatctatcatcacagtattttcctggcctcagccttttcttaaaaacccacctaaggcatctttttccttcttcctgttatgacccatgacagagacaagagccacctgtacatagttgacctcaaacagctgaggaattcagtactagaaaaccaaataaattgcatcaagattctgattcttttattcaggcctaaatcaaagttcaagcctcaaattttgctaaaactgtatatatatttctgaattttcatattataaaataacagcttgaataaaaataggtgcctgactaaaaaatgtacaatagatggaatgtttgtgcaattactcaaataatcattccctcctaaattatactatgtcctattatgtatgtcaaggtatgtaaattactaaataataattttatcgcagcactaagttaaacactgcaaataccataaacatacagcaagatttaaatctggatcctgagaagctgggatgcctaatatgaactctgactactctgactaaaatccattaaattatatactattcatcaaaaactatatagtatgagaatatagctaaaacttctaaaagttatcagagagtttggtattaaacaaaggcaatctcaaaatttacacttttaacctagcctctctataattccttaacttcagtagattgattagaataggaaaaaaaagtactaagtaaaagcaagcaatgatagctgagaaacagagacactgatctgtattctttttttttatacttcaagttctagggtacatgtgcacaacatcattaaaaccaaagaaaaatgttatgctcagaatattcccatttgtgtatttctcccttttcctaactctcttcttaatcccaaatttaaaagactagttgtaaaacagtagggtgccaaattaaaacacattttattttcagatgtctccacactcacaggctgacttcctgtcaggaagagttccatttcattgaataccccaatcagcagggaacttgcagaattaagtgccagttgatattactttgttttgcatttaccacccttgagaataatgttcaaagatctagttatatagtcagcatggtatcatccttctgactagactgccaagccacagggtgtactgccagttccacaaaatttacctcaaaggttgtgttttctaaatcctagtgtgctggtgaatccataggacgcctgtatttcaggtcaaatcctgaatctaaagttaaattatgtttttctttggttgtaacagcacttttaaatcaatattatggaaactcaaataaagatcaattaatgctcaccaacccatcaacctattttatttttgaaaagaaaaaaaaagtactttactccgatttattttgtattaatgtttttgctattgtttcaagacaaatgtttccaccttataatagaaagttatctgttataaaattttgaatcaataaagcatgtttgcatatcagcaataaagtacagttattgagctgattttaaatattttaaaatagttcatgcatctaagtttttcatgaccaatttatatagcttgaatcttcacctaacctctccaactaccatagacttcctatccagtcctcacaagtctatacttccttcttttaaggtcaactgtttttactgcgcacaaaatgaattctgagcatttcagcaaagaatacctactttctcgggctttgtatattataagaacaaagcattcacagcagctctaaagcaaaacaatatgagtgtattagaagcctaccctattgattctcattccatctgcaatcaaaaggtcataggtagtaacaataacaaagctcagggacaatcaatttatatccactaattttttataagtacgttctaaggataagttacaaacacatcaagaaggaattaaaaattcctttttgaaattgaaattaaaatgtactgaaaccaacattttccaaacttatttaacactgtatattcttttcatggaacaatttcttttgagactgggtctgctcatgttgttgcccaggctggtctcaaactcctggcctcaggcaattctatgcttcagccccagtagcggggattacagttgcaaaccaccacactgggcagaacacctactattattatcacaaggtactcactgtggaatttgctgtattgaaaaagtcagatagtgagagttgatcaaacaagcacatggctaccacaatttcaaccaaggaaaattgttaatgtccgtttaaaattattatcttatattacaattatttgtctcgctcactaattgtctcttctactgcttaaggaataatagatgatagtttccttaaaggaaggggcttgtcttaaaagcatacgacacatgtttgctaaataaatgaataaataataccagaagcagacataaagaaaaggacttgggcaaggcagatatattcacacaaagctctgtagaagagacagcatttgaactgagcctgattgaccataaaactgaaaattctaaatgtacagaataatggcctcctcaaactgctatacaaaacttcgtatcataggatttccttataggtgaaagaaatgcataatgaagttaagaaggcttggccgggcgcggtggctcatgcctgtaatcccagcactttgggaggccgaggcaggtggatcacgagctcaggagatcgagaccatcctggctaacacagtgaaaccccgtctctactaaaaatacaaaaaaattagccaggtgtggtggtgggcgcctgtagtcccagctgctcgggaggctgaggcaggagaatggcatgaacccgggagatggaggttgcagtgagcagaaatcgcgccactgcactccagcctgggcgacagagcaaggctccatctcaaaaaaaaaaaaaaaaaaaaaaagaaggcttatttctattttgattaagcaaagcaactcatagtcaaaatttctattttttggttggcaaaaaataatcctttatttcattacctcaattatttctttgaaataaatacataattttcctaataccggatagtaagttttagttaaaaaaaaaaaaaaggttgaagcgtaccctaaacacagcacactatgaatagctaaccactccacttaaaagaaataaatttctatttatattaagttcagcagtaagtaaaactaatccacagtaatagaaatcaaatcactggcaacttgaggtgacagaggaggggattgattgaaaagaggcacagggaaatttgaggattaaaatggttgggtatatgtcaaaattcactgaacagtacacttaaaatgtgtgggtatttactgtatataaattatacctcaataaagttgacgttttttatttatttatttatttttgagacagggtcttcctctgtcacccagactggagtgcaccagtgcgaccctagctcactgtaacctcgaatctttgggctcaagcgatcctgctgcagcatccagagtagctaggtctacaggcacatgctaccaagttcagttaaatgtttttctttttggtagagatagggtcttgctatgttgcccaggctggtatcgaactcctggcctcaagcaatcctcccacctgggctaaattgttttttttaaaaaaagaggtctaggctaggggccgggcacagtggctcaggcctgtaatcccagcactttgggaggcctaggcgggcgaatcacctgaggtcaggagttcaagaccagcctggccaacatggtgaaaccccgtctctaataaaaatacaaaattagccaggcatggtggcaggcatctgtaatcccagctactcaggtggctgaggcaggagaatagcttgaacccaggaggcggaggttgcagtgagccaagaccacgccattgcactccagcctgggcgacaagagcgaaactccatctcaaacaaaaaaaaaaaagaaagaggtccaggctgacaaacataaggagaccctatctcaacaaaaaaatcaaaaaattagccatgtatgctggcatgtgcctgtagtcccagctacttgggaggctgaagcaggaggatcacttgagcctgggaggtcaaatgcagtggaccatgattgcaccactgaactccagcctgggcaacagagcaagaccccgtcttaaaaaaatgaggtgaatctgattaagtcacaagaaaatgaaaaaccaaaggccctgctcataaatgaacataactacactatttggtaatgataaaattagttgtcttaatgaaaatgaagatttaatataaaaactaattaatacaggaaagtatggaggtatttcctaatgaaaaagaccaaaagacaaagtccaaaatatggtgacttatgatccatgttaccattgatttatcaattatacaagtacataaacatttatatggttgaacagtactatactggacgctggggatacaatagaaaaaaaacacagtgcttgtcttcaagaaatttgcagtctacatggaagagaaaggaaaacaacaggcaacttaaatatagaatgaaattaactatgggtgagtgttctgcacaatacctcatttaggcgtagagttgtagggaagagagggtaaaggaaatctttccaaaagagattgtaatttatctaggagctagctaactgattcattttttccataaatattcactaagccataatgtgctaggtaccagaaatactttaatggacaaagcagaaatagctgttaccttcatagcatctagaaaacaaagaggaatactaacagtaaacaagtaaaccaattagcatatttatacttacaatttgtggtaaattctataattggtgctaagattaagacaaaaagataccaattatagatatgatcctcgaagaatgagataattaagctgagctctgaatgataagcagcagctaacaaaagtcaccaagttagaaagaggggcagcttagggaaagaaaaagcatgtaccaagacacagaaatataatggcatatttgggtatctttaaatagttcagcatggcttgagaataagtggtaagaaatgaggttcaggcattaagagagacctaaatggtaaaggacaccttgtgccatgtatggagctggtttgccttttttgggggtggtggaagagaggtattttaataatcttctcatactgaaaatattcatctataaaatcataactatagaaaagaatattaatatcatatattcagaaaaaataaactcaaaatggagaagaaacttgggattagagaaaagaaagtacagaagaacaaaaaataaagaaacgttttactgaagattcaggaaaaaaattcaaacataaaactgacataaaataatcataagaactatctcattcttattataaattattataattttaaaattaataattcagaggtacagaaagaaatacaagtcaaaaatgaccaaaccttatatcattaccttcatgtaaagaaaatatttcccaaaacagcaacaatctacatattttgttgaaaaattttttaaagaataatcagcctaaaatagtattttaaattaacttttgctgctaattaattactcagacaggatgccagtccagactacatggtgcttctagtttttctatatactgtatgcatttctgataaatgggaaaagaatagatgacctggcagaaggctcagacaataatatgtgatttacaggacaagaatgcagctaccacaagatttatctgacagccctctccgatagtggactgttgagtatccgaaggaatgatttctagtctacaaagtctactactgagtagccatacacattatttatttattagatgttttgggttgaaaccatttttaaatgatgcacttcacaatgcacagtcataaatttagctttaaacccaagaagggaggtagtgttattggaatgtatgtcagactgaattaggactagcaacacaacgcttttataaagtggccttgaatgcaacgtcaagtctttcaaaaatgatattaatgtcaaatgaacaagatacaaacactttatataatgctggagtaatattacttgaaacatttgcttaacattttctttaaattcatatatatttaaaacaggtttatacacatatacaacaaatttggcacacaagtaagttgcatgtttgtgaaaaaccacctgaaacacagttgagaacttgttcaatttttgtgtatttgcaacagagaacatacagtttcctgaagaatgtaagcagtcttattttaagaaataaagaggatttaaattgatctttggaacttcagtcattcttgaattattctacatgggattcaacagatgaataaatctatttttacaaacctcatattttaattatactcaaaaatataatgctgagtattatgagaggtttccaactctaattaataacattttgcctaaacaatattaacatttaaatagactaaaatatgaaatggtgcctaatcaactattatatatagcctaatcaactattggtaaatgagtggacattgaaaatgacaatcttagtcaaaacaaatatatagtgatctgtttggttttattgtcagctaaccaaatgtgatcatttcctcatttcttaaatttaggctctaaattctcttttacaaataaaatgcagttaaacaccttattaaaaataacacaaaaagaatataagttttgaatggattcaagaaaaataatcagagcatggctgattgtcatgaaattaacaccaactaatttgtaaagttctaaatcaaatttgcagatgttaagttcataagcatatcccattatttacgtgattaaaaagtagtttttgacctgatctttcgatctttggcactccgtcctctccatctcctcttaaaaaattaattaaaattttagcaagatggtagcttttgcttcccaccctatctcagaccaaaaaaaattatcaatcaaactcaagccatccccacccaggatctgtaaaatgtcgacttgaaattcaatttcatatctcttaagctttcatgtagaaaaagacagttcacttcttaacaaaataaatcacttttgtgattgccaagttgacctctttgaattaggaaaattcaaagtgaaaaatgtaattatcaccccagaacaatctgtatacatctggagctaattctagcttcatttttcacatcatttttcacactgtgctacatcttgtagagatgccatggaacttttgaagaactcacaaaaaatgttaaggacttcaaatacccaataatgtattttattcaaacaaaaaccttgacaatttctgacttgaaacttactgtactatatgatcttcatatcccatttgattgcattagtattaaacagtactgtgacatacatgataaataggcatattaaaacatgtcattctttatctttgcagctcctaacattaaaatatgcaatatactatattggaaatagcttccatgtaccaaaaatacattcgattcttctaaactagaaagtaaaacttcattgtgaaaattcacctatgaaataattatatcactatgaacaataaatttatattcttgtaaggaaacatccaaaaccataagaatgctcttttaaagtgagggcaatttcatgtagacataagaatgctatatggcaatttctatccaagaaagaaacaattatttctaatcaaatggcttaatgagaaattttatctagtcagcttttgaagaaatggagttttctaaatgagatgattaaattatagaacatgattctcagtaaatctaagaatcacaagcctactaagtaactacttctcacaagttcattacaaaaatccattaggtgtaatctctagaagtaattgttcttatcgcaccttattgacaatgcatagtattgatttttcacaccttctatgattctttaatttatattcatgaaatgtccatcagcacagtctaaataaatttggcatataggcactaaaacaaataaatcgatgcaaagaaacattaattttgcattatccttattcgttaggcaagtaaaccatgagagttgtaaatgaaggtcaaaggttttgaaatgggtcaaaacccttgacctctagaccaatacctttcctattaaaaaaggctattttaaagttttaagtgggggaatttactaccaccaagatatcactttaaaagactacaaagaaaactctcaataaaaacattcatctgtttaattgcaaaacagaaaagaaaacctcacaggatacatgatttttatataagttttttttaaaaaaatcattaaagtttaccacatgaggtacaaggttttggaacacctaaaataattttgctcttaggaatttattttctacatcttattatgatagctgccacatttttgttaatgttttcccaaatctactgtgcatgtcaaaaataattaccaatgacaaggattcaaaatcatttatcgctcattttataacctctgcacaaaatggaagtaaacccataattcccagtggagtcagcgtggcactccacaagatatagaaataaatctgtttttataaccttaatatatacagcaaagaaattatcaagatcatttgatctggacatttttaaagtgactctaaaaacttttgtttctcacttcctctcatgcttgcttcaaaattatctgcaagtatcaaaaataagaagtaatccttttgcaatacaaacaaaattattttaaaacagcaaactcacaattttattataccaaaaatttcagtaatgcaaatataaaatcccccatgaaaacaaattcatgtgataatctacttttaattcaacatttattcttgccactcacctgagaacacagtagcataaccaattccacaactgaactactcgacttcatgcaaaccagacctattttaaagagaattttaaaaaagaagttataaagaaaacaaatgaggatttgttacaatttcatccaaactgtttcttcaaattattttttcagactattaatagtgcacatttaatcacatgatcaaataaggtacactatagttagttcaaagctggcttcaaaactaccaccatttttgtaaagtatttcatttcagctttcaaaatactaaaacatttattacaacttcatatataatgacaattcacaatactcatagaaatgtgcacaacatatgccatattgatcaatatcatctacattttgttttggagagagttgatcgttatacatgcagagaagggaaatggctccctgacctttgctttctccactacactctctcccttcaaccctctagctatcaatcaagtttccattttgtttcatggcagcagacatcccaaacactcttattagtaccttgacctctgacctcacactaaaccttaacagaaatgcaagccgttgtctgttatatattcttgatttcttataaattaattcatttacttttatgtttcattttggttcaccaaaaatatctttagaatggatattttatataattaatacctatttaaagaagtctttggttttaattaccaataaaatataaagtagttcattagtatcttaacaaagcaatgccaataattaaagggactaaattattaaattgcattactagtaatcaaaaaaattacaatttttttattcgacatttttctaagcaaacacaggcttaggttccagggtataacatctaaaataattcctgatggctcttaaacatcctattgccttcttttttctcccgaagaaaactcttccaggtaccctatccattccctttgtctttttattctttagttctttctccttccccgtttaaatacgaatgcttccaacctaatgatagcgcatgttggcattttttagctttataaatagcattcaagttaaaagggctgttcacccccttcgttttttaaaaaatgttagaaccatttttctcaatgtctgaaaaaatatgtaacatagaaatgatggtaacagtgtcagcactggcaagaaaattagctatagaatgtctctatattgtattaggaagcaaattattaactacagtgtgatttctgtagggcgaagatgaacatggctcttcaggctaatgctgtcaaggccaaaagaaaaggcaagcaatactccctctcttactgcaggtgtagccctctgctggtctgaaaccttgccatttttccttaaatttaacccagataataaaagaagttcagttttgctccaacttcaaaacccattatttccagaaagtaaattcagatctttctattattaggtcattaatccttattgctttattcgagagaaactagaattcctgccattgggccctgatgggcccttttattatacatctcttcagataatgaaaaatagtaattttaaaaaagaccttaagctatccaaaattagggagatttataggtgctcctttgtccctcttaccacacttatcatatttcatacatatacatatatatatattttttgagacgttgtctcgctctgtcacccaggctggagtgcaatggcacgatctcagctcaccacaacctccacctcccaggttcaatcaattctcctgcctcagccacccgagtagctggaattacaggcgcccaccaccacacttggctaatttctgtagttttagtagagacggagtttcaccatgttggccacgctggtctcgaactcctgacctcaggtgattcgccaaccttggcctcccaaagtgctgggattacaggcgtgagccaccatacctggcccatatacctatatagtcttaagaaaaatttcacacatacacatttctgtttatttatttcagtcttattttccaataataaaggctaacaaaccagaagaaggttcatagctactttctagttggatatgaatattcaggaaaaaatatattcactgacaaagctagtaaaaggtcaaataacatttcatagttcggtttgaacaattaaggtggaggagagtgatggtagatgtattgcaggggcagggtggaaagtatgttcaattcgaatgagtaagggcttcagaaaacaagagagacctgataacagaccttaagttccctgtctaaaggacactggtactgtaaacacaaaaataacattgggagcaaagaaatagaggatagccccaataaggaacttaacatcaaaatgtagaacttacgtcacttctatttttgacctaaatttttgccaatggatgacactcatcacatgtgcaaaaaaacaaataataaacctgtaaatctctcttcagatttagtcatactctaagaacatccaaaggaaggccctaaaaccttaaagtcaagttgtaagttactgccagaactatcattttcattttatacacccacaaacacacacaccctattactgtctcaatcaaaagaaacgaagtactgcaagcttacagatttgaaccagctcacaatctgacctctctaaaactctcagtagaatagtagaataatagggtttggtttgattattttttggttggcttttcaaaggtagaaaatgttagtcttttcaaaaggacaaactcaggataccaagccaagagttttatatctgcactaatctggaattttatgatcaaagaccactgtaatttcttcagtggagactcacccagatatatcacttcagtgaaaggattaaatgactcaccagacagtaagccagtgccacctaaacccatcgatctatctaaatcctcaagtatacaatgaaaaaatagtcatgactatttactatctggaatataagagccctcttgttttttgtatttaagtcaccttaaataatttattttttaaaataggatggcaataaacattatgagaaactttaataagaatttaaggataataaactcaagaagttttactccatattttcctggttttgaaggtatatacatatactccaaatgagcattatcttttagataaaactaaatgctcatgatgaatctgaaacacaaccatcttgaaaacactaagtcgaaatttcaaatacatgtttaataggctctagcttatcataaattctggttttccttcctgaatttatatcatccaatccaacattttggaaaaattggatgactaaaaattttgttaaagaggacagacatcttctttgcttgagacttgcaaaatattttcttgtacagatttgcaaacatttagaataatcaatccactgaattttttatttccatataaacttttccttctagtcatcattgtatgcacacctgcctttagcatttatctacttagaaactgtatcaagtaaactgtggtacataatcatcccacaagacggaagaacaccgccacacgtctttttagaaaaatgggatggcccaggttcttgtctcaagttatcacacaaactaagcacaatgaagtccttcctgctaaataacatgctcatagagtgtacagagatactgtgaccctttggagggtcacaaaccattgtaatatctaagatattttttgcctaccccaaaaaaagtttttgccccattgagactgcaagtttatactttcttaaaacacagtgcaggcagagtgcagtggctcatgcctgtaatcccaacatcttgggaggccaaggcgggtggatcacttgaggccagaagttcaagaacagcctgggcaacgcagcaaaacccatctctataaataaataaataaataaataaataaataaataaataaataaatcaataaaattttttaaaacattagacgagcatggtgacatgcgcctgtagtcccaactacttgagaggctaaggtgggaggatcaactgagcccaggaagacaaggctgcagtgagccatgatcacaccattgcactccagtctgggtgtaggagtgagactcagtctcaaaaaaaaaaaaaaaaaaccacagtgcaaaattttgggtaaagcaatacaacgacagaggctaataaacaagagtaattatttcttttcctattgcaccatcactccaagtgcaattctagcattcgtgggttttttttttttaattttagtccacagcatagtaaagaatagctgatgtgtaatagtgaaatagcaaaatgtttcaagatacagaaaaaataagatcactaagactataattaatcatatttataaaaaggatccagtgaactcacatataataattgtaagacataatttaaaattttcaagcttgtgttctctttgttctttggaaaatctctttagaaaaattaatccttacaaagggttataactacttgaaaaagagggttaattaacatcattacaattgagacaatcaggctacaggtgattccaggcatgatgtaatatgaaatattacatctaatttaacttttagctttaacttcaagtcttcaaaatatacagggcatatggccagacgcagtggctcaggcctgtaatcccagcactttgggaggcaaggccggaggactgctcggggtcaggagtttgagatcagcctgggcaatgtggcgaaaccccatctctacaaaatatacaaaatttagccagcttggtggcacatgcctgtagtcacagctactagggagactgaggcacaagaattgcttgaactcgggaggcagaggttgcagtgagccaagatcgcaccactgcactccagcctgggtggcacggtgagactctgtctccaaaaaaaaaaaaaaaaaaaactaaaaacaaaaacaaaaacaaacaaaaaaaaaatatatatacacacacacacacacacacacacacatatatacacacacaaatatatatatgtctatataaacatatatatttcttaaagataaatatgggctgggtattagacgacattaagaaactattactattattaggtgtaatagcagcattgtgattatgtaagaaaatgtctttttttacatgctattaagtattcaagggttgaatgacatgacatctaagatagttttaaatatctaagatagttttaaatattaaagcaaaataaagggaagtagagatatcaaataattatggaaaaatgaatatggtttggatagctggtaataagttcatagatactatacttactacttttgtgaaaatttgaaattttcattaaaatatttttaatactaaaaaactcataagcatttttttaaaaattaagaagctttgtaatgtttggtcacacagctagtcactggcaaggacagaatgaaaaccaaagtctcctgccttttatattaatgctttttgtacagtattatgctgcttatacagtactatggcacaatcacctctttttaaatcctttctgttttacagtacatgaaaccacaatccaaaacattcctcacaacataaaatacataagttacataagaactcttagatttgtttgctatttttatgaacatcatcaatgaataggcactgctcaaatttatacatgagcaatagtacaccttcttccttcttacaattttaccaaaatttattggtaaaaaatcattctaaattaaattttgttcagggatatagaagtgtccattgctaatgcttctgggtatttaacatgatcctatcttgttatctgctataaaattcaaagaccaataagcaacaatgtcttgcaatactgagaggctgtatttaatacatacatcttactcactgtaataaaattaaacatagttcataagttgttacaccatttaaaaaaaaagtttcatatatgaaacataaattagggaaaagccctgaaatatagactcttcaatttttaaaattcaatttttttccaattatattacttcataagtaaaagtcattcattacttcatcaaatagttcatagctaaataaattatatccttcaatagatctaaggaaattgctattccaaacttaagtacttctaaaatctgaactttctttttcaaataaactcattgttactttttgactgcatgaaaataatatcgctcatcaccaactccatttacatctatagaagagatgaaattcctaactaaagcttcatatgtacctactgatattgtaagggtcaaacgaagtgctcatattgcacagttaatactcaaatatagatatcttaaactattagcctacctataaccttgcatttccattatatccttattgctacaagagagatgctttttcacaggtttttaaaaaattcctcagaccatctcctagctactgttagtcaacaaaagattacaataactaaagctgccagttgatacttaaagacactggaatacagatgggagtgtcattcccatgatttttcagtttgaggagaatacaagtatattatcctaaaccatcaatcacgggcccaaaaaaagccagatttagcaaccacctaatccaagcacttttgaatgcaaaaattaattctatatcatcatttataaaaagccctgtagcttcaccttaaaaaatcctagttatgaggtcaggtgcagtggctcacacctgtaatcccagcaactcagaaggccaaggtagggttcaatcttgccagtacactgcactccagcctacacaacaaagcaagactctgtctcttcaaaaacaaaataaaataaaaaataaatcctaggtacgaagatgaagattggtattttgaagtcagtctgataaactcttcaactcattatttaagaaattatcctctattgaactgcaatctgttttctgaggaaatttacggtaaatctactttcacttggttaagtcactctctctaatattcgaaggcactcactacatggcaatgctccatgcgcaaaaagaaaaaaaaaaggaaggaaggaaggcagaaggaaggaaggaaggaaggaaaggaaaggaaaggaaaaggagaaggaaaggagaaggaaacgagaaggaaaggaaaggaaaggagaaggaaaggaaaggaaaggaaaggaaaggaaaggaaaggaaaggaaaggaaaggagaaggagaaggaaagaaaaggaaaggaaaggaagggaagggaaaaggaaaggaaaggaagggaaaaggaaaggaagggaaaggaaaggaaaggaaaggaaggaaagggaaaggaaaggaaaggaaaggaaaggaaaggaaaggaaaggaaaggagaaggaggagaaagagaaggaaaggaaaaggaaaggaaaggaagggagaaggaaaggaaaggaaaggaaaggaaaggaaaggaaaggaaaggaaaggaaaggaaaggaaaagaaaggaaaggaaaggaaaggagaaggagaaggaaaggaaaggaaaggaagggagaaggaaaggaaaagaaacgaaaggaaaggaaaggagaaggagaaggaaaggacccattattcctcatccactccataaatagcatggtttccaatcccctcagcaacctacctcagcatgctatctagtttgacaatctcaaagtacactacctagaagagacccaggaatctatgaatgacgtaagcagtatagagtaaaatgctgttatctctatttgtaaaacagaattctacaaataacaatgcattccttatctgtgtggcaatacattgttgttcatatggatctaagttcaagtaaaatcctgtgacactagtctctccaattctttgctctcaaaattaattttaatgtatcaaaaaaaaaaaaaagtcttagttctttggttcaacacataattctacgctccatccaaatcactgataaaaatcttgaagattacaacataatagacatgtgacacagtcttcaaaagatagcctatgagaaaccttgtcaaaggctgacaacacttaaacaatgaaactccatgttatttcattatccatgtaagtttttaatcctgaaatataaatacatacaaataaaataaagaaaaaccacttacttgttccttctataagcagttcttgtccatggctacccaaaagtgtccgagaaagaaaaggtgcaaaatccacaaaaatctcacgaaggagaggagctgccttttccaaagcgtgttcaagcctctctgtaatactaaggaaaagacattaagttacttgaactattcaacagattgtatcaattttctagttttgaaaataaagatgtatttccatatatatatataattatttaaaaaaattaaaaatcacctaaagagacattactgctatgcatagcagtccttctgccaaaaatattcgtttttatcctgatctatcttgcccctacaatctccaacaaacaacctggttaacaaccactccaagcatcagtacttactacaagtctcacctggccagttaagagcagtttgtttttaggcccattataatctaaacaaactctcatcaagtcttcaacaaatttttctatttaccactaaaccattagcacactgagttcaagaaccatgacttcattttaaaattcacagttatagcatatagtatagactcaacagacgttgagtgcttataaattataaaaagcagttcttttttattgaagtcaattattcctttctaatgcaatgtgaatgatttttctcctgaaaataatatactttataggcacattataacaaaactatcatttggttgatagttatatttattaataaactgagatagttgtaaatgtacctataaatatataaaaatatattaatatatatttgtgattatatatacatgtattcatgtatacatacacagatacatttaatgagggttttttttttaaggtccccagcatttcagataattcacagatatccacagctttagtttctaacttacaaattaaacatatacataaagagccactagttatctactattaacactaggagtacttcctattcatactaccaagaagacagttgctactgaaactatcaacacaaacatatataaatttttgctgtgaataaccatctcctcacaggcactgctctaaatactattttcttccacacaactcatagaacttgttatccctgaagagtatcacaaatactagctatactcgaagcactcaagtacctacatttgtagtgtctaatggatttcccaattgtggtaaagaaaatcaaggactctctggacactaagtctccagtggtggaaaatacactcaaagcattcgaaattaaactctgaaacccaattaaacaaggtaagtaacaataaaaatctatctacaattcagtattattgtggctttggctgactggctatcacttatatcagcattttgttgttgttgttgttgttgttgttgttgttgttgagatggagtctcactctgtctcccaggctggagtgcagtggtgcgatctcggctcactgcagcctctgcctcccgggttcaagtgattctcctgcctcagcatcccgagtagctgggactaaaggtgtgcaccaccacacctagctaattttttttaatatttttagtagagatgagttttcaccatgttggccaggctgatcttgaactcctgacttcaagtaatccgcctgcctcagcctctcaaagtgctgggattacaggcgtgagccaccgcacctggcctatatcagtattttatagaggagaaacaacaaattccacactttcaatttgcaatcatttgaaagaaagtcataagcttatgtaaatatttgttatgcatgcagcaattatttttttaccacaaatagtcacttctcatgaagtgacttgtacatcatgaaatgacttgtacatcatcaaatgacttgtacatcttataatctttcaaaagaaaatgaacttctaaaatgttcccaagcctctaaatgtcatatatgttgaaagaaagaaatgaaatgaaatgaaatgaaacgaagtaaaataaacctagatagcttaaaaagtcatcaaaaggtataaatcacaatattcaagttagtagcttaaatacctcatatttgaaaccggatcttgtgaaactgaatcaactgttggaactgagggcaattttgcattagatgatctactgcctataaaagaaaaataaccatctataggaattttctgcttttagatatgaagatttaaataaaaagaatgtcattataccagtcaataaaagcattataacgtatttttatgtccattactatttggataacattaaaatctaacaattaacaactaaatgctttcatatataaacctcagctacaagctcaattatcatgccagagcaatctttctatccatgagctgaagaagcaagagaaaagtaaattctgactccctaaataaggttcacaattccttctactcaacaccaagtgtcaacagaaagttacaagtaaaagcattttcttaacatagcaaaaacacagaaacagctacattccaaatttagctttaaacctccattaccatgaaaactatccgtattcagttatcaaatcactactaaaggactaaattgtagcaataaatgtaatcagggttagaagcctagatctctgagaatctgtaatcttgtatcacaactattatcagttattttccccttatgccccaaatacaaaaacactatgctttaaagagaataagggccctctttcccaaagattgttgaatctttcagtccaaaagtgattagaaacacatcaaggaaagcatctgcatcaggctggaggttgtgttggcccagagaaagttattggagccagtgtgaggaggaaatccaaggaaaagagaaaactgagaattgtagaattcatatctatatgaattcatggttccaataaaggatggaaataatatgtgaatgacagtatatatttttatagacttttatatacaaacatacacacacacaaacacacacactgcctctagctctgtccactaagaggacacggaagcagcagcatcttaacacttggtgtccagatcttggtttctaaatactatactccactaaaagaaagaaatggctgattcaagatctgtgtaagaaaagcacaaaatgagtttgaaacatctagttatgctttgtagaaagcaaggaatgataagatatatacaaggaataaggttatgtcaaaggacaatgaagccagcttgaaggggctcccactgatcaaataccattgtactccatcctgggtaagaaagtgaaactccgtctcaaaaaaaagaattgccatttttggccaggtgcagtggctcacgccagtaatcccaacactttgggaggccaagacaggaggactgcttgagctcaggagttcaagattagcctgtgaaacacagcaatgcccgtctctactaaaaatacaacaaagtggccaggaatggttgtgtgtgcctgtggtcccagctaggtcccagctcaaggatcacttgagcctagagggcagaggttgcagtgtgccaagactgcactactgcattctagcctgagtgacaaagcaagaccctgtcttaaaatacgatacgatacgatacgatacgatacgatacgatacgatacgatacgatacgatacgatacgatacgatacgatacgatacttccctctgcttcacaccactcccagaacttcctcaagctcacttcaattgtatctaggaattctgattcaatgtgctctttttggtaaggcaaataaggttaattctggatatagataagcatagccaggacctaatcagaagatttgtggatataactgaataaaaaacagcaaggatctgaggcaattttgaactttcctgaaacatgcttggtttttaggcagtacttgatcaataaccctcagttctgattaccaggtctcagtcaaatctaaggatccaaaaatctagacaatttggccccccaacaagcttggttccttttggaaagcaggcaatgcagcaatcttccacaattaacctctggataattactgagcccaccccttagagtgagcacatacctagtacaaaatgaacttaactgtagttaatctttcttttccacaacatatttcctttcccattcccttgataatcaaagttgactttcctttatataccggaagttttgtattgcttacagtcctgccttcctcaccatcctgctcaactgagatctaactgtacctaaaaactctaaccaagtgactgttggtcaggacgcataggattcgtttaaaaatgaagctaaagcacacacttcatcatgctgacaattattttttatttttctttttttgagagagggtcttgctctctcacccaggctggagtgcagtggtgtgatcagagctcactgcagccttgaactcctggactcaagccgtcttcctgcctcagcctcccaagtagctgggaatataggtggatgccaccacacctggctattttctattttttttgtagagacagggtctcattatgttgcccaggcgggtctcgaactcttggtctcaagcaatcctttggccttggcctcccaaagtgcgagggttataggtgtgagtcaccatgcccagcccattgtgacaatttttaaaagcataaatatcaattcacatttcatcataaaaatattgctatttttgtgtttttcacaataaaatttcaaattagagggcaagaccagggaagttcaaaaacattttttcaccctttggtatctggcacttctaagagtcaggtccaatcctaaaatcatatacaacactcagtaaagtacttcacagacccaatggctttattaaactcagtaaatgacacctgcaattttctaagttcttgacaactatatgatcactgaatcacagtgggtcattgactgttaccagtgattaattaaatagttctgttttcttaattggtgatagtttttgaagaccatttttattgcaatgtatcagacattttctctattaggattattgatggattttcttgagcttttctgaagctaatacaaaggaacacataaggacccatttacttaaaagtagaaatggaaaaaataaatccctccccagaaaacatatgcatgaggctttaggaaaaaaaaaaaaagggggtgtgcatgaggctttaggcaaaattagtctttactgtgttaactggtttattgggttttttgttttttgttttaagagacgaggtcttgctctattgcccaggctggagtgtactggtgtgatcatagctcaccacagccctgagttcctggactcaagtaatcctcctgtctcagccttctgagtaggtgagattacaggcatgtaccaccacgttcagctaattttttttaatttcttgtagagataaggtctcactttgttgtccaggctagtcttgaactcctggcttcaggtgattcttccaccccagcctctcaaagtgctgggactacaggtgtaaatcaccacaccctgcccactgtgctaaatgatactaattttaatgagaaatgcatattagaaatgtgaaaaagaaaagcaacattgttacttctaaataaagcagtaacaaaaattatttcctcacactaccctagaagtaatgccaattttcaattctaaaagagaatatagcagaaagagattttttacagtgtcttaagtcataagaagacactttaccaacacggataataaattaaccagcaatagttataagaaaaaaatcacatgaaagaataaactaaatacaccagtaatttcacactaggttgtcctccattcctgctgtggaaaaaaatgtaatatccaaacacattctgtattttttcaactcaggtaaaaatataaactttcaatcaatttgttttaaattatcattaaatatttccagcaaatgatcacaaatacataaatgcagaagctacctcctacatgtggaatgatactcacttatcttttccttatcctagcactgataaactggctccttctaactgacagttttccagacattcaaaagaacaaaaaggaaaatgcaaatatatcatctgtctagcatctatctggggagtaggcaattgtttatttaaggtccctgcgggtctaaataactaatgtcccttgcaataaagaatcattaaaacaaatgccaatttttaacccctaaacactttagcactgcatttctctctctcttttctgaaccagttaattcagcctgggatagtctacatgcccagtaaaaactaattaaacaaatcctattgaatgaataaaaataagcctattggcctaaatcttacacaaagcaaagatggttatgactcaaatatttccctaatattaaaaaagtactaattaataatgtatatggctctgataaacagatactgtctaatattctagtaagtggtagaattactaaattttgcaaaatagcaaacaccaggcatataaattagtgaacagtatacttagttccactattgagctagtttcaattttgatttattcatttatgctttgcaatatagagaaacagcatattggaaaaagaataatgatattttaacatacaagaagggatatgggtgaaagtggaaggatcacttgaagccaggacttcaaggcttgtctgggcaatagaacaagactctgtctctacaaaaattttaaaattagccaggaatggtgacacacacctgtagttctggctacttgggaagctgaagcaggaggatcactcaagcccaggagttcaaggctgcagttgagctatgattgtgccactgcactccagcctgggaaacaaagacagaccctgtctcaattaaaaaaaaaaaaaaagaaagaaagaaagaaagaaaagaaaaaagaaaggatactgtattctaggtaatcagatctttgctgatgactataaaatttctagattttgatatatttactaaaatcactttcgcttttctttgaaaacatgcatatacaaggatatgccttatcctctgatgaatatcttttaatacttattaattagaagatacaattgttgctcttagactagtccttttggttgataaaatgctgcataagctaaggtatactattcaaattaaaatttgaaatttgaaatttgtacaccaaaaaagttttgtatgttaattacagtcttaataatgtatactatttcaaaatgcaaacaaattctcaatttttatgggttataaaatttttcagtgataatattttcatagaaaaagcttggacctcatataaagctggcaagttttaactctgtttctgtgattattatctatctagtactagtttctctttaattgtaccacatgtaaaatgtgtctcattttgatatcaaaatttccaaatatccacaaatgggaatttccttgaagatatcatgtgaatatataacagaaaatatgaatgtcacagaagaaacttcatattttctatcaagtaaattttttgcccaactgtaggataatgtaagtgttctgagcacatttaagatagggtagattaagctatgttgtttggtaagttaggtgcattaaatgcattttcaattttcaatattttcaccttacaatggtttatcatgatgtaaccccatcataagtcaaggagcatctatattctaagtcacaaatgcatttaacagagcctattttataagaaggtattggatatatcacataatttactaaatattgtattgaaagtgaaaaatagaatggtcatacggatacttgaggtacagtttttactgaatgtgtattgctttcacaccattataaagtcaaaaaattgttaagatggaaccatctatatatttatctacttattttaatggcagataacttaaatcgagagacccaccaaaaagaaaacaaaaatttaacagttaaaaaaatactgacaagggaaagagaactatttgggaggttggggtagtttccatgtgaaaatgagtactaacaagtacaagggcaagtatagtaggcaaaagcatgtaaagtggggcggcagaagagtaagaagcaggacaaccaaaaacactagattaggttagatttttcttatcaaggcagtaatgttcatggcatcaattaacggaataaaatagaagcaatacactgaaatagagaacccatatgacagtaacaagaacacagtgaaagaggaaaaagaagagtcagatgtggaaaccaaaacaaatggtaaacagaaagaccatcatcacaaggaagacttgaaataactgaaaaagcaataactgtttttttaaaaatggggggggctaaggaggggaaaaaagtttaaaattctagctcaagatggaaaaaaaaattggtaactatttgagaaactccatcacaaattatacaaaatttaaacaatagaaaaataagatacattatgagctggatcaatggtatagggttttgtagattttgccaataaatgtaacagtcttcaagatagcaaattgttttataattctgcatacagtttttcaaagtgaatattttaaattacaatgaatttattggaaaaaatacaatggtttcagagagaaatgtataatactgttacatgtaaaatattacccatatgtctcagctgtttcttatctcttctgaaaactccaagacttaaattttaaagaatagacttaaaagcaatcaaagggtcctatttcctctgttcctaaactgaaactagagggcagtataagaaaatattttactcaatgtactttgaatttctgaaactacatttgattttggatgttaatgaaaaatttactatacctgaatttaaaagacggcaggtaaatcatttcatagatattaataactattgcatttttcacaaaagggactactctagaaaaaccacagttgattctttttttttaaaggactttggatgggggtggagaagcggaaatgtgcatacccagctccaaatgaattaccaaattatttcttctccaaaggaaaaaaaaaaaagaggcatcagagtataatggaacaataaagatgaaaaatttgctagagtttcatgcccattttcctttgtaattctcactgggccaggggaaaccagcgagggagagaatgacagggtatttgagaattctctgtacttcaaactcaattttcctgtaaacttaaaactgatctaaaaaataaagtctattaatttttggaaaaaattataaaataaaaagcaaggcagacaaaactctgctaccatcgcagcttttggtttcaaactagaaaaaaaattctaatcactatttttcctaagaataaaaataatacaagactattaattaaatgttagaaatgccacctaaagtaaatttcgaaaatcaaaattgccagtagcccaacttcatggagatccaaatgacttcataatacactttcttgcttttaccatgtaaagaaggtagataagtcacttggttgtaattatacagtacgtaaagaattgcatataactttcttttacttaacctactggaacattttctctattcactaaatactataaaatttgtaaaaaaattaaatacatttaaaacttcttataaaatgtatttttgttaacacaagcacaataacaaataaaagagaagacaaaagaaataaacatagtatttgtttctaggatacatgattacatagtacacatcaaggaaaaaaattcccagctactggccagtagcaatatcaagtttggaacaaaactctccaagatatgctaatttgccaaataaaggtggaacagcagaatagaaggcaaaccctggcctgagatatcccaaaagaagtaacggcattatttctgatctcaatataatccaccaggccattccttcaaaattcctttattttccgtcaatctcaacctagaatcataagatgagtgttttggtaggtacaatatcttgttattaactttaagaaacagcaaaatatccagaagaaaaccactgatacagtaacatcccttttgttatacttggtcattttaatactgcacattcttcacattattcaagtttacccagtatcaccattaagcttcccatcaatgtataggatcttgcatccatatatatgcttttatacatggaaataattttttatccatatatatgcttttaaacatggaaagaatgtagaaggagagatggacaaaaataaaagtgctataggaggaaatgaaccagtatgaccattgttagaatgatgctacacttcagagcagcattcctttccaagcctctaattcaaaaaaatatgccaaaaaaaacaaagtattggacactatataaatattttttttttgtacagtccaaaatatttgacaaccagtaaccacattaaaagattacatgtcaacaagactttcttatttaggccactatctatatacatcttcttaagtgcagggaaagaaaataaaggaaaaaaatatttttatgaatctatcattcatccatgcactcatctacccaactagcagcatctaatctaccacacactactaggtttgagtggagaaaatagtgaaatccttgacttaatttcttttaattttactcaaatttattcagaaaagtagtaaacaatcaacagtataaaagtacaatggtttctaatgtgcccccaaattttaagttaatcaaaaatcttaagcgttgctaaaatgagatctaaaaacatttttgttgaaatcactgataactaactcacctggtgattctcctcccatatctgaggcttgggctgaatctactgaggaaaccacactgacagcattggtaggtatgcttgtattaaaggtggaaggtgagactgctgacttttttgctgcaacaatgacacttctgtaataaagaaagtaaacagactgaaagatacaaattgatctcttgaattaattacatgaatttcaaaacagaaactaggtagctaacttatttttctaattttctttcttatttctatttgatgtacaatttagacttttcacccaacatgaaatatcttcaatactgtccatatttatctgcatttcactatgaaaatataataatctatttaacatttaagcttatatttaccacatagtatttttaaaatttaggatcatcttaattatctaacaaataaaatataaccaaaagtattaaagcagaaaattcaacgtttccacaagaattgtaaagcactgctaatctgaaataataaaaccttagaaatcttataagcttaaaaaaaaaaagcagatataagcaatttgctaacatgtatacaacccagtttttcatttttaaaccccaaagactatatcttttgataatatataaaaaagcaatgcataggaataaaaaccatacgcaaaaatatcaaatagtcaaagttctttatcttgtatattattcaaacacaggtatttatgatataccaatttcaattaaaatgtaatactttataccaaacagtaagtaaaagaccttgttaggcataacttaaaaggcatttttaattgaagttggctccataaacatgcaaaaactcagttaatgaggtaaagaggacagctgatatataatgcactcccacagcagtgcttacttttaattacctggtgttaaccataagcccaaagtcttcaacattcaatttatttaatcacatcttttgttgacagtactataactgcgagcttcaagtattcccttaatagctttaaagtattcagcttctaaacaaagtaacttaggtatttgatccctatacatgcattcaaaagtgaaaattatgtaattccaatattttaataatacatttttgtagttatttttaaaaacacacacacaaagcaaaataggtttcgttttacctcagtgcctatcatgtgagggcaaacactgttgccaattaaatcaaggtctcttgtgctaggcatggcttattcaatgtacttcagggtagctggtgtcacatcattataagggtgactgccaatgttaactatacactaaaaaatagaagcaacagccacctgagcccccaatccaaaatggtgtgcttaaatcacagcagcttatatcagatgaagattattgacttaagggggagtagatatgacgaatgtctgtgtgtgtgtgtgtgtgtgtgtgtgtgtgtgcgtgcacgaatgtgtgtgtgtacgtatgtattagtggtaccttcaaaaacaacgcaaaatgtaatttttgtatttcctactggagggagaaatttaaaacccattgcttaagaaaatcactgtcttctaccaatgtttttgcaggggagggaggagaaatatgaagaatttactttcacatttgttcacaaaagaaagaaccagcaagatctagtttactcatactgtaagtagggactgaattgagcaatagaaaagaatacttagaaaagtgcaattgctttttctataatcaaaatgtaagatatatacccatctatgctatgactcaacaattccacttctaggaatttcctcaagaaagcttatgtccacaaaacatgtatacagtaatggtcatacaggctttatttataatagtcaaaaactggaaatagcccaaatgtcctttatgcagatatagtaaatttttaatggtgctatgcttctagaatggaatattattcagcaataaaaggtaacaaactactgatgaatgaaatgaaaaggtaacaaacaacatggatgaatctcaaaagcattatgttgaatgaagtcttatactaaggagtatatactttatgggttttttttttttaacatgcatgtctagaacagacaaaactaatttatggtagaaaaaaatcagaataattgcctctgggggataggaacaggaattggctgggaaagagaactttcaagaccaatgatatcatgatggggacttaaggttacacaagtgtataaatttgtcaaaactcatcaaatggtacacttaagacctgtgtctttcattgtatgtaaattttagctcaaaaaaaaaaactgtattcatctccagttagagagctgcatgctggctgaaatatttaagagtgaagtgaactgatgtctacaactttgaagtacattacaaaaataagattgattgatggatacatggtgaagcaaacagagctaaaagctaattgttgaatctcagtgatgggtctacaggtgttcactgtgcaattctttcaacttttctgtatgcctgaacattttcataataaaacactggaaaactggtaacagaacagaatttactacagctgttccaaatatgcacaatccctatttattcaagatgacatagctaattaaacacaacaaaagaactcaacttcatttctaatcctctagcctcttgctgttaatgtttcagtcacaaataagatcttattcttttattcagttcagtaaatatttattgtccaagatctttcacctattgtcaggaatgatagatcagaagtacggctttctacatgaatttacattttacatgttcctcacacacttcttcaacatgctcttatggttgctaagcgtgttgtgtcatttcacaactccaacccttcgtatatatgcctcctctgccaagatgctttcttcttaatcctgcttgcttgttaggtaatataaaattataaattctaatagcagctaagataaatgcactgacaatatgccaacaattattattcaattctcaaaacaatcctaaggtacatattaattcaatttttagaaattttaaataaaaacctcagaaaggtaaagtaataaccaaagtaaatggtagaactaccatggaaatctaggtttatctaacagcagagccttgaatttgaaccgtttccccatgttgacctttcttaaaacttcagagatataattcacataccatttaattcactaaaaatatacagttaagagatttttggtatgctcacaaagttgtatatttatcaccacaatcatattaacatttaaacataattttagaatcatctataatcaacagcaataaagatctctaacatataaaattatttatatactaccataaaatcacaaaaatacatctgctcataaatttttaaaagctgaattatttcatatagctacataattagtatataatagagaaataaaatcaatttccaaattcgctgactgattcaaatcaattctaaggaattaacataacattgcttcagcttaaggctacacaaaatcaaagaaaaatcaaagttacaatgatccaattaaaaggacactaagcagtaggtagattttgaaatattttcattgtctttaccaatcattgtcattattactataaagtttcagtgtaaaagactaaaatcttcaacagagatctttaacctatcgtgtttatgttgttaaatataagtataaatctaaattagtaaagcatgttccacagttaacaaaaataatctagaattttaaacttaccaatagttaagattgatcatgcaaaaactaagcatttaatattacctttttatacaatgcattggaaaacacagaggaaaatgcaatatgcatttgacaaaactgagactttacatgacagacaatgtgctagggatatttctggcatctttctcaggctacagcttaagtttctatttaagaaacaaattgaaatcttttttaatgtttaagaacaattattggaactttttatatctacatcaattttagcagaaagtgcttcaaactttttagcataaggaatctgaaagatagacaaccaattatgcaagctggtttcccaaattgtcaattataaaccaaatattaaaagagataaaaattgttcttattatcatttttttctttatgaactcactatgaatacttaatatttgtggggcaccgtgcttaagaacatacacaaattatcatatttaatttatgacaacccttgagattagtagtacatattattatgctaattttacaaatgagaaagaagtaattttcctaaagtaccacacagaacaaatgaaaatactgttgctggattttttttttcccctgaacaagggatactcatttcaaagtttcttttaatttactggcaataggcaaatagcaacaatgccttcccgatcaataaagttgagaacttccatttcagtattatatcagtttcaaatatcacaaaccctcacacaaatgctattttacttaacatgcaaatagttcactaaaggaaaaaagagcatttcagcctaccacttcagtccctaaggatccagttgaaaagccaaaccagtccttgaactttatcaagataaatccctggcattcactaatcatcagagaggatcttcaaattagataagaacaagaattttggcatgggaatgaacacaaacacctttgcattcacaaaggcccacaacctggcagcctttcagcaaggttttattcatgtagctgttactctaaactttccagctattccttggaagttgataatacttaagatatgaggagagttgtgatttctgacatagcattcctgagataaatacatgatcagagggatgctttgaaattcccaaagatattccactagcccaaggcagcatgaaagtttttacaaaggggtctctaaataagaaaaaaaaagagggtaaaaaacagagcagtttccttgccatcagagactgttaaatgaatactagacatgttaaattctacagaacatcctggaaaatgctaccatcaaaattatctgttgttttctatttcaataaaccccttaaaatgtattacacctaagcatgatttcctaaatatgttcatgatctactcactgaagacatcagtaaggcacaaatttaatttctacactattttaaaaagaaataaatgctaaaatacataaaattttgatcattagtaaacaatgtaactatattaacatatattaaatttaaaagtatagcctcacatatttctgggtactcaatctaacactaacaaatctaaataaattataaaaattgagaatagacagggcacagtggctcacgcctggaatcccaatgctttgggaggacaatgcagcaggatcgcttgaggtcaggagttcagcaccagcctgggcaacagagcaacacctcatctctacaaaaaattttttaaatagctggacatgttggtcccagctactcaggggactgaggaagaacgatcccttgatcccatgagtttgaggctgcagtgagctatgactgccactgcactccagcctgggtggcagagcaagacaccgtctcaaaaataaaataaataaataaaaattgaagccaggcgcagtggctgatgcctgtaatctcaacactttggatcacttgaggccaggagtttgagaccagcctggccaacatggtgaaacctcatctctactaaaaatacaaagactagctgggcatggtggcacacatcagtaatcacagcttaaaccggtaagcacagtgttataaacacaaactagttctatttttagttgcctcgggaacctccaaactgtttcccatagtggttgtagtaattacactcccaccaacagtatatgaaggttcccttatctccacatccttgccaacatttgttactgcttatcttttggatataagcgattttaactggagtgagatgatatctcattgttttgatttgcatttttctgatcaatgatgttgagcatcttgtcataaaatcatttgacatttctatgtcttctttgagaaatgtctattgagatctttagcccattttaaggttatcatttcgtttaaaatgtagtaatatttttaaattattattaatacatttcttcctatagagttggttgagtcccttatatattctgattattagaacccttgtcagttaaccagaattataagtttattatataatccccagtctgtgggttgtctcttcaatttgttgattgttttctctgctatgcataagttctgtagcttgatgtgatctcatctgtccatgtttgctttgactgcctgtgcttttggggtattactcgagaaatctccccagattaatgtcctggagagtttttccaatgattttttttcagtagtttcatagtttcaggtcatagatttaagtctttaatccattttgaactgatttttgtatatagtaagagataaaggtattcattcttctgcatatggatatacactttactcagtaccactgagaagactgtcctttccccattgcatgttcttggcacctttgtcaaaaatgagttcacttgtagacgtgtggatttatttgagttctctattctattccattggtctatgtatctgtttttatgacagtatcatgctgttttggttaccatagctctgtagtataatttgaagttttgttctctttgctcaggatagctttggctattctgagtctctgtggttccatatagtttctaggaatattttttctatttctgtgaagaatgtcactggtattttgatatggattgcactgaatctgtagattgctttgggtagcatgaacattttaacactattaattcttccaatccatgaatatgaaatatctttcattttgggggtcctttttagtttttgcatcaatgttttatagttgtcactgagggatctttcacttctttggctgtttattcctaggtattttacttatagctattgtaaattggattactttcttgatctctttttcagattgttcactgttagcatatagaaatgatactaatttttgtatgctaatttttgtcatgcaactgtactgaatttatcagttataatagttttttatggactctttaggtttttctaaatactctaaatacaagatcatatcatctgcaaacaactgacatcttcctttccaatttaaatgccatttctttctcttgtctgattgctttacctaggacctccagtactgtgttgagtaacagtaatgaaagtgggcatcgttgtctcattccagattttagagaaaaggctttcagtttttctctgttccatatgatactagctgtggatctgttctttatggctttttattgtgttatgttccctctatatgcagttttttaagggtttttatcatgaaggaatagtgaattttatcaaatgcttttcagcagcaattgaaatgatcatatggcttttgtcttccatcctgttgatatgatgtatcacactgatagtttgtgtatgctcagacattcttgcatccccagaataaatcccactcattatgcatcaatttttaaaaagtttctttgagacaagttctccctctgtcacccaggctggagtgcagtggcatgaacacagctcactgtagtgtcaaactcctgggctccagtgatcctcccgcctcagcctcctgagtagctgagactacaggcacacatcaccatgcccagctaatctttttgttttaaaatctcaccgtgttgcccaggctagtctcaaattcctggactcaagcaatcctcccacctcagcccacaaaatgctggaattgcaggtgtgagtcactgcacccagacaaaaaaaaaaaattcataaaatgaaaaatctcagaagacacaaaaataagttaaaatatatcaaaacttacaaacacaaacacttagaaatagtacatggtaccatctacagttaaaagaaatgtaaacaatgtaaatttcaattattaaagcataactgtataaaattaacattaatgcatactgtactactgtaataatttcatagctacttcctgccacaattgcattgagcattggtattgttagcatcacttaaaatgctgtgtgacactagtcatctcagagcacgcagttcatctctttttatggggcagggggggaaggagttttgctcttgttgcccaggctggagtgcaatgctgcagttttggctcactgcaacctccacctcccaggttcaagcgattctcctgcctctgcctcccaaatagctgggattacaggcacccgccaccacgcgtagataatttttttgtatttttagtagaggtggggtttcaccatgttggccgggctggtcttgaactgctgatctcaaatgatccacccgcctcagcctcccaaagtactgggaagtttgtctctccagtaaactgtgtatcacggtaaaagtgctctctcccagttctcatatatttttcatcatgtttactgcaatattataaacctttgataacataatgggacccatacaaagtgccactagcaatactggacatgctcccaagcagcagggaaaagtcatgacattataagaaaaagttgaattgcttgatatgtactgtagattgaggtctgtagctatggttgcctgccatttccaaagaaattaatcccgcataagaactattgtaaagaaaaggaagttggcaaagttgtcactgcagtgacaccaggaggcaaaaaaacaaacaaacaaaaaaacaaaacaaaaaaaacttgcactttttgtgaaatatctttatcttgcactgaaaatgcagcttttatgtgggtacaggattgttataagaaaggcatacctatagactctaacatgatttgagaaaaactgaagtcattatatgtcaaatttaagtaaaaaagaatctaaggctagatttaatgccagcaaaggatgatcaagataacaggagaagcagcttctgccaaccaagaggcaacagatgagttcctagacatcaagaaaatcatttagaagaaaggaccagcccagtcaggtttttaatgcagacaaacgtaacctatttgggatgggggggaagccacaaaggatatttattagcaaggaagagaagtgagcactaggatttatggcaggaagagataggctaactctactgttttgtgcaaatgcagttgggtttatgatcatgactgcccttatctattaatataaagctgctaacccctgagccttgaaaggaaaacacaaacaccagctgcaagtctgttggttgtacaagaaggcctggacaaaaagaatcctttttctggattggttctattgatactttgtccctaaagtcaggaagtaccttatcagtaagagattaacttttaaagttcttttacaattggacaatgctcctgaccacccagagcttcatgagttcaacactgagggtgttgaagtggtctaactgccctcaaacgcaacttctctaattcagcctctagaacaggaggtcacaaggacctttatggttcattacacatggcattcttaggaaacaactgtcaacactatggaagagaacccaacagaacatcgtgaaagtctagaaggattataccactgaggatcactgttacagaaaaagctgtggaaaccatcaagtttgaaacaataaattcctcctagagaagactgtgtttctaggtgttgtgcatgactccacaggatttctgacagaactaatcaaggaaatcatgagagactatagatatgacaaaaaggtgaggggtgaagggtttcaagatatgaatctcagagaaattcaagaactaacagataccacaagaacagaaggatcaacagagggaaaacaatttgacggagacaagaacatccaaaccactattagatgaggaagacatagaagaagcagtaccagaaaatgaactgacattagacaatctggcagaagggttctaatgattcaagactgcttttaacttcttttatgacattcacccttctatgatacaggcactgaaactaaagcaaatggtgaaagaagggtttgtaccacatagaaacatttttagacaaataaaaaagcaaaaaggtcagaaagaaattccagtgcatttctgtaaatttacaccaagtgtgtctgcctctcctgcttcccctttcactttctccaactctgctacctcaactgcccctgagatactaaaatcaacctcttctcttcctcctcctcagcatactcaacatgaagacaagaaagatgaagatctttatgatgattcgcttcacctgatgaacagtaatatatttttttcttccttatgatttctttttttttctttttttttttttagacagagtttcgctcttcttgcccaggctggagtgcaatggtgcgatctcagctcattgcaaccactgcccctcctgggttcaagcgattctcctgcctcagcctctggagtagcctggattacaggcacaccccaccatgcccagctaatttttgtatttttagtagagactgggtttcaccatgttggtcaggctggtctcgaactcctgacctcaggtgatccacacacttcaacctcccaaaatgctgggattacagatgtgagccactgcacctggccttccttatgattttcttaataacatgttctttttttctagcttaccttactgtaagattacagtatataatacatataacaatcaaaatatgtgtgaatcaactgtttatgttatcagtaaagtttctgatcaacataagctattggtagttaagttctgagggagtgaaaagttatatgtggattttcggctacacagggcgtcatcatccctaacccccatgttgttcaagggtcagatgtagaaacataccaaaacgaaaaactattatcagtacctgtcaaaagatctgaactgcacgggttgttccacagatagatcaccaagggctccaaggcaggctggtggcagaagggcaggatccactgtgactccatctgctggtatgttaaccaagcttcggagaatgtctttcacattgacgttttttgaaactgaaactgacggtgtagccttagtgtccaagtcatttcctctatcatttttggtttccggagacttattgacttctaaagaaagagtagatagcacctcgctgattgcatctgggcctgcactgacaccaggaggtgctgtgtgaggagttacttccacatggcttcctaaaccagtggctgtttcttccccaatgcctgagtccctccttcgagcagatgatgtgctttcagattcttccactgatgccgtagttaaagtgctgaatgctgctggtgtgatttctatatcatacccagaaacacaagaaataaacaaacaaaagtttagaactaatttttaaaaggtatattctgttttaatagctatctactgttttgaattatgaaatacatcatgttctaaaaaagcaaaaactaattacgtattctacagaatgtactgagtgggtgcacctattatcaagacagatggtataataaaataaataataaaatacttgcaaaaatgatctaaagtaatgggtagcaacacaaggttgaaagtcattggcctgtaagaaaaagtctataatcttttttgggggtgtgtgtgtgtgtgtgtgtgtgtgtgtgtgtgtgtgtgtgtcagtctgttgcccaggctgaagtgcagtggtgtgacctaggctcactgcagccttgacctcctgggctcaggcgatcctcccacctaagcctctcaagtagctgagactacaggtatgtgctaccacgtctggctaatttttctatttttttgtagagatgaggtttcaccatgttgcccaggctggtctcaaactcctgagctcaagcaatctacctgcctcggcctcccaaagtgctaggattataggcatgcaccaccatgcctggcccaagtccgcaatctttaggataaaataaaaagctctacctcaaacatggttactgcagctggaaaacttgttaccccttctacgtgcataaataattcaatgatccttaaaatccagttcaacaaggaacacctccttttctctcttttaattctcactccctttaatcagggtttcaacccattctagcaaaaatagtcttatcaaggtcaccaaaaaatctgcatcttgctaactccaatggtcagtgttcagtcctaataggacttcacataacagcaacagctgattattccctccaactagacaatgcttcctttcctcggctttcaggacaccattctctttttgttttccttgtactacttcactgactgttccttcttaacatccttcacctctttttctccctgatttcttaagttggagggacacaaggttcagtccttgttcctcttatgttctctgtctgcatttagtcccttcgtggtatcattcattctccaagttttaaataccactatatttccccaccaaaaaactcaaactattaaatataactgctaccctacaacttatcttacatgtctaaaaaaacctctcaaactcaacatgctgaaaactgaatttcttctctttttatctttccctgaaaatctctttcacctttaatctactccactgtaccttgtaatcatttttgactacctttttcattcacaaaatgcacacctaatgttttaaaattctgttttttctaccactaaaacatattcagaatctgactgcctctcaccatctctagttaccaacctaatccaacccaccataacctcttgcctggattactgattactgcaatatcctccttcctaactgttgtggaagagggttgttttaataatcctactgccccatgtctcctggtatgcatcccttgacaagcccttgaatctggactaggcttgactgacaataacccacaggatctggcaaaagcagcagtgggccagtatttggcccacgttttaaggtctggcagctcttgcattcccagaatctctgaacatctctgtaagaagtgtggcttatttctgatctaccttgctggaaagaacatgtagagagacgatatggagacagagatgctctccaaactaatgaaggaaaccaggaactcagttgagaacaagtatcaaggctgcagacacacaaccccagctcagctgttttagtcagtcagtctcagctcttggagccatcccacctgaggcactatatatactattagaaaagtcatcttagattttccagacccagcaaacatcatctgaaacagggataaaccatgcccaccgtgccctatccaaatctaactcaagaaatcatgaaggaaagattaaaatggttatggtcttaggacactaagtgcagggtaaggtattaaacagcagtacccagccaaaaacactgattatccttgccctctacgctatatcctctacacagaatacagagttacttttttttttttttttttttttggaaacggagtctcactctgtcacccaggctggagttgttgtggtgggatctctgctcactgcaacctctgcctcccaagttcaagcgattctcctgcctcagcttcctaagtagctgggattacaggcacccaccaccatgcctggctaattttttgtatttttagtagagatagggttttaccatgttggccaggatggtctccaactcctgacctcaagtgatccagctgcctcggcttcccaaagtgctgggattactggcgtgaactaccaagcccagcccagaggtactttttaaaacataaattgtaactcctgtactcaagaccctccaatgagttctcatttccctcaaagagaaatccatacccaattactcctggtcattcctgatatttttaccatctttattactttctttttttttttttttagcactttcaccaccttctaaaatactacacaatctacttatagcatgtagatattttctatctcctcccattagaatataagctccataaggaaacagattttttgttttgttttagtcatgaatatatacccaagtatccagtagatattgaatgaatatcgagtgaataataaattgcctcctttgggtggtagctacttctataattgcaacagctacttaactaactatacttttataactggaagctacttttaatactccaattattgcagttacttgttaacaagtctgtctcttagaatatgagttagtgattcttcacagcaaatgaagtcaataaaatttttcaactctttttgtataacattttctgacttacatttaattagttcatttaaagaacaaaaaatatcccaattgcaattaattacattatatttaagccacaacttttagttaataataaaaatatatgtatgctctcccttaatttgcacagaaatggatttaaattccaatatcaatattttaaccatcaaaagtaagtaacatttatttgaactttggtacaaaggaatagaaaatgcaaacttaccagagagtgatacattctcattttcactgccagtttctgtacatgactggctatgcctttcattttggggttccaaaatgtctctgtacttggagaccataagaacagagataaagtatactactgccaaggctaaaaattgagcttgtttgctatcctcctgggaaaaaaaattaaaggagttgattatgtaaccataaaataacatcattatattttacatcacaatgtttaaatacaaaacatgttcacaaatctttcaatatacacagaaaatacattacctacgtaaataataaatttattaataaacttacttgagcaaacattaggcaaagactcttagaaaaatgtctttaaatgagaagctttatacttgcaaaacatggaaagagagaagttagctcatttttttaaattattcaatctaaagacgtatgtcctaatatacattataatgttaatcaaacaaacagtaattataattatatgaaaacaggtcagatgcagtggctcacacctgtaatcccagtactttgggggccaaaccaggcggatcacttgaggtcaggaatttgagaccagcctggccaacatagtgaaaccccatctctactaaaaatacaaaaattagccaggtgtggtggcacatgcctgtaatcccagctactcaggagcctgaggtgggagaatggcttgaacccaggaggcagaggttgcagtgagctgagatcgcatcactgcactcaagcctgggcgacagagtgagtgagactctatctcaatcaagcaatcaatcaataaataaataaacaatgatatgaggataactggttatttttatctgtaatcataaaaactaaaatacataaaatatcacaataaaagtgccaaaaaataaacatgcagaagaaaaaaactgaagctattagatacagaataggatgccaaaggaattccttcttttttttgagacagggccccactccattgctcaggctggagtacaatgacacaatcatagctcactgtacccttgaactcccatgctcaagagatcttcctgcctcagcctcacaagtagctaggactacaagaatacaccaccacatccagctaatttttgttttttaatttcttgaagagacagggtcttgttatgtagctcaggctggtctcgaactcttggcctcgagcaatcctcctgccttagcctcccaaagcactgggattataggtgtgagctcccacacctgaccacaaaggaattcttgagagtatttaaaatagtacaaacaattatatatcaagatttaaaaaaaaaggatctatgagaaagaagacaaactagactgacctcttgaagggcctaggctccattctagctctacaggtcacctatatatcactgacctctttatcttgtcaaattccccatcttcaaggagaacctacacacaccactattctactaactttcccaaatatgtttgaacttgttaatttaaagaaaaaactcaaatttatctatcaaattctgaaaaccaaaggctcaagcagaaggtaaatttaaaataagaacatgaagaacactgttccctatcagataaatccaggcataccatggagataccacaggtttagttccggaccactgcaataaagtggctatcacaataaagtgagtcacacaaatattttagtttccgagtgtatataaaagttacgtttacactatactgtaatctattaattgtacaacagcattgtatctaaaaaaaacgcacataatttaaaaatattttatagcttaaaaatgctaacaattatctgaactttcagtgagtcacaatctttttgctagtggaaggttgcatctccacattcatggatgtcgactgatgggtgagggtggtaactgtagcaatctcttaaaataagacaagaaactttgccacattaactgaatctttctttcacaaaagatttttctgtagcaagcaacgctgtttcatagcattttactcacaggattggagtcattcctctgaaaccctacaaaggttttatcaaatacatttaggtaatattctaaatcctttgttatcatttcaacaatgttcacagtatcttcatcatgaatggattccattgtaggaaaccaatttctttgattatccataggaagcaactcttcattcgttggagtattatcatgacattgtaggaattcaatcacatgtttaggctctgcttctcattctgattctcttgctatttccaccacatcagcagtgacttcctccatggaaatcatgaactcctaaaagtcatccatgagaattgtaatcaatttcttccaaactcctattaacattgatatgttgatttcttcccatgaatcacatgggtacttcatggtatctacaatagtgaatcaattccagaagattttccatttactttgcccagatccatcaaaggaattactatctatagcagctacagcctgataaaatgtatgtcttaaataataagaagtatttcttaaatagtaagtcaaaatgactcttaatccatgaactgcagaatgaatatttcactaaaaagcatgaaaataacatgaatctccttgtatatctgatcagagctgttgggtgaccaggttgattatcaatgagcagtaataatttgaaaagactcttttcttctgaacagcaggtctcactagtggccttaaaacattcagtaagccatgtcgtaagcagatgcgctcttatctaggctttgtccttccttttatagagcacaggcagagtagatttataataattcttaagggtccgaggattttcagaatgataattgtgcattggctttaacttaaagtcaccagctgtattagtccctaacaagagaatcagcctgtcctttgtaacactgaagccaggcattgacttcctggtagctaggaacattgtaggatggtatcttcttccaataaaaggtgttttggcttttgttgccattgcttttggtgttttagacatgaagtccttgcccatgcctgtgtcctgaatggtactgcctaggttttcttctagggtttttatggttttaggtcttacatttaagtctttgatccatcttgaattaatgcttgtataaggtgtaaggaagggatccagtttcagctttctacatatggctagctagttttcccagcaccatttattaaatagggaatcctttccccatttcttgtttttgtcaggtttgtcgaagatcagatagttgtagatgtgtggtgttatttctgaggcctctgttctgttccgttggtctatatctctgttttcataccagtaccatgctgttttggttactgtagccttatagtatagcttgaagtcaggtagtgtgatgcctccagctttgttcttttggcttaagattacattggaaatgcaggctcttttttggttccatatgaactttaaagtagttttatccaattctgtgaagaaagtcattggtagcctgatggggatggcaatgaatctataaattaccttgggcagtatggccattttcatgatattgattcttcctatccatgagcatggaatgtttttccatttgtttgtgtcctcttttatttcgctgagcagtgatttgtagttctccttgaagaggtccttcacatctcttgtaagttggattcctaggtattttattttttttgaagcaattgtgaatgggagttcactcatgatttggctgtttgtctgttattggtgtataggaatgtttgtgatttttgcacattgattttgtatcctgagactttgctgaagttgcttatcagcttaaggagattttgggctgagatgatggggttttctaaatatacaatcatgtcatctgcaaacagggacaatttgacttcctcttttcctaattgaataccctttctttctttctcctgacggattgccctggccagaacttccaacactatgttgaataagagtggtgagagagggcatcgctttcttgtgccagttttcaaagggaatgcttccagttttgcccattcagtatgatattggctgtgagtttgtcataaatagctcttattattttgagatacgtcccatcaatacctaatttatacagagtttttagcatgaagcgctgttgaattttgtcaatggccttttctgcatctattgagacaatcacgtagtttttgtcgttggttctgtttatatgctggattacgtttattgatttccatatgttgaaccagccttgcatcccagggatgaagcccacttgatcatggtggataagctttttgatgtgctgctggattcggtttgccagtattttagtgaggatttttgcatcgatgttcatcagggatattggtctaaaattctctttttttgttgtgtctctgccaggctttggtaacaggatgatgctggcctcataaaatgagttagggaggattccctctttttctattgattggaatagtttcagaaggaatggtaccagctcctccttgcacctcgggtggaattcagctgtgaatccatctggtcctggactttttttggttgttaggctattaattattgcctcaatttcagagcctgctattggtctcttcagggattcaacttcttcctggtttagtcttgggagggtgtccaggaatttatccatttcttctagattttctaatttatttgcatagaggtgtttatagtattctctgatggtaatttgtatttctgtgggattggtggtgatatcccctttatcattttatattgagtcattcgattcttctctcttttcttctttattagtcttgctagtggcctatcaattttgttgatctttccaaaaaaccagctcctggattcattgattttttgaagggttttttgtgtctctatctccttcagttctactctgatcttagttatttcttgccttctgctagcttttgaatctgtttgctcttgcttctctaattattttaattgtgatgttagggtgtcaattttagatctttcctgctttctcttgtgggcatttagtgctataaatttccctctacacactgctttaaatgtgtcccagagattctggtatgttgtgtctttgttctcattggtttcaaagaacatctttatttctgccttcattttgttatgtacccagtagtcattcaggagcaggttgctcagtttccatgtagttgagtggttttgagtgagtttcttaatcctgagttctagtttgattgcactgtggtcggagagatggtttgttataatttctgttcttttacatttgctgaggagtgctttacttccaactatgtggtcaattttggaataagtgcgacgtggtgctgagaagaatgattattctgttgatttggggtggagagttctgtagatgtctattaggtccacttggtgcagagctgagttcaattcctgggtatccttgttaaccttctgtctcgttgatctgtctaatgttgacggtggggtgtgaaagtctcccattattattgtgtgggagtctaagtctctttctaggtctctaaggacttgctttatgaacctgggtactcctgtattgggtgcatatatatttaggatagttagctcttcttgttgaattgatccctttaccattatgtaatggccttgtctcttttgatctttgttggtttaaagtctgttttatcagagactaggattgcaacccctgcctttttttgttttccatttgcttggtagatcttcctccatctctttattttcagcctatgtgtgtctctgcatgtgagatgggtctcctgaatacagcacactgatgggtcttgactctttacccaatttgccagtctgtgtcttttaattggagcatttagcccatttacatttaaagttaatattgttatgtgtgaatttgatcctgtcattatgatgttagctggttattttgctcattagttgatgcagtttcttcctagcatcgatggtctttacaatttggcatgtttttgcagtggctggtactggttgttcctttccatgtttagtgcttccttcaggagctcttgtagggcaggcctggtggtgacaaatctctcagcatttacttgtctgtaaaggattttatttctccttcacttatgaagcttagtttggctggatatgaaattctgggttgaaaattcgtttctttaagaatgttgaatattggcccccactctcttctggcttgtagagtttctgccaagagatccgctcttagtctgatgagcttccctttgtgggtaacccgatctttctctctggctgcccttaacattttttccttcatttcaactttggtgaatttcacaattatgtgtcttggagttgctcttctcgaggagtatgtttgtgatgttctctgtatttccttaatttgaatgttggcctgccttgctaggttgggcaagtcctcctggataatatactgcagagtgttttccagcttggtaccactctccccatcactttcaggtacaccaatcagacgtagatttggtcttttcacatagtcccatatttcttggaggcttcgttcatttctctttactcttttttctctaaacttctcttctcacttcatttcattcatttgatcttcaatcactgacaccctttcttccagttgatcaaattggctactgaagcttgtgcatttgtcacgtagtacttgtgccatggttttcagctccatcaggtcctttaaggacttctctacactggttattctagtttgccattcgtctaatcttttttcaaggttttcatagcttcttttggatgggttcaaacttcctcctttagctcagagaagtctgaccatctgaagctttcttctctcaactcgtcaaagtcattctctgtacagctttgttccattgctggcaaggagtggcgttcctttggagggggagaggtgctctgattttttgaattttcaaatgggatctatttaaactgaagagcttctgtacagcaaaagaaactatcatcagagtgaacaggcaacctacagaatgggagaaaatttttgctatctactcatctgacaaagggctaatatccagaatctacaaataactcaaacaaatttacaagaaaaaaacaaccccatcaaaaagtgggcgaaggagatgaacagacaattctcaaaagaagatatttatgcagccaacagacacatgaaaaaatgctcatcatcactggccatcagagaaatgcaaatcaagaccacaatgagataccatctcacaccggtttgaatggcgatcattaaaaagtcaggaaacaacaggtgctggagaggatgtggagaaaaaggaacacttttacagtgttggtgggactgtaaactagttcaaccattgtgaagacagtgtggcgattcctcagggatctagaactacaaataccatttggcccagccatcccattactgggtatatactcaaaggattataaatcatgctgctataaagacacatgcacacgtatgttcactgcaggactattcacaatagcaaagacttggaaccaatccaaatgtccatcaatgatagactggattaagaaaatgtggcacatatacaccatggaatactatgcagccataaaaaaggatgagtttatatcctttgtagggacatggatgaagctggaaaccatcattctcagcaaactattgcaaggacaaaaaaccaaacactgcatcttctcactcataggtgggaattgaacaatgagaacacttggacacaggaaggggaacatcacacaccagggcctgtcatggggcggggttaggggagagggatagcattagaagatatacctaatgtaaatgacaagttaatgggtgcagcacaccaacatggcacatggatacatatgtaacaaacctgcacgttgtgcacatgtaccctagaacttaaagtattaaaaaaaaaaaaaggtgttttgtccacattgaaaatctgttgcctagtgtagacaccttcatcaatttcttagctagctcttctgcacctattgcttcaccttgtacttttctgttatggagacagcttcttttcttaaattttatgaaccaacctctggtagcttcacttttcttctgcagcttcctcacttctctcggcctttacagaattgaagagcgttggagccttatctgaaataggctttggcctaagtgtgcctggttggatcttttatacagaccactaaaactttcttcaaatcaacagtataaagccgttttacttcttatcagtcatttgctcactggagtaatcgtttacttttaatttcctttaagaactttgcatttgccttcacaacttggctaaatgtttggcacaagaagcccagcttttggcctgtatcagcttttgatatatcatcttcactaagcttaatcatttctagctttttatttaaagtgagagacatgcaacttttcctttctcttgaacccttagaggccactgtagggctgtaattggtctcatttcaatattgttgtgtttcaggaaatagagagacagggtaaaggcccctcccaaggagatggggagagacaggaatggccagtttgtagcacagtcagacatttattaagttcactgtcttaaatgggtgtggtttgtggtgccccaagacaattacaatagtaataccaaagatcactgatgacagatcagcatgacagataaataataataatgaaaaggtttgaaatattgtaagaattaccaatatatgacataaagacataaagtacatgctgttggataaatggcatggatagactagttcaacacagagttgccaaaaaccatcaatttgtaaaaaatccagtaatcggcaacatgcaatagcaaagcacagtaaaatgaggcatgcctgtaaatagaaactaatggtaaaaatgagactaattgttaatacttaatgtcaaaaattttggatataatcagtttcagaaaaatagaagataggctcaatttgaacatatccacttgatgcaattctttgacatatttgtgatccgtgatctgacaaaatctatgatattttgcaggttcatatgtaatgacttcttagtctgttggaaaaaacaaaggtacatttgtcttttttataaaccaccccttttctctagacatacccatgttcttctgccacacaattctgccatgttataataactgctgctaatgatattaatattcaaaatgcaagcaaataatttacttgttcttaacttcttagtctgttataaattagttatgccaatctaaatccttatttagcccattaatatgttcaatgtttactaactaccacatgaagtttacagtatatgcctgatttttggcctcaaataaaaaatatcccataaatcgtttacatttaaatcctaactcaagaaatagatttgctttccattgtagctgtcatttattgaatacttaccgtaggccaggcactgtgctatgtatttcatacatatttttattagcaaacttgaacaagataaggcttagagaagcaacttacttaaggacatatagtatgtaaaaaagcaaatctgaactcagattatggtgattaaaaaccttagctctttacctcaaggtagaaatttatttatgtcgtcgatcttaggtcatttccctttttttttctttttattttttaaatttttttattttattttttgagacagagtcttgctctgtcgcccaggctggactgcagtggtgtgacctgggctcactgcaagctccgcctcccgagttcacgccattctcccgcctcagcctcccgagtagctgggactacaggcacccacaaccatgcccagctaattctgcttttgtatttttagtagagatggggattcaccatgttagccaggatggtctccatctcctggccttgtgatccacctgcctcagcctcccaaagtgctgggattacaggtgtgagccaccgcacccacccagtgatttcctttttcatcataggttccttttgttccctaaagagactaaactctagcatgtaaaatatagtgttttcttttttctaaaactcctataaggtgattatataacttttataattacaaaacacttaaaattatttatgactttcagtaatcatatagtaaaggagatattctaattgtttgcagaatattgtaatataataactggttagaaggttcttcaagagccagatcatccagaggcactgtgaagagtttggattccatttaaccactaaaagatgatattagagaattctgaaagaaaaagagtaacatcatctattctagtttatttgtttgtttatgagacagggtcttgctgtgtcacacaggctgtagtgacacaatcatagctcacggtaaccttgacctcctaggctcaagcgatcctccccacctcagcctcccaagtagctaggactagaggcgtgtgctaccacatgtggctaattctattctagatttttaaggatcattctaggaaatataaagttatggacaatagactcagaacctgcccaatggaaaaaaagtgaacagaggagaaaacagcaacatttggtcctcaaactgaccacattcaaaggattccagggagaaaaaaagttgatggcttcttaattaaaggaataataacagctactagagaactatgatctaagaaggtagtatagccttttagttaagatcaaaatttcaagaatcagattccctaagtcctaaactcactttcacctcttactaattgtataatcttaagcacattacttaaatattgctaactccctcatagaattattgtgagaattaaacacacatatacagcattggtccccaacctttttggcacaagggactagtttcatagaagacaatttttcaatggacctgtagggggtaagaggcggggtgggggtagggggcatggtttcaggatgattcaagtgcattacatttataattagattttcataaggagcgcacaaccaagatccatcgcatgcacagttcacaatagggttcgtgctcctatgagagtctaatgctcctgcccatctgaccaggaggcggagcttggcttcactcctcaccctttgctcacctcacctcctgctgtgcagcctaagtgcaggtcagtggtctgggggttggggacccctgataagagcatccagtatcatgtttaatacacagtaagtattcaatactattaagtagtgataatactccaaattctacatatgcataaaaacctagtcaagaactaaagagaataaaactattgaaaaaaagggaggggaaaaagaaaaattgaggttagaaagtttgtaagaaatatatatgtaaaacatacagtaagtgttcaacaaatatttactaatgataatattccaaatgctgatgagtgcaattataaattatttttactttcatctttatactttctatatgactttaaattgtctacataagaattagcaatgttttctatcaaaatcagctgaaacaaaactgtttttcaactttaaaaaattagaaacaccaaactgagagcaacatttcatcatgcacctttttatcacattagtgtacctttgaggaaaaaatatccaatattcagtaaaataatatgccattcagaagttgaacattttattacattcagagcatcaattttagaattaagactgctgggtttgaatcctgattttatcattgtttatcaacactagcttggagatgttactcaagctttatgtgccttagattattcatctataaaatggaaattacaatagtacagctcaataagttgttggacttaattaatacatgtatatcacttagactgcttactatgtaataatgcattattccttttaatatcactatgctgatctgctagctcgctttatataaactatcttttctaatattctgtttctaaaatcattgtcaaaagaagtcgtttctagacctttctatctctgctccactatttgatatcacaaagaatttttaatctcaatacattaggcctaagaggaaatatgcatcagttaagagagtatgtgaaagacatattgtaacttactatgtctctgaaaacaactgccctaagccgattaatatccatgtcctgtagaagcctgtcaagatctcttactggagatataccgccagtcacaatgtccactgggctctatttaagattaaaaaaaaattgtatatatatatattcatatatacattacacagatattctttaaaaataaacacagtattcccagaaccagaaaagcaaagctatagcattcctttccccactttttttgtgtgtatgcttccttcttctttgaggggttggggagagaggtggagaaagatggcatgcaggaaaaaatgacatatttgaaggaaaaggcatcacagaaacaatcaaagtaaacactgggaaaagcagagaggtttaaatataaacaaatctttattgtgtatttaaacacaaatatttgaatgttatatgcaggcctaaagtaactattttaatctctgccagatttatttaactttatgttgaaatgaacaaataaaaatcttaattgtaaaataggagtatgctttttgaaaattaattaatctgtatacttaccttcgctgcagatttccctaaaggaataaggctatgcattggtttcaaggctttatctcccctagttttcagttgtgaatgctgttgacactccaagcaattccttactgcgactgcacaaactgtaatttattttaaggaaaagatagggaaagaaaagttaatatttaagattatggaagtgaaaaacatcaactacacaatatgatttacataagattttattcaaaacagacgacattcagcttattcctaaaatgtccctagactttatcgcctagtgttggttgtctgatattgttagcttccatgctgtggcccagttaagatttagggaggcagtatggcctagtggtctaaacgtttagggtttgctgaaaggaaatcagttcaggaatcttaacaataggctactatttcttagatctcaactaagctagctgggacaatctttagttaagaaaaggatagggaagaaaagaattgaaagaaatggaagaaaacagggaacaaagtacattaccatgaactagtcgaggtaacaatcttctattaccatcattaaagtaaattagttaaactggaaactttgatgttcttcttatattgcatcattacagcatgatattaattgagactaatagaggatatagcttttgaaagaagctttatagggtccagcatttactagctttcattaaaactgcttagaaaatgggagacaggaaagggaatttgattaatatacagtctaaaattacctaaggctcccacgaatcaggcagttagattacttagaaattaattttggattttaaatgatgaattacattatgtacccttcactatgaattgcttgataccatgtaatcatctaaattccctccaaatctgtagcactcaaggtacttgaactgagcaaaggagggagagcaaattaggaacaaaatagcaaacttaaggggggacttcacaaagaatcactggcctatcacatggctagcaggcatgagaatttagaaagaaagtgttctgaaaggtgcccaaagagagcaataaaagttgaaagaaaggaaggagggaacaagaggagggaagagagaatatggaatacagctttgtcaaatttgctatcagacccaagaaatattttactttatcaaatttgctatcagacccaggaaatacttttcatacaaactttttcacaagttgcataaaatcaaatttgagtctgtattacaaagttaaaaatcacacctcatttcctggtttcaatcagttactcttactgctgtcatcctaacttctaactccaacctcaggaaacaagaatgaggacaccagtgtccatcaacagataactagataaagaaactgtggtacatatacgcaatgaaataatattcagccgtaaaaaagaaagaaatcatgtcttttgcagcaatatagatggaactggagatcattatcttaagtgaaacaagtcagacacagagagacaaatattgtatgttctcacttataagtgggagctaaatagtgtgtacacatggaagtagagtgcgtaatgattgaaaatggagactcaggccagcggtgggggctcacatctgtaatcccagcactttgggaggccgaggcggggggatcacaaggtcaggagatcgagaccatgctggtcaacatggtgaaaccccgtctctactaaaaatgcaaagaattagccgggtgtggtggggcacacctgtagtcccagctactcaggaggctgagatagggcaattgcttgaacccggaagaaagaggttgcagtgagcccagatcttgccactgcactccagcctggcgacagagtaaggctccatctccaaaaaaaaaaaaagaaagaaaatggagactcagaactcagaaggatgagggggtgaggggggtctgatgatgagaaattatttaatggtacaatgtgtgttattcatgtgatgaataccctaaaagctctaacttcaccactaagcaatccatgtatgtaacaaaattgcacttgtaccccataaatttacacaaatacaatttaaaaaaaagatatcacacatttggactgttactttgtttaccatactctattaaatgatcttggacaagtcattttttaagtcccatttccatatataagaacagatggtactggggtggattaaattatctcttaattcttttccgtggctatgaaaaactaggaacatagagtatttccctagcctctgaatctgatgattcttgagtaaggctttgctagtatagccttgcacttttacttctagaaatgtactctttctaggaaagtgaaaagccttcgaaaatggcacacataaagcaataaagtctaaatattttaattataatactaatagattaaagaagtatactacaatagaaagagtaggagcactagttagacaaaagtatagtattcaaattctaccttcaccaattatagctttttagctatagataagtttcccaatttcttttatcttcaatttcctcatgaataaaaagaacaaaattgtcaccgtgaaaatcaacaatgacaaatgacaatagtcaataaatgataacttttattttgttatgcttacaattagaatgtctcttaaattttaaaacaactgtctataaattgttattccaagttacttagaatagcaagatataccattgattattaaatataaaatacttggaattttacatttaaactaatactattaaatactttgaatagcattttgagtaaaaattatacttgtggcaaaaagcacaggtatacattagtttatgtaacagacattcttgctaaatatgaaaaaatatgtcattaactacattttccacttccatgttatgttttcataggtgctttatctcttcatatgaccatggctcctaatggtttgcttccatttcttgtgccttctctcctcaccaccttctcttcacttaataatcaaatcatttaacaaagtctcgatatttacaactatatagaaggaaaattatgcaaaaaagggtttttttgttttgttttttgcttcacctaagaagtccagttaacattaaaaagtcatttcatgtatttttacttttacttagggaagaagtgtttccaggagaagaacagagatttcatgattttattaactgcattaacaaattaccacagcttttttgaataaaggctgtacttgaatgatgctagtttagaacgttgttattccagtgtgtttgtaagaaaagcagcatcaacatcacctgggacttggtagtcaattttaggccttaccctagacctctataaccctttttttttttgagacagagtcccgctcaattgcccaggctgcagtgcagtggtgtgatcttggctcactgcaatctccaacttccaggttcaagcgattctgctgcctcagcctcccaagtagctgggattataagcgtgcaccaccacacctggttaatttttgtatttttagtaaagacggggtttcaccatgttggccaggctggtcttgaactcctgacctcaggggatccacccactttggcctcccaaagagctgggattacaggtgtgagccaccaccccagcctagacctatataatctaatctgcattttaacaagatcatcaaatttatgaatcaccttgtgttttttaatcaccttaagtttatgtatctccttaaaatttcagaagcactactttagagcaaaaagagataggggagcacctctaattccagctactaggaaggataaggaggcgggatcacttgagcccaggattttgacaccagccttggcaagaaagcagaaccaccatttcagggagaaaaaagaaaaaaaaaaaaaaaaaagataggggagagtggaaactcctgaccaaaatcaccttagtaaatttttcaaaatacatcctccttcttgcccatccaacttaccaactactactatgtacattaaaaaaagtaaccatatgacaaattagctaacatatattttctcaccaacagaagacggataattttcaatgtcatctctgaattactgaaaaattttttttagtaaattcccaacggtttttagcagctcacctagtcggagacactgccgcaaaattcctccagatgacatacttttttcagcttcaatttcagtaaagccaagagaacttgcaaatataagcacatccacaaggctaattagcctctgcaaaaatgtcacagaggcttctattgaaaggccttgagtaggttcaatattttccagttcatgctgtaaagaataaagtttgacatttatatatatatattctgaaaaaaaaattttaccagatatagtcctaaaatttataaattgcataagtagtcagactttcagaaacctagtaacacagagtgatttatacttattatttcatctaaaaagggtgggggatgaggaggagcaacagaaccatacaggtgaaacatcatgaaccacattcttcactagctgactcatacttagggaatcaacattcttttaagttctttcattactagaacagattctaaggtcctctcaagtaaaagatcctattgttttttatttatagcacctacgatgcatagtaaccaccacatttaagttttagtcaataaagttgcataacactcatgttttcacaccaattttctatagtaattaagtccttactgtagccgatgtagcagctgaaagcaatggcagtatacccccacaagccatgaccatattgtccatcacttgagagatgagatgaattgtgttgtgtacaaagatgacattatcactgctattcacgaagtccataactgtctttgttgaatggctgtccaaagataaatgatatttactgataaagctaaagaaaggaaatcacagtttgcctacttgaggggaggaaagataagaaggtgcttttgcttcatcttgaaaactgaaggaagatgatgcagcaggcatttggagggtgtatacttcttcagaagaaacagaccattccatatcagtagttactatccatgccctccttcagtgctgaaacataaatactattcattttacactggatataaaaagttgaagaaaattatccttactgggaacaaaactaagaaatcatgtgacaaaaattaggaggtaaatactggtaaatgtgctattaaaaatgaattttcttctgtaatgcctataaaatgcttttaaacataacaagaatcttacacaaataaaaaaaaataaattaggtcactttaaaatcataaatcatacaatgggggataacttgaagtacacagattttttttaatgctaaaaatacattggaaatattgataatgttataacaattttttttttttttttgagacagagtctcgctctgtcgcccaggccggagtgcagtggcgtggtctcagctcactgcaagcgccacctcccgggttcacaccattctcctacctcagcctcctgagtagctgggactacagacgcccgccaccactcccagctaatttttttgtatttttagtagagacagggtttcaccgtgttagccaggatggtctcgacctcctgaccttatgatccgcctgcatcggcctcccaaagtgctgggattacaggcttgagcaactgcgcccggcctataccaattattttttaatacttctagtaataaaccaacttgataaacctaccttctggtgaattccgtgccataaaattgctacaggaaatctactacaaatttttttaaaagagaaacctctgcttttcacatttttgtaatccagataaggattccattcttataatggagaataaaagtgaattcagtaaaaccctaccatagaataatttctattctactttttaaccaaatgtctgaaattaattacaaactgtttctatggatttctttgaaaataaagactaggtttatacacatcttccataataaacatatagacaaaccttctccacatctgtatatctgtttctattgaaaataatagatcagtgagcaaacgttgatgcatctgagaccagttgaactcaggaatacgaaacacagtagatctggaatccctcctttgtccattaactgcatctggtgctattccttgccctggctgctcatgttgccttgatatctaatacagaaatttaaaaagtaataaaataggttcaacttcagcaggaggctttagcaaagtaaataatttagtagcttctatgcaattcatctaacacgtttttaagacactataagaaccaaattagagaaagaaaaattatcaatgagtaataacattaacattttagtacatgtaagcaaagctatcaaaagtgcaaaactaccacaatttaaaagtaattaacttggaaccatgttaagtattaccactatgtagcattttataaaagaatcaagtaacagttcttagtttttagccttagcctaaaagaaaggcagtatttagaatctaagtggcatttggattatgaagtggctagaatgaagaataaaaacagagataacataatgaagaaccaaccaacaaaaacaaaaaaaaggagggtgggacagaggataagaattgaataaagtggaaaatgacaacatgctaccaagcactgtctcatgggtcactctgagatatggacagaggagaaggctgtgcctctagatctcacaaagcctcctctctcttatagacttcataatacaattttaaatcacatgcttagtaactaaaattatacactggcaggtaggtagccctagagtttgttggaaaactaatgtactaggattgggttagtcaaataaaaggtaaaatgcaagtgtttccaatatttgttttataaactaaaattataccaatccttcaaagtggtaacttctggtgatactatggtaaaaatagtaataaaaactgtcatttaatgaactcacattaactgccaaacactgtgctaatgatctgaaatacaatcttcacattcattgcatttatttagttgtgaatagcatgtgaaccaaattcaaaataaaataaaatttaagtatatacacttgctcttttttaactcagtgcaaaagtacttgaataagacaatatataaaatcacctcaagcacatgtcgatgaggttgaggtgcttccacgttgggactggccttcaactccagcctctcagtatctgtagcaacattggaaacatccaacttcgcaatcttttgctcagaagaagcctcagagacactaccatgacaatcattaattaatttggtttctctagtgaggttagttgctttcttcccttcctccagcatctgaccaaggtctgattctacagctatttgggaaacagtagtttctggtgacatagctgaagaccctgatgctgtcatagtctgaattccagaatctttagaatcttgagtttcagtatcagtttgcttttcagtaacaggttttccttcttgaaatattaatttgtcatcattaccaaacatgtccagtttttcaccggcttcagatgcagctggagacaaactgttatcttggagctctgtgggtagattagcttcctcagtaggactgccttctactttcagttccacataatcatcatcttcctcttcctctactatagatttatccaagaattctggcatctctgaggcatcctcttctgaaggagaacttatagaagcagttacttcactgacagtcattgaatctttgccagttgttataaaagaattagaggaaatagccacagcttctattatgtcagaagatacttctaaatcatctgcattccttgtctcatttgtcagtgtttcttccaaagtgccttcatctggtaactcctgattttcttgctcagctttcatttcttcataagatgtattagtagtttgcagttcaatattagatgcagattctagtgaacttgtcttctctatacttgaattttcattaccatttgtggtgaaatgaggacagacaggagaatccttcgtatctggttgctgggatcctactgaaacattaatatcccttctaatgccagaggctgcttgaactgaagttgaagaacacagccctatttcttcatcaacttttccttgctgttccctaaatatattggcaaggttttctttgtgtatttcaaaagtgacctaggtgaaaaatgtacaatcagttaaaatatgcatgagaaatgaagacagaatacaaaatataaaactaaataattttcaaatacatagtttatataatacaataaaacttaattttcctatattttattttagtagaatgataaatgtaagtcaatcacagaaatctaaatattcattaaaaactacagccaattttaatgttaacaagtaacacagcatgaaaccacaagaagaacataattatttagcctattattaaacatgtataggaaaaggatacactattctactggccaccataacttgtaccagaatttaagtatgtaccattgggaagtgctttatgcactggataacacttgtttcaaccgctatgaataccaatttccccaggacttgtccgcaggagagattaaaaatatcaattaattatgctcaccattacagtagctctacagatatctattaagctacaaaaccattatctcactaagccaatgaatacaaattcttttagcaatgggagaaaaaagatccagcccttcccccaaaggttaaccataatttccaaagtttgaactggtcgaaaatagtctgaatgtttcagttgatccatccatacatccattcattccatttatatctgagtgactacaatatattaggcaccgtgaacattcctatatcatgctttgccttttacccaaatgggaaaaaactgaaaaagtaaatttttttttaaagagagtgctgtacttgttaatgtcacaagatttagaatttttaaaatctaaggattatcttatagccaccatcatatgatttccattggtgtttcaatggtaacccccatcaccccttgcaacaaaaatgccagaaaaacctataacacatgcagaaagtattagcctaattatagtttattaatcccaaaagtgtttgtttctgtaatctacattattatatagagtaaactgaacattcattcaataaatctttattgagccatagtataagaggatgataggacaatcaaggaagaaaagctgatttttttatccacaaaaatcaataggccttattgaatcacaagagtatacacacagatgaaaagcaaacaaaagtaaaaatgactctcaatgcaaaaatttccttctatcgacattaactcgcctttactcatgacatatacagaacattcatgccatgtgatatacctaaaaataaaaatgttcagggaatgaatattttcctgtgaatatttgtatttttcctaattgtaactatttccacattgtaactatgttcttaattctaaaacttagaaatctttttataatatttcaacaataaatgcatgtattcctcactaaacagtaaaatgacataatcacattaacaaaatatcaatttcttttacattcacaatgccaatattttatttgacatgggttctgtattttaattgaccaattcctcatattcattcaacaaaaatttactgaacatcggtagcaggccaggcattgtgtgatgaacacattgttcctgacttcatggagcttatattctaaagaaggtgtcagaaaataaacacacgaatatgtaagataatgtcaaatagtaataagagctttgaagggagggggaagtacagagtgaagaactgttctgaaagtctaggcgagaaggtgtatttactagtgtaactgcagtaggcctctctgttctatttgaacaaaggcaagaataaaagagagagcaagccatgtaaaaagaaaagagtttcaggcagagaagaacaaatgcaaaggccttggagctgaaataagcttggtatgtatgatgaataacaataaagcaataaactgagaactaaagaaaatgaggtcaaagatgtggccacgagctagattatgattgtagaacattatagactgtattaaagactgtattttattctgagagagccatttgagaattaagagtgtagggaagacaatctgatttccctttttaaaagatcagtggctgggcacggtggctcacgcctgtaatcccagcactttaggagtccaaggtgggcagatcacctgaggtcaggagtttgagatcagcctggccaacatggtgaaacattgtctctactaaaaacacaaacattagctgggcatggtggcacacacctgtaatcccagctactcaggaagctgaggcaggaaaattgcttgaacccaacccaggaggcagaggttgcagtgagccaaaatagcaccactgcactccaccctgggtgacagagtgagactctgtctccaaaaaaataagactggttagcctactttttggaaaactgactttagagagagcatttctccaccaacaaacaattatcattgtcaaaagaaagcaagttacatattaccaacctcacagtcattttgaaaataggccatttatttctacaatagcctgtgttatagaatgactttagttttcaataatcatttgctttgattttatttatattaaaggtttttagaatttgtattatacaatggatcaataaacatgagtatatgtaatttatatgtacaggttaagaaacaattttttttaatctcacatgcctaccacccatgtcaagaagtaaaacgttaccagtacctcacaattcccctatgtgccctgcccaaactgtactccctatttctccactacaatcagaaaaaaatcactatcctggtatttctatcgttcactgtttataaatagttttacctggaggtcagagctttgggagataattttaaaagatagttttactatctatatactaaacatacccattatgtttagtttaaaaaactaagtctaacacaaacctagccaattgtattttaaagagcaatactgccacacctgagctcccaagaaaagacaagatacacagaatctgtgagttgcagcagggcttcagcttatttgagagaatatgtaaagccatttctgggaagtcttataggcaagtcattaggaaatacaggaaatatagaggtcaagagaactggagaacctatcagaggcagtgtgtgccaggtagagtgtattggcatgaaatactttatatttttcaattctaagctcaccatggtgaacctctaccctaagaagtaggtcgaagcacagcatgtctttgtggagtgaagtgagaatcttcaggtgattcacattagacaggaaaacaggaatttaatcagcacatgatgaaggcaagcaagctaagtactcctaataagaatacaggtccacctctcctgagtgaaactgctccagtccagatggactgtcatctgcctactacatagctgctattgggatctccctttctacagtcctggagatccccttcatctctcttctatgttgtctcttgtttcttatatttcatttcttcctctttgtattattctctccttttgtgcaatatcctgcagtgccttcttaagaaaggatgtatataaatgttttgagatctcaaatcctgaaaaggtatttattctcgcttcatacttgattaatagtcagagtataaaaccacagatagaaaagcatttaccttcagaatctgaaatgcttttaaaattctaaagtcatttggtttttaaatttgcccttaatttaattcatccaatggtctaaaagctaaattgcaattgaacaactatcagtattatctttttggatgctgttttccttaagatatttgtgactttaaaactgataatttccaattaattgccagatattgttctaaattacccagctaaaagactagtcattaatcttcacaatcatttgatagctaatctatagctgtttgtaatgtttggaaagcacttctataaactactagttaaagatacttgtgagctaatgactataacatttcttttgccattattttcaacttaattggcactcaaatttactaattagtagataaaagataaacacaatacatccagatgttaatattatctttttaatctatacattaaaaccgtataacctgtaaaatttagacattttaaactgttaggcaatgtttagcaactgactttgtttttaagcaaaggcatctttttcagtgtctgttttcatatgaaaataccagctaaatatgatgttaacttctgattaagttaccaacctttgataaataagatatatctttaaaaacaggtggatcttcccatatgtattatcaatgagcataagtcaaaatgattgccaccacattaatgagatcttttataaagactctgatgtataacaatggtataggtaacagatataatggtaaaatcaagcattactgacataattaagagcaattctaaaggttggtagtacaatccccatttataaagataggaagaacactgacaaaagaatattgcagcaaataacttctaatcttttcatttttaaaacagtcattttgatcaattttaatttcttaaaaacagtctaaacagatgctttcatgcaaatctagcgtataaactggtacaaatttttagagggcaatttagcaatatctactaaaaactttttaaaacatgtacagactccttcctctggaaattccacttacaggaatttatcctacaaaataagggttacagtattgaaccaggctcatcattggtcaatgataaggaacagataaagtatgattataatataaatcaatagattttttaaatctctcttccatcaatttttctaaatacaattttggagaatgccagaatataaaaagaaaacttgaatcatttacacggtcactccttcctagaattttaagtggtctgataacattcaaatgttatatcaaagctgaatcttatgctctttacttctccataatgtcatataatatgcaggcattaaaattcatgtaagaagcatatcattaaataatactctaaaatagtaaaaatacgatcacattttgttagcaaataattatatgttatgtatagattcatgtatagaagagaagactaaaaggtctcgcactaaaatgttaataagttatacataggtgtttggataatggataatttttgttttctgtgtgtatgcatttctgctgggttcaagatttcctgtaatgaaaacttattattattttaaattttttaaagtaataaatgctatttggtttcaaaatgttaaagctaagaatacttttagccaggaacaaaggtacatgcctgcagtcccagctactggagaggctgaagggagaggatcacttgagccaaggagtatgaagctgtagtgtgttatatataatggcacctgtaaagaaccaccgcactctagcctgggaagcacagcaacagtctgtctctctctctttttcttttttttttttaagtgccatttaaatttgataaaaacacacacacaaacactcacacagaaatcaggtatttttaaagaattatttagcaattaaataaggtgcaaagtgctgataatccatgaaatgcggacattttgtaacttttttatttttgtaatttttgtgagatatctcctttcatcacccagactgaagtgcagtggcacaatctcagctcactgcagcttcagcatcccgtattcaagtgattttcatgccttagtccccagtagctgggaccacaggcatgcaccaccactcctggctaatttttgtatttttagtagagacagggtttcaccacgttgaccaggctggtctcaaactctggcctcaagtgatccacctgcctcagcctcccaaagtgctgggaggcatgagccaccatgtccagccaattttgtaacttttgaaatttcttcaaacaagtcgcttttaatcttatcatacagccaccataaacacatatacatttttgtatatgccagttcatatcttatgatttaaaaaataattttaataaaccaattagagaattctttaaaaaaaaatcttatttccacatgcttttacccaatctaaatggtagttttttcttatgtacagtgactgaaatgtatacttcagatatttcatttcttatgtacagtgactgaaatttatacttcagatatttcatcagtaaacagcaagtaaaatcttcagatatttcaaaaaatccaagataattaaggactttatcctcaaattcactatttaggaggaaatccaattcatattatacttttaactctaacatgactaatctttattcattttaagtcataaacccattctaacttatggcaatatgagtctagacaaaatacagtatctaaggtgttagttttatgtgtttagaaaagaatgtgtttacaaaattctcataattcagaatagtttaaatgccttaatttaaattttaattaatgagtaaaagcattttatcataccaagtgaaaaaaagtattacttaagcacagaaaaatgttcaatttgaagccaaaaacaaacaaaaaaaaatgaaaacctagacaacaaataagacaatgaaatcacaaacgttactaggtgcactctttaaaaccctgagatcaaagtaaccaacatagtgcagttatactagaagagcctattactgcttataaaacccagttcagctgctggaggagaggcatatagtgacaaacagcttccctgctacaaaggtggcaggaaatctatcaaactggacaataaaactgcaattgagtttctttggctttttatagcagcagcatgtatcctgatgtaactctgcaaaagctatccaattctgcaacattagttctttacacatcagttctttatcaagaaccatgttataaatttgggatattgagattcaaaatgactgcaaaaaggaaaaagcatcactttaacactgtatgtataaaagtattataaaatcttcagaacttatatttttagagaaaagaaaattttgttccaataattccagtggaatttttaatagctgctaaaaattgttcacctacttactgaatcactacagctctattctaagctttattaaataatgacttgaagagccttagggtataagtttctgtcttattttaaaaatagctataaagatttaaaattccaaaaaacttaacagcattcaaataaattactttgtataagcctcatgaaacagaaaagccttttaaaaatgaagaaaatccacacgaaggaataaaagacatgtatgaaacactaaaataaaaggtgaacaaatgtaagaaccaacttacaactttaaacttttgttttccctctcataagtaatgttttagcatgtatttttaaaagtatactttgacagcaaaaagtggtaggtctagttttactcagataaaaagactccatgattaacttagcattatcccatcttataaatgaatactaaaacttaagtcagtgtggttcttggtcaaaagtaggcactagagacctctccttaaagcaactattttcttcagaaaaattttaagatctgtttaaagccataagtcactggactaaagaaacatataggccgggcgcggtggttcacacctgtaatcccagcattttgggaggctgaggcgcgtggatcacgaggtcaggagatcgagaccatcctggctaacatggtgaaacctcttctctactaaaaatacaaaaaattagccaggcatggtggcaggcgcctgtagtcccagctactcagggaggctgaggcagaagaatggcgtgaacccaggaggcagagcttgcagtgagccaagatcgtgccacagggcgacagagcgagactccgtctcaaaaaaaaaaaagaaatatataaactaaacaaaactatagtcatgcatcacttaatcatgaagatatgttctgagaaatgcatcattaagcaatttcatcatgtgaacaccatagagtgtacttaagcaaacctagattgtatcacctactatatacctagactctatggtatagcttattactcctaggctacaaacctgtatagcttattactgtacagaagactgcagacaactgtaacacaatatatgtatttgtgttatctattttttttaatgttttaatttttgttttaacaaaagactgagtctcgctctgtgacccaggctggagtccagtggcacaatcatagttcactgttacgttacttcaaactcctgggctcaagtgatcctcccacctcagcctcctgagtagctagaaatacaggtgcatgccaccatcccagctaatggtgtgtgtgtgtgtgtgtgtgtgtgtgtgtgtgtgtgtgtagattgagactcactatgttgcccaggctggtctcaaattcctggcctcaagccatctttcagacttggcctcccaaagtgctgggattagaggtgtgagccaccattcccagcccttatattgtgtgtacgtaaggtttagaaatgtgtatctaaacaaatataaacatagaaaaggtatagtaaaaatccaatataaaagatttaaaatggtacctacataaggcatttaccatgaatggagcttataaaactagaagttgccctgggtcaatcagtgagtaagtggtgagtaaatgtgcaggtctagtacactacagaagactttataaacactgtaaatataggctacactaaatttatttttaaaaactacttttctttgttcaataagaaattaacctcagcttactgtaacattttaactttttaaacattttaatttttaaaactttttgactcttttgaaatcaaatttagcttaaaacacaaacacattgtacagttgtaaaaagatattttctgacaggcacagtggctcacaactgtaatcccagctacttgggaggctgaggcatgagaattgcttgaacctgggaggtggaggttgcagtgggccaagattacaccactgcactccagcctgggcaacagagcaagactctgactccaaaaaaaaaaaaaagttagaatggtgatcattaaaaaataaggaaacaacaggtactggagaggatgtggagaaataggaacacttttacactgttggtgggactgtaaactagttcaaccattgtggaagacagtgtggcaattcctcaaggttctagaactagaaataccatttgacccagccatcccattactgggtatatacccaaaggattataaatcatgctgttataaagcacatgcacacgtatgtttattgcagcactattcacaatagcaaacacttgcagccaacccaaatgtccaacaatgatagactggattaagaaaatgtggcacatgcacaccatggaatactatgcagccataaaaaaggatgagttcatgtcctttgtagggacatggatgaaactggaaaccatcattctcagcaaactatcacaaggacagaaaaccaaacactgcatgttctcactcataggtgggaattgaacaatgagaacacttggacacaggaaagggaacatcacacactggggcctgtcatggggtgggggagagggaagggtagcattaggagatatacctaatgtaaatgacaagttaatgggtgcagcacaccaacatggcacaggtatacatatgtaacaaacctgcacgttgtgtacatgtaccctagaacttaaagtataatttaaaaaaaaaaaaaaaagtccaggtgcagtcacgcacgcctgtaatcctaacactttaggaggtggaggtgggtggatcccctgagctccggaattcaagactagcctgggcaacgtggtgaaaccctgtctctactaaaaatacaaaaaaattagctgagtgtggaggtgcacacctgttgtcccagctactcgccaggctgaggcaggagaatcgcttgaacccaggaggtggaggtttcagtgagccaagattgcaccactgcattccagccagggtgacagagcaagactctgtctcatttaaaaaagacacacacacacacacacacacattctaaccgggtgtgtggctcatgcttataatcccagcactttcagaggcccaggcggggggccacttgagtccaggagttgaagaccagcctgagcaacacagtaagacctcgtctctacaaaaaaactaaaaaagtagccaggtgtggtagcacaagtctgtagtcccagctactcaggaggttgaggtgagaggatcacttgagcccaggagtttgaagttgcagtgagctatgagcacaccactacacttcacctgtctcaaaaaatattttttttcctttctctatatccttattctaaaagcttttttctctttttaaaattatatatttttcaaacttttttgttagaaactaagacacaagccagtcccggtggctcacccctgtaatcccagcactttgggaggctgagtcaggcagatcacctgaggtcaggagttcgagaccagcctggccaatatggcgaaacaccgtctctactaaaaatacaaaaattagccagttgcagtggcaggcaactgtaatcccagatactcgggaggctgaggcataacaatcatttgagcctgggaggcggagtttacagtgagccaagattgcgccactgcactctagcctgggtgacagggagactctttttcctgagcttacacagctaataattactataaatcaggattcacaccctgtctccaaagtccacattctttcattacttacacaaacggatttgaaaactggatataaatacttagtcataaatgctcacaagctcaaaacacctgagatatcacctaatccaactcctttattttgtatatagggaactcaaaaagactaatctattcatcctaaatatcctattattttctaagatagcagttctcaaactttttggtctcatgacactttatttatttatttatttattttattttttgagacagagtctcgctctgttgcaggctggagtgcagtggtacgatctcggctcactgcaactccacctcctgggttcaagcgattcttctgtctcaccctcacaagtagctgggactacaggcactcaccaccacgcccagctaatttttgtatttttagtagagacagggtttcaccatgttggccaggatgatctcaatctcttggcctcatgatccacccacctcaacctcccaaagtgctgggattacaggcgtgagccaccgtgcccgggcaacactttacattcttaaaaagtattaaggtccccaaagactctttatctatgtggattatatctactactgcttattatattaggaattaaaactgagaccttttagaactattaacccacttaaaaataataaactcaatatataatataaataacattttttgaaaatgattatttttcaaaaccaaacaataacaagaagagtgccattatttcatatttttgtcaatctctttaaagtttggcttcatagaagacaactgcattctcatatttgcttttgcattcaatctgttgcatatattggtttggctgaagtatataaagaaaatccaccctcatacagctatgcagtaggaaaggaggactgcacagaccccatgaaaagctctcatgggcccacgttcttttttttttttttttttttgagacagagtctcactctgtcacccaggctggagtatagtggtatgatcttggctcaatgcaacctctgcctcctgggttcaggcaattctcctgcctcagtctcccaagtacctgggattacaggcatgcaccaccgtgcccagctaatttttgtatttttagcagagatggggtttcaccatgttggccaggctggtcctgaactcctgacctcaagtgatccagccgcctcagcctgtgattacatgcatgtgccatcgtgcctggcctccctcccaaggtctttaggttatacttttaacaacgattgctttaaagtttatactcctccagccatctttcctaaggacttgaagaaactaaggtgaactgacatagatctgttagaaacgtgaaaaatctgctttatactgggcacttccctaacctataatctcccctagaaatctctgaaatctactccagatgtatatggggcacaaagtcaaccctatttttcttataatcttttgtaaatggcaacatagtatgagaaaaaaaatcagtctagattgcagcagcctactgcaatagaaatgagaatatctgggcatcagcacaaactaaagttacagaaaggatggcaaacagttcctgtaatgagccaaatagtaaatattttagattttaggggccatgtcgttgatgtaacatgtatgattatccttatagtgtgaaagtagccatatacaatatataaaggaatggtagtggatacattctagcacaattttatttagatctgacacttaggccatggctagctgaattctgttttaaacaaaactgatcaacctcaacaatacagtgactaaaacaaagccattttataaaatcagatctcttttcttatttacaaatggattttactccttgtaaacccttgtagaagcatactttctctcaatgaagaaagaggaggaacaatgaataatttgtaggaactttcaatcaataattaaaagctattcaaatacctagaaacatgtaattaggaaagggcaatatattcttttttttttttttttttagatggagtctcactgtctcaccaggctagagtacaatggctctatctctgctcactgcaacctctgcctcccaggttcaagcaattctcctgcctcggccccccaagtagctgggattacaggtgcacgccaccacgcctggctaatgtttgtatttttagtagagatggcgtttcaccatgttggccaggctagtctccaacttttgacctcaggtgatccacccgccttggcctcccaaagtgctgggattacaggcgtgagccaccacacctggccagaaatggcaatatattctacagaatgacaaaatatcttagaataataactttgatagtcagtaaaatgtaacacttaaagatatagagaaattatcattcttggtatttattccttctagtcaattttttattaaataaatagctatataattatacagtattccttctgagtaatgaaaaagttcttaaaattcaaaaaacatacaccgtaaatgaaactaatagattttaatgcattaattacttgaaatgtaaattttcctcagaaggtacaaacataaaactccaaaaatagttagataatccacatattggcagaagatgttcataaacaacatagctagcaaaggattaagaatgagactacataaagaactcccacaaaacaacaagaaaacacagatcaagattatggtgatgtagcattttaaattcatcaaagtgacaaatttttaaactccagccataccacgtgattaggtgatgtgaagcaatgagaacttaaacactgctggtgatatgtaaactgatacactactttagaatactgtattgtattggaatacgatactttggaaaagaatttgcattatcttgtaaagttcaacattttcaccttataagtcagcaattctacttctaggaatatatgcagaaaattcttgaacaagcacaaaatgtatacgaaaatgctaattaattggtaaataaatagtcatgtcatgcaatacattacaattgagaaaatgaacaaaactatatgggtcaatgtggatgaatctcaaacagtaataagcacaaacagtaattaacaaaaaaatgcattcagtatgccacatttaccttaagtgcaaacataaaaaataaaactctttattgtttagagttatatacacgtagtaaaggtatagaaaagacaaaagacaacaccaaataaaagctagtggtgttgggggtcaggcgaagaagaggagacaaagcaattatagaggagtaacccaatttcataaacagtgatcctttttgtatgcttagagtatttcaaaaaagaatttaagctatatataaataactaaacttactttggcttaatttaaaaaaaaaaaaaaaaaaaaactacattcttccaaacccagtttttagctacctgtaagattagcacagggcagacatcacccagagcttttctgtttactcatccaccttacgttgctaaaacaactgttcatctttgaatatagtgcgccaccttgtgttcaaaagcttttaactcatataaaattctgagacccatgtttgtaaacagggcttcctcgaaaaaaaatattaggttggtgcaaaaataattgcagtttttgccgcaactactttttcagcaccctagtataaattcctttatgctgtggcaatagatttaccattataaagataagtacatgtaaaaacaacattagaaaaaattattttgattctaaagaaattacaaatgctttatttctattgataatctttttgagctttcattttgctgtactttcagaagataacttgccttttttccttgattttaagtatcgaaattttttaaatgactaaaattcaaaaattatagatatttaaaatgctacaatacgctttcataaagaaacttacctttgaatgagtgattgataaagtgtctacccatacacgccagccaccccactcatatttgactgcatggtaaagcaggattctgaatatggcgtataccatttctgttatcttttgctcatctgaattcttaggattaaaatagcagagagaaagcatccattcttgccacacagagcattgtagcaagctcctgaaaattatgagagggtactaaattactgaagaaaaaaaaattatctaaaataaatctaaaggtttaaaacaaaataaccctgcccctccctttccccccgaaaaagaaacacatttagttatacattaagaacaattcgacaatgtggtactaaaaattctaacttaactatgtggtacattatttacatactcttaataaaaaaaatagaaaaatcatttcacagtatttttaaagcaatttttcttagataaaatgggcttatacaaaagtacatttgaatactgcaaataaatgctttctgattcagcttacctcctgttttctctactgttattaaaaagtttaatcatgtcagaaagaaaggctctgcgaacctccatgctctctgggcactggggagaatttcgaagtagggtcgcaattacttttagtatctctgtaagacagtttataaataagtaaaaaccaaactcaacaaaaaactcatgatagaaggtcatccatctattgcaatttctttagtttccctaacacaaatgtctaccaaaaacatcctcttctgttattaaaaaaaatcacctctggaaagaaatgacaatacattcattagaaagcatttataaatatgaaaggaaatttctttcatgattcaaatgtgcaaaaataaagctgaactttaaaaggttaaaataaaacaagttaaattataaatgaattaaatgtcagtgaaactgcttactctctctgagatataccaaatagtaaagttgatcttaaaaacaagcaggccgggcgaggtggctcacgcctgtaattccaacattttgggaagctgaggtgggtggatcacttgaggtcaggagttcgagagcggcctggccaacatggcaaaaccccatctctactaaaaatataaaaattagccaggtgtggtggcgtgtgcctgtaatcccagctactcaggagggtgagacaggtgaatcgcttgaacccaggaggcagaggctgcagtgagccaagatcgtgccactgcaccccagcctaagcgacacagcaagactctgtctcaaaaaaaaataatgaaataaaataaaaaatactataatcaaaatctcagaaaaatataataaattcttagattcctcatcataatttatggtatgcacacacagtctttcatagctgggattataggcacctgccaccacgcctagctaatttttgtatttttagtagagacagcgtttctccgtcttggtcagggtggtcttgaactcctgacctcgtgatccacctgccttggcgtcccaaagtgctgggattacaggcatgagccaccacggccggcctaccatagagaatttttaaaggtgtgaagattttctttcataatcttaaaagtaaaattagacacaaaaaacccaaaggaaattaaaacctattcaacatcccatctccccagaaaatgcaaactaaactactattgtaatggtcttagcataaagctatttaaatctccagaatttagcttaaattaggccaggcacagcggctcatgcctgtaatcccagaactttgggaggctgaggcagttggataatttgaggtcaagagttcaagaccaccctggccaacatggcgaaatcccatctccacaaaaaatacaaaaattagccaggcctggtagcaggcacctgtaatcccagctaccagggaggctgaggcaggagaatcacttgaaccaggaggcagaggttacagtggctgagatcctggcactctactctagtctgggcaacagagcacaagactcggtctctaaataaataaataatctccagaacttagcttcttagcttaaattaaaacaaaaaaaaaaattcttttaaaaatatgcacttagaccaggtgcagtaggctcatgcctgtaataccagcactttgggaggttgaggtgggaagattgcttgagcccaggagttttagaccagcctgggcaacataggcaaaataatgacatcacgtttctctgaaagctgaggaaaattaaacctcaaagccacgtgctttgaaaattagcactggagtaccaaacacacaaatacacctaaccacataaaatgtaattaaattttaaaactctacaaactaataattttaataacatgatcttaaaaagcaagatgaaaaaggtatactttatacaagtgcttaagaattctaaatatcaaaagaaaagactgtttaacaagactatcttcataaacaataaagaagacatattgttctattccaaatttggtatttttatattcacagtaatttaagataaaactaccccaatggttcttgtaattctgcctgacatcactaaatagcacaatcaaaattttgctgaaagtctgaacatatattacatcaagaccttaagcaaacaattcttcaaaacctttatataagaatttccacataacttaaggttgattcgaaggaatactcaatataaaacccaaacaaaactagtataatatcatcacccttaatgaaacattcatctaacaatctgtttcaacaacatcaattttaggttgttcacagtgactttctttttaagtagcaaaaggtagtttttgttaaagtatataaaatacatacgagggttttgtatcttcactgaagaatcaggatctggatgctgtttatgtatcacctgagtaccaatctgttctataagaatctacagaagtaaaacaatggattacattagcaaatcactggattagcatcactattaatgaactttaagtgcatcactattaattaactttaagtacaacactaatcaaaatatagtatatttttagtccaatattgtcatgctaaataatatacttctaaaataactacagcattattactctatgttttcttaattataaaatgagacatcaaatagttaataaaatggagggaacatttaaacagaaataacgatactgtttagaaattcacagattaattatagatttctaaaaatgcagccacatctccttatatcatttcaaagctgtacattacaaacttaaatggtctggtcagcatggtggctcatgcctgtaatcccagcactttgggaggctgaagtgggtagatcgcctgaggtcaggagttcgagaccagcctagccaacacagcaaaacccgtcactactaaaaatacaaaaattagccgggttaggtggtgtgcacctgtaatcccagctactggggaggctgagacaggagaatcacttgaacccgggaggtggaggttgcagtgagccaagactgtaccactgcactccagcctgggtgacagagtgagactctgtctcaaaaaataaaataaaaataaatgatcttatttacctacacaatgttaagaggcatttttataataagaaatttagaggagtaaatcctaagtacattcctacctcaaacagcacattatatgtggtcattgtgattaaatttgtctgaagcatgagcctttcagctagcaatgaaaacaatccatgtccaagcatgacttctgctttcctcctgcaattacacaaaaagaaatcatcaaatgtagagcttttctgtgctctacttaatatgcatgctggatgaaggaaacacaaaatactttttcacattacaaacaattcccaactcaattactctcccaactatcttcaatctagaacttttaaggccacaaaacctttaagcagagaaatgctaactatataagcatagccgaagttaaaaattaaaaaaaaaaaagacaagtgtgcctatgctacagcacagcaaaaacctcctccaaaatcttcagagcagttatttatttaacgaagttgctacaatctaccagcactaacttagtctcccctggggatgatcatctaaagcacaataaatacttaagtagaaaaacaatgtggagaaaaagtagaagaaatgtaatataattttttaaaataaatactatgaaaacatatataccaaaattaaccttccaagcataaattcagaaactaaaggatcacaaactttaattttacccttggggtcagcaaagcttttctgcaaatggccagggggtaaatattttagaatttgtggaccaggtgatttctgtcacaactcaacactgtccttgtatcatgaaagcagccacagatgatacacaaataaattattgtggctgttttccaataaaactttatttacaggtggctaactggattcctaaagacttcagtttaccaacacttgttctacccccaaaattttctttttaaaataaactacttctggtacaaagaacaagaggtagaacatgaatatctgtattcagctaagaaaataagcgtggaagtttcagttttgagttacgcatacagcagaacacactatgtgacaaacatccaggttatgtattactttataatacagataaagcaaaaatggtgtgagtcacctgaaatcaagtctccatagcttcttgaatgcaagctgtccaaactaattctcataattcacattaaatacatgaataatttaaataattttatgtacaaaaaaattaatcctgttcacttaatttttaaaatatgtactagtgggattacatttatacagcaatttatgaataaaaataaaagaaaaactagaggactatagaacaaaattactactgcaaagatttataaaataaataagtagaatacaacagtccatcttagatttcggcatacttactttggggccagatgttttaaaaaataacccattgccttaagagcttgtaccctgattccttcacttttcgatgccagaagtttgtagataacactgaatgaataaaaatttaaaacaaactattttgagtataatttttaaatggaaaggtttaaaatatatacttttcatattattataaatctatttcaaataatatggaaggaaatttaatatagatttctgtatataaaaaatctgcttatctcaggctagagttcctttcaatgaaaactaagaaatgagaagaaattggaatataagaaatgaggtgacttttccatgcacatacttatatgtaacgtgtgtatcaagctagctttcagatacttttttccttctgctacaggcttgtaaatgttctgaaggttaccaacttgttattttaagtcagtagaaagaaagcatttctaatggtagcacatatttaaatttctaaataattgtcgccatgaaaaacaagacagtaggctaataataaatgattatcagaaataattacaaaagtaaaaagatttacaaccaaagaactgctaaaaataaatttctcattcaattctcaaaaattatatagtaatctaatttaatttttaaagatctatgaggcagctggatgcagtggctcacgtctgtaatcccagcagtttgggaggccaaggcaggcagatcacctgaagtcaggagttcgagaccagcctagccaacatggtgagaccccatctctactaaaaatacaaaaattagctgggtgtggtggcatgtgcctctaatccagcttctcgggaggctgaggcaggagaatcgcttgaacctgggaggtggaggttgcagggagccgagatcatgccactgcactccagcctgagcaacacagtgagactctgtctcaaaaaaaaaaacaaacaaacaaagatctaggaaggccttctgattttagtataagtaaagtataatgcaactgaaattaaactgattcattacagcattcccttcctcataaacatttagaacaagaacagtaattagaaactcttataattacttataaaaattaaggatatcagtatcctcctagatcaaaattttggtgtttagtaagttagaaaacattctgaacaaaaaggaaatatcttcaacctctagtgatcaatagaaaagcaggtatataaaaaagaagtttgattccttttaaaacatgaactaaaggcatccaggtccatatcacattgtaactgcataattttaattcaaatcttagtacaaaaacttaacagtcaatcattaggaaaatactaatatgttgtatgtttcttttcttcaaggatttaaattcagccaaataaaaattaaaccttttaaaagaaatattaatataataccagtttaaaatcacaatagttttttgagtttttttccccaaagatggcagatttgagggctttagcatttctcagccacttagaaatagcaagatagtatataaaaatcaactgtgagctttaattcaggaagaaaagcaggactccaccagaatcatgaaaggcaccctagttcccgagagcactttgtttctcccaagacctggagctaactgggaaagaggtatggagatactgtgagggaaagacaccaggaaaagttgcagggaccaacagcaggatgccattttgaattcaagcacacacaattcaaactggaaatctggcagtgtggctgtgcaggcatgccagagattagagtccctgctttggagccagaattgtgaaaactgcctcagcagtaggtgttataattgtactctaccccgtcgcaggcctggggtgggaggaaagctgctacagctgcaatatctcctggacaacaagacttggcaggcagaggcagcttggtgacctggaaccagtctgcatgtgtcattgctgggtgctccagcctgctaccctgacactgtggtgcagcagggccctctctgctccactctcaggcagaaatccagacattcaagccaccccacccttcgtagacacagatcatagcactggaccctctttgctccatgcccaggcagatctccaggcaactgacgcacccactcccacggactagcaacctgagccctattccacgtggtgcagcaagatgcacaggcagatctccaggcattaaatgcacttgcttgcccagattggcagcctgagccaccccactcttcctttgcagagatccaggttcagaggggtcctctatgcttcatgctcagggagatctccaggcattcagagcagctgcttggctactccagcagcctgagtcacctcacccctctgtgcaaagatcttggtgcaagggggaacctctctgctccatggccaggcagatttccaggcattcagactactcagtcacctggaacagcaccctctgcaccattcctatgtagagatcctggtacagggggccctctctgtttcacacccaagcctatctccagggattcaaaataactgcttgcctggttcagtaccctgaggtgtcccaccattccggtgcagaaatcctggtgtaggagaccctctccatttcacagccagtagatctccaggaatctggaaaacccatttttcctggattaggagtttaggccatccccattcccatgcagagaacttggggctgaggtttcccatcactattttttgtgcccttctccagagcatagaagggagctcagaccaccatgcactacacacatcagcttattgcctgaggcaacagagaacttctcccactaaacaagggtcaagtatatacccagccacattggccaaagcccactcttactcataactgccatccaatggcttgtaggttgaactgcacagcccaatataaaacctgctgacggaagtgtataaagctacagaagcaaagccaaaaggccctacccagcattctctatagccacaccccctatgaagacagggaaagagaaagaagacaaaaaaataataataacattacagagaaagaaaaaaatcttaaaagcatgaaaattattacaaaagttacaagtgtcagcatctccaaagaaggaaccaccacaaaacttcagacaccatgaaaaatctgagtgtggtgacaccatcaaaggatcacactggctctccaaccatggtccataaccaaaatggaaactcagaagaattgacaaataaataattcaaagcatggactgcaaggaagctcaatgatatccaagacaatgttgaaaattaaaagaaacttctaaagcaatccaggagatgaatgggattaaacatcttaaaaagaaatcaatcagagatcctggaattgaaaaactcacttaagaaattacaaaacaagactgaaagttttatcagcagactggacaaaccaaaagaaagaatttcaaagcctgaagaccgatctttcaaatttacctgaacaaaaattttcaaaaacaggttgaaaaatgaaaaaaagtcttcaagaaatataagactatgcaaagcagccaaacctataaattactggcattactgagagagatggataaaaagaaaacaacctggaaaatatatgtgaggaaataattcaagttgctagagatatagacatccaaatacaagaaatctagagaacatcacaagataccatacaaaatgaacatcaccacagcatatagtcaccagactgcccaagatcaatattaaagaaaaaatcttaaaggtagccagagaaaaaggtcagatcacatacaaacagaaccccatcagcctaacagcagacttcttggcagaaaccacacaagccaggagacattgagggcttattttcagtatccttaaaagaaaataaatttagccaagaaatttcatatccacccaaactaagcttaataagcaaaggagaaataaatgtttttcaggcaagcaagcatcaagggaatttgttacctacagaccaaccttacaagagatccttaagggagttctaaacacggaaatgtaagaacaacacttactaccacaaaaatacatgtacgtagcttgcaaaccttataaaacaaccacacaaaagaaattacaaagcaaccagctaacaacttcatgataggatcaaaatctcacatatcaatattaactatgagtgtaaatggtctaaatgcccccactcaaaagacacagaatggcatattggataaaaaaaacaaaactcatccatctactgtctttaagagacctatttcagctgggcgcagtggctcacgcctgtaatcccagcactttgggaggccgaggcaggaggatcacgaggtcaggagatcgagaccatcctggctaacacagtgaaaccccgtctttactaaaaacacacaaaaaaaaattagccaaccatggtggcgggcgcctgtattcccagctactcaggaggctaaggcaggagaatggcatgaacctgggaggcagagcttgcagtgagcagagatcgcgccactgcactccagcctgaatgacagagcaagactccgtatcaaaaaaaaaaaaaaaaaagagagacctatttcacatataacaccactcataggctcatagtacagggttggggaaagatctaccacacagagagaacagagaaaaagagcaggtgtcactattcttatatcagataaaacaaacgataaactatcaagagttaaaaaggacaaaaaatggcattgcataatgaaaaatagttcaattcaacaagaaaacttaattaccttaaatatatatgcacccaatagtagagcaatcagatatataaaacaacgactacgagacgtaggaacagacttagacagtcacacaatattagtggtggatttcaacaccccactgacaggcattagacatgccatggaggcagaaaactaacaaataaattctggacataaattcaacacttgactaattggacctaatagacatctatgggatactccacccatcagccacaggatacacattcttctcatctgcacacaaaacatactccaagatcaaccacatgcttcgccataaagaaagtctcaataaattcaaaaaattgaaatcatgccaaccatattctcagaccacagtgaaataaaaatagaaatcaataccaagatgatctctcaaaaccatacaattacatggaagttgaacaacttgctcctgaatgacttttgggtaaacaatgaaatgaaggcagaaatttaaaaattttttgaaataaatgaaaacaaagccacaacataaccaaaactctaggatacagccaaagcagtgttaagacgaaactttaggccaggcacagtggctcatgcctgtaatcccaacactttaggaggtcaaggtgggcagatcacttgagagcaggagttctggaccagcctggccaacatggtgaaaccctgtcttttccaaaaatacaaaaaaaaaaaatagctaggcatgatggtgggcacctgtaatcccagctactcaggaggctgaggcaggagagtcacttgaacctgggaggcagaggttgtagtgagctgagactgagccactgcactccagcctgggtgacagagcaggactgtctcaaaaaaaaaggaaattttatagcacatagcactaatggcctaagtcaaaaagctagaaagatctaaaattaacaatctaacatcacacctagaggaactagaaaaacacaaactattaaccccaaagctaccagaagaaaataaaaaataacaaaaatcagagcagaactaaacaaaactgagaccaaaaaaaatccatacaaagaaccagcaaaacgaaaagctggttatttgaatggataaagaagactgatagaccactagctagattaaaaaaaaaaaatccacatacaagcacaatcagaaatgacaaagttgatgatacaaccaatctcatagaaatacaaaagatcctcagagacaattatgaacacctctatgcacacaaactagaaaatctataggaaatggataaattcatagaaacacaaaatcaggaagaaattaaaaccctgaacagaccaggattgagctccgaaactgtatacctgcttaaatttggcagtgaatttttctggtccaggaattttttttttttttttggttacctactaaccaaaaaaatcctagatgaggtaaattcactgccaaattctagcagatatacaaagaagaggtggtagcaatcctactaaaaatattcaaaaaacttgagtacaaggaactccaccctaacttattttacaaagccggcatcaccctgataccaaaacccagcagagacacaacgaaaaagaaaactacaggccaatatccctgatgaacacagctgcaaaagtccccaacaaaatactagcaaaccaaatccagcaacacatcaaaaagttaattcacgatgatcaagtaggcttcatttctggaatgcgaggttggttcaacatacacaaatcaataaatatgattcaatacaaacagaattaaaaacaaaaccatacatttatcccaatagatgtggaaaaaactttcaataaaatccagcatctcttcatcataaaaatcctcaagaaaccaggcatagaaggaacatacatcaaaataatgagagccatctagggtaaacccacagctaacatcatattaaacagacaaaaacaggaagcattcctttgagaactggagcaagaaaagggtgcctactcttaccactcttattcaacatagcactggaagtccttgccagagcaatcaggcaagaaaagggaacaaaaggcatccaaataggacaaaaaaaattcaaactctctctcttcatgacaatataattctacaactagaaaaccctaaagactcctccaaaaggctcctgtgactgattaaatgacttcagtacagtttcgggatataaaattgatgtataaaaatcagtagcatttccaaacaacaaccttcaagttcatatccaaatcaagaaagcaattccttttacaatatccatgctcaaggattggaagaatcaatattattttaatggccatactgcccaaagcaatccacagattccatactattcctacaaaactacgaatgtgatttttcacagaactagaaaaaaactatactaaaatacatacggaaccaaaacaagagcccaaataggcaaagcaatcctaaacaaaaagaacaaagctggagtcatcacaatacccaacttcaaactatactataaggctacagtgaccaaaacagcatggtactggtataaaaacagacacatgtgtcaatggaacaaaatagagaacccagaaacaaagccacctacctacagccctctgatctttgacaaagtagagaaaaataagcaatggggaaaggactccctattcaataaatagtattggaatagctggttagccatatgcagaagaatgaaactggacccttacctttcaccatacaaaacttggccaagtgtggtggttgacacctgtatcccaacactttgggagtctgaggtgggtggatcacgtgagcccaggaatttgagaccagcctaggcaacgtggtgaaactctgtctctacaaaaaacgcaaaaatcatctgggcatggtggcacatgcctgtaatcccagctacctgggaggccaaggtgggaagatcgcttcagatgcagaggcagaggctgtagtgagctgtgatcgtgccactgcactccaacctgggaaacagagcaataccctgtctccaaaaaaaaaaaaaaaaaccttttagctcaagatggattaaaggtttaaatgtaagccatcgaattagaacaatcctagaagaaaaacgagaaaacaccattctggacatcagccttgggaaagaatttatcactaagtcctcaaaagcaattgcaatacaaacaaaaattgacaagtgggacccaattaaactaagcgcttaggtacaaagaaactgtcaagagagtaaacagacaatctacagaatgggaaaatactgacaaactgtgcatttgacaaaggtctaatatccagaatctataaggaacttaaacaattatacaagctaaaaacaatcccattaaaaaatgggaaacgccacaaacagacacttcttaaaagaagacatacaagcaggcaacaaacatatgaaaaaatgcttaattaacatcgctaatcatcagcaaaatgcaaatcaaaataatgagataccatctcagaccagtcagaatagctattactaaaaagtcaaaaaacaactgattctggcaaagctgcagagaaaaggttggtgggaatgtaagttagttcagcctctgtggaaagcagcttggagatttctcaaaaaactttgaactaccattcaactcagcaattttattaccgggtacatatccaaaataaaataaatcattctaccaacaacacatgcactcgtatgtgtattacagcactaatcacaacagcaaagacatgaaatcaacctaggtttctatcaacggtagattggatagagaaaatgtaatacatatacaccaaagaatactacacagccataaaaataaaccaaaatcatgtcctttgcagaaacatggatgcagctggaggtcattatcctaagtgaattaatgcaggaacaaaatgccaaatatcacatcttctcagttataactaggagctaaataatgggcactcatagacataaaaatggcaataatagacaatgaggactacaagaaggagagaaggaagggggaaaaggttgaaaaacttaactattgagtgctatactcagtacttgggtgacaggatcaatcatacctcaaacctcagcatcatacaatatacccatgtaacaaacctgcacatgtaccccctgaatctaagataaaggtgggaattattaacataaatacataataaataaaaataaaaactgtaacacactaagatattttaacgtatcaaaaaactatccttgctatagcttaactcacaaatatctacggttaaaaatcacaatagggctgggcgcggtggctcacacctgtaatcccagcattttgggaggccgaggtgggcggatcacctgaggtcaggagctcgagaccagccagaccaacatggcaaaaccctgtctctattaaaaatacaaaattagttgggtgtggtggcacatgcctgtaatcccagctactctggaggctgaggcaggagaatcgcttcaacccgagaggcagaagttgcagtgagctgagatggagccattgcactccagcctgggcaacaagagcaaaactctgtctcaaaaaaaaaaaaatcacaataattttttcaaaagataaactctagacattgtctatgtactttcaaataatgttttattaggattaataacacaagaagatcaaaagaacctgaaattattctatgaacctaatagttatcctacaaaaaatttttaaattttgaacacttctaaccaaagcagaatcaaactagtttatctgctaaacatcagcagtaaattttgtaaaagttaaatgggcctattttgctttttgaccatagttttgttcttatttaatgcacaaaaaaatactttacacattaaagggaggaaaaatcctgtagtgcttcaatgaaatttatatatttatctaatcataaaacaataaataaatgtttattctctatttggaaataaagaaaagtgtaagggagataacaaaaataacccatgaagaacaatattcaaatctggaaatattttcatgcaatctatttgactatgcttacatgtttaaagaaatagatatggatatttttgaattgaaatatactatggtatgtacagtatattttcaatgcagaaaatataattcaggcaagagaaacgcccaaaaagataatctgaatagtaacatgatttcaatctgctcacagatattaaaaatatgataacagatcattaactagactcaaatattaaaaatttataacaatttaagcagggcatatgatgagactgacactgagtcagaaaacacagtcacttctaaggaaggataagtcttccaagctgttgacctaagttcaatatcagagctaatgtttaaatgatttcatggtagagaaaaatttatattaaataactgaatgtgaaaatttctgtcatttgatgaaaattaaattgtcattccaatttggaaatgttactgatgactatgacacagtttggcatgcctatattatctgtcaccaataaagaccatcccccctccaattttctccacttgagactgtgcttacacccccatttaactttcagttaatatgaaaccttttcttaattcacctctgtttttttcatggtggccttcaaaaattatggttctaggccgggagtggtggctcacgcatgtaatcccagcactttgggaggccaagatgggcagatcacttgaggtcaggagatcaagaccagcctgggcaacatggtgaaacgtgtctctactaaaaatacaaaaattagccaggcatgggggtgggcgcctgtaataccagctactcaggaggctgaggcaggacaatcacttgaacctgggaggtggaggttgaagtgagccgagattgcaccactgcactccagcctgggcgacagagtgagacgctgtctcaaaaaacaaaaaaattatgttactgtatactaagtaccaaggtaatcataaacaggtactgaaattatgtatcaatgtctagtttgaattttctgtctctccccgaccttccaccatctctctttttaaatcatcgaaaacaaaaatccataatttaaaaaatgtaaatactgaatttttggacccaaagaatactttcaaagaactccaattagattgaagggaactatccatcattcaaaaatcattttaaactacataactaatataaacatttaataaatatttctacccagtttaagtaactgaactgaatttaaatgggactaaatcttcacatttctatatactagtccaaattagaaattttttatttcttcacagtaataaataaaagactgagaaagtagcaaaaattaaaacatactataaaagcaaaatagggggaataatgatgctaacatggaagtcagcattttccctccatgaaaaaagacaggaataaaaccgaaaaaaattttcactgaaaaatatttattgttgagaaattgctagaaattcaggtaagaatatcaggagtcagtggccttattaatgagactactcctgtcattaccaccccagtttagttggtaagaactgtagttttaccatttgggggctggcagtaaaaagtagcactgttgctttcaaacagggcaaacctattcagggtaagaaatgaaaactgcagttctccagctaaaagtggcagacttggttacgaatcaatgggagaaaccagcagctttgctagatcagagatacaggcacaattcagggggaacagcagaccagttagatatttactagggagatattaaaagagaaccatagaaagattgagataagtactccacacagacatagctgattgagaaagtacctatatccaggagacacctgggtcactaactgaaaaagggaaggcaagagagactagataagtagccacaactttgaatgcaatccctaaaaatatacagatcaacacagtgggcctaagggctgaaggaattttatcagaacctgtagctaaatcattgactgaactctaagatatatagaaacatggaaaaccctaagagtgctatggaaagaaaaagggaaaaagtaaaaatactgggcagagaaaagtcagagctgtagaccgtggagaaaacacaatctgcaaactaaatgaggcaaattatttaaaaccaaacaaaaaccaacaaccatagaaaaacaaaaaaagtctagagttgcccagttttcaacaaaaattactatatatgcaaaaaaacaaaaaagagtataacccataatcagtaaaagagcaataatcaaaaataacttgtaaggtccaaatgttagattcagcaaatatttttaaggacttgtaataaattatattcaataaatgaaaaaatagtatgttcaaataattgaatgaaacagattaacaatgagttctcaaaaaagtataaaaagaccaaatggaaattctagagataaaaaagtaccatttaaaaatcaaggaattcactataggcattcaacaggagactcagatggcaaataaagaatctgtgaattcaaagataaatcaatataaattatatagtctaaaaaacagagaaaaaaatgggaacacaaattattcaacctttagacactgtaggacaatacagtgttccaacatagatgtaacaagagttccaaaaaaaaaaaaaaaaggcacagaaaagaaacatctgaagaaatagggataaaatcttccaaaatttaatgacgaaacatttacttacagattcaaactcaataaaccaccgaagtgaaagtaacaaagtgagtcaccactaggccgggcacagtggctcatgcctgtaatcccagcacttaggctgagatgggcgggtaatttgaggccaggcattcgagaccagcctgacccacacagtgaaaccccatctctactaaaaatacaaaaattagctgagcacagtggtacatgcctgtagtcccagctacttgggaggctgaggcacgagaatcacctgaacccaggagacagaggttgtagtgagccaagaccatgccactgtactccatcctgggtgacagagggagactctgtctcaaaaaaaaaagtgaatcacaactaaacaaaccacagtcaaattgctgaaatccaaagacaatgaaaaaaaccttaaaagcatcaagagaaaaatgactgatgacatacagagcaacaacaatgcaattcattgctgtcatctcatcagaaacaatggagtccacaggtcagggagatgacagtcaagtgctaacagaaagaaaactgcaatttaagttcttatatccaggataagtatcctctaaaaatggaagcaaataaaagtattctgagatgaacaaagactgagaaaattcattgctagcaaatatgccttgtaagaaataataaagcccaccaagatgaaagaatatactgtaaaaccactaataaaagataacctttaagaagaaaactaaaatcaacaggggaattttgatccaaccaaatggagtcagcccaataaagcctctctgtcccaaatattaataaaattataggggaaaaaaacacaaaaatcaacttcccaagtactctgaagactaaacaaaagcaggtgcattgtgtaggggagttaaaacttggagaattactcatatggatagaagaatcatttttttcctttctctcttctgaatctgcccctgtttcagggctggatgtcagaagctcgggtggcaaaattctaagaaaaactatgcttccagttagagaaatctagaaattaggtcctagataggagaagtgtggggaagaatcctaaatagcagagagtaagagaaaagggttctctaaatctgtgtaaaaacctgtgataaccccaaactcacccaagagacgcatgggtgtgggacaaacccaaatcagaatagacacctttctaaatttaattaccatccaattctcagcctaattcctgaatgaagcatatgtatgtgaggaaaatacaaggcaaactagtctgtctccctggatcgaaggggaaaaaccaaagaatgaaagaaaacccaaagtagggtaagagaggtttgaaaaatgaagggacactggaaacatcatgcacagagaagaggtggaacttgcagccccacccttaccaggttgtctatttgctaaacaacaacaacaaaacatgtgttagaggattataacagggcccagagttatgctctaatgcatccaggacccacaatattcaagacacattagaagattacgcaacatacaaagagccaagaaaatgtgactgtttctcataggaaaacacaaacaacagatgtcaatgagatgagcaaaatgttggacttatcacacaaagactttaaaggagatactataattatgctttagaaaataaaggttaacaaagtctaaatgaattgaaaaagttctccaaaaagaaataataaatgtttgaggtgatggagatgctaactaccctgatttgaatattatatgttatatgcatgtattaatatatcacaatattgcatataatatgtacaattattgtcaatttaaaatattaaagaaaatagagttctcatccaaaaatgaaagcataaaagtgaaccatattgaaattttagacttgaaatgcatactatctgaaacaaaatatgcaagagatgggttcaatatcaaaatgtaaaacacaaagaaaaagtccataaatttgaagatcaagtttattatacatatcaagtttctatgcacaaactacaatctgaaaaaaaacaagactgaaacaaactaaacaaatgcttaaggagttgcctgactctatcagaagatctaatacttatttctttggagacccaaagtgaaaggagaaagatataagtgaagcaaaaattgaaaaaataagaaccggccgggagcagtggctcacgggccgggtgtggtggctcacgtctgtaatcccagcactttgggaggccgaggcaggcagatggtcaggagatcgagaccatcctggctaatacggtgaaaccctgtctctactaaaaatacaaaaaaattagtcaggcatgctggcgggcgcctgtagtcacagctactcaggaggctgaggcaggagaatggcatgaacccaggaggcggagcttacagtgagccaagatcgggccactgcactccagtctgggcaacagagcacgactccgtctcaaaaaaaaaaaaaaaaaagaaagaaaaaaaaaagaacctacaacttctcaaatttggtagtaatcacaaagaaaaccataatgaacctatgaaaggaggaagagagagatggatgcagtcaagtgtgcctgtagtcccagctactgaggagactgaggcaagagaactgcttaagcccaggagttcctgggcaacatagtaagaccccaattctaaaaaacaaaaacctaaagaaaatgtcttgaaagcaagtgcagaaatctagaacattatatttaacaaagaaagatttcaataaccacagatttctcattggaaaccatggacaccagccaacagaagaaaaacacaggaaagaaaggaaaggaaaaaggtaaggaaaaaggaaaggaaaaaaatgattacaaacacagaattctacatacaacaaaaatatccttggagagtgaaggtcaaataaatatattttcagaagaaataattaaaaattgtttctgtcaaaactgctcaacaagttctttttcagcagaagttcttctaaaggaagttcttcaagaataaacagcaaaagaaactgtaaatacctggataaaagtagaaacttttttctctcttcaattctttaagctatatataactagtgaaagtaaaactttaagctatatataactagtaaaagtaaaacttattaactgtctggaggcgcttatgtatatacagacataataaggacaattgaggcagttaaagggatctgagcagttccaagggttctatactttatttgaagaggtaaaatattaacactaggtagactgtgaaattacatacactggcatctctagagcaaccaccaaaaaagttacacaaagagataaactccaaactcaaaatataaattttgagaatatttttaaaattcaaataaaaacaacatagaaaaagagaaacaaggaatatattacactgggataaatagaaaacaaataaaatggtagatgaaaataattacaatatcaataattacattaaacataaatggtctaaacatactgtaaaaaacctgactttgtcagactggattaaaataaataaaacctacaactattctgtgtgtattagctaggtttttccagagaaacagaaccaagaggatgtgcagatagagagagagacagagattgatttcaagaagtttattcatgcaattatggaggcttggtatgtctcaactcagaagagtagaccagcaagctgaagatgtaggaaagaactgtattctcagtacaaaggcagtcagccagcctaatttccttcatccctggggcaggtcagactttgttttattaaggccttcaactgattagatgaggtccagacatattacagtggataatctgttttactcaaagtccaccaatttaacctatttatgtctagtgttccattattggaacactaagcttgtgggagttatttatatcctactgctcaaggtcattgccaagatttgattttccacaaaaaaaaaaaaaattgcaacctctggcataaatggcttaaatgttaatctcatcaaaaaaacactttcaggccaggtgcagtggctcctgcctataatcccctcactttaggaggccaaggcgggcagatcatgaggtcaggtgatcgagaccatcctggccaacaaaaattagttgggaaccaggccacacagcaggcggtgagcaccaggccagcaagcattactgcctgagctctgcctcctgtcatatcagctgtggcattagattctcataggagtagaaccctattgtaaactgtgcatacgaggtatctaggttacatgttccctatgagaatcaaatgataaatataatgcacttcaatcatcctgaaaccacccccaaccccagtttgtggaaaaactgtcttccacaaaaccagtccctggtgccaaaaaggctggggacctctgttttagaatttatgggccatatcatctctgttacaactctttgactctgttgttatagcaggaaactaaccataggcaatatttaagagaatgagagtggctgtggttatagcaggaaagtaaccacagacaatatttaaaataatgagaatgacagtgccacaacaaaattttatttataaagacaaatcattatagaagagtcagccaaagaaagcaataaaaataaaatagaaaaaataaaaatgaatatgatcgagagcaataatggaagggcagccataaacgggaagaagaccttatctactactactgtactagaagtaagtaaacaagaacgtgctctaaaatacacctttggggaaaaaagatggaagttgaaataattccctcctaataggtctaatgaagtagatgaggctgtcactgctgacaggaagagttgtaaaaatttagaattgtatctgaaggaacaaagaaatgtttaacaatgatagaagtatagatcatgaatttataataatttcaacatacaacactgcatgacatttccccaccagccaaggtttagcttagagtgtgcctacctagactaatctaggatcagaattctcaaaagcaaatctaacaggacaagggcagacgggagtttttgttagaaaccacttccagcaaatagccaggctaagaaggaagtaaacaatggcagatatagtatgacacactaggattaaaaaaaagcaagatcacaggacagaaggtaactatgaggctgaagagcattggaaagggcgatattagaaaaagaggagatagatggttttgattaaagagtaagattggaatttaaaatttatgatgtgaaaacatgccagtgataaaaaggtctaggtttttaaaacaggaatggataaattacaaagaatggcagtaagggtagcaaagttaaggaattaaaaaattacaaaatgtgaatgttaagatgagttagtcacaaggacaatgaagttattcacatgtagtgaaactgagataagactgtgaaccaaaaattcacacactaagactaaaagtataaagtatagactttccttgcccagactttcaatagaataattcttcttactagtttttaaatgtctatgatactatcttgcaattatttttttttttaaaagtggtaaaatcctatacagtaaatcacaaaatacactaaagcacatccacacaaatacaggttatatccacagaaaataaggttataaaattagatactctggcaccaaaaagaaaaaaatctgccaagcctttacataaacccttaaatcttttttctgaaattcagttattagataggaaatgtgtacaaagaaacaaacaagtatttataagcctcgtttgttttgtgttaatatggctatcatacgacctatccattacattcctaagtatggtatatactcaagataaatgaaaacatatgtccatacaaatacttgtacatgaatgttcatagcaagcttgttcaaagtaataattattagacagtggtgagggaaaataaagagtactttgtttgacagcaaaactataaataaataacaaactgtaaatttacctcttacaatgcttaactttatgtgtcaactgggctaggccatggtatcaagatagttggtcaaatatttttctagatgtttctttgaaggtattttttggatgagattaacatttaaataagcagattttttgtatgtggaccttatccagctgaaagcctaacagaaaaaagcctaactgccttggagaaagagaaaattcactcagcagactgcctttggacttgaactgcaacatcaacccttccctgggtctccagtcagcctgcctatcctatggattttggatttgccagcttccacaattgtgtaaaacagttgcttaaaataaatctctctcgtgagtgtgtgcatggacacccacgcacacactattggttctgtttccctggagaactctgaaaataaaccccttaagtataatgaataaagacactttttatcttatagagaatgaacattaaaaaataccaaataaagaatctgttatagaagatcaatgtgtgtttgagcctaggagttcaagaccagcctaggcaacatggtgagactttgtctctacaaaaaacttttaaaataagctgggcatggtggcacacgcctgtagtcccagctactcaggagactgaggaaggaggatcccttgagcccaggaggtcaaggctgcagtgacccgtgatcataccactgcactccagtctgggtgacagagtgagaactgtctcaaaaacaaacaaaaatccctgtgtgaatttattataactagataattaaattagtttctgtagctgatgattaagcaaaactagttgctaaacttttcttgcccactttctcattaaacaaaagattttaaacttccttatacgtaaaatagaggtattctgtttttgttgttgatgactgtaatggaccaaatgtttgcatacacccaaaattcttatgttgaagccctatcattagtatttggagagggagcctctaaggaagtaattaaggttaaatgcggtcctaagagtgggtccctaatccaataggagtaacgtcattgtaagaagagacacgagagagctcactcatgctctctttctctctctgctacatgacaacacagcaaggaagaggatgtaggcaacccaagaggagagtcttcaccaaacaccaacccgactggcatcttgatcttagacttcccacctccagaactgtgagaaaccaatttttgttgtgtaagccatccaatctacggtatttgattatggcagcctaagcacacaaatacaatgttgagtcagaagtgggaggtggaggaagtgacattttaaaggaaggatagagagcttgtcttggatttcaattgaacactatttaatactatctaggacctaaagataattctgctaaagaagtcaacaatacagtagctctataatagcactcaccatacaaaatattggaatcatttatctgtcttcacaaatcaaatagtaacaaatagtaacacagcctctataattaaagattcattgaaaaaaaatgcatgattataaatgggtcttaaatcttaactcatttcatgctataaactcatttcatatgtaagtttaaataatccttttcatatttaagaagctttcaaatatttccaaactaatcccttatatgaaatagattaaaaactcttaccgtaacccattcctttggtcaaaagcaggaatcatagagttagggtgttctgacattaatgcaacaagcagctgtaggacatccattagattgtcatcctataatcattttagaaattttttttaaaaaatgaggaaaaaacaacttagttgaataatgaatacttctgaaatagaaatttcaacattagaaatataagtagacatatgtgtgatatatacttatttttaacaaattatgttctttaaatgtaaacattcacctctgtaactccaaatatacataaaatagcaaaccaatttctttttttgtgcgggggggcagagtctcgctctctcactcaggctggagcacagtggtgtgatctcagctcactgcaacctctgcctcccaggttgaagcaattcttgtgcatagcctccctagtagctgggactacaggagtgcaccaccacatctggctaatttttgtatttttggtagagacaaggtttcaccatgttggccaggctggtctcgaactcttggccttaagtgatctgcctacctcagcctcccaaagtgctgggattacaagttgagccaccgcacctgacctcaaaacaatttctttgtttttttgttttttgttttttgttttttgagacagagtcttgctgtgtcgcccaggctggagttcagtggcacaatctcggctcactgcaagctctgcatcccgggttcatgccattctcctgcctcagcttcccaagtagctgggactacaggtggccaccaccacgcccggctaattttttgtatttttattagagacggggtttcaccatattagccaggatggtctcgatctcctgacctcgtgatccacccgccttggccttccaaagtgctgggattacaggcgtgagtgagccaccgcgcccggcctcgaaacaatttcttcatcaaagaaataaaataccttttatgttatattgaatcaagattttgtaaaacataacctttagaaacagtatatccaacatgacttttttttaaggaaggcttatatatcaagaaattgtggggaagggttattctctattacagaaaaatatattagagcttctaaaatgctactaaatgttgcaaatctggtggtagtggtagggctaagatattatgtatcatttcttaaacttatctgatctggaatgttttattcactgtgcctctccagaaactagttctaaaagaacactttgtgggaaatgataaccggatcattttcatatacggtattatctattgtccctataaagataaagataaccaataaatgtttactcggtcaacataccactaatatgtggtagtatttgataacatttacagaataccagcacaagaaacgagttctagacccccaaaaaaacttcatgaaaatccttcactacctttgttgcatataccaatatgtatgcatatcattagagccaacttggacaatactgacccaaaaaggaaaaggcaaacagctaacagagtttagttaacttggttgccctgactctagttttccttcactgctttggaatttttgctgtggaagctacttgtataccgaattttcattaagttaaacagatgatctggagctaggacactgaatcattgaaagtgttatttagaggacctgaaactttcctaacaataaggaatcactgtgacttccagtttatctcatataaagtactttattcagtcccttagggttaataaaaacaaaatcacatatatagatcactatgaaattcacctgaaaacttcaaatattatatttggtcagaaaaatctaaaaattaatagaattgcctattcaagaggaaaaaatatcataatcattaatgattttaagtcaaatattactcaatcacaaaatttaagccattcttttatacctgaattaacaaagagatccaatcattatccctcatttaaaaattaaagaaggcactactccattctaaaatatatttattaattcacaaggtattaattataatataggagtataaattatcatttaaaatgctgtgatgtattatattccatcaattcctaagttttactaattataggtaaaaatctaactaaaaatagatgatttagttagattgcaactgacatatattgcattttcctggtgctaaaaaataaaaacagatatttcaacctatttaattttctttttatttttttttaattacacttcaagttttagggtacatgtgcacaatgtgcaggtttgttacatatgtatacatgtgccatgttggtgtgctgcacccattaactcgtcatttaacattaggtatatctccaaatgctatccctccccgctacccccaccccacaacaggccccggtgtgtgatgttccccttcctgtgtccatgtgttctcattgttcaattcccacctatgagtgagaacatgtggtgtttggttttttgtccttgcaatagtttgctgagaatgatggtttccagcttcatccatgtccctacaaaggacatgaactcatccttttttatggctgcatagtattccatggtgtatatgtgccacattttcttaatccagtctatcactgttggacatttgggttggttccaagtgtttgctattgtgaatagtgccgcaataaacatacgtgtgcatgtgtctttatggtagcatgatttataatcctttgggtatatacccagtaatgggatggctgggtcaaatggtatttctagttctagatccctgaggaatcgccacaccgacttccacaatggttgaactactttacagtcccaccaacagtgtaaaagtgttcctatttctccacatcctctccagcacctatttaattttcaacctccttttcaaacacataattttaaataccattataaatgagctgtttaatatctgaacatgtaaagtcagtaggaagattgtgttatgaatttttaaaacctaatcatttttagtcattttcgtaatctattttttcatttgttacactggtttctggaaatacactgaaagtatgctttggtatactttattattaattcaatgaaatctaatgttagtactttttaaagcctttcatgatgattctcaagattcatcttgtggtaataaaggatatttaaataaagattgctagggcttagttcctaagtagacacatttactccccattacagttacataattactgaagatttctttaaatttttacttttaaaaaagtctaatgtagcttcaaaaattaaaatttcaaaatataaaattcatatattacctcatgcatagtcagtaggtaattaagaatggcctgtaattcatcttcctttactccagaatccttcaaaaacataatacaggtatcttacgtttacatgtaaaaaaatgtttaaagagaaattatacacatagatttgtcaagttggtcagctactataaatataaaaatataatgtaatagacaatctaaatttaaaacaaaaatttggggaagcactaaagacatcagtactccagaacatgtagaggtcaattaacatcagcttcctgttttcaacaccttatataatatgacagcctacttactaaagctacagaatcctgaagtcagcaaaaataataagtaatgataacttaaaaagtaatatccacacctactactcctctaaatacagaagacatcttttcgactgaaattaaatgtggagaatacaatgaacagtttctgaaattatcaagttaaaatgtcaagtacctaaaaattaaatagtaatctcactcgggaaaagaaaaacacactgcacttctaaatatgagctcgttatgaaaattttcaacctactctatcagtatattaatcactaaaaaagctgcaatctaaaaaaaaaaaaacaccacaagaagaaaagaaattggaaaacaaaaaacagtatgcatcaggaacgagcaacaaaacaaagacaattcaaaggacactttttttaatacatggaaataaggtatctgaatctgaaaggtatactaaaagttaggttcacttgccataatcttatgtgacaactaataaagcattataaaatcatataggaaaatactgaaaaaatattggtaacaattacatttatatattgctatcttataaaaccaaaatgccttttttagaatattaaattttactttacctgtaatagaatgaaaagggacaaaatgtgaccacttctaaaggctcatacacctacctggtacatttatacagaaatactatttctcaaaatctgaatgtcagttacaaggagcctgctaaaaatgaaacctccttcaggagtttagtgccaaatactaacagaaacatagtaaatatttgctgaatgagtgaacacacttgagctactatacaaatttatataacataaaatacaactaccaatccctaattctgcaataatttacatccatataggctccaaaaaagaaccaaaacaaacatggaaatatctttcaaagtattttccaatgtgtaaccacagtaaccaagcaaagaataaaaaaaccaagattgtatttcatgtgaaattataaccttcaatacacggtatgctatggaataagcaacgtgaactcaccttcatcactaattgcttaatgaacatcaacaagaatgctcgtagagaaagcatttctttttgattaggtcgcggtccatcttttaaaaaaatatacacatacacatttagtatttaaaggacctcaaagctgtcaaagtataaaattctcattcccaacagcttttccatgtgtttgtaagaaatataaaggtaggtctcctacagaatgaccttttatgcctctagaaagacaagtgtttaatcttacatgcactgtatacacaatatttcaaacatacaaacaggttatgttgaaactactatgaagaagtttgtactttgaataggtcaaagaatgtccaaaacataaaaatgaggtaacaaataaaatttgtattcaataataatatacgtattttaagactctgagagtattagtaaggtaacagaagtttacaaagaaaaaaacaaaggaaaatctaaactttcaacattattattatatgtgaattcagtatgacaaaatttttctactgttatcattatataagctaatacagaaatctcaaaaagaatgcctcactacacgatatcattcatgaagaagggaaatattatgttaactgcctctgacatctccttctctgcttagaaaagtccttggtcacacatggctcacattaaatcaattttcatgtctcaaacatataattcccaagtagaaagcttttgaaaccaaacactcattgttctaagatcctaagttagggacctgttttctcatatattttataatttttccaccactaatcactatttatagatagttcttagaccaccaaagcataggaccaccatgactttgaacagatcaatgaaaataggaagaaaattgtttaaaatttgttccatgtgattcctagacaaaaaaaaataataagactagagttagaagaggatcacaaaatttgtccagctctctcatttgaagaatgagactttcccaaggtcactaatcagttataaaaggcaggcgagaatacaaaactagcacctaggacagtacatgatacacctacagcaccatgaaatagtcatgagaaaattctgacccggttctggatctgccacaaccttgccagcttaaaaagttcatagcttgctaaattataggtaccagattctctgaggctaaaccaagcttattttgaaagtgatataaaaagtagtatgcaaattgaaaatctttgtaaatcactaaacaaccaaagcctcttactgcaatcagaatgtatgttattgactccccagcatctatttcttaatttcaagcaacagctcttaatttttaccaagtgactgaagtcatcttcactttcagacaatgtctttcaacttaggggatgcctccatttctaagcaatcagggcaactacaaccacaaaaatgggcacatgatacaatcaaagccaatgagcaacagagagactaaaagagactttcactggaaatacattatataggcagatgctcttacactgaatttaagttgttacggatgtgaaaggggaccggctgcttgctactacaaaggaagcgaatatgtgaaaacagccaacacagaagaattggcaagtgcagtgagacaaattcagtcctatggtcatactcagaatacctttatcaagttgtatctggaactgccagtttatatgagctgattacctccctttttgatgtaagccagttccaaggagactgttatagttacaaccaaaagagccactatatgtcaaaagttttattttgaccccttatatgaactgctagacatgatgaatgaatattaccctttcagcaagttagtcctcattatgtaagaaaataattgctaacattttgtaatttcattatctctttaagagaagcagataactcctacttctgcaagaaaccaccatattcccaaaacaccattttcaaggaatctcattgtgacaatccatctcagcatcaattactaaaaactaattaagaatttcttggcattttcagtgtcttacaacaaccatcctagtcatattagctccccaaacaactcacaccagcacaagtagtattcttccacacaagtagcaagttattaaactctagaaaccacaatttaggacaaactattaacattatcaatgagattaaaataaaattttgccataatggaatatagaaaaactgcccaaatatatgatagtactggttaaaacaaaaagaaaaattaaatcctgatttgcatttgtgtaaagtaatatacagacagaaattatatacctaatccttttggggtgataccacttcgatcctgaggattcactgcccagtagtagtacttcagcgtgtgcatgatgagaagcactgttccaactctccgaatggtgttatatatgttgactgtaccaatgaattccgtggacagataagtatagagcatcagttgaacctacagaataaaaatgaagaacttagagaaccccaccagcattttatctgtttccagtaacacttccaggctgttttattttcaccacgcttcttccaaaaagtaagatgctgagcctgataataatatccatattagacaacacatactcactgacacacaagcacatgcacacacactccttataaaaccaaaccaggtaatttcttcttttatagcagcattatcaaatatggaaactttttgctgcattattccatgaaaataactttgtgattcctatttagcaatcagcaattattcctaagcatgtgtaacttctttataatagacttattacttatgctatctatgcatagttgtttgaaaaagctagaatttctttcaaatacaacatttgcagaaaatcaggagctaaaatgactcaaaagaaaaagtactagtaactcaaaaggaaaaaataaatagaacaaaaccaaaagaaagaaaaccacagaaaaagatatagagtttaccttgaagaatattagaaaaacagaattctattacagtagctcattacaagaaacattccaatctagcattttaatcataacattataatctctcaacatgtatatcatgtcccccaattaggaaaggattctactaatctcattgaaagtaaatagtctaaaaaaatacataagaagttatatatgtttatattaacttcgaaatatctcctcttcatatgtaagagaaagaaataatacaagtgctaccccaccactgcacatttcatcttaacaaaaaattggcccaccccagtgattcacgcctgtaatttcagcatgttaggaggctgaggcgggcagatcacttgaggtcaggagtttaaaaccagcctggccaacatcgtgaaacttcgtctctaccaaaaaatacaaaaattagccgggcgtgatggtacacacctgtagtcccaggtactcaggagactgaggcaagagaatcgcttgaacccaggaggtagagagtgcagtaagccgagagagcaccactgcactccagcctgggcaacagagaccctgcctcaaaaaaaacaaattttttttcagtgaaattatgggtctgaaactcatcaactataatccattacttaaagcagcaaaaataacgactgcttttgctctactctcatgttgaaatcaattcattttattgctagagggtatattttataagctgaacaactgtaagtataggatatatattcttcccttgaccatagaccaaactactgatcatttataactgaacctttatgttaccttcctggacaatgagggcattttccttttcaaacctgcaaggtacctcagtgtcacctagggatttctttagagagcaaaaagtaggtacctatcttccaggtgccctgcaaataaacaatcaaggctaaatgaattagagtgtcagtgaataaatctaacatgctaaaaagtggcaggttctgaaccacttaaaagcagggcttggaagatcattataattcacaaaaccatatatgtatctatacacatacaatacattgtgatctactgacctgccgcaaaatgttattttgatgtagctactgctgttcaaattgataggcccaatccacttgtcattgagacaatacgacatgcctcaaattcttaaccatgttatttcagtctcttagcaaatatttacatctaactatatgcataacactgtatcatggaaatacagtggcacatatgctgtccctaagtagctgaaatacagttgaaaagattaaaaaaacacttatatttaagcaaaacaaatcaaagacaataaatatgcctaccaaaacatgaaaaaagtcatgaagcaatatgtaattgagtgacatagagctatgaaatattattaattcagaggacagataaattattataggataaactgaaatagtaaagaaaagcttcactaataaagtaggcattaagataggctttgaagatgagtagtagaatagacagacagaatacaagaggaaatttcaagctagaaaaatgatggttgaaataaaggtttccctagagttagaacaacagttctcaatcttgactgcacattaaaataactgaaaaacttttctttttttttaatactgatgcctgagtcccatcccagtgaggcaggagaatagggtctggaggcagcgaacctaaggacttcctagaactaaatcaaatggaaatgctacagctatgacaggaaatatcctctccatttacatagggcatacaccgagtaaatgactttgtaactttactgtatcctcttcatttacatagggcatacaccaagcaaccaatggaaacctctaaaggttatttaaaccccagaaaattctgtaacagggctcttgagcccctacgctcaggcctgctcccacagtgtggagtgtactttcattttcaataaacttctgcttttgttccttcattcttcccttgctttgtgcattttgtccaatcctttgttcaagacaccaagaacctggacactctccacggataacaccagattgatgaaatcagaatctgcagtggaagtggtgggattctatttttgcttgtttttaaaaacctaccccaactgattctatcagcagtcaagactgagaaccaccactgtagggaaaccttttggtacctccctatccactgaggatatttccatttttaagctagaaaatctagaaataagaattgacatgaaatccttagataaaggactaactacttcgttctgagaacaatgggaaaccattaaaactgctggggctaagaaattataagagtcatatgttaggaaaatattggcgttgggcatggtagctcaagactgtaatcccaacactttctggggctgagagaggaggattgcttgaggccggaagttcgagaccagcctaaacaacaaagcaagaccctagtctctacaaaaaaatttaaagagttagctgggaatggtggcgcacacctgcagtatcagctactcaggaggctgaggcaggaggactgattgagcccaggagtttaaggtcgcactgagccatggccatgaaaagaacatgttggaattctggcagaatagttataagttagacaaagaaatggaaaactggagaaagtcagtctattgagaatgatactgtggtaaaagaaaaatgaacagaggctgggcctgatggctcacacctgtgatcccagcactcttggggggctgaggcaggtagatcacttgagcccaggagttcgagaccagcctgggcaacatggcaaaacatcatctctacaaaaaaatacaaaaattagctgtgtgtggtggtacacagctacagtcccaactactcaggaggctgagatgggaggatcacctgagctggggaggcagaagttacagtgagctgagatcccaccttagtgacacagtgagaccctgcgtcaaaaaaataagtaaacagaatttagtagcaacgtatagagatgaatgaaagacctcaagattactcatatgctaattatgaataaaccttccctcattcactcattatgtactccaatagccacacaaattgtgtgttaacatctgtctttcccactaaatctaaattctatgagggcaagtatcaagtctatcttgttcatcaccatatccacagtgcccaccataaagtagtcactcaacaaatatttgttgagtaaatgaaggaccatggtagacaagaaaattcatctctcctgctaggtcattaaaaagatgttctctgaacagatctaagataaatggaaattataaatcgctggtagctcccttttccaaaagcaaagcttttcacatccacacatccagaccttcaacttttaaccagaggtggattgaccacgaagctgataaagcttcaactttatgaccactgatctataaatgtttcttccaagaccctaaacctaattttgtatgcattatattgtattcttcttcttaaaaaatttcccacatgataaacatttgaccttcaagtcaaacaaaatttggatctgcccttttttatgactgtctttacaataaaataaaagcagataaaaccccttgtggatacataaagcagatggctaaaacaggagaaaatgctaatattatcaactcaactgcaaattctaaaaaggaaattgagaaaagttattaaaaagtagaagataagaaatagagtataataatactaggaaactaagaaaatcataagatgaattttttttaattcccctccaactaagtatctaataagaggctttctgaccacatcaaaagagacacaaagccttacaaatatgctgattagtaagacaaaaaagtatctagtaaaagattttaaaagtaacttgaaacaatcctcaaaaagaagtaagactgagggtcatggaagaaaatgaggtcaaatttgacctggagataaaaagctacaacctccaactgcctgtttcgattatttccaaatggcaatcagagtcagcagctgtttttctctttaacatttgaaaagaccagctgaaaataaaatattaagactctagaaaagcaaaaaagtctgcagacttttttctgacaactagaataagtaggtgctattccaacttaaacaatgataaacactgcaagtgggccaaaaggcagaaggggagagaggaaaactgggcttgaaataacacgacttctaacaaaaattgtagataagacggatacaattatgcaatttaataaaatgatctgtttcaagttatgcttaatactgccactactgaatttttaggacaatgtattacaacactaggatttattaaagattttgttcatataccttaccacaaattcatttacattcacatagaactaattggtttgttgttacaaaactgaaaaaaaaaatttgtacaaatgttttcataatttgaattaacgtgaaattaaaatgattacgagactagtatatcatgccttcaaagaaaaagtgacatttcagtggtacctataagaatgaaactcagtagttcatcatgttggaaggcaaaagtgtgaagtaaaaaagagagagagcaggagcagggtgagttcttaagaaataaaaaaaaaagaaaaaatatatatggatatttacaatggaacaaagctacagttactaggaaacattaataattacattaaaactgtctaactttgatttatatttagtaaatgaagtctctcccaaataaaactttatttcatttaatttcagaaaacaaagactatacctgtatcttttaaaataatgatattgtttacaaagaatatattctttgtatgtatgtatatattatttgtatatattcatacacacacacacacaatttgcaatttttcctgaagagtaaaaaaggatgcttagtcaaaaaaagcaatccactgaagtcttgcataatagtacataaaaaaaagaaaatcctcttaattatcactctcctcacgcacaaaaacagcaaagatagtaaaacaatatcaatatatagatatatattaccttggctggggtatgaatccatatggcaggattaagaagaacgtgatcacacaattgcttgagcaggggcatcccattctgcagattactcagatattttgaaaatgcaaggcaaagttcaagtactgctctgctaacatgagatttggaagactgcaaaaaaagtagttcaaatgttaccacaaattcaagtcaaagtaagtgaattacaggctgtccctaccaggaaaaaaactggcccacaaattatgctcaaagttaaagatgccatgaagctcactatcacatttgtttgatagaggaatggaggcaaggtaaaacaacaaaatgttattttagtttaggtaattttctgtaaccaaggagacattcttgcagacagaattccttagccacttagagaacaaatgtatggcctgtaaattaagaatcaaaaacataaaatatttcatactttaccttttcaaggctatatcctattaccaagaagcccttacaggcaagcatctgttcctgcatagcaattgagttcttcaacaattccatgataaaggccagcaaggttgaactagaattttttaaaaaggcgatgattaaaaaaacatattctattttttttaaattaggttagatagatgtaacccttccattcaccttaataaaaagttctccatttcaaagaaattgaagctccactaaaactgcttccaacattacatcagaactagatttttaatgtaggattaggagttactcagatatttatttcatatactttatctcaaacacattgataggtgaattacttagaaacaatgacaaatgttcatgatatagagaaaaatgagcaacttccaaaaacaaccaataacaaatacttattaaaaatacactaaggccttaaagaacagatataacttagataagcaagtatattcaactttgaagcgttaggggccaaaaggtgagaaaagacagtggagcaaacagagtaaggtgtaaatcctcaaaatgtgttagggctccagacttgcatagtctgaatggagcagagggcacatgaagagaaagatgagacagttaacttggaggcaaacttgagctccttgaacactaatttaagaagtttgttcattatcccaacaacaaaattgtaattctccagtcagtctcgaacacttttaaaactgaataggggctacagccatgctctactacctacaatttttaaagatccccggaaaggaaaggaaaaagatcagttgttactgccttctcagagagaagtcccacaaaacaaaaaaaaagagagagagagagaaagcatgaccagcagccaatctcctcctccacatcagtgctttcactgccagcaatttcaatacggggggaggggggagggagagggagaggggagggagggaagagagaagggggggagaggggagggagggaggagagaagtgggggagagggggaagggagggagggggcagagaggggaggaaggggaagggggagggaaggaagggagggagggaggaaaactgtaagtaaaccctgttagaacacagcacaaaacaattccataaagtattaatatgtcagggtaatttaattttatattttttaaaatataagttgacaaatactagatttgataactttttatttttaaaaaaattgttgcctgaaaataatgaggacaattaccattattatacacactggtggcagacatcaagttatgtataaaagcaaaaatcaaagggagaatttcaaaatgagagaatgtaaaagtatttaaatttctcaagtaacaaatgaaacaataatttcaatacaaatgaaacaataatttcactatacattgtttcactagaatatatagccatgagaaattgagactcctttcctacattttatgacttaccctataacttatatccctttcttttttagactcaggactacaacacaagagacaaaaatgtgctaaatgtacaatctaatttttttcaaaaagactaattcacttcgataacactattaaaattttgacttccaattacataaatgcaatcagtaataaataattaaaatatgaaaagttaagttccataataaatcattaccaaataattttaaatatttcagaaattaaaaatttcttattgcattctgagtaatgggtagtaaaaaaaatttttaatttagacaaaaaaatgtatttatttttgagtaacccattattgccatttataatgttattctaaaaccaatttattgtgtttcttacagcttccatatttcctactgataaacaagaacttaagttaatactgacataattaatatggacttgtaatacagtttatagttcacaagtttaaattattttgacacaacaaaacctgaaaggcaaaatattgtatagctcaacagtgatgaaattaaccctcacagccaattaaagaaacaaataaaggcactcaccatatagtcaaatcaatctcatcagacaaatattgcctgtaatccaactgtgcaaaaagtggaaatagtacttgtactcctccaattgaatgcattgcactttggatggaatgtgttaaaactgcctttacatccttgtaagatcaaaaacacagtaaagagttcaatgattttttttccaaaacaattaaaaataaggcacaacaataaatgcagaaacactataaacgtgacattccatgtgtttaacagaagctaccaaatacatctcaataacacatcaaaaattaccattataaatgttcttaaaagatcacagttagtacctggagcatgagtgcatgtggtgaatgaacaaaaattgaagggttgtccttaggagatgattcaagacaaagctgggcatctgtagcccgtggattgtacgtgaatgcaatggcactagagagtttcccatcgtacaataaaagtttgtgatgctcagcaaggaaaaggtcgctttctgctttgaatttaaatgtaccctaagaattaattaaaaacagttaaatagtatgccacaaagagaatctaagtacaaatcaacacaggtgtaaaactttaaggagacagaccattgataatcttttaacagtattatataagaggacccctcgtttacttctaaaattggctgaatttaaagatataatggaaatcaagtcaacttgacattaaaaccttaccttaaaaatgtagaagtgaccaatagatcatattttatcttttttcgtatattctttttttaaaattgtgatcaaaagcatataatatacaacttaccatcttaagtatttttaagtgtataattgagaaacattaactgtattcatattgttcaacagcaaatctctagaacttttatatcttgcaaaactgaaactctgtagccatttaacaactccccatttcctgctccccaccagcccgactatcacaattctactttctgtttctatgagttggactcttagatacctcgtataagtggaatcatacagtatttgtctttttgtgacccaagcatttcatttagcacaatgtcttcacagttcctccatgttttagctgatgacaggatttccttgttttttaaggttgaatatggtcccgtgtgtttatgtgtgttgtctgtcacattttctttatccattcatctgctactggacatgtgggttacttctatctctgggttatcgagaatattactatgaacatggatgggcaaatatctccttgtgaccctattttttgtgtgcaaatacgtctctgtgatcctcttttcaattattttgtatatatcccataagtgagattactggatcacatggaagttctatttttaattttttgaggaacctcatattgttgtccatagcagctgcaccatttttcattcccctcaacagtgcacaaaggtaccaatttctccacattctcaccaacacttgttattttgttttcttttttaagtagtcatcctaaatgatgaggcaatagctcgctgtagtttaaattagcatttttctaatgtctagtgatattgagcatcttttcatatgttcattggctatttttatatcttctttaaagaaatgtctactcaactcttttatgcatttttaattgttttgttattgttgttgttgttgagttacaggattcatatattctggatattaactccttatcagatatatgattgctaaatattttctctcactctgtaggttacctttccactctgctggatatttcctctgatgcgcagaactttataactttgacaacatcttatttgtctgttttggctttggttgcctgtactttcggtatcacagtcaagaaatcactgccaaattcaatgtcgtaaagcttttcccttgtgtattcttttaggagttttatagttttacatcttacttttaggtctttaatccattttcagctcatttttatatacaatgtacaatatgaattaagtataaaacttttctttcttatttttcgcatctggatatccagttttcccaacatcatgtgttgaacacattgtcctttccccagtatgtggccttgcctcacttgtcaaagatcatttgaccgtatatgcaaaagtttatttccggacactctattgtgttcccttggcctatgtgtctaagcaagtctaacgttgttttcattatgtatcatagccttgtaataaattttgaaaccctgaagtgtaaagcctgcaactttgttcccctttttaaatactgttttggcttctgagaatcccttgagattccacattaattttagaattgtgcttctatttatgcaaaaaatgccattgggattttgataagaactgtactgaatctgtagattgctttaggtagtatggatttttagcatattaaatcttccaagggatgtctttacatttgtttcggtctcttaaattttgtcagcaacattttgtacttttcaatgtacaactcttttgcctccttggtggagtcagggtacagctcttttgccaccttggttgagtttatttctaagtattttatccttgttgatgctattgtaaaagaaattgtttgcgtaattttcaaactgttcattactacttcattattactaatagaaacacaattgatttgtgtgtattgattttgtgccttggaactctgcagaattcatttactagtcctaacagttttcagtgaaatctttaaggatttttagatataaggtcatgccatacgccaacagatgattttacctcttcccttccaatttagatgccttttctttttcttgccaaattgctctaactggatttccaaatactatgttgaatagaaatggaaagaataagcatccttgctttgttcctgattttagaggaaaaactgtcagtttttcactgttcagtattgtgtcagtcatgggcttttcatatacaatattttattatgttgaggtagtttccttctattcatagattgttgagtgttttaggttttttttaaatcaagaaagagtgttgaattttgtcaaatccttttctgtatcagttgatatatgatcatatggattttgtaattcactgttagtgtggtacattgcattgactgatttccatgttgaaccatctttgcattccagaaataaatcgtaatttgacattgtgtataattcttttaatgtgctgttaaattcaatttcttagtattttattgaagatttttccatcaatattcatcagggatattagtctatagttttctttcttgtactatcttgatctggctttggtatcagggtaacactggcctcataaaatcagtttgaaaatgttccctactcttaaaatttttgtaaatttgaggagaattggcattaattcttctttagatgactgagagcattctccagtgaagccatctagtccctggctttctttgttgaaaagttttttattattgattcaatctccttactagctataggtcttttcggattttttaaatttatttttgattcagtctcagtaggatgtatatttctagaaaattgtccatttcttctaaattatccgatttgttggcatatacttttcatagcattctcttataattctttctatttctgtggcaagttataatgcctcctccttaatttctgattttacttatttatgtgctcttcttttttccttagcctatgtaagaatttgtcaattttgctgatgtttaattaaaaaaaaaactgttagtttcactgatttttttctcactgcttttctattttctattccaggggtccctaaccaggtatatgacctgttaggaacaacagcaagaagtgagcggtgggcaagcaagcaaagcttcatctgtatttacagccactccctaccactcacattactgcctgagctccacctcctgtcagatcagatttttatagaagggtgaaccctattgtgaactgcacatgcaagggatctagattgtgtgctccttatgagaatataatacctgataatctgtcactgtctcccatcacccccggatggaaccgtctagttgcagaaaacaagctctgctttgtttcccactgattctacattatggtgagtcgtataattatttcattatatattacaatgtaataataacagaaataaagtgcacaataaatgtaatgcacttgaatcatcccgaaaccatccctgctgcgcccccaccacccgtggtccatggaaaaactgtcttccatgaaactggtccctgggaccaaaaaggttggggactgctgctctatttcatttatttctgctcggatttttatcatttccttctatctgctaacgttaactttatttgttgttctttttccagttccatgttgtataaattaggttgctgatctgagatctttcttttggtgataatgatcagtcattatcaccataatcttctctcttagactgaggtcactgaatctcgtaagttttggtaggttgtgcttacattttgatttctctcaagatattttctaattttccttgtgatttatctttgacccaaaggctgttttaagtgtgttgtttaatttctacattaaacattttctacattaaaaacttggtggactttccagtttttctttggcaactggtttctagtttcattttattgtggtcaaaaaagatacttggtataatttcaatcttaactttgttgacacttgttttgtggcataacacatgtctatcctggagaatgttctgtgtgtgcttaagaaaaatgcaggtcaggtgcagtggctcacgcctgtaatcccagcactttgggaagccgaggcgggcggatcacctgaggtcaggagtttgagaccagcctgaccaaaatggcaaaaccccatctctattaaaattacaaaattagctgggtgcagtgccacatgcctgtaatcccaggtacttgggaggctgaggcaggagaattgcttgaacccaggaggtggaggttgcaatgagccaagatcatgccattgcactccagcctgggcaacaagagcaaaactccacctcaaaaaaaagaagaagaagaagaacaatgcacattctactgttgtttcatcgagtgttatgtatactactgctaaatacattgggctgcattgctgttcaagtcttctgtttacttattgatcttctgtctggttgttctattcattattgaaagctgaatactgaagtgtcctactataatggtgttgctatctacttcttttaattctatcaaagtttgcttcatatatttgagagctctgatgttaagtacatatatttgttctatctttctggtgaactgaccctatcatcataaaatgtccttctttgtctcttttgacagtttttgacttaaagtctattttgtctaatttaagtaagctactcctactcttctctggttaccatttgcacacatctctttatttgtgggtacattttaggtgtatatatttatggggcccataaaatgttttaatacagtcatgcaacgtgaaataagcacatcatggagaacagatatccatcccttcaagcatttaccaatttagttgaaaaccatccaattacactatttcaaaatgtacagttattattgactatagtcaccctgctgtggtatcaaatagtaggtctcatttttcttttttttttttgtatccattaaccaaactctccatgtataacccaccttcaaatcaagctgaactaacattggttaagcacaaaacagtaagcaaactaccttgtatcccaggcccaactgataaatagcaaatatctgagctgcatttagagcttcactgaaaaggtaaactgcagtcatctgaccacagaatactctattagcatctgctgtttctgatgagcccaggaaacatttgtcaaaggtctgtaaaagaaaaaaaaaaaggaattaggaaaaaacaaaaaaaaactccagaaataataaaaacctatattatcataaatgttttgtccattctaaactgtatctaaatagactaacataatttataccataaaaccattagaaagaatgttgaaaaatgtgtatgtaatgacattaggggatatagaaaagtttgaaacacatgtgttctcaagccaaacaacctagatcaaatccctgcatcctatgccactgagtatggcaagttacttaacctctttgtacttcacctatctgtaaaatgaagattataataatgcttatcttgcaaggttgctggagctttttgaaaataaagctatttattacaatgcctggaatacaaaaagcactcagtaaaagttaatgtaagaaaaaacaggttacaaaacaatacttacatatgagcccttttttgtactaaaaaagagctaacattgagcactcattctgtataaggcgcgctgctaatagatttatggatattatctcatttaatcagatgacaactttctgaggtatgaatattttatgtccattttcaggaggaaaaatgctaaggcctaatagattaggtaaggtcatgcagtcaataaatgacagagctgagattcaaacctaagtctgtctgattcaagaccctgatctcttgaggttagcattacaaaatatgtatatatgtgtagcaaaggatatgaaaagaggagttaatggtgtgtgggtagtgtactttatgttcattttcctggtatttttcaagtttttataaaaagaacataattacaggaaaaacattttaaatttcattctaacctatagatttatttttgaaacctgtaaacgttaacaacatactagttaactatagcagttagaattatatgcaagatttataagcatgcatcatttaactcattcagaaaaatgatcagaaccctatagtggagctcttgttcattttgataaatgaaccaatgacccactccccagatatagccactgttagctataaatccttatttctacctatatggaatgattttataacaaggactaatatttcagtgacatattaagttctattaacatgctagccaaattatgtttataaaaatctaccattgtaatactttgaattttatattcaagttgtaaaactttttcttgtttaaaaagctcatgcttttaaaatcacttttttcattgcaacattttgaaactacttacatcgctagtgttgacaaaccatgttatctctccataggaagccagctcaccattcacataacatcgaagttcactattcttccatcggttatagatgtgtactatggtaaccatataccactgcagaagcaaaaaacagttaaaaatacaaagataacaattatcccaataacgcaaccatactgatgagtaaaagttaaatgataagttgtaattcaacctaaaaataaaacaagactacctttgttaaattcaatatttactttctggaacaatatctattcatgggcctttcaactgataagaacttaatcactagatcatttttccagctttttattatggaaattttcaaacataccccaaaaatctgaaaatcaagtacaaacaccccctttttccaccaactagattccataattgtcaattttttgccatatttgcttaatctatctgactacctatctacttatacattttgttgatgaaccatttattaacctctaaattttaaggtacaaaagcaaacacatattaaatttgcaatactaaaataaatgccgtagatatttcctacttgtatctcccttaatctccataaataactaaatttgcaatctttttcatatccaaatcagagaggtcaattattcagtgatttacgcttcatctttttaaacagtaaaaacgaagttgtgctttagcatgttattatatgaataacattaaaacaaagcattttgatgactagcatagcttgttaacataactatgactcaagaagatcatgtaccttttgtggcttgaaatcaaatttcacacagtgttgaaagccttttccttttgactttattgatgttacaatcaaacagcctccaacaaaatgagcagaatagccaagacctttgctggttctgaaactataaagaatagttttcattttacctctaaatattcttctcagtttcaaagtaaggttttaacactaatcagttacagaaatacataccaatacaaatatggtttatccttatctacattgatgttatttacaggatccattctaagccatgtatgaaatgtaaaaccattctggtatggccatttggctataggaggtaatgcaatagcctaaaggaaagaaactttgagttattaactcacgtgaaaacctgtcttattaaaatcatgaaaataagactttgcaatgctacatatatttgtactacatcacattactttatgtcacaattaaaatatctgaggccgggcgcggtggctcacgcctgtaatcccagcactttgggaggccgaggcaggtgcatcacaaggtcaggagattgagaccatcctggctaacacggtgaaaccccgtctctactaaaaatacaaaaaattagccgggtacggtggtgggtgcctgtagtcccagctactcgggaggctgagacaggagaacggcgtgaacccaggaggcagagtttgcagtgagccgagaccacaccactgcactacagcctgggcgaaagagcaagactccatctcaaaaaaaaaaatatatatatatctgaaagaagactctttatctggaagaagactctttatcaggaagaagacttttagtaactttttaattttccctaatacatagtaatgttaattaaatgaaaaaaaaattcagtgtaacctggacacatgaatcttgtattcttcatttcttaaaatgaacgtatccacagagattctaattaaaagagataggaagtgataacaaattggaaatttgatgaaattttaaggtattagaatagagaaagatggacaggaatggaaagagagaagagaaaaactgggtatatgctgcttttataaaactacaaatataaaactgaagaggattagttcataatatttttaaattatattcagaagtcaatatacaaatggctttaccgcttggtttagatttttatttaaaagatcatactacataataaaaggatcttgtatagccaaaacaatcttttaaaaagaacaggccagatacggtggctcacacctgtaatcccagcactttgggaggccaaggcaggcagatcatctgcggtcaggagttcgagaccagcctggccaacatggtgaaaccctgcctctactaaaaaaatacaaaaattagccatgcgtggtggtgggtgcctgtaatcccagctactcaggagggtgaggcaggagaattgcttgaacccaggaggcagaggttgcagtgagccgagatcatgccattgcactccagccagggtgacaagaacaaaaatctgtctcaaaaaaaaaaatgaagaagaacaaagttagaagactcatactaccatttcaaaacctaccattaatataaagcaacagtgatgaagactgtggtattagcataaggccctggtgtcctttggttaggcaaatccttcttattatgtcaccaaaaggacaagtgacaaaagaaaaaaatatatacattggactttattaaaattaaaacctgtgctttaaggaacaccatcaaaaaagtgaaaagacaagccacaagaatggaagtaaacatctgcaaactgaatacctgataaaggacttgtaaccaaaatatataaagtactcttataactcaataataaaaggacaagtaaaattttaaaatgggcaaaagatctaaatatacatatctccaaagaagatatacaaatagccaataaaaatataaaaagatgctcaatatcattagtcataaaggaaatgcaaatcaaaactacaatgagatatcacttcataccaactaggatagctactaatacaatcacaaagacagatactggccgggcacggtggctcacgcctataatcccagcactttgggaggctgaggcaggtggatcacttcaggtcaggagttgaagaccagcctggccaacatggtgaaaccctgtctctactaaaaaatacaaaagttagctgggcatggtggtacacatctgtaatcccagctactcaggaagctgagacacaagaatcgcttgaaccgggaggcagaggttgcagggagccaagatcacaccactgcattccagcctgggtgacagagcaagacttcatctcaaaaacaaacaaacaaaaatagacattaaccatcttagcaaggatgtagagaaatttgacccttatacattgctgtgggatcgtaaaatgttacagctactttggaaaacagtctggaagttcatcaaaatgttaaacaaagaccatatgacctaatctagagattgggacaaattaaaacatatgtccacacataaaattgtacactaatgtccataacagcattattcatactagcccaagaagtgaaaatcccaaatattcactagttgacaaatgattaaataaagtatggtatatccatacaatataataccagccataaaaaggaatgaagtactgatacatgctgtaccatggatggaccttgaaaacattatgataagtgaaaaaagccagtcacaaaagaccagatgttgtatgattccactaatatgaatggtccagaatagggctggggaatatggggagtggctgctaatcagtatggggtttcttttgggtgtgatgagaatgtcccaaaattgactgtggtgatggttgacaactctgtgaacacatttacctactatactatatactttaaatgagttaattgtgtggtatgtggattatatctcaataaagctgttttgtaaaaaattcaaactgcacaagtgtctgttttattgtaacttacatatgcatttatgtatacatattatacatatattcttttatatgtattagataagacataaaacatgaaagacatcatagagccaaacttcagtaataacactattgagacttcaagagtgaacgttgcattaaacgttgcattaatgcaaaaatgaacgttgcattaagaaaaaaggaaaagaataattacaactcacagactgacaaaaaaaaattttaggagaaaaacatatattcagtgcgtacacatgttctctctcaccaaaaacgatagcaaagatgtaaaagctttgcaaaaatactttattcatgactactttaaattcccagtaaaagctatgtttaaggaaaggaagtcactaaacatatttaaaacatctattctcttcaagtttcaaaagctgttcagctcacctgccctactttcaagataaatgcatgcactgcaatctcagaactgtaaataataaaattataacatgaggcatgaaaaaggttaatctcataagaacactttttttaatgttagaggcaatgataggctatgataagaaagtaaaattattctgaaaagctacaaatctaaaatcgactgtaaggaaaaactgtaaaggaaaaaattgggcaataaaacttttcaaagaaagttgtatattgtgtatataacatttaaatatcacaaatgtcatattaaaacatattcttatctttctgcagatactgccaggctacacagggcctaatataagattttatgagaactaacataaaaaaaagaatgaaagataagctcaggaaaagaatagactgaaatatcttttttaaaagtttgtcttgggccgggcgtggtgactcatgcctgtaatcccagcacttcgggaggctgaggtgggtggatcacctgaggtcaggaattcgagacaagcctggccaacatggcaaaaccccgtctctactaaaaatacaaaaattagtcaggcgtggtcgtgggcacttgtaatcgcagctactcaggaggctgaggcagaagaatcgcttgaaaccaggaggcagaggttgcagtgagccgagatcgcaccactgcactccagcctgggcaacaagagcaaaactccatctcaaaataaaaaaaaagtttgttttgcttgtaacagactgaccaatgtaataatgaggagattttagaaacttccataaataacatatatacattatagaatgtgcttctataacattacgaaacattacagatatcactattatacataattgtcttatgtataaactgattaacggcttacaggaacactgagaccaacataatttggaaactcacaagtcaaggaaaacttgcgtagtaagtttcagagcctctatttcttcactatcattctatacacaaggtacaaaaaaaaagacaggtagagtaatgaaaggcaagagaaagatgttcacaaagatagacatgaaggtgttacacacaaatagctacttaagacaacatggctatgtttaaaagaatgaggttcttattccattgctgacccaagctgtgactgggcattttctcaactaatttaagcctctatttcttcacctctaaagcaattacaaaaaagtaacatgcacgactatcataaggattaaagtatgttgagcagaagtttctacctagcacagaacctgtcaggggtgttcacagggctgtactttcagggagcaaaggaaagaagaactgggagtgatttcctcattaatatttacttactgcagcactctttcctggaaagttaaaaaaggcatcaggaccatacttctgaggcatatgctttaacacagacagcaacttcccagcatgtggaggctatgaagataattaacaattcattaaccacattatttaccataagataaaaaaaacacatctttaatatagtcttgctgtaatatatacaggaataatgctataaggttaaaagcatagaaaataatttctaagttattttcaaatatcttaaagaaataatgtactctacaccagtttttgtaatgctgtagggcctattaggtattcaataaatatgagccagtatcattagacacctgaaactcttctccaagctgcagcaaaaatgatcttttttttttcttttttgagatggagtctcactctgccacccaggctggagtccatgtgcagtggcgccatctcggctcaccataaactctgcctcccagattcaagtgattcaccagctgagtagctgggattacaggtgtgtgccaccacacccagctaatttttttttctttcgagatggagtctcgctctgtcactcaggctagagtgcaatggcatgatctcggctcaccgcaacctccgcctcccaggttcaagcgattctcctgcctcaccctcccaagtagctgggattacaggtgcacgccaccacacccggctaacttttgtacttttagtagagacggggtttctccatgttggtcaggctggtctcgaaccaacctcaggtgatccacctgcctgggcctcccaaagtggtgggattacaggcgtaagccactgtgcccggcctatattttttgtatttttagtagagacagggtttcaccacgttggccagactggtctcaaactcctgacttcaagtgatccacctgcctcagcctcacaaagtgctgggattacaggcatgagccaccacacctggccaaaaacgatcttttaaaaatataaactacatcaatcccccacccacccttctttaaaattaaaaatacttaataatttaacaaatacttaaataatgcttactatattccactgttaaaggtacttcaaaaagatacttgcacatgcatgtttatagcagcacaattcacaattgcaaaatcatggaacctacccaaatgcccatcaatcaacgagtggataaagaaactgtggtatatatatatatatatatatatgatggaatactactcagccattaaaagaaataaattatcagcatttgcagtgacctggataagactggaaactattattctaagtgaagtaactcaggaatggaaaaccaaacagtgtatgttctcactgatatgtgggagctaagctatgaggacacaaaggaaaaagaaagatacaatggactttggggacttggggtaagagtgggaggcgggtgagagataaaagtctacaaatatggtgtggtgtatactgctcaggtgacgggtgcaccaaaatctcacaaatcaccactaaagaacttactcatgtaaccaaatactacctgtaccccaataacttatggaaaaataaaattaaaaaataaaaataaacatttcaaaaaatggtacttcaaaaacactaaaatattttaacctcataaccaccctatgggatggtattattatgattatccgcagtttacagaagaagaatctgaggcaggggaacatttccaaagtcacatgggtaataactgtcaaggtcaggatgagaactcaatcttgactccagagtccatgcttttaaacaactatacagatgctcctcaacttacgatagggttacatcctgataaacccacagtaagttgaaaagaatgtaaatcgaaagtatgtttttgatccaaaatattgtcaacttaagatgggtttagccggaggtagccccatcctaagtgaaggagtatactgaatgcatatcactttcacaccatcgtaaagtcaaaaaaaaaaaaaaacaactatactttcaccattaaaatagggaccaaaacctttaacatggactataagatactttatctacttctttagcctcattttgcttcttactctccccttctccctgcactccatccttttttcagtcttcttcccacaacagggcctcagcaaaagctattccttatgcttaaaatgttctcaaaaggacccctgtactcccctcttatccaagtcaatcttacccagcctttagagctcatcttaacagtcacttcctcagggtagccttccttgaaactgagagtggattaaacttccctatcatatttcattctacaatatacctttaccgcatagcatataaatatatgtatacgcatagcatatacatataaaagctgcaacgctgagtttatttgattaatgtttccttggtccacaagtctctaatacatgaaacaaccaacaataaaaatgaaaaatctcatttgcagttacaaggaaaaacaaaagataatcagacatactatctcattttaatcagtttataaccaaataagaaaagtgtggggcattcctccttgttaaaaatgtaaaagttcaaaacagggtcaaactacaaatgaaatcattggtttgccttcatcttatttttatagatgatataaattataattactacctgtgtaaaagagtttggcaacctttcacctaaatattaagtggaagcttcattcttaagtgaacaagaaattttcaattaaccatactgctcaattgtaaaagcataataacaagtaactacaatcacagtgattttttaaaataaattccaaagtaaaataaagtaaccaaaaataactctgcagttaaaaataaaaatacagtattatagcatgtccatctagaaacatcattcctccaaatttcctttcctataaatcagtcaacaaaagaatacattaagataagcactttacttgacagacattgctgggggagtgtatactgtactggtaaagcctttcagaaaaaaatttagtagaccaggcacagtggttcacatctgtaatctcaacactttaggaggccaaggtggagggatcgcttgagcctaggggtttgagaccagcctgggcaacatggagaaactccatctctagaaaacaatacaaaaattagccaagaatggtggcaagtgcctgtggtcccagctgcttggaaagctgaggtgggaggattgcttgacccaggaggcagaggttgcaggcagccgagatagcaccactgtactccaacctgggtaacagagcaagactctgtctgaaaaagaaaaagaaagaggaaaagaaaaagatgtagtagtcatatttcaagagtccgtaaagacgttcatgtccaccaatgcaatatttccacatgtaaaaatctatgctaaagtaatcaccacaagggcagacagagatttagatatagggattttttcactgcactgctataacagcaaacgatagaaataatatgcctaatattaaataactaaataaacgtaatgagtatctgagcaaggccttgctctcattttataaatagttcattattttttccctttatcatctaaaactattctcattctcctccccctccccataggcaactatattaacatgtttaatcttttttatgtagattattccttcaaaaataatgtttggggctgagtgtggtggctcatgcctgtaatcctagcactctgggaggactgcttgagctcaggagtttgacaccagcttggacaacatggcaaaacccagcctctaaaagaaatgcaaaaattagcctggcatggtggcacatgtccgtggtcccagctacttgggaggctgaggtggatctcttgataccaggaagctgagaatgcagtgagccatgatcacaccattgcactccagcctggatgagagtgagaccctgtctttaaaaaaaaaaaaaagaaaagaaaaaaaggtttttatgtgcttacacttatcattgctttctttcctatatattttacatctattcctattactccatgtactgattctgttatagaacaatctaccttctatacattttaccaatccactctcttaatgatgaacatccatgttaacattcactgccatcaaaaataatgcttcagtgaacatcctcatgtattttatggatctatgtgagaatttcttggaatacgcactcagaagtgaattattaaatcactggatacaggtaaaattaacatgactaagtagcactagactcctcttgaggttggctccactggtgttcattctaatgaaaagcgcaccaagtataaaataaccctatatcccaaactatacttgccattttccaactttaaaattcttgagaaactacagatggaaggtgacaatatcaatactgttttaatgtgaatgtctctaattattaatgattttgtgttcatttggttgtggggtttctacctctgtaaataaatattagttcatattatttgctattttcttacctataattttctatgcttatgaatataataaaaatacattacatattcagaataaataatgtgaatataaataaaaaccaaaatcaaatatatactttctcttctggacacgacatattaataggacctggacttaccaacctaccataaacaactagaaaagtgggcaaaatgtatcaaacaaaaacagttttcagtatgcaggaagaggtagctcaagactgtgttccctgagaaaacaaaatgacttaaacctggagtcaatttccatatcattgcacagggaaaccaaacagaacccgaaagtctcagtgagttggaaagaaagtggagtccacagaagatagaagtttcagagaagaatactagggaggaaagaactgaacagacaagaagctccagaaatctgcattgactctttgacttaataccagactgatcatgcttatgataaaactcaacatggtggggctaagatagtaagagctttaagttaaagaattcccaaaactaatacagagctaggaattgttgagaccctactagacacttcggagagaccacagtcttgctacctcctgtcctatgtctgagacttgagagttattcaatagagaccctctaagagacacgcctgaatagtaaaactaaactagccgtagcgtaacagccactctaaaccttactggaaaaaaaacttttaaactagttttgaaggataaagttgatccacaaataacttatctgcctacaaaaccagtctaacaatcttaaaaggaatatgacaaaatccaacactcagcaacataaaatttgctatgtctgatatattgtctaaattcagtagccataagcagcagaaaaatgtgacctacataaaggagcaaaatcaatgagtaaaaaactgacctagaaaatgacattctagaatgaaaaaccaagagcattaaagcaactattcatatgctaaatattgtcaaggatttaaaggaattaaatgagggaaaaaatggaaaatatttaaaagaaccaaatagaatttacagaaagagaccaggcatggtggcttatgcctgtaatcccagcactttgggaggccaagacgggtggatcacaaggtcaggagttcgagaccatcctgaccaacactgtgaaaccctgtctctactaaaaatagaaaagttagccaggcgtggtggtgtgcgcctgtaatcccagcaactcaggaggctgaggtaggagaattgcttgaacccaggaggtggaggttgcagtgagcagagatcgcaccactggacgttagcctggcgacagagcaagactccgtctcaaaagaaagaaaaaaaaaaaaaaggccaggcgcggtggctcacacctgtaatctcagcactctgggaggccaaggcgggcagatcacaaggttaggagatcgagaccatcctggctaacatggcaaaaccccgtctctactaaaaatacaaaaattagccgcacttggtggcatacgcctgtagtcccagctacttgggaggctgaggcaggaggatggcatgaacccgggaggcagagcttgcagtgagccgagatcatggcactgcactccaggctgggcaacagagcgagactctgccttaaaaaaaaaaaaaaaaaaatttacagaaagaaaaatatactatctgaaatttcagtggatggaattaacacactgctgaagaaaagatcagttaacttgagactacagcaataaaaactatctaaaataaagcacaaaaagattaaaaaaagagttaacagatcccagtaacctgtgagaaaatatcaagaggtctaatatatctgtaattggagtcccagaaaagacaggaagcggggacaagaagacagtatttgaagaaacaatgactaaaatgtttccaaattttgtgacaattatcttatacccccacagaagcaaaaactctaagaagataaacacaaggtaagctagaaccagaaatataatcaaattcaatgaaaattagtaaaaaaaactaaaattagacagtaaactggagtttgagagaaatatgctaaagaatctaaattttaacataatgaaaaagagtaattgtagggcacagttttagatacatttaatgaaagctagattaaggatcagctggctgagctgttgctgtgggcaatgatctctaaagggcactaaaataagattggaaatgcaacaaaaatggagaaaatatttactactcctcttcaatgggacagataactatatggtggaagaaacagtttgataaggcacctggggttcaaaataagttcacccccatcactacccattgcaaatgactcctaagttgcatctcaagagggtagatccaattaactgcagaggttttgttcacggagtgagttactcaagtttaagccactcagataaaactagatcaaaaagaagaaaaggtaggtactactacctaatacttttctttctctacatttatctttttttctaataaatattgaatgtacatttaaagaacaacattttgaagaagaattaaattaccagtttgcctgaaacaccattatcttagtgcatactcttagtgtccaagtatggcacgagtagccacagggatctcaatgctattttaattaatctattcaatttgacaattatcccatgtataataatatcagttactttacaagctacgaatgtgtttgggaggagcatactttaaaataccaaagagtacttaagtttttttacccatcgtcctttatctccttgaagtttactgaagaaaagctttagctcgcgaactgtcaaattatagctagccagcactcccaacatgtcaaccaaaagatctggaaacaaaagaaaacgataaaataactcagctagttatatttctcgaatatttaaaataaactgtgcttatttaagggcttggacactaaagttctaggtgcatgctacatgctcaaatatttcttaaatattgctaaatggaataagaaaaatatgtatttgaaaatcaaactttatttctttgcatatattgtactatagaaaaaatcatacctgctatcatattgtcaactttttcaattttcccaagcactttttcaacaaggcctacttcagtgcagacttgaagattccgtatgcttttcttcagaatggctgtaaacatgctccagacttctgcttggcacgtaatgtcacatttttccagtaggtccaccatgcagttaatactctcaccttcttggataatgaaattcatttccagatcaaactgtcctcctaccaacttacaaggaaaaaaaaaaaacacattaaaagcattagtatcctcaatatcactatagcatgttcctaaacattagattaacaataactactcacattcttcctccacatcaaaaggttcattaaaaaacatgcagctcaaaaaactgaagtttctgaagtaatctccaaatttagacagcaaagtaagagaatataaaaattaaaatatttttcaacaaaaacaaatataggatgtcttaggtaaattgctatctactaacctgttaccaataaagatctaaatcaactctacaattgcttctcatccagtctttcatttatgaagtatcaaatctgtgaactacactgaataatctaaaggtcctttgttacccaaacaacttatgagctcacggtaaaactgaaaagctgaaaaaggctcagagtggtcacacattggagtttatattagtcaaatttttggtttattaagcctattcattttacctctcctctgtagataatcagtataacttacatataattagtcacatatccaaagtcagtaaccaagaaaatgtatttcactgatattactatcagaacgctatagctatacaggccttgtcatctcacccagagcctccccatacagagggaaggttcgtaaattttaaataaatcgtaattgtgtaaaggaattaaaatacttttagaattacctttgtagagctatctcatttaactagattttttaaataaatttttttaaatttaaatttttttaatttaaaaatacatatatttaaggtatacaataatgctatcaactagattttttaaagatctctgtcagaaatagctacacacatgattcacctacgcttctttctgaatacttcttgatttttcattatgcatttccaaactgcatacccaaaaggtatgcaataattagaagaaagtgaactttaaaaaacaaatccggcagggcgtggtggctcatgcctgtaatcccagcactttgggagaccgaggcaggcggaccacctgaggtcaggagttcaagaccagcctggccaacacggtgaaaccccatctctactaaaaatacaaaaattagctgggcgtggtggcatgcgcctgtaatcccagctactcaggaggttgaggtaggagaatcacttgaacctgagtggcagagattgcagtgagctgagattgtgccactgcactgtagcctgggcaactgagcgagactccgtctcaaaaaaaaaaaacaaaaaaatacaaaaacttagccaggcatggtggcatgtgcctgtagtcccagttacttgggaggctgaggcaggagaatcacttaaacctgggaggcagaggttgcaatgagtcaagatcatgccattgagctccagcctaggcaacagaccaagactccatctcaaaaaaaaataaaaataaaaataaatccaatggctcttataaagaataacagacatgaccaagtggagtttagtccaggaaagcaaggaaggttcaaaactaggaaataaattaaaattccattcagcaggatcaacaacatgtatcccaggttctgacaaaaatatacacaggcatgagactgaaaaaaatggaaatgaacaatgtgaggatctgtacctgcatgcagagagacaagaactcctggcaagcacagtgataaagacatttcatctttctcagaaagctctggtagagatctcagcatacaatgctttgtatcatcactaccaagcagtgttaggagatgacagctgggattttgctaaaacagtctctccttgtgatggagtcaattctcctagttacatggccgtagctaaaaagtatacgtgcttggttccctagtcctcctggataaacgctataagctatctattatactatgaaatattccattctacttgaactggttgaattagattatattgtctgtaaatatgttgtttgtaaattttaaaaatacacaattcaaataagaactttaatatagctgttttggttttgtttgtattatttcctaatattgtctgtaactttttattttgaaataatttcgaacattcaaaaaaagtacagaattcctttatactcttcatccagcttccccaatgtatatatattacataatcatagtacagttatttaaaccaggaaattaacatttacaataccattaaccaatctacagatatcactcataaaaagatttaaaaaaaggcatgtatatgaataaggtgcttattattaataatgcttggctgacggtggtggttattgttattataagttttataattttataattacatatctatatttatatattattatatgataaaagtgacatgcaaatagaacaaagatcatttcatcaaaaggttagtggctgggcatggtggttcacacctataatcccaaaactttgggaggctaagacaggaggatcacttgaggcctggagtttgagaccagtctggcaacacagccagactctgtctccatattcaaaaaaaaaaaaaaaaaattacccaggtatggtggtgggtacatgcagccctagtactcaggaggctgaggtgggaagattgcttgagcccaggagttcaagactaaagtgagatcacaccactgcactccagcctgggtgacagtgcaagatcctgtctaaaaaaaaaataagtttagggatagctatattcaaatatctgggggaaaaaaaatcatcaatcaatccctcataccataaaaaaatttccaaatgagtctaagatttaaatgtaaaactgaagtcataaaatgagtctaaaataaaacttataaaagcactaaatgggttaggcgtggtggctcatgcctgtaatcccagcacttctgggagaccaaggcgggagagtcatgtgagtgcaggacttcaaggctacagtgagctatgatcatgccactgagccctagcctgggtgacagagcaggacatgtctctaaaaataaaaattaattaaataaaagcactgaatgaaatgatacaaaaaacattttatcacttcaagtggtaaaagcttttctaactaagagtttttaagatttctggacttcatattgacatatttaactacataataatcagaaactctatatgcaaaaaaaaatcaaaaagtaaattaaacacttagaaaaatcatttgcaacccatatcattacataagcacaaatagcttcctgaaaaaaaatttttaaaagaaaatatatctgcttgtgggaactagggtgttaaaaaaaaaaaaaagaaaatttaggcaaaggcaatgaacaaaaaggtaaataaaagtggcactaaaacatgaaacccaactttgcttacaaaatgaatattaaaaatacactaatataccatttttacatatttgattgacaaattccaaatctctaacaacatataaaaataatacatagtatgtgcaagaacatgaggaaacaggtactgtcatacattactgttgttgaggaaacaggtacaatatgacttattaagagcaatttggggctgggtacgttggcgcacacctgtaatcccgggactttgggaggccgaggcaggtggatcccttgagcgcaggagtttaagatgagccaaggcaacatagcaaaatcccatctctactaaaaatacaaaaattagccaggcgtggtggcagacacctttagccccatctacttgggaggctgagacacaagaatcacttgaacccacgaggcagaggttgcagttagccaagatcgcatcactgcactctagactgggtgacagagtgagaccttgtctcaaaacaaaaaaaagaaaaacaaaaaaatagcaatttggtaatatctatcaaaattttttatttttgaaacagcaatcaaactactagaaatgtatattatagacacatttatgtatctaacataatgatgttagatacaagaacttcattgtattgactctttttaaattacaagataaaggttaatgacagcctggcatgatggatcactcctgtaatcccagcactctgggaggccaaggtgggtggatcacttgaggtcaggagttcaagaccagcctggtcaacatggtgaaaccccgtctctactaaaaatacaaaaattagccaggcatggtgacacgtgcctgtaatcccaactacttgggaggctgaggcacaagaattgcttgatcccaggaagcggaggttgcagtgagtcacctgggcaacagagcaagactctgtctcaaaaaaaaaaaaaaaaagttaatgaagttgtatacaactatacaatgaaatatgatgtacatatagaaaagaatgaggccactccacatgatatgaaaagatctctaagatactgtgagaaaatcaaggtggagaaaagtgtgaacagtaggctacaatttgagtgtaaatcatttacacatagacctatgcatgtgctaaatatgtctaagaatgaactaaatatcgattgtctctggaaaagatctattgcatagaaggcaaaaaaaagattttagtacatacacttttgaacaatttgaattttgtgccatgaacacatattacttatttcaaaaaaaacaatttaaaaagaagcaaatgcagccaggtagggtggcttatgcctgtaatcccagcactttgggaaaccgagagagcagatcagttgcactcagagagttcaagaccagcctggggtcttgaaccaacatggcgagaccccatctctaccaaaaataaaacaaaaaattagctgggtgtggtggcatgtggctgtagtcccagctgcttggaggctgaggtgggagaatggcttgagtccgaaaggcagaggttgcagcagcccaagattgtgccactgcactccagcctgggcgacagggcaagaccctgtctcaaaaaaaaaaaagcaaatgcacaaaacaccactgatgtgaactgtagagcttatgaaatcatcataaatacaaatggtattaatacaaacgtttgggatttctcaagtaacctatttctaacaaattactcactgagtcaaaaataattcagcacaatataacaatgacattgcagaggcattattcaaatatttaacaactggcacagtgcaggcaccatgcaatcagaacacatacaaaacctatcaagatgggctcaagctgtaaaaatctcatacttacatattgaggcacattggctagctattggccttcatagaacatacttaagtaaaaaataacagatacaacacatctgcagaaaacaatcacaaaatacaaacctctactatataataaatttataaactcattcaacacacttttactgaatgcctacagtatgccaggccctgaggaaatagtggaacagtgatcaataagacagaaatagcctacccgtatttgcaggaacactgtgtcttatatcctacagaaatcttttttaattgcttatttagaaaatggctgggtgcggtggctcacatctgtaatcccagcactttgggaggcaaaggtgggtggatcacctgaggtcagtagttccgagaccagtgtggccaacatggtgaaaccccagctccgttaaaaatacaaaaattaggccgggcacagtggctcacgcctgtaatcccagcactttgggaggccgaggcgggcaaattacctgaggtcaggagtttgagatcagcctgggcaacacggcgaaaccccgtctctactaaaaatacaaaattagccgggcatggtgacacatgcctgtaatcccagctactcgggaagctgaggcaggagaatcgcttgaacctgggaggtggaggatgcggtgagccgagatcgcgccattgcactctagcctgggcaacaagagtaaatctccatctcagaaaaaaaaaaaaaaaattagccaggtgtggtggtgcatgtctgtggttccagctactcaggaggttgaggcaggagaatcgcttgaacccaggaggtggaagctgcagtgagccgagattgccccattgcactccagcctggtcaacaaagcaaaactccgtctcacgaaaaaaaaaaaaaagaagaaaagaaaatactagacttctggtttccaaactggaaatctctttctccatgaaaatatataatataggaatgacaccaagtagtaacttcagctcaaaatgtcattttgtataaatataaaatatataacattcataagttttcctaaatacctataatatctaacagaaaatacaagagttttaaaacaacatttctgataccaactataagtataaagtatctaggagtgtattaaaacatacacaagacttgaaagtaaagaaatttttttccacttttgataaatgaacagacctgtttctggatgggaatattaaatcagttcaagttgttaacttttcacaaattaatctataaattcagcacattaccattaaaattccaatatgatttttttctgaaacttatagtgattctaatttctatctgggaattaaatatatgaaaaaagtgaagggaaattctatacaaaaagaatactagaatcattaaacaaatggtataacataattattaaaactgtatggtactagacagaaaataatctaattaaaataaaaggttggtacaaataacttcaatataggattagagtgtcatcacaagcattaaatggagctatgaaattttcattttaaaaaattaagactgaatccttatcttacaaaatatgccaaaataaattctagataacttaaaatatcaaaagttaaattagaagccacaaatataagaaattctcaaagagtacaaaactcattaagctgtagaaataaaaagtggtacagaaataaagtattttcaatttggtgaaaaaaatgtttaggaagacatgaacagtcaattcacaaaaaaaaaatccaaatgacacttgcaaaaaaaaaatactaaatgaatttaactttgtttgaaattattaatgctcaaagtaggtgagaacaagattaaacagatactttcatacactcctgttgaaatatttccagaaagcaatatggtaatactaactaaacatataattgtgttaagtcaagacaatcttttattaaatgtgaggaataacaatcagcagcagatgccaatgattaagaaaaattaagaggaaaaattcaaaactgagaaaattaattccatgaacttcaacctgtaaatttggtaaagataatttttaatcaattttagcagtagaaaggtctggtccaggtccaagaacaccagtattctcaggaagataatttaaaagaatccacacagaagaatgtaaaattaaggagtgacagaatcttcagacacaagaaaaccttcttgtggaaaagaattgcagtgattcagaaaagtagcagaaaaaaacaaaaatctctaaggccatacaaaactagtaattccataattatataatgattataacttcaaaataactttttagtgaaaggaaagctcaaagagaaaatattttatgaaaatcatctagatacaacaataaaaaagacaaactcttcaacagtattttctagaagacagaaactaaaccttgtccactgaatacaataaagtacttcttacaacacccacatacaattgtacatcatttcatataagggaaaccaaccaataaatctgaaacaatttactgccaagaagataatgtctggagagagttttaatagtgtgaaattttcttctaacaattacatatcctccatgcgatctaaattggtcaaaaacctcgttacaactaacataagagaccttaccttcatcttaatattacttacatcaatcattcctataagtaaccaccctttcaagaagctatagatttttgaaagtaatttccaaaaaaagccccaaatatttcaccagcttttaaactgagattataatggtgagagcaatatccagacaggtgttttaaatattcctccattgctttaaatactataaaatatgcctttcaaggagaaattgatggcagaaatttgtacatacaaatgtgtggcatatttgatatactatatgtatgcatatctattatacctaaaaaacatgcacagggtctacagtatgtcatgttaaccctttctaatagttatttgaagctgatcaaccttcaaaacacaaatttgtttccaatgacagggatcataatccaggtacaggcattggctagttattatctgagctgtagtaatggctctgcactacaaaatgtaatcttcccaaatgtcacagtaagttatgaatatctgagcagcctaatgcactttactagccatgaaatgtgaaaatgtaatcttattaccttttttatggttgtatttttttgaataatgtagcatggaaactgatgtatagtctttttctacattttagcatgatttggtctcctttgctatatagaacatttttcaaaactctccatttcaacatattttagtcttggcctgaacttcataaacaatttttatagcagccttcagggtggcataacatgctttctataggttatactttaatgcataaggttatagaaattttaaagcaacttattcgaagaattcaaataaacctttataagttttgtatgaggactttaattgagcatgattatttttcttctcaatagtgatactaataaaatactttaagctgacattagtcactaatctaaattacctgtatattcggaaaatctaaagaccaaacatggagatcaaaaataattatcttctcttcaaaagattaatacaactggaatactgtgtgactcacagaaaattcaaatacttcaaagtaaagctctgttctccctggacaactcactggaaacttgctaaatttttcctcaaaggtggggcaggagtatggtatagtttaaaaaaaaaaaaaaaaaggacagggtgtaatcacagcttctgaccctaactagatactttcttgtgacctatctattatgacaggtgtagttaacacctgtctaaaaatgtcaaaattgcttttttctctgaacctatttatttataaaattaactaagagtaagcttcttttatttatctgcatccttcagaaacatattcaggttttaaaagtgtcaacctcaagatatccaatttttctccaggaatcctttcctaagtgaatgttaccttgtatatgtttacagccactggaaacttactaataaggagaagttgagggaaaattacaaagctgtgacacagactgcactgactcccaggttatatttccttcttccataataataaagagtttctagtttggcacacagagcccaggaaaaagatctcactctccagcttttcttgaatgaaaagcattcctgatcagccatgtgaccaagttctgaccaacaggcagtaaatacgtgcaacctctaggtattattctttaaagaaagaaacctgacccctttttccagctacgctccttcctactgcttaagatgcagaatagtggcaagagctacagtagccatcctggaattgaaggtgtcttatgttgaagataaaagagcaaatcgatctatggatcctggcaatcatagaactgccacactagcccgctacccagactttcacctgaaggacaaatacatttctgttttgcagaaaccactgttaatttgggcctctctgttctatcagttaaaagcctatattctgactaatatagatgctattcactgcattttctcagaaattaaaaaatatatattatctataactatctcaaatgatgtatccttattccccattcttataccatagcaggtgttagttcaccaaaagtgtcttttttgacctacttttgatagttggttatgtgccctggtaagttgagaaaccacagaacagcctattccctgactatattcttactggatagcttcatatatgctctacactactgtgccactatgacactttgccagatgccccattacaggttgaattgtgttctccaagaggacatatgttcaattcttaacctccagtgcttcaaaatgtgatcttatttggaaataggattgctacagatgtaattagttaagatgaggtcattagggtgggtcttaatccaatatgactgttacccttataaagagggaaaatttgtgctcgacacatgtacacagagaaaatatcatgtgaaaatgaagatagagattacagtgatacttctatatgccaaagaatgtcaaagattgccagcaaatcaccagaagtcaggaaagaaacatgaaacagattctcacaattctcagaaccaaccatgccaacacacttatcttagacttctagcccacagaactgagggaataaatttccattgtttcagcaacctaatttctagtactttattacacagccctaacaaactaatacatcccaacatctcccaaggtttatttttgatgttacccactaaattccccagtaagcattgtcaagaactcttagaaaagccaaaccacgacccagagactctgttcagcttatcttcacccagaccttcctacaacaccgtactctccttagagaaagaggtttgcggaatggatacacacagacatacagagtgaaataatagacactggagactccaaataatggaaaggaggtgagggtgaaatatcacctattgggtacaatgtgcactattcaggtgatgggtacactaacaggccagacttcaccataactcaatatatcaaggtaacacactgaacttatacccctaaatccataaaaataaaaacttcaatgtcaaaaaataggtttgtgattggtactcagtttttccaaaaagaacaatatattgctgaggaatatatacgtagataataaacttaaaaaaaaaaacaaacaaaggaatgactcacatcaaagttagcaaaagagctgggcatagtggcttatgcctgtaatctcagtactttgggaggctgaggcaggaggactgcttgagcccaggagttcaagaccaggctgggcaacatagcaagacctggtctcttaaaaaaaaaaaaaaatagcctggcaggtggcacatgccaatagtccaagctactcaggaagctgaggcaagaggactgcctgagcccaggagttcaaagctgcagtgagctatgatcatgccacagcaccccagtctgggtgacagggcaagatgctttctcaaaaaaacaaaacaaaacaaagttagaataaagataattgttttagcaaagaaaaagagattccaagtaaaaatattgttctattgttaacctggtattggatatatgcaggtacattttaatggtttttaagtacttttatatactttacacatatctttttaagtactttttaatacttttaagtacttttatatattttacacatacatttttaaaatacaacttattttgtatttgctatctccttgcctctctctgctatcttttggaaatttccccagtgtttcagttaccacattctttattcaattctttctaatctacttttcaatctgtctgttgagttaatttctatgtctttttatttaaaagttctatttgttgttatttttcaaatctgcttagtaatcttctctctttcctacataatcttttaagtgccttttttgttttccttctttttgttttctttctttcatgactttttgacatgaaagggcctctatttcataatttattataattttctaaattttatagtttgaaagtcttgaagatctaatcttgctttcagtgtatctactgactcctcatgctgtgctgcttttttaacgggtttttaaattttagattgtaaatttattttcaatggggctttatctgagagactctcgtgcagcctgtgcctctctaggttgaattaggtattctgctacctgccctagggatgtcttcagcatggaatgacttaaaaatatatatatatattttgagatggagtctcactctgctgcccaggctggagttcagcagcatcggcttactgcaacctccacctcctgggttcaagcgattctcctgcctcagcctcccgagtagctgggattacaggcgcccaccaacacgcccagctaatttttgtatttttagtagagacagggtttcaccattttggccaggctggtctcaaactcctgaccttgtgatccacccaccttggcctcccaaaatgctgggattacaggcgtgagccaccgcacctggccttaaaaaatattttttattgtgaaatgtttcactgcacccagctgccaagctattcttagacaaaatttaacattacagatatcgtggtaatacaatccagactttttttggaaatatcatattttctttcggaacaaacatttcttatatagtgtctggctacaatggctcatgtctgtaatcccagcactttgggaggcagaggcaggtggatcacctgaggtcagaagttcaagaccagcctggccaacatgggggaaccccgtctctaataaaaatacaaaaattagccaggtgtggtggcaggcacctgtaatcccagctacttcagaaactgaggcaggagaatcacttgagcctgggaggcggaggttgcagtgagcagaaatcaagccattgcactccagcctgggcaagactctgtctcaaaaaaaaaaaaaaaattcttagtaatatttgtctctactgggattctaaatctctgtaggtaaagacagtaaagtgtttttcttgcaggtaaagaaaattatgagttcgatactatataaaagaaaaagagtaagtttaatatgatttacagttaagtgtaaatgtagaatgtcactagaaacaaatataaattttcaacatatcccacccaaagaacttcacacaaatatgagtccaaaatatttcctaattatcaggtactagaaatcaaatctgctgttttaggacccaatttgaattctaaaatgttttcaccgaatacaacaatatgggttgggtagacaaaatttcagctcactctggttttcccctgtcccttctctaagatcataattgtaaaaaactatgtccatgtcccaggaatcacagaacatttagtctcgtataagaaatttctcatttcagaaaattaggttaaatttggtattctctacaattgcctttcctctttcttgcttcttttaaagaactataccttaacgttttcttaaggcccagctcaagaaatatctctctgagaaccattttgacctctccagccgacagtaaactagaatgatacacatcatattaccaatacaatatagtcatttaatatgctgaactgaaaatattccctttgaagtttttgttctccttctacttactatattctgggtctttcactatttcttagaatgcacagaagccctagcagtttcagcaatattatcaacaaactcacaatcatataagatttccatttctactatcataactaatccttacaagaaccctgtaagtcatacagattagtcaattatcacatctagctgataaaggaacaaaaaaaaaatgtgtccattcatagccaagactacaaatcagactatctgactcatagtctcatgtttccttacaccttcactaataatctattatttaagttagatttttttttctttaaatagtgagctaagtatttgaaaaatttgtgaactttactatctatacaaaaattagtcaaagtatatgttactgaaaataaattagaagtatcatctttatatttatttaaatccccaaacatactacaaaatagtcgaaatctcctctcattgtttattgtacccttcataagagttagaaattttcacagaataatggtatgtctacaaaagtgttaagaaaaaaggttccatgatcaaataagtctaagaaataatgaattaaacaatggtaaagagatgtttatatgatagaattaccagagctttaatatgcaactgtgcagtagacatcttgaaaggaagatatacaaccaatgcatggacttcccaaaagttatttcacaatggaacctcttttcctttttatttgatttagagatagggtctcactatgttggccaggctggacttgaacttctgtgctcaagcaatcctcctgcctcagcctcccaggtttctgtttgaacaagagattttttcataaatagcattcttcaacagctttttcaaaaaacatttgatgatgtaacatatttatgttcttgaagcttattattgtaagcttcacccagacccctaaatccataaaaataaaagtgcttgaagtcttagataggcagctggatgaataaatatcacagaattaactatgttttaagcaaacatttagtaggcacttcagaagtttttcaggtaagtagtttaactcaacctgtttgttttttcacagatttccttttatgacttattgaagttagtaagtaaacaaaaaagacatcttcaattaagattactttaggaaaaaagaaaatatgagcaaataaaatcacactaacccctcatccctttctgaaccagtcagtccaaaagtcaagcaacatagatatcctcccacatttggctggtctgtgtgcccacagaagtaatgtgtgacttacgaagttaggtcattagagcttcatggctccctttacatcattcattctaaggaaaatcagtcaccacaaatgaggatattcaagcagctcagtgagaggctcacttagagaggaacagtcctccagccagcagccagcaccaacttgccagtcatgtaagtaaccctgaaagcaagtcctctagtcccagttaagtctttagatgactacagctccagccaacattttgaatgcaacctcgtgacagaccctgagtcaaaactatctagccaacctactcccaaattcctgacccagaaaaactgagctgataaatgtttatcactgttttacactgtaaggtttgggggtaatttgtaacacagcaatacataactagtacagttacaaatcagtaattggggaaaactttattatgctatttattcctgtatcataaattttttaattcaaatattctaataataaaaatgcacagaataagtgattgctgtcagctacataggcactttacataagcactttacatggattatcatatttaattacctcttgtaaacatgaaacataagtaacttctgaacatgggtttcaacactacataatacttgtatttaattatttgtgacagttactgcagactggcttacccaacaccaattcctcaaagtctatcagacaaaactgaaaagaaagtataaatgagaaaaaaaaaatagttcatatggcaagaagacagttttggcaatgagaaaaatgaaacaaaaagatatagccaggctttaaaatcatactctatacctatgtattaagaagagaaaaagcagtgaaaaaaattcgagtggctaacagtttgtactctggcatgactctatacatctgaatactggtgatatggtttgtctgtgtctccacccaaatctcatcttgaattgcagctcccataatccctacatgtcgtgggaaggacccagtggtgggtaactgaatcatggggtggggggttctcatgatagtgaataagtctcacaagatctgatggttttataaagggcagttaccctgcacatgctctcttgcctgccgcatataagacgtgcctttgttcctccttcgccttccactacgactgtggggcctccccagcaatgtggaactgtgagtccattaaaactcactttctttataaattacccagtctcggttatttcttcacagcagtatgaaaatggactaatacaactggaaagttctttttttccatctcaaatatccaagtcagtctgaaatgtggaaggtatttagagttcaaggaaaaaaaggcagaatcaaataattcgagtacctatataaatatcttctataaaattacgtatagaaaataagatataaagatatctattgcagcactatttgtgaaactgaaacattagatatagcctaaatatccagcaatagagagatacttataaccagctgatggccatgtaatggaatattgtacagcctttaaaaagaatataaatcaatatgtgctggcatgccacgatgttcaagacacaatactaaatttttttaaaggtgcaggacagtatttacagtatgaccacatttccttaaaagatacaattatatttaaatcagagataagtgaaactgcagtttcagcctaggtagttgccaaaacatattgcttggtttcagctaagtgcccacttatgcactgcttctgacattcctaaagtgtaggtgataaataattgtattatcaagtatattaacatcatatataatcagtatgacaatgtcagtaatatagataaggcaagtcattcggatatagtatctgaatattcactttcaaatgcagacaaatttttgaggaaaaatctccttatgtgctttatatggtaaaagtgaggaattaaggcatatttctttttttttttttagatggagtctcgctttgttgcccaggctggagtacagtggcacaatctcagctcactgcaacctccgcctcccaggttcaagcgattctcctgcctcggcctcccaagtagctgggactacaggtgtacgccaccaagcatggctaatttttgtatttttagtagagacggggtttcaccgtgttagccaggatggtctcaaactcctgaccttgtgatccacccacctcagcctccctaagtgctgggattataggcgtgagccaccatgcccagccggcatatttcttattataagaataaaatgctacaatatttatttattatgaaataaacagtattatgaaagctactaattttatcttacaaaagtaactgtgccttcctcaataattggtagaaataaacagaaaatcagaaaggattaaaagaactcaataacactatcaacaaagaagaactaattgacatttatataagactccacccaattatagaacaataaatattgtttacaagggcctatggactagagattatattctgggacataatacaaactcaacaaatttaaagatattgaaagtatatggagtgggttctctgaccacaatgaaatcaaactaggaatcaataacagaaagataaagatcacagaaaaatgtgcgaacacttggaaactattacactcctaaatagtttatgtgtcaaaagaggaagtctcaaataaattttttaaatacgatgaactgaatcaaaataaaaatataatatatcaaaatttgtgggccatacctgagagggaaatttgtagcactaaaaccagaagtctcaaatcaataatctaagtttccattttaaagaacctagtagaaaagcaaaataagcccaaaacaagcagaaagaaggaaataataaagacaaaagcagaagtcagtgaagtagaaagtaggaaaacaataatcaatgaagagctagttctttgaaaagatcaataaaattgacaaaccttggcaggacttaaaaagcagcaagaaataagacacaaattactagtatcagggagaaaacactatcactacaggccttagaggcagcaaaaaaaaaaaaaatagggaatactgcaaacaactctaaacatataatgtgacaacttagaggaaatggaccaattcctcaaaactggaagctaccactacttgcccaatatgaaataatttgaataatcctataattattaaggaaattaagttcataattttaaaattcaaaaaagaaatctcaaagttcacatggtttctctggagaattcttctaaatattttttaaaaaattaatgccaattttaaatttctcaatccattttacgaagctactattttactaaaaccagacaaagacagtaccaaaaaaaaaaaaagcctatacaccaatatccctcatgaatataaacaccaaaattcttaacaaaaaattagcaagtagaattcggcaataaataagaattttacaccatggccaagtagattttattccaggaatgcaacactgttttaatatttaaaaatcaattaatgtaatccaccatattaataggataaggtaggacaatcacacgatcatatcaactgatgcagaaaaagtatttgacaaaaattcaataacactattgaggataaaaactcagaaaaatggaaacaaaaaaaaacttcaacttgataagcaacatttacataaaacctacgactaacattatactcaatgataaaagaccgagtattttctctcctaaagatcaggaacatggctaagacatgcactctcactacttttattcaaattagtgctgaaagttccagccatggcaattcagcaagaagaaataaaaggtatgcaggtgagaaaggaagaaattaagctgtccctatttgcaccaaagacatttccaaaaacagaaacctcctagaaataatgagttcagcaaggtaacgggttaccagataaacatttaaaaatcaattatacttccatatactaccaaggaacatgtgggcaatgacatttaaaatataccatctataattgctcaaaaatatgaagttcttagatgtaaatctaacaaaatatatacaggacttgaatgctgaaaacaataatatgatgatgaaagaaatcaaagaagatctaaataaatggagaggcacactgcattcatagtacagctgtcaattcctccaaaactgatatatagatctaacatagttcccatcaaaatcccagcaagacttttgcagatatagaaaagattattgtatgatttatatggaaaagcaaaggaactagaataccaaaaacaatcttgaaagagaaagataaagtagaaagaatccatctacccaatttcaaaacttattatgtagctacagcaatcaacactgtgaggaactggtggaggggcagacacataaatcaatgagacagaataaagaacccagaactagacccacacaaatattctgaacagttttaacaaaagtacaaaaagcaattcaagggagaaagaagagtctttaaaacaaatggtactggaacaattacaaatgaacttttctttacctaagtattacaccttacacaaaaactaactcaatattgatcacggatttaaatgtaaaatataaaacttttttaaaaacataggagaaaatcttcagaatttagggttaagcaagaagtttttagacttgacacaaaagcaagatccatacagggaaaactgataaattaggctttattaaaattaaaaattctgctcaccaaaaaaccttttcaggaggatgaaatggcaagctacaaactaggagaaaatatctgcaaaccaaatatctgacaaaagaataatatctaaaaaatatagtctctcaaaagtcaagagtaaaaaaaatccaattagaaaatgtgcagaagaacgtttcaccaaagaagacataaagaagacacataaacacacacacacaaaaagtctaacatcattaggcattaaagaaatgcaaattaagaccacagtggatatcactatacatcaatcaaaacaactaaaaaaataatgacaacaccaaatgctggtgaggatgtggagaaactggataattcgtatgttgttggtgggaatgtaaaatgacacagccactatgaaaaagtttggtaatttctatttaaaaaaaaaaaactaaatatgcacctactattcaatctagcaagtgcactcctgccatttttcccaaataaataaaaacttatgttcacacaaaaacctgtatataaatatttacagtagttttgttggtaatagccaaaaagtggaaatcactcggatgtccttcaacagctaaatggttaaacaaactgtagtacatccataccataaaatactattcaacaataaaaaggaacaaactattgacacacacagcaatctagaagaatctccagagaaccaattggtttttttctcaagttcgtacagtcttctggagattcttcaactgacaaaaatatagaaattgagaacagattggtggttgccaggggttaagatggggtagaggaaagtgggtatagctgtaagagggtaacaggaggaaactttctgcacctcgattataccaatatcaatattgttctagttttgcaagattttcccattgggggaaaccggataaagagtacaaaggatttctctgcattatgtcttcaactgcatgtgaatcagcaattatctcaaaatagaagacctagttttaaaaaataagtaattctatgtgaggtataaattgtcacaggattaattttccaccaattatttcccattgaaaagaaaactatattaacctaaatgaatcttcaattggtagaaaaatgagagccaaattaagcggcaaggaaactcgtaagttcaaattctgaagccacctacagacatacataatcccagcttctttacttatccctccctccctactccagccaaaaaaaaatcagtatatttaattacttgccctacacctgaaaaaatgtttgccatatactatacaaaaaagatgaagcatatattgatatcacacagagtttaactatatatcctactgactcacatctaatacttgcattatagaataaatatgcaaatttgaaccttcaaacaggaaatgaaattttctaaatccattacataacttcagattcatgtgtgcactgaaggctaataaatcatctaaaccttcatacagagaacctttttaaatttgcatttatctacagtaaattctgtcatgttctttaatagcttgctggttcaatctagcaaactagtgatttatagcagtgacatatttcaaaaatcagaaatctctcactatgtgacaaccagtcaaagtccactgaacttacattacttgaactcaaacatcataggatatgaaagagatagcaaaatgtcatgaatttcatattcaaatcaatttgagtttatgtttataagtgtttaaaactatagcatcacatacattacttaatacttcagtaccccaaatattttatgtcatgattccctcaatgtgtccaaactacctgtattttaaaatacatttttaaatttgatagttcataatttgaagactctacaaatcttactttgaagaacaccaaaatttagggtacatgaaagaaagatctatatattaggttttctccaccaaaaaaaaaaaatgtacttttagatctttataataatttcataccaatatccttatgtagggagatttatcagatgtgaaaatggagattatattaacaatagggaaataaactggaaattaccaaaatgttcactgtaatagacaatgttgtttttgtctgtattgtatttactcttccttccatcctcttccatttatggaattctgacaagaaagtctcagtacctcacacccaggtcacagagaggtcacttaagtcaggcctggctaaatatatacttcccccttctactggccacagtgattaatacaagactgagaatgtgagctaagtcaggccaatcaaaatcattaccaagactgttttttaatttataaggtgaaaaagaagggctcttggtctttgggtcaaaagtaggagaaatatgtaaactgaaggcttccagcagatatgttccctgccatgtggacagaggaggcctagctgcaccataaatggaagaagaatattctggtgacatcaattccctgtttccagggtttccctggttcttgcagcttcattcaatgatgtagcctggtcctatgaaccaatcattcccttttatacttaagctactttgatgtaagattctatctcttacaatgagaaaatcccggattaattccaaaaaaagaaggaactagctgaattatggcacatacgtatagttgtatataacacagcaattttttaaatcattttcattcatagttctccactgacagtctacgttagactcaacatcatctttttacaaaaaaaaaaaaaattctttgtgacacccctatactaacctgaaataaaagtgacacattccattttatcaattattttaaaaagatcagagatcagaatgtgtcttataatcaatggcatctaaaattacaattgcagggttttttcctaatgctgcataaaaataatgacaaatcttacaacttggcatcttagacttgaggaaacacaatagataataagacctacctataaacaacaacaaaaatctacaaagtactctaaccataataaaagaaaaataattaaaatacttttcagtattttttccatatataaatccttgtaaataaccaaataataaagtagttaggtcctggtaactatatacagaatctacattaatgtatgttacagaaacaaggcacagtgattcaggtgtgtattagatattcaaatactattatattccaattagacgtgatttttaattcttcataaagttccaaataaaacaaagtatgatttttttcttctttaaagcttacttatgtttctaaaaaaactcagcatatgttaaaagtattcaaaaagtttatgctgatatggaaaatgaaattaaagtctaataagttcaggagaacagaggatatcacaccttgctgtttgcaaatgtatcttccattgcaaggtccttagcagccttagtccagaacactaagtgtccactaccaactccaaatcattctaagaaccaaaaatactcaccaaatttcctaaacacctccaaggagcagtactggtctcactgagaactactcatgattggacaaggaaagatgtttaagatacatgattaaaggaaaaaaagcagatatgtacaaaataacctgttgtatatgtgtgtgtgtgtgtgtgtgtatgtctatagagagagagataggtagagacaaatgaagacagatgctgatacatataaaaatgtgtaggatgtatatgggtgtgtgtgctgcaagaagggcagacaataaactattaacaatggctacctcaaagaagtgggttgaggagagggaaattagacagtcagtctttcattttcacttcatacttttttaaatgagcatatactgctttaaacaataaaaaaaaggactttaaaaaatccaagtagtaaaggccatgtccaacatcattcccaagagcctgtctctttgcctgtgtctgtcaatgtctgcctgagcctcatcctgaccgtctataaggccgtctgtttctctctctctttctctctgtgcgtggggtgggcggggtggagagggtttctgtacctatctctctctggttcttggtatctgcatatctcttctttgagtgtgtctctcttgaaattatgtgtatctgtgctttactctctgagtatctgtctctctgtgtatgcatgaatgtcttcctcccggagcacagacggaagcatgggccttgacctcctcccagtcttaatgcattcatctttatatctctgtgtatgtgtccatcttccactttctcacttacaattattttgcttcctttcctcttctgtttccctgacccctcatctccctccatcaagcccttcgcccatcttgtcttcctctactacctccccaactgtttccatataagcaaagttcacactgctagagtgttaatgtgttcatagccctgataaactctcttcaactggatcacaaatgatcatttctatctgaagagcgtatctgaagagttctgttagttacaaaataacatgctaactaaattaaaattagggtaactaatccttattttaataatagaacaactcagcagaagatcaacatgaaaaacagaagaggtgaacaacactataaaccaactaacctcacgaacatctataggatatttattctccaggatagaccatgttactcatccataaaacaaatctcaataaatttaaaagaatagctccctctccctctctccctccccctccccctcccccccctctttgcacggtctccctctgatgccgagccaaggctggactgtactgccgccatctcggctcactgcaacctccctgcctgattctcctgcctcagcctgggagtgcctgggattgcaggtgcgcaccgccacacctgactggttttcgtattttttggtggagacagggtttcgccgtgttggctgggctggtctccagctcctaccgcgagtgatctgccagcccgggcctcccgaggtgccgggattgcagacagagtctcactcactgagtgctcaatgttgcccaggctggagtgcagtggtgtgatctcggctcactacaacctccacctcccagccgcctgccttggcctcccaaagtgccaagattgcagcctctgcccggccgccaccccgtctaggaagtgagaagcgtctctgcccggccgcccatcatctgggatgtgaggagcccctctgcctggctgcccagtctgggaagtgaggagcgcctcttcccggccgtcatcccgtctaggaagtgaggagcatctctgcccggccacccatcttctgggatgtggggagcgcctctgccccgccaccccgtctgggaggtaaggagcgtctctgaccggccaccccgtctgagaagtgaggagcctctccgcccggcagccaccccgtctgggaagtgagaagcccctccacccagcagccgccccgtctgggaagtgaggagcatctctgcccggcagccgccccgtcggggaggtggggggcagcccccgcccggccagccgccccgtccagaaggtggggggcccctctgcccggccaccccgtctgggaagtgaggagcccctctgcccggccgccaccccgtctgggaggtgtacccaacagctcattgagaacgggccatgatgacgatggcggttttgtcaaatagaaaagggggaaatgtggggaaaagaaagagggatcagattgttactgtgtctgtatagaaagaagtagacataggagactccattttgttctgtactaggaaaaattcttctgccttgggatgctgttaatctataaccttacccccaaccccgtgctctctgaaacatgtgctgtgtccactaagggttaaatggattaagggcggtgcaagatgtgctttgttaaacagatgcttgaaggcagcatactcgttaagagtcatcaccactccctaatctcaagtacccagggacacaaacactgcagaaggcggcagggccctctgcctaggaaaaccagagacctttgttcacatgtttatctgctgaccttccctccactattgtcctatgaccctgccaaatcctcctctctgagaaacacccaagaatgatcaataaatactaaaaaattttttaaaaattaaaaaaaaaagaacctagactcagaaatcaaaaaaaaaaaaaaaaaaaaagaataaaaggaacaccaagtatatcatttgaccataagggaataaaactagaaatcataacagaaagaaattttggaaactcaacaaatatatggaaattaaacaacacactcctaaatagcctatataaaagaataagtgaagaaaaaaaattaggctaggcacagtggctcacacctgtaatcccagcacttcaggaggccaaggcaggtgcatcacttgagcccagagttcgagaatggcctgagaaacatggtgaaaccctgtctctacaaaaaacagaaaaatgagccaggtgtggtggcacatgcctgtagtcccagtgtctcaggacacctgtgaggatcacctgagcctgagaggtagaatctgcagtgagccaccatcacaccactgcactccagcctgactgaaagagtgacacactatctcataaaagaaaaaggaaaggaaaaaaagaaaatagaaaatacactgagatgaatgaaaatgaagatacaacatgacaaaatgtatggaatgtataaagcagtgttcagagggaatttatagctgtaaatgcctactttaaaatagaagaaagatactaaatcaacaatataacctttgaacatgcataaaaagaaggagccaagccatgtccggtggcacccacctgtggtctagctactcaggaggctgacgcaggaagattgcttgagcccaggagttcgaggtcagcctgggcaacacaaggcaaacccccatctcaataataataataatgacgtaggccgggcgccgtggctcacacctgtaatcccagcactttgaaaggccaaggcatgcagatctcctgaggtcaggagttcaagaccagcctggccaacatggtgaaaccccatctctactaaaaatacaaaaattacccaggtggggtggtgggcgcctgtaatcccagctacttgggaggctgagacaggagaatcacttgaacccgggaggcagaggttgtggtgagccgagattgtgccactgcactccagcctgggcaacagagagagactccatctcaaaaataataataataatgtagccttccatcttaaaccctacaaaagaagcgcatagtaaacctaaagcaagcaaaaggaataaaataataaagattacagaagaaatgaatgaaacaaatgagaataaaatgaaattaacaatataaaattagtggtatttttaaaaataaaatcaatacaacctggcttctttggtccttcaacaacaacaacaaaaaaatgaaattgacagatttttagttagactaaccaagaagaaaagagaagactcaaattactaaaatcagaaatgagagtgcattactaccaaccttacataaatgagattataaagacacactatgaacaattgtatgccaataattagacaacttagataaaaggagcaaattcctcagagggatacaaactacagaaactgactcaaaaagaaatacaaaatacaaacagacctacaacaagaattaaattagtaataaaaaaatcaactcacaaaaaacaaaacaaaaaaaaaacttaggcccaggtggcttcactggtgaattctacctaacatttaaagacaaattaatacaattcttcacaaactcttccaaaacactgaggaggagagaacacatcccagctaaatctatgaggccggtactaaccttatgccaagatcagacaaaaccatcacaaaaaagaaaactacagaccaatatatcttatgaatatgaacacaaaaatcctcaacaaaatactagcaaaccaaatccaggaacatataaaaacagttatacactatgactaaatgagatttattccaggaatgcaagctcagtttaacattcaaaaattaataaatgtgatacaccataaaatgaaaaaccacatgatcatctcaatagacaaaaaaagcatctgacaaaatctaatacctttcattattaaaacacttaacagactaagaatagaaagaaacttcttcaacctgacaaagggcatctatgaaaatcccacagctaacatcatacttaatggaagtatcactatgaaccaattaggtattttatcttaaaatacatatacacacacatatacacatacacactcacacataaatatgtaatgtgtgtgagtgtgtgcgtgtgtgtgtatgtgtagttttatcaactggaaaggggtacaaacaatgaccaacacaataacaatgaacatgcttactgcccagattgtggtcttgaaataccatttctcactaaaaatcagggcttcttgaaggagtagcttgtattagtctgttctcacactgctaataaagacatacctgagactgggtaatttataaaggaaagaggtttaactgactcacagttccactccccagtggaactggggaggcctcacaatcatggctgaaggtgaaggtggagcaaagacatgtctttgcaggcaagtgagcatgtgcaggggaactcccctttataaaaccaccagatctcatgagacttattcactatcaagagaacagcacggaaagacctgcccccatgattcaattacctcccactgggtccctcccacaacatgtgggaattgtgggagctagaattcaagatgagattttggtggggacacagccaaaccatatcattctgcccacggcccctcccaaatctcatatcctcacatttcaaaaccaatcatgccttcccaacagtccccccagtcttaacccattttagcattaactccaaagtccacagtccaaagtctcatccaagacaaggcaagtcccttctgcctatgaatctgtaaaatcaaaagaagctagttactgcctggatacaatgggggtacaggcattgggtaaatacactcattccaaataggagaaattggccaaaacaaaggggctacaggtcccgtgcaagtccaaagccagtgggacagtcaaatcttaaagctccaaaatgatctcctttgacttcatgtctcacatccaggtcacactgatgcaagaggtgggttcccacggtcttgggcagctccgcccctgtggctttgcagggtacagacccactccttgctgctttcacggctggcgttgagcatctgcagcttttcgaggtgcacagtgcaagctgtcagtggatctaccattctggggtctggaagattgtggccctcttctcacagctccactaggcagtgccccagtggaaactctgtggaggcgcttgtaccccacatttcccttccacagtgtcttagcagaggttctctgtgagggctccacccctgcagcacacctctgcctggacatccaggtattttcatacatcctctgcaatctaggtggaggttcccaaacctcagttcttgacttctgtgcacccaaaggcccgacaccacacataggccatcaaggcttagggctttcaccctctgaagcaatggtgtgagctgtatattgcccccttttagccacagctgggatgcagggcacaatgtccccagactgcacaaagctgcaagtcccggaggccagcccacaaaaccactttttcctcccaggactccaggcctgtgatgggaggggcttctgtgaagacctctgacatgccctggagacatttccctattgtcttggcaattaacatttggctcctctttacttatgcaaatttctgcagctggcttgaatttctcctcagaaaatgggtttttcttttctattgcatcattaggctacaaattttccaaacttttacactttgcttcctcttgaatgctttagcacttagaaatttcttccaccagataccctaaataacctctctcaagttcaaaattccacagacctctagggcaagggtaaactgccgcaagtctctttgcatggcaagaatgatctttactccagttcccaacaagttcctcatctccatctgagatcacctcagcctggactttatcgtccatttcaccatcagcatcttggtcaaagccattcaacaagtctctaggaagtttcaaactttcccacatttccctatcttcttctaagccctccaaactgttccaacctcttcctgttacccacttccaaagtaacttccacattttcaggtatctttacagcagcaccccaccctaccattaccaatttactgtccgagtctgttctcacactgctaataaagacatacctgagactgggtaatttacaaaggcaagaggattaacggactcacagttctacatgcctggagaggcctcatagtcaaggctgaaggcaaaggaggagcaaagacacatcttacatggcagcagccaagagtgtgtgcaggggaactcccctttataaaaccatcagatctcgtgagacttatccactatcaagagaagagcaggggaaaaacccacccccatgattcaattacctcccactgggtccctcccacatgagacctacaattcaagaaagattttggtggggacacagccaagccattatgatagctggttcaaggtctggaactagaaatgaaaatatgagcctgaaatatcttgccataaaaatagcagaaacatgatcaaagtctagtagggttgtaccaaaaggactcaggaatcaacctgaagaagtgcctactggccaaaaataaaagtttgaggttcaataaagtaataataattgccatcaaatatgtttaaatcctttaattcataatatttcaaaaagacaataacaacgaattggtctcctgtagaggataagaagagaaatggctgttacttacaaaattaatgaataaaaggaatgaaactgttccaattacatatttatataatatttatataatatgtaacatagtgtaaatctaatatacttattatattatctataattatatataaagaacatataaaaagtatataaatatataaaagaatgtaaatacacaaagaatatatttataaatctatataaagtatacataaatatataaagtgtgtgtgtgcatgtacgtatacatacttttttttttttttaagaaacagggtcttcccatgttgcccaagctggccttgaactactgtgttcaaggaatcctcctgccccagcctcccaactagctggggctaccggtgtgtaccaccatgcctggcttatctatgtattaactgtgccactggataactaaatacaactggataattaaatacatcttttcatagaactattccatttaatacatgaaaaaatatatataatatcatcattattcagactccagtgatttaatggatctagatgttgagaatcaacagctgataacattataaaaagagacaacctgacataagagcctccggatgacagaacacagcaccacctagagtctagccaaaggtatggaagccaaatcttctggaatcaacttccaatttgcaggaaatacggaggacacaagaacatgttaaactacaccatgaatatgcacttaacaaaatccagaccatgggaaatgctaaatgtcaaaaggtccaggttttttaaaaggtccaggtttttttaacagatagaatgacctgagacttaaaaaacgtgttttttaaaactaagaaaaactaaattatagataagggatgtattattagattacataattacaaataaataaaagaaagtgattactgtaaaagtcaagatagaggttccatttgagggagagaggcagttgtaattagagggattctaagatgactggcaaaattctatttcttgacctacatggtggtttaaaggtaattatttgccctttagttttatatttgttttggtttggtttttcaatagttacagttttacaataaaaatttttatgagaaagttctgtcaatggttaatttcatattttaaaacatctatattcaggcaatgcaattccatcataaaattagtagtttcagtttttgtaaacttgtaactcacagcctgtattaaatacatataacacatttctttcagtgactcctaagaagcttctgatgcataactaacctccatatgtaagtcacctcaaaacagtaacagtgctctcaagctgcctcagggaacatggcgccacctctctgctgagttatgtatagccactttggccgcccactgcatcctgatggtgatgggggagacaggctttgattgccagtcacacccctctatcctcaccccatattggctgtggctgtagatgagattcagctgtgggtggcctcagctcaccaaccactgccttggttttgagggtcaaacccaggctcaaacaggtgggggaggaggataaacagccatattcacaaatgcattcttgaatcactgaatctatgtgaaataattaaacaaaagagaatgtccttaaaaagaactcatatttgcaggcctaatcttcacccaagagatcttaaaatgctatcaccttatgcataagagctaaagagaaatactgcaaggcatcatgatatcctgagaaaacttaaagctaagacagaagaaacagagattagccagaaaaaaacaaagtctagaaaaatcaacattgatatatttcaaaagatttaacagctgcagaaaatgagtttcaaaaacaaaaaatactatttttaaaaataccagtcttattatttttattagaaaggttaggaggatagaagagaagcaagtagacaagctgactctaaatttctctaggaaaagtaagcaaacaggaatagccaggaagctgtgaaaaagaagtgcaacaatgggaagctagctccatcagagattaaaacataatatgaaataaaataacttttttaaaaagcggtagcagtagatgaatgtctgctagatgaagaagagaacagaaagtccacacatagtgccaaagacaacaggaaattatcacaccataataatagcaatttttagagcacttacttgtgccaggcactaagaatcttatgtatattaaatgtctgactactccatgagataggtacaattattgtatttttatttgaggaaactgaggcatagacatatgaagtaacttgcccaagatctcagaggcaagaagtggtgctgctagaatttcaacctaggtaatctagctacaaagtccacactcttaacctgtacgcactatggtttttctgtttttcattcaggtgacatctcaaatcatggaggaataataaacaattcaataaacagcattaaattggaattcaatttttttctacatatgttcaaatggacatttgtagaaaaaataaattggcccatatttcaaatcaggaaaaatttcaggccagacacagtggctcacacctgtaatcccaacactttgggaggctgagataggaggattgcttcagtccaggtgtgcaaaactggtctgggtaacatggggaaaccccatttctacaaaaaaatgcaaaattagctgggcatggtggtgctcacctatgatctcagctactcaggcagctgaggtggaaggatcacttgagcccgggaagtcccagctacagtaagctgtgatcacaccactgcaatccagcctgggtgacagagtgagatggataaataccagagtgataaataccatcaaaataatacaggaaagcatagaactttaaggaagttctgagtaagaaaagcctttctatgtatgattcaaaacccactaactataaaagaatagcacaataaattcaagctacataaaaataaaaagcttttggctgggcacagtggctcgtgcctgtaatcccagcactttgggaggctgaggtggacagatcacttgaggtcaggagttcgacaccagcctgaccaacatggtagaaccctgtctctactaaaaatataaaaattagccgggcgtggtggcatgtgcctataatcccagctacttgggaggctgaggcagaagaattgcttgaacccaggaagcagaggttgcagtgagccgatatcacaccactgcactccagcctgggtgacagagccagactctgtctgaaaaaaataataaataaaatttaaaagaaataaaaataaataaaataaaataaaaagctttttattaaaaaaaaaaacaccactagtcaagtcaaatcaatccctttaaaataagaagcttctagaaaataacaaaaacatcaactcaatataaaaaggggcaaagtaacatgttatttaacaatgaatttaatccctctccctctcactctgcctctccccctccccctcccctttgcacggtcctcgtctcccctttgcacggtctccctctgatgccgagccgaggctggactgtactgctgccatcttggctcactgcagcctccctgcctgattctcctgcctcagcctgccgagtgcctgggattgcaggcatgcgccaccacacctgactggttttcgtattttttggtggagacggggtttcgccctgttggccgggctggtctccagctcctgactgcgagtggtctgccggcctcggcctcctgaggtgccgggattgcagacagagtctcgttcactcagtgctcaatggtgcccaggctggagtgcagtggcgtgatctcgaatcgctacaacctccacctcccagccgcctgccttggcctcccaaagtgccgagattgcagcctctgcccggctgccaccccatataggaagtgaggagcgtctctgcctggccgcccatcgtctgggatgcgaggagcccctctgcctggccgcccagtccgggaagtgaggagtgcctcttcccggccgccaccccgtctaggaagtgaggagcatctctgcctggccgcccatcgtctgggatgtgaggagcccctccgcccggccccccagtctgggaagtgaggagcgcctcttcccggcagtcatcccgtctaggaagtgaggagcgtctctgcctggccgcccatcatctgggatgtggggagcgcctgtgccccgccgccccgtctgggatgtgaagagtgcctctgccctgccgcgaccccgtctgggaactgaggagtgtctctgccctgccgccaccccttctgggaggtgaggagcgtctctgaccggccgccccatctgagaagtgatgagcccctccgcccggcagcctccccgtccgggaagtgaggagcgtctccgcccggcagccgccccgtccaggaggtggggggcagcccccgcccggccagctgccccgtctgggaggtggggggcccctctgcccagccaccccatctgggaagtgagaagcccctctgcccggccgccaccctgtctgggagatgggggggcccctctgcccagcagccccgtctgggaagtgaggagcccctctgcccggccgccaccccgtctgggaggtgtacccaacagctcattgagaacgggccatgatgacgatggcggttttgtcgaatagaaaagggggaaatgtggggaaaagaaggagaggtcggattgttattgtgtctgtgtggaaagaagtagacataggagactccatttcattctgtactaggaaaaattcttctgccttgggatgctgttaatctataaccttacccccaaccccgtgctctctgaaacatgtgctgtgtccactaagggttaaatggattaagggcggtgcaagatgtgctttgttaaacagatgcttgaaggcagcatactcgttaagagtcatcaccactccctaatctcaagtacccagggacacaaacactgcagaaggcggcagggccctctgcctaggaaaaccagagacctttgttcacatgtttatctgctgaccttccctccactattgtcctatgaccctgccaaatccccctctctgagaaacacccaagaatgatcaataaatactaaaataaaaaaattaaaaaaaatgaatttaaaaatgagcaaaggatacaaatggataattcaaagaaaatatggtcaaccttagtcataagggaaatgtaaatttaaattctgattaatcatcactttttcacctattagactggcaaaaaccacagctgctaatactgttggagatgctacagaggcactttcatagagttctggagggagaataaattaatataatccctgggaaggcagtttggcaatataaaccaaaattataaaggaataaaacctttgacccagcaattatatctctaagaatctatcctatagatacaattacattaagtatgaaatagtatatgtaaagattatttattgaagtattattagtaataacaaaatactggaaacaacccagtaaacaggggtcaagacaaccatggttcatctatgcaatagaatacttatatagctcttttaaaaatacagaagctctgtataaaatgctttagaaagacaaataagaaaaattatcagcaaagaaaaagcaagatgtagaacaaggggtacagcatgccaccttctgtacaatgaacaagtgaaacatacaagtatttacattagtttataaaagcctaagaaaatttagaaggatacatgagctgctaataatacttttcaggttttctctctatcgtctatatatcaatcattcatccatctacctatctatttatttgagacagggtctcactctgttgtccaggtggcagactgcagtggcgtgaacacagctcactgtagccacaacctcctgggctcaagggatcctcccgcctcagcctcctaagtagctgggactataggcacatacgaccatgcccggctaatttttttttttttttttaatacagatggggtttcaccaagttgtccaggttggtctcaaactcctgggcttaaacagtccttccacctcggccttgcaaagtgttgatgttacaggtgtgagccactgggcctgacctaggttttcttaagcagtgactaaattaactgaaggagagagatgagcaagggataatgtatgctggaaacaaggagaaaagaggtcatagagagagatttcattaaatacattcctatttttgacctgtgttaaaatgtttcaaagtcatatatttgacagaccagaaacaataccatcccacaggtactggatgagataccccaaataatatgttaatatcaataaagatagtgttttgtacatgatccatcttcattttcgtttttgactatggtattatgtgaaattttgcccctggagaaagggaagtacatattggagactgcagtggaagatggtagaaaagaagtgaatcagcaacttatgaggcaaatgcattaaaagcaaaatacccaagtggtatatttgtagctcattctcttaagtgctacatcttactgcttgttttgtattgctagttcattcttttttttttttttgagacggagtctcgttctgtcacccaggctggagtgcagtggcatgatcttgacatactgcaagctctgcctcccaggttcaaagccattctcctgcctcagcctcccaggtagctgggactacaggtgcccgccaccacacccagctaattttttttttttttttttttttggtaatttttggtagagacggggtttcaccatgttagccaggatgatcttgatctcccaacctcgtgatccgcccgcttcggcctcccagagtgctgggattacaggcgtgagccaccgcgcccggccgctagttcattcttaattattcaaattaactaaaaggcaaatcaggatgctttctagataattttttgtattataaaaccaagaaggtaaacagtgctagtttaagcatttggctgagttaacagatttttcccaaacaagagcacactgcagcctgtatttctcaaaacatctattactattgcatgtcatccatcagcataaacaaatggaagttcaaaaaatagggctgaaacaagacagctttggtaagaattaatatttaaatgtcttcctcagtgtcgtgtcatcaggaatcccaggctgaggcccagagacaacctcatggccttgaaatctaaacaacatagaaacataagccttcactatctcttattagttatttgagatctactatttactccataaacttaaaatatcaagtaaacactggtttttaataaaagtctaatttaatttgttttaaatagtagttaaaaaaccattaacacattaaggacataaaaaaaattcctccttgaaaaataactccaatttaattcagaactctaatgatagcacattattaccaccacctcaagcttctcaagaccattttaactatgtaataacccctgaacaaaaatcatcatggcttctcatcacctacagaataaaattttaatcacttgggcaacaacgcaaaatgtcaaaaagtctcacttcccatgttgtccctatacaatccagtccagactatttattatatccagaaggagttttaatattctactcccttgcctttgctctccctccctaaaattcaaagtttagctctagccccacttctacaaaacgacatttccagataaaacttgtccattgcaaaatatgctcagttcatagatactgctttgaatttttagtctcccatccaagtacagacatacatcattttatggcacttcatgttattgttctttgcagatacagcattttttacaaattgaaggtttgtggcagccctgcatccagcaggtccattggcaccatttttccaacagcatgtgcttgctttgtgtttctgtgtcacattttggtaaatctcacaatatctccaactttttcattattattatatttgttatgatgatctggaatcagtgatctttgatgttactactgtaactgttctggggtatcataaaccatgtccatataagatagtgaacttaataaatgtggtatgtgttctatagctctaccaagagactattcccccatctctcttcctctttttgggccaccctattatctgagacataacattgaaattaggccaattaataaacctacaatggcctctaagtgttcaagtgaaaggaagatttgcacatcttttttttttttttttttttgagacagagtctcactctgtcgcccaggctggagagcagtggcgcgatttcggtttactgcaacctccacctcccaggttcaagcgattctcctgcctcagccgcccgagtagctgggattccaggcatctgccaccatgtctggctaatttttgtattttagtagggatggggtttcaccatgttggccaggctagtctcgaactcctgacctcaagtgatcacccacctcggccttccaaagtgctgggatcacaggcatgagccactgtgcccggccgcacatctctcattttaagtaaaaaactagaaatgattaagcacagaaaggcctacgtcaaaggttgaaataggccaaaagctaggcctcttgtgccaaaatccaagtgtgaatgcaaagggaaagttcttgaaggaaattaaacgtaagcaaaacagcttcatggctgatatggagaaagttttagtggtctggatagatcaaatcagtcacaacgttcccttaggccaaagcctaatccagtgcaaggccctaactctcttcaattttatgaagtctgggagaggtgagtaagctgtagaagaaaaagtggaagccagcagaggcttaaggaaagaaacagtctccataacacaaaatgcaagataaagcttcaggtactaatggagaaggtacagcaaattatccagaagatctacctgagataactgataaaggtggctacacaatagatttttaatgtagacaaaacagccttctattgcaagaagatgccatctaggactttcctagatacagatatgaaatcaatgcctggtttcaaagcttcatagaacaggcagactctactgttaggggctaatgcagctggtgactaagttgaaggcaatgctcacaaaccattctgaaaatcgtaagatccttcagaattatgttaaatgtactctgcctatgctctataaatggaacaacaaagcctggatgactgcatatctgttcacagcacagtgtactgaatattttaagccaactgttgagactcactgctcggaaaaaaagatttcctttcaaaatattattgaccatttacaatgcacctggtcacctaagagctctgatgcagatatacaaggagattcacgttgttttcgtgcctgttaacataacatccattttgcagcccatagttcaaaatgtaatttcaactttcaaatcttattatctaggaaatacattttgtaaggctatcactgccatagatagtgattcctctgatagagctgagcaaagtaaacagaaaaccttctgaaaatgattcaccattgtagatgccatgaggaacatttttgattcatgggaggaggagtttggaagaaatggattccagaccccatggatgactttgagaggttcaagacttccatggaggaagtcacagcacatgtggtggaaatagcaagagaactagattgagaagtggagcacccaggctggagtgcagtggtgcaatcacaactcactatagccttgacctcccagactcaggtaatcctcccacctcagccacccaggtagctaggactacagatgaacgccacaacacccagctaatttctttttatttttggtagagacaaggtctcaccatgttgcccaggctagtctcgaactcctgggctcaagttatccacccacctcagcctcccaaagtgctgagattacaggcgtgagccaccacacctggccaaagcggtttcttgagatggaaatctacaactggtgaagatgccatgagtattgttgagataacaaaggatttagaatcttacataaatttagttgataacgcagtagcagaatttgagaggactgactccaattctgaaagaagttctactgttcatagaacactactgaacagcattgcatgctacagagaaatttttcaagacaagaaaacaaagatcagtcaatggggcaaaacttcattgtggtctgattttaacaacttttcacagccactgagcaaccaccaccctgatcgaggcaaaaccctccaccaccaaaaagattaggacactctgaatgctcagatgatcgttagcatttttaagcaataaagcatttttttaatgaaggtgtgtgcattgtttttttagacataatggtattacacacttaacagactaaagtaggctgggtgtgatggctcacatctgtaatcccagcacttagggaggctgaggcagacagatcacttgagcccaggagtttaagaccagcctgggcaacttagggagaccccatctctacaaaaaagtaaaaacttagctgggcatggtggcctacacctgtagtcccagctacttgggaggttgaggtgggaggatcgcttaagcccaagaggttgaggctgcagtaagccttgatcacactactgcacttcagcctgggcagcaaagcaagaccctgtctcaaaaaaataataataatatatacttgtgtgtgtgtgtgtgtgtgtgtgtgtgtgtgtacacacacacacacacacacacacacacacaaaagtatactgtaaatgtaactcatatgcattggaaaaccaaaaaatgtgtgactcatattcactactttattgcagtgctctcaaacaaaatctgcaatatctccaaggtatgcctgtactaatcaggcctaactccgcttagcttcaaagatcagacaacactgggtgtgctcagggtggtataactgtgtctagagtattagttatctttatatgagtcttgtttccatcagactgtaagcttctgagaaggaaaactgcatttggtgagcacctactatgtgctgggcattattttcaaatattccaagagccctatgaaactggtactgttattctcattttaaagatacagaaactaggtcagaaagattacacagcttgaccaagatcataagcccaagaactgacagacctgagtcaaaccaaaagtctacctgattccatgcaagatactgcctctcaaaaagaaaagaaaaattcaaaacaaaactattagaaagctatacagtatatagaatatgtcgaagtgtgctcactcatttcatttttgttgcaacccttagaggcaatgtattagttatggttgctactacttttctctggcaagcataatttcacatttccctttctctggttcctttgaggaactttttccttacttcaaagtagtcctggcagggacatgaatcatggtgcccaatttcatacagagtggcacacaacaaagataaggcaatcagacacatactgtcacatataatgattgttttagctataaggtcatcatgtaagccagcccagtcaaaatccttcaggggtctaggcattttcattatgttattttgaataattctgcttctaaccttcatcccagccaccttctctttcctcaactcaacacaacagaaatttgataaaagttcaataattgcaaaaggaatatttggcataagggtgaaaatacacagatatacttggttcctcatgtcttaataaaatctatagtgaaataaagtcaaagaacaatgctttcagtacagagtacttagataacaaaatatcattctctttctaatcataagatatatttaatactaaattttatgtaacaaatagctataaacaaatgaaacattaagagctctgatttttatttactatttcacaagggttccaagcttggcccaaagaggaagggaaaaagaattcacatgctataaaaaacaggtatgcaatctgaagcttgtgttaaagaaagaaggtaaaaatggagatgcctttaatgtatcatcatttgaaaacttacagcaaattaatgtagtatattagccaacacacagattagggagaaaaaatgcataaatgtatgccagtataatgtacctccattccataactactgagaaaataattagaaatttacagcacaatatatttatagattctcttataagtaccttaccaaaaaaatcaatgctacaaaaatgaaactaatgagcaccatctcatgggcatttgaagtaatatatgtaaaaccagcctttgcaagagctttaaaaagccaagttacttagtaaaggattaatcataaaactttcttttaaaatttcaaattttgtacatatatcctaaaaagttaacaagggttttaaacaaacagatatactatttaagccagtatttaaatagcttcaacaaatataaggggaggagatgtaaaatgattctcacaaaacaaactctgtagaagagttaaatagaagcaaaatccaaaactgttaaaaaataaaataaaataaaatagtacttaacaagaaaaaacaggattttagatagatttggcaaatctgaaagtaacataaatcaactctttctcatagtgactaacagattttccattttaaaaaccctgacttgatcattatacattctacgcatgtaacaaaataccatatgtaccccataaatatgtaaaatattacatatcaatttttaaaagtcagaagaaatgcttaaaaaacgtatttcacatttcctctaatggtgtacatttaaaaggaaatgcatttcccattcaaagaaaaacatgtactactttaagactaaagcaatctttgtcagcttcctggctcttcatttaagtttattttctaaaggcaatcaagtggaatatattaactagactatctgatactaaacaaagcagttatttcctgcctgaaatttcatccagtagcaacatacactcactgaagcacttcagtgtcacattctctcttggttcagattacatgaactcactttctgtaaattaatagtcagatcaagtatcttcttacagtgttagaagaaatggcaaactttgagaacaaaaattgtcctttaaaaaaaaactatcaataattagtcttggccgggactggtgatgggcacctataatcctagcactttgggaagccaaggaaggaggatcacttgaggccaggagttcaagaccagcctgggcaacagaatgagaccctgtctctatttttaaaattaaatattttgtctgtctgtttgtttgtttgtttgtttgtttgtttgtttttggagacaaagttttgctcttgttgcccaggctggagtgcaatggcatgatctcagctcactgcaacctccgcctcctgggttcaagcaattctcctgcctccgcctcccgagtagctgggattacaggcatgcgccaccacgcccagctaattttgtatttttagtagagacggggtttctccatattggtcaggctggtctcaaactcccgacctcaggtgatctgcccgcctcagcctcccaaagtgctggtattacaggcgtgagctaccatgcttggcctaaaattaaaattttttaaatgatattaatcagtctagttatcaagtccaatcttgttctacattaatatttcaaaagaggcataatgtatagaatcaaatgtgtacaatatagagtaaaatcttctaataattctgttctaataactgtgtgattacatataagataaaaggatgtctaaataaaaacttgtgtggatttttgccagttaggctattgattctgtttaaagaaaccaactcatgaccagacatggtggcttgtgcctgtaaccccagcacttcacgaggctgaagcgagaagatcacttcagcccaggaattcaagaccagcctgggcaaaatagcgagaccctgtctccacaaaaagtaaaaagcaaaagaaacttgagcatcagcagtgcagtaaagtttaaaagagcacaacacaagaatgcatcactgcaaatgaatctatcaacacacattaatcaagcagctattacataaaagatcaaatataagacgcactcgctgattcacaaaaatattcatgttcagcaggcaaaataacaatgagtacggtatgcaaagtactgccactggctataaaagggtaatggacaccagatttaatctctcaccataaagtggaaaactaaacaaaatacataaaacaattctttggactgtgatcactgaaagcacaaaaacaaacaaggtctcaactcagtgacaccttgagacaatgaaaccattgagttgagacaaccatcattctaatgagttgaagagacacagatcagagttcagagagaatgagatggctggaattcaaggagaagagtaccagagaagaaggttacctgagaaattgctctagaaatcttagtagtggtccctttgagtatttggatgaatactaaactgcatgggcattgggtgagaatcagaacaccatcaagagaagaacaactaccgagattgttgtaagctgaaaaattctacaggtcacacagggctgagagaagtctgaattctattcaaagtggaaagatctcaaacatccaaggctttggactaagctttagttgtacaactaaacaaggactagaataaaggctacactatatctaccattgcaatatttaaaaacaagctttgagtctgccttgaaagaactgtatagcagataaatagaagcgctggctacagtgctgacagaaaccttgtctttcaagccagacaaactggaaaaaggcaggagagggtaggaaagtcatggagagaagaaaagttctctatgaaccaatacaagactcatccctgtgcaaagcatatgacagacccaaaccagaaaagtaaaagctttgagaatcgaactcaaatctcagactagcccctgagtggcatatacacaggacaaacccaaaaaaaaagcaaggcaaagcttttgaaaactgaactgatattgaaaccactacatatagaaagcaggccaaaacttgtggtctgaccctaataaaggttgattgcctgctaaacaaacaaaataaatcagccttctccaagaaatataacacagctcagagtctaccaacataactttcacaaaatcaggaatacaatccagaaattacttggcatacaaaaaatcaaaaaactatgaatttcaagagaaacaacaataaacagataaaaacaaatctctactaatcagatgttggaattaccatggaaagagtttaaagcagctattaatattataactatgcttcaggaggtaaagataaaggtaaagtagccaggcacagtggctcacgcctgtaatcccaacattttgagaagccaaggcgggtgggatcacttgaggccaagagttagagaccagcctggccaacgtggtgaaaccccatcttaaaaatacaaaaattagctgggtgtggtggtgcatgcctgtaattccagctactcaggaggctgaggcaggagaatcccttgaacccgggagacggaggttgcagtgagcccagatcgcaccactgcacttcagcctaagtgacagagtgagactgtgagactctatctcaaaaaaaaaaaaaagaaagaaagaaaacaaaaaagaaaaggtaaagaaaaatgaaatgaatggaaagacagaatagaagtattcaatggagaaaactgagaagtaaaaaatctattaagaaattatttaagaagtaaaaacctattaagcctagatgggcacattagcagaatggagatgacagaaaaaataatcaatgaatataaaaataaatcaatataaattatttaacctgaaaaacaaagaaagaggtaagattgaaaaaaatgaataatctaatggaaatatgggacagtatccaaaagtctaacatacatgtcactggagttccaaaaaggagagtagaggccgggcgcagtggctcacgcctgtaatcccaacactttgggaggccaaggtgggcagatcacttgatgtaaggagtttgagaccagcctggccaacatagtgaaaccccatctctattaaaaattaaaaaaataaaataaaaacttagctgggcgtggcagcacacacctgtaatcccagctactcagaaggctgaggcaggagaatcgtctgaacctgggaggcagaggttgcagtgagccaagattgtgccactgcactccagcttgggtgacagagtgaaactccgtcttgaaaaaaaaaaaaaaaaaaagaacaaaaaggagagtagaaagagactgaggcagaaaaatatttgactgactagacaaatttgttgaaatatataaattacttctaatatagcctcaccataaactcacacgtcatacaagctaacagaagagctgtcccccaaacaaatacatttcactaatgatgcagagctcaaatagcacaaaagaagtaattcatcctctggataaatgatttccaaacagttgattacatactcctactggcaaaaaattaagtagtcagatcacagatatattaacgtataaattatatatgggttactgaatactaatctgttatttaatctaatatgttatatatgttactaatctttattaagttattttttaaaagaaattagaggacagagaaagatggccaaatacaagccttcaccgatcatcgccgcgacagaaacaacaaatttaacaaccatgtccacaaaaaagcaccttcataaaaaccaaaaataaggtgagcaatcacttcgtatcacagaaaggggcactgaagaaggtaagcaagacagtcttgaattgctattccccccaaaagcagctgtgtgtcatggagcacctacgcgcctgggagtgggagagtgcagcgactgtgggatcctgcattgaacagtgctgccctgtcacagcggaaagcagaacaagactaaaattagccaacgtccacctacagagagagtattaagaccagccctagccagaagagaactgcacatcccagtggctggaaacagtattgacaagcctcaccaccgtggcttaaagtgcttggggcctctaaataaacttgaagggcagtctaggccacaaggactgaaattcctaggcaagtcctagcactgtgctctgagtccactggctctgaacatgaggggcatgtgacctggtaagaccccagctggggcagctaaggaagtacttgcgccactcctctccaacccctggcagcgcagcttgcaacaacaaaagtgactccttccatcagcttgaggagaggagagtgaaaagttaaaaggactttgtcttgcatcttggatactagctcagccacaatcgaataggaaaccaggcagtcatgaggaccccattccaggtcccagctcagtcatgaggaccccattccaggtcgtagctcgggcaacatatatacacacacgctgggccagaagggaacccgctgccttgaagggaatgacccaatcctggcaggattgattacttgctgactaaagagcccttggaccctgcagaaccagaagcaacatccaagtagtaagccatgggccttgggtgagactctgaaacgtgccggcttcaggaatcacctcggacacagtggtgtaaagcaccaaaagggctcctgagatccccgattctaggctttggctcttggacagcatttctggacatgccctgggccagaagagagcctgctgcccaaaagggtgagtcccaggcctggaagcattcaccacaagctaactgaagagtccttgggccttaagcgaacattggcagtaacctggcagtattccccatgggtctgtggtggtggtggctagtgggagatgctcctctacctatgtaaacaggagggaagagtgggaaagactttgagcaacatcttagccacagaatagagcaccagtcagatttctaagagtttttattccactccttggctcctggatggcctctctagacctgccaagggcctcaggaaacacgctaccctgaagggaaggacataagccttactggcttcgccaactgctgatggtagagccctagggccttgagtgaatatagagagtagccaggtagtggttatagcaggccttgggtgagacccagtgctgtgctggcttcagatctgacccagcacagtcccaatggtggtggccacataggtgcttgtgtctccctacacccagctccaggtggttcagcacagagagagagagagcaacataccatttgtttgggacaaagtaatggaagaaaacaagagtctccacctggtaaccaacagaattcttccagatcttatccaagaccaccaaggcagtacctctatgagtctacaagaaccaaagcattatgggcttgggatgccccctaatccagatacagcttagatcacaatagccagtcccttcaaatacctggaaagccttcccaagacagatgggcacaaataagcccagactgtgaagactataataacagtccagacactgacaaacatccacaagcatcaacacttcctaggaaaacatgacctcaccaaaaaactacataaagaaccagagaccaatcctggagaaacagagatatgtggccttttaggcacagaattcaaaatagctattttgaggaaactcaaagaaattgaagataacacaaagaaggaattcagaattctatcggataaatttaacaaaaaagatgaaatattaaaaaagaatcaagcagaaatttgagaattgaaaaatgaaactgatatattaaagaatgcatcagagtctcttaacagaattgatcaaacagaagaaagaattagtaagcttgaagacagcctatttgaaaatacacacttagaggagacaaaaacaaagaaaagaatacaaaagaatgaagcatgcctacaagatctagaaaacagcctcaaaaggacaaatctgagagttattgtccttaaagaggaagtggagaaagaaataggggtagaaagtctattcaaagggataataacagagaactttgcaaacctagagaaagatatcaatactcaagtacaagaaggatacagaacaccaagcagatttaacccaaagactacctcaaggcatttaataatcaaactcccaaagatcaataataaggaaaggatcctaaaaggggcaggagaaaagaaacaaataacgtacaatggagctccaatacatccggcagctgacttttcagtggaaaccttaaagccacatgagagtggcatgaatatatttaaggtgcagacggaaaaaaactcttaccctagaatattatatccagtgaaaatatccttcaaacatgaagaagaaattaagacttccaagacaaacaaaagctgaggtgtttcatcaccatacctgtcctacaagaaatgctaaaggaagttagttcctcaatcaaaaagaaacagatgttagtaagcaacaagaaaagaaatcatctgaaagtacaaaattaattggcaacagtaagcatacagaaaaacacaataacaccataacttgggcatataaattactcttaagtagaatgactaaaagatgaacacagacactacaataaaatataaacagaaacaacaaaaagttaaaaagcagggagataaaggtaaagtgtagagcttttattagttttctttttgcttctttgtttaagcaatcagtgttaaactgtcaccagtttaaaataataagttataagatagtatttgcaagcttcatggtaacctcaaatcagaaaacatacaacctaccaatattgaaccaggaagaaatccaaagtctaaacagaccaataacaagtaatgagattgaagccataataaagtgtctcacagtaaagaaaagtccaggacctgatggctttactgctggattctaacaaacatttgaagaactaataccaatcctactcaaattattccgaaaaataggggagggaatacttccaaactcattcaacatggccagtattaccctgataccaaaagagacaaagacatatcaaaaaaaggaaaactgtacaccactatctctgatgaatattcacatgaaaatcctcaacaaaatactataatagcaagctgaatttaacaacacatgaaaaagatcatttatcatgaccaagtgagatttatcccagggatgcaaagatggttcaacatatgcaaatcaatcaatatgatacatcatattaacagaatggagaacaaaaacaacaagatcatttcaactgatgctgaaaaagcatttgacaaaattcaatgtctcaccgtgacaaaaaaaaccctcaaaaaactagggagagaagaggcatacctcaacataataaaagccatatatgacaaccacagatagtatcatactgatgggggaaaaactgaaagtctttcctctagatctggaacacaacaaagatgcccactatcaccactgttattaaacatagtactggaagccatagctagagcaatcagacaagagaaagaaataaagagtggtggcacttgcctgtggtcccagctgcccaggggagagggggctgaggcaggagaatcgcttgaacctgggaggcggaggttgcagtgagacgagatcacgccactgcacttgggtgacagagtgaaattcggagagaaaaggaaggggaaggggaaggggaatccaaattggaaaggaagaagttaaatttcccttgtttgcatatgatatgatcttatatttggaaaaacctagagagtccaccaaaaaactattagaagtgattaattcagtaaagttgtagaatacaaaatcaacatttgaatatcagtagcatttctatatgccaacagcaaacaatctgaacatgaaatgaaaaaaagtaatcctatttaaaatagctacaaataaatacctaggaattaaccaaagaattaaaagatctctacaatgaaaacaataaaatactggtgaaaaaaagtgaagaggacaccaaaaaatggaaagatattccatgttcacggattgcaagaatcaatactgttaaaatgtccatagtacccaaagcaatctacagattcaatgcaatccctatcaaaatactaatgacattcttcagagaaattaaaaaaaaaaaaaacattagctcggcgcagtggctcacgcctgtaatcccagcactttgggaggccgcggtgggcagatcacaaggtccgaagttcgagaccagcctggccaacatagtgaaaccttgtctctactaaaaatacaaaaaattagccaggtgtgctggcatgcacctgtagtcccagctactctggaggctgaggtgggagaatcgcctgaacctgggaagtggaggttgtggtgagctgagatcacaccattgcactccagcctcggcgacggagtgagactgtctcaaaaaaaaaaaaaaaaaaaattataaaatttatatggaaccacaaaagacccagaatagccaaagctatcctgagcaaaagaacaaaactggaagaatcacactatctgacttcaatttataccacacagctatagtaaccaaaacagcatggtactagcacaaaaacagacacacagaccagaagaacagaacagacaactcagaaacaaatccatacaactacagtgaactcaattccaacaaaggtgccaagaacacacattgggggccggacacggtggctcacacctgtaatcccagcactttgggaggccgaggcaggtggatcacgaggtcaggagatcaagaccatcctggctaacacggcgaaaccctgtgtctactaaaaatacaaaaaattagccgggcgtggtggtggcgggtgcctgtagtcccagctacttgggaggctgaggcaggagaacggtgtgaacccgggaggcggaggttgcagggagctgagatcatgccactgcactccagccagggagacagagcaagactccatctcaaaaaaaaaaaaaaaaaagtaacctgtttcatagtttaataaataatgttttctgtttcttagttgtacaaaaaatgatgcatcttacaatagcatcttatggagtcaatgaaaaataataaatgtacaggccaaaacacatcaagttttcttcatccaactaactagaaaaatagaagacccaccatacacactagattaaggctacttagagatgagagacagtagtatgatcgatctggtcttcaagtaattgggacttcagttattaattgttccttaagtctcattctataataaatgtgcttaattataattttaaaagtacttacgtacattgtgaggaaatcaatatatagctattaaaatatgtaatgttttaaatgggctttaaagcttcaaaaactaaaatgccccttgaaaactaggtttagagggaactaaaaactactaaattatttaataggtgatcatccaaaataaaatgtgtaacaaaaggaaacaatgtaaggttacagtaaatatgggatttaaatacagtaagaagacaattcaactgtcagtaaactccctgtaatgctaggaaaatgaatgctaggattatcagagattttttaattttgtttcatttgtatttgccaaaaaaaaaaaaaacacccatagaataaaaaataccagtttctcttgtaatttgcattttttaccaccacatttccccttctggaaggaattaaaggaagattactaagatgggtcaagtaacaacagaggacaacaagtaaacaaagaagccacagaatgtagggcaatgcttatcagtttaaccaagtgaatcaggagactatgaatgtaatggaacaaatttagccataaattcactgagctgggacaaccatctgaaaacctacactgtgatctatggatttacacaaaaggtgcagaactggaaagtgggagaagaaaactgtataccaaattatttcctaggaattatccagtctgatgatttttccactttaaaactttctgatcacctgagcccaggaggtcaaggttgcagtaagcagtgactgtgccactgtactccagcctgggcaacagagcaagaccctgtctcaaagaaaaaaacaaaaagaaaaagaaaaaacaacattataaaactcaaatatttctaccacaaaattaaataagagattagaaaagtgaagtttttagccaggtgcagtggctcatacctgtagtcccagcatttgggaggctgaggcaagcggaacacttgaagccagaagttcaagactggcctgggcaacatggcaaaaaccatctctacaaaaaatcaaaaattagccaggtatgatggaacatgcctgtagtcccagttactgaggaagttgaggcagaaggaatgcttgaccccaggaggttgaggctgcagtgagctgtgttcatgccactgcaagccagcctgggtgatgaagcaagcactcttttttttttttttttttttttgagatggagtctcgctctgtcacctaggctgtagtgcagtggcacgatctcagctcactgcaacctctgcctctgggttcaagtgattctcctgcctcagcctcccgagtagctgggattacaggtgcccgccaccatacctggctaactttttgtattttttagtagataaagggtttcaccatgttggccaggctggtctcgaactcctgtcctcaggtgatccgcctgcctcagcctcccaaactgctgggattacaggtgtgagccaccacgccaggctggcgagtactccgtcttaaaaaaaaaaaaaaactacaatggctgataaggtaagaattagagaccagttaccatctgaactctcaagatacttacatgtaaaagaagagttgtatggtcatactcacctttctaccagaaatacttctgggatgtttttattcatgtatgcattcatttattcatttatttaacaaatatttattcagttcctatgatgccaggctgtttccaacctctgaaggcacttgattcaagccacaagcccaatttcctctactgcccacccccaactccaacagctcaagggcagttagttcaaatctttctgaataagaagataagggtagtaaaccacaaagaaccacactacggcctgccaataaaactagctaatttcattcaacctgttaaaatccaatcagaaagaaaaataaaccaaacataagaaaatttttgcgatctacagaactttagggctgggcgcagtggcccacgcctgtaatcccagcactttgggaggccaaggcgggcggatcacctgaggtcaggagttcgagaccagcctcaacatggagaaaccccatctctactaaaaatacaaaattagccgggcatggtggtgcatgcctgtaattccagctactctggaggctgagacaggagaattgcttgaacccggaaggcggaggttgtggtgagtggagattgcgccattgcactccagcctgggcaacaagagcgaaagtccgtctcaaaaaaaaaaagaactttaggatttgatagcatatctaatattccaaaataaatacatataatttcttaattgacatgccatctgtcaataaaagatttaaaaggtaatctgctacaagtcttcattcttatcactaacctttcttcatgtgctaacatgtacatttccttctttactgtgccttgactttccaaataaatttgtgtgtgtgtctgtaacagaatgagagacagacaaacagagacgcatttgggttttattataacgtattcacaccttaaggaaggagaaaggctgaggtagcaaaggaaaggaaaaaagtaaatggaattataaaagtgatggcttaaaaaaaacatacatatcacaaaactgttcttcctagcagcaattctctaacactcaaatttgtctatctagctatctaactcttaagaaagtaattaagcatttttaaataagtcttaaaaagcacggtggctcatgcccgtaatcccagtactttgggaggccaaggcgggtggatcacctaaggtagggagttcaagaccagcctggccaacatggcgaaaccccgtctctactaaaaatacaaaaaattaaccaggcatggtgacaggcgcctgtaatcccagctactcgagaagctgaggcaggagaatcacttgaacctgggggtggaggttgcagtgagccaagatcgcatcactgcactccagcctgggtgacagagctagactccatctcaaaaaaaaaaaaaaagcttatattttaaattaaaaaataaaacaaaagctcatgttcccttctaaaataagacctatgagaaaagttccaccatggaactagtaaaatcaaaataactattttatgttagttcagtctatgtaaattgtactgtaaagtttttgtatttagcattttagccaagataaaaatttaataaatacaggttgaaatctagaattgcacttttttttaatatatagtttttttttttttaattgagatggagtctcgctctattgcccaggctggagtgcagtggcaccatctcggctcactgcaagttccgcctcccgggttcacgccgttctcctgcctcagcctcccgagtagccaggactacaggcacccaccaccacacccagctaattttttatatttttattagagacgggatttcatcgtgttagccaggatagtcttgatctcctgacctcgtgatccgcccgcctcggcctcccaaagtgctgggattacaggcgtgagccaccgcgcccagttgaattgcacgtttttaatggtcatatttttatatcatgttgttaggaggaaaaaataaaatacctaagaatgatagttaaaaatccaaatgattctttactatcctactactctaattttaaatcaacattaaatttttcccagtatatttaatacatattataactaaaacattttaaatgtataaaagtgctttttttttggtagagatgggggtctcactttgttgaccaggctggtcttgaactccttaaaagtacattttttacagtcacacaggcaaattcacctaaataatttacaatgtagaattgaacatagtctgttaagggtgctttcaggtcatcagaatctgaaaattatacattaaaatagcagtccccaacctttatggcactagggaccagtttcacaaaagacaatttttccacagaacgggggtcagaggtgggtggatggtttcaagatgaaactgttccacctcagcgggagatgaacggcaggcaagcgagcattaccacctgagcttcacctcctgtcagatcagtggtagcattagattctcataggagcacaaaggagggatctgggttgcttgctccttatgagaatatgtacatagacctgaggtacatagacctgaggtactacagacttggtcaacttttggcctccttcttaaccatcagaggatgctaaaacatggtctgaaacagaatgtagacaaatctgacaaaatctgtcaatctggtaagatggttaaaataaagggaaggaagtagactgctatcccaactgtttccaaaccaatcactgaaatctccaatacacaaatcaaagccatcatgctaatttttgtcattccataaagggtagcaaacgtaccataaaaacaaaacagagatctactcatgttgtggtgactgaaaacaaagattttacaggcctttttacttgacacaggatgccaaggaagcttctaactgcagaagaacagaatacagatcccaaggaaaagcaacagcccaaggggcaaggaagtgagggggaaggcagtaaagaaaatgatactcgtgcgataggtgaaaggagagaaagggaatctgtggaaacttccaccttctgctaaagaacagaaaaaaatcataggatattccattcgaccaacaatataccctctggggccagggagtagagaagctagctgaaaacagcctcattagagtcaaaatttgacatgtctcaggcaaaatcattcttaaagttttgttccatatcaagttttcatgtcttcagatttacataagaagggttttcctcatctataaccaattaattggcatttccagctagaaataagaacttaaattacacagtggtcccaatgattaaaagctcccaggattgtaaacagactttgatttgcaattaagaatattttactcctactccagtaatgacaagagcaaaacaaaaatacatcaagtctttctcaaagccaatacagtaagtactgaagaaattgtgctaatgccttaaaggttactgaaaataaggtacttacagaagtatgcatataaatctctactagaaaggataaaagtgccagtcagcaagttcattcaggccagatgtggtggctcacctgtaatcccagcactttgggggactgaggcgggcagaccacttagtccagtcaggagctcgaaaacagctgggccaacatggcaaaaccccgtctctactaaaaacacaaaaattagccaggcatggtggcaggcacctgtaatcccagctactctgcaggctgagacaggagaatcgcttgaacctgggagacagaggtggcagtgagctgagatcgcaccactgcactccagcctgggcgacagagtgagtctctgtatccaaaaaaaaaaacaggccaggcgcggtggctcacacctgtaatcccagcactgtgagaggccgaggcaggcagatcacctgaggtcaggagctcgagaccagcctggccaacatggggaaaccctgtctctactaaaaatacaaaaaattgccgggtgtcctggtgagcggctgtaataccagctacccaggaggctgaggcaggagaatcgcttgaacccaggaggcagaggttgcagttagcagagatcacacaacttcactacagcctgggtgacagagcaagactccgtctcaaaaaaaaaaaaaaaaaagtgcattcgccttattgaaaactcttcttataatatcaaacccaaatcagcatccatcatcatagattattagacttctatctcaaatacacaagaaaaaaataataaagtcaaaccctatgtataaacccatggtgacctcaggcaattttaaatccaaaattattcaaaattatttgaagggataaagaatcaaattgccagcaccctcaaaatagaacagtacaggacacactggatcccattattgagcatggtactactacattcaacacaccatggatattatttcatcaatttcatataaactttggcagcagactttaagttcctagaaaattgttccccaaagttttgtaaccttaattaaagtataataattccaagaaacaaatcacagagaggcaaagaaaacaaacatatagaggccatgatgtcattagttaaaatgacatatgaaaaaatgcaagaatgttgataatgattaaagctggctgatgagttcataggttttcttttcgcttttgtgtatgtctaaaattttctatgagaaacagaatatcaaattttttttttttgagacacagtctcgctctgtcaccaggctggagtgcagtggtgcaatctcggctcactgcaacctctgtctcccgggttcaagctattctcttgcctcagtctcccgagtagctggaactacagctgcgtaccaccatgcccagctaatttttgtattttcagtagagacagggttttcccatgttggccaggatggtctcgatctcttgaccttgtgatccacccacctgggcctcccaaagtgctgggattacaggtgtgaaccaccgtgcccagccatcagattttatgaacagtatatcaaactcaccaaaatgagtttttattggctgtttataaattgggggtgggggggacacggtaattatcattaattaagtgcctataaagtgtttgtttttttgttgttgtttttttgttttgagacagagtctcactctgtcacccaggctggagtacaatggcacaatctgggatcactggaacctctgcctccagggtttaagcaattctcctgcctcagcctcccaagtagctaggactacaggcacgcaccaccaccccgcctcactaatttctgtattgttagtagagatggggtttcgccatgttggccaggctggtctcaaactcccgatctgaagtgatccacccaccacggcctcccaaagagctgaaattacaggtgcgagccacagcccccaagtaggtgttttaatatataagaactctgtggccaggcatggtggttcacacctgtaatcccagcactttgggaggccgaggcaggcagatcacgaggtcaggtgttcgagaccagcctggccaatatggtgaaacctcgactctactaaaaatacaaaaagtagccaggcatggtgacacacacctgtagtcccagctactcaggaggctgaggtgagagaatcgcttgaacccggaaggcacaggctgcagtgagccgagatcacgccactgcactccagcccgggcgacagagcgagactccatctcaaaaaaaagaactctatgagatagaatcagcccaattttacataaaagaaaattaagaatcaagagggtaaacttaatcttcctcaagatcatataggagctgaactgagacccacagccaaagaaagaaagaaggaaataaaaaaggaagacaatgactggtaaagggggtaaaaaaaaaaacctttttggcactaatatacaaaagaaacaatcagagaaataagccaggcatgcatggtggctcatgcctgtaatcacagaactttggaaggctaaggtgggataatggcttaaggccaggagttcgagaccagcctgggcaacatagcaagacccccatctctatgaaaaaaaatttttaattagaatttaattttttttaattagagaaatacaatttccagaaaatatcactaggtaaaatattcttatagaagtatgcaataacaaatattcaagcaaaatgaaagaaaaaatagaactgtatttagaaatctacactgtaagggtggatatcttgaggattagaatccagaggagaaatcccatttcagccatgatgttaaccagttgtgtgtgtgtatatatttacatatatatgtaaattcacatatacatatccatatcaaaacttccctaaacctgaatttaacatacaacttagaatagattaagaaaatgttctaaaaagtgtcattacatatttaacgtggtagtctatatttatcatccagaagaatttagcatataatcctcatatttgaagttcactgtacaaatacattactccaacactccagtgttaaggcaagcatctaaaagtaatattttgctgggtatcgtgactcatgcctgtaatcccagcactttaggagaccaaagtgggagaactgcttgaggccaggagtttcagaccagcctaggcaagacaacaaaaccccgtctctacaaaaaaaaacaaaacaaaagaattagccaggtgtggtggcatgtgcctatagtcccagctacttgggaggctgaggttggaggatcacttgagcccaggaggttgaggctacagtgaactgggatcacaccagtgtacttcagcctgggtgacagagcaagaccctatcacatggccaggcacagtagctcatgcctataatatcagcattttaggtggccgaggtgggcggatcacttgaggccaggagttgagaccagcctggccaacacggcaaaactctgtctattactaaaatacaaaaagtagctgggcatggtggtgcacacctgtaatcctagctactcaggaggctgagaggcacaagaatcacttgaaccagggaagcgctgaaccagggaggcgctgaacctcggacagggaggttgcactgagctgagattgtgccacagcattccaacctgagtgacaaagtgagactctgtctccaaaaaaaaaaaaaaaaagaagacgaagaagaaaaagaggaggaagaggaggatgaagaggaggaagaggaagcgtaagaagaagaaacaacaacacaattaaacaccactacaaacttactagaatgactaaaatttaaaacactgataataccaagtgctgacaaggatggagaacaactacagcaactacattactggtaggaatgcagcatgctacagccactttggaaaacagtttgacagttcttatgaagttaaacatacatttaccataccaagcacactcttcagtattcacccaggagaaaggaaaacatgtccaccaaaggcctataggcaaaggtttggggcaacttacccaaagtaactggataaacaaattgtaattacatccatagaatagaatacttctcagcaaaaattaaaaaagaaacaagcaacttaattatgcaacgacatagaggaatctcaaatgcaatttgctgagtacaagaagctagtcacgaaaggctacttgctacatgattccatttttattcaacattctggaaaacaaagtgacagggacagaaattagatcagtggttgccaggggatagggatggggaagagagaaatgactacaaaggggtaaaagggaactttttgaggtgggggaaatatctcatataccaaatgtgatggttgttatatgaccgtatacatcaatctacacaactcaaaagggtgaattttattctatgtaaatcataccttaataaacctgacttttaagatgacaaagatgtaatctctgccttcaagctcatgatctaatgagagaaatatatataaacacataatttgaacaaggtaaatgctatagtaagttatgaacaaagttctgtggtagaatggaggaggaataaagtctgtctcagagtgaggcaaaggattctcagagaaaataacatgtaagctatgtcttaaaagtaacaaggctgggcgcagtggctcatgcctgtaatcacagcactttgggaggccaaggcaggtacaatcactgaggtcaggagttcgagaccagcctagccaacatggcgaaacccagtctctactaaaaatacaaaaattagctggacacagtagcgtgcgcctgtaggcccagctactcgtgaggctgaggctagaaaatcgcttgaactcgggaggcaggggttgcagtgagccgagactacaccactgcactccagactgggcaacagagcgagactccgtctcaaaaaaaaaaaaaaggtaacgagcatgatgatgacagaccaagaagaaaaggacccaagcagagagaacagttgagagaaaaaacacagaggtatgtaaaggcaagattagccatgtgagagacagtaaacgaagtgtaggatgagttagagcatcagaggtcatgccatacatgataagatttgtgttttagaaagataagtataaatatcatgtgggaaaatatatggaggtatagaatgactggcagagaacaagaacagttttgaagggtgttacaataatcctagaaagagatacctggggtctgaattaaggttcaattaaaaggctatttagtgaaagactacttatgggaataaggaagaaaagacaagttaaggttaattgaaatttctgcaaagaacaagtgatcatcaataagatgagaaacataaaaggaaatacagatttgtttgataatccaagttggggggagaatcatctggcttccattttcctatctactaactctcttccttgtaggcatgccttctctaactaaaactgatatttattatgacttatctacttgaactattttataaaataactataagaagtaaaggcaacacagcaaaacctcagcaaagtttttacagtatcttagatatagcagaatagttattttaaaggtaaaaataaggccgggtgcagtggctcacacctataatccacgcactttgggaagccaaggcaggaggattgtttgagcccaggatatcaagaccctagcctgggcaacatagcaagactccatctctacaaaaaaataaaatttaaagaaattaaaaataagttttaaaaaagaaaacattgggcagtttggctagagcataattattagaacagataattagatttcctagtttttcaaaaatttgaattgtaataaaaggaaatttcaatgttctatttcaattttcagcagcaaataaatgtgtacaaaaaggaacttaaagaataaaaaataaatgaaaataggagaggaaagaataaatttaaatactgcatcgccaacttatgtaataggttccaaatttgtctttaaaaagcaattatgtgatggctaggcatagtaggctcacacctgtaaccccagcacgttgggaggccaaggcaggtggatcacctgaggtcaggagttcaagaccagcctgaccaacatgataaaacctcattgtattagtccattttcatgctattgataaagacatacaaaagactgggaagaaaaagaagtttaattggacttacagttccacatggctggggaggcctcaggatcatggagggaagcaaaaggcatttcttacatggtggtggcaagagaaaaagaggaagatgcaaaagcagaaacccctgataaaaccatcagatctcatgagacttattcactaccacgagaacagtatgggggaaactgcccccatgactcaaattatctcacaccgggtccctcccacaacacatgggaattatgggagtacaattcaagatgagatttgggtggggacacagagcaaaaccatatcacccatccctactaaaaatacaaaaattagcctggcgtggtggcaggcacctgtaatcccagatactcagtaggctaaggcaggagaattgcctgaacctgggaggcagaggttgcagtgagccgagatcataccactgcactccagcctgggcgacagagcaagactctgtctcaaaaaaaaaaaaaaaaaatcaattatgtgaaatttagaatatattgccccaaagaaacaatgtgacactaaagcatagctaaacaatactagggtattacaccaacctgctgaataaccaaccccaccaccatcaccaccaccaccaccactaccactaccactaccaaagtacagtgttgaggagaacagggtgctctgaggctgcctgaggttcaacatcttttgtgacctcgactggggtaattaattctacaagtctaatattcctcacctttaaaatggagatgataaaatcacctgctccacacgagttactgtgaaaattaaaagagggaacctaaagcacttagcacagtcatccatccaacatgtatttattaagcacctactacatgttaggtacaaggccccaaggccctggcaatgaaacagtaaacaaaaaaagtaagtccctacttttatggagtgtgtattctaataaaagaaaacacgcaataaaaaaaatctgatggagttaatgctatgaaaataaagcaggatataagagataaagagtaacaaggagaaggatactattttggtagtggggaaaggttctctaataaggccacaaattttaacaaagaccataagagaatgaagaagagggtcatacagagaactgggggaagaaatcagatccatttctggcaatatggtagactagatgcccagaaaagtacttgtgattcagaatttcttaaaatgctgaatattaaaacaaaaatagtatttttcatgagtggctgagctgaaagaaagaaaaaacaacaaagcattggtgagcactgaaaccagcctctcccctgggagcatccatcaattccccagtggcttagaagtcagtttaagggactggtgagaaggacataaaggttggggcctaaacaaggtgggaaatctgaaaagcaacactcagtggatgaactgcagaggagggtaaacaacatgctaaacagagatcacagttggcatgtttgcctttcccagtctcggtggaagagaaaaaacgaagtcacccttcgctcactccagtttaaggacaaaattcatactacctatgtggtctagaaaaactcagactaaaaattcagtttcgagagattctgggttggaagagactagagcatgacagaagcaaacaccaatccagccaagaggagtacactaaacccaagccttcagtgatattcacaaataaaaatccatggaagattatctcacaattaaaaagaaattcacaaaataatgaaaaaagcccccaagaatcagcagaacaagcctttcaggaacagaagaaacgatgaggaacatgaaaataatcagatatataatataaaaatgttaatgtttaaggaaataaaagagatatagaaagtatgactgaggaaaagaaactgtaaaaaacatgaatatgaaaaaatcaaacaattgtaatgtttctggatagaaacattacaattgcttattgatagtcatacaataattggatatttgagaggagatcattctaggcaaaggaaaaaataagttcaaaggccctaaggtaagactgtgcttggcttgctttaggaagtacaaaagggccatggcatccagagttgagtaaacaaggaagaaaagtgggaagaaatgacgaccaagaactggtacttaataggtcacaaaatacctcaataaatattatttattatcccataatttctattggaaaaatttggatattagaaataataatttcttctttaccatttctgcattaaatatagaagccagagcagagctacagaggatctcaagtaggttcagaaggaaataagaaaatattccttttctatgaagtagggagagtcttcagtagaggtcccagtgccaaggaagacatctgggtcttgtgtgagcaaggtagaaatgaagtgattcagaagatacatttctggaaataataatgatcaacaacaaccaaaaaaaaaaaaaaaaagtcaagatggaattaccatttcaaagtaggagacatttcaaacttgggcattaattggtaatcaggacatcctcagagtactcaaaaatttcacggttcaagtgaacgtttacatcctatgacaatgagaatttagcataaatgaaactcccaaagatatgccaaactttttaactatctggtttaattctcaactttttctaaatattttcaaaagacactaacaagtagcaaaatagtactactctgatttttcttttcttccatattcctaccctcagactaaggtattgcctaaaaaagccatgaacaaaacacaagtaatacaggttaagaataatattcataagccacaactagaggtataatcaatccctaaatattaaagagttggtcattccattttttcctgattagcaaaataacagaaaattgactggtggatatcttaaatacatataaactaccatgcaccatttgacacatgaagaaatagatgcaaagaatcaaagtatgcattgttaaatcaatgataaaagttttaaaataattcattttctcaaagcttatcactcttaacaatgtttctaattatcataacctaatacaattcctgacaaatttaatcaaattaggttctaatacaagaacacaacttatattaataatcacacagtataacatggtacacacaaaattcaaaatcaaacaacctgagtccaaatgccatcttactaactatgacacttgagcatcattgaccactccaatcctgttttcatgctataaatcaagtttaataaagtactgccccatggagttgttacatggaaaaaataaaataatcccgtaaaacacttatgtttatcagcagactcagatatacaccctgacttacatctaggttccattctattataactggatcataaagcaaagcattaatttctttttttatttttattttattttaatttaagttcaggatacatgtggcattaatttcagtctttccttctgaagcaccacttaaataacttgacgtgactgttctcacacagtgcattcagcactatagaataaagtcagtgtctaacaataaaaactagaaagatatttgtgcaatatgttatgctaaatgtagaacttggctaaattgaaaattttctgaaatactttatgtaaataaagaaacagagcagtccctacaaatagaaatgactcctgaaatttttatgtcaaaagtcattgtgtcaatttatgtgtaatattcaagtgactaccaaatggtcatcatttgactcactcaaactattgtgtttcaaaagttcatccccatgcagataaacatgttaaagatagtataattcactaaaaatagtcaagttctctattgatacaaatgggatttctatgcaggttacttgtattcaatctaaatgactaagaacttataaagacttaagacgatcctgcaagaaagatgcctaaggggaaaaaaaaagaattaagataaagtagtattttgctctaggttgtttattttaagtgtgtagcggttggggaaaaaaacatgactcctttatattatcctaaaacattctacaattctttttttttttaataatcctttttgagacagagtctctctctgtcgcccaggctggagtgcagtggcgcaatcttggcttactgcaacctccgtctcccgggttcaagcgattcccatgcctgagcctcccgagtagctgggattacaggcgcacaccaccacgcccagttaatttttgtatttttagtagagacagggtttcatcacgttggccaggctggtctccgactcctgacctcaagtgatccgcccacctcggcttcccaaagtgctaggattacaagcgtgagccactgcacctggccaaacagtctataattgtaaaagctatgaaaactcttttttttttcttttttaagagatagggtctcggccgggcacggtggctcatacctgtaatcccagcactttgggaggccaaggcaggtggatcacatgaggttgggagttcgggactggcctgaccaagatggagaaaccccgtctctactaaaaaaatacaaaattagccaggcttggtggtgcatgactgtaatcccagctacttgggaggctgaggcaggagaatcgtttgaacccagggggcggaggttgcagtgagccgagatcacgccactgcactccagcctgggtaacgagaacgaaactccgtctcaaaaaaaaaaaaaaaagagagatagggtctcattctgtcgcccaggatagagtacagtggcataatcatagttcgctacagtctcaaactcctgggctcacgtgatcctgccacctcaccatctccagtgggtaggactacaggcacacactaccacgtagacctgatttttttgtttttttgtagatataggatctcactatgttgccctgggtggtcttgaactcctggcctcaagcagtcctcccacctgagcctcccaaagtgtcgggactataggcatgagcaaccgcacccggcaggaaaattcacttaattactaaaattttaaaacaccacctccacacataaaatcccccatgaataaatctatattttgttttggtaatacaaggttgctttctaagataacaattgctcatctgcctgtatgtataaatacatgtaagcatttgggaaagaagaaaaatgactaattttatcttcctacaatttcttcagtgatctacactagaactccattatctgaaattatctaaggtattcctaagcagaaaaataagttggtcaattgtagcctaagttggtcctatatttattcaatggctatcacacattcatcacttcgttataccttagacttccagcagataatgaatataacctttaaatccatcactttacaaatgcctacaaatattaggtaaatataacaaaaaatacttttcaatgtagaactgagcttgagtttgcaaagaaagaaagaaaggaaaatccccgagcctaaagtgaagaagaaacagaaaaataagtatctgaacttccattacaactgctgaagaggcaagaaagaggaagctagtactagggggcttgaattttatttcctttttagaaacaaacaaaaaaaaagtattcactcaagatggggaagtagagataaaatctctatataaatatgggatcctcaaaaggttgaccctcaggaaaaagtagattcttcctctcccccacaaaaaaacttccctggcacaggaaattacaaataattagtctttggctgggctgctgatttcctttttttttttaattctatagagataaggtctatgttgcccaggctggtcttgaactcctgggctcaaatgatcttcctgcctctgtctcccaaagtcctgggattacatgcatgagccaccgtgcctggtcactactgattatttttaagtttcctctaagatagtaaaattctgggatttcctctaagatagtaaaattctgctattcacataggaagtccaaatttacactactggcatgaacaacaaaccccagaatgacaaatttaaaaaacaaaacaaaaaaaaaaacaatttcaggtataatataccccctgaggctccaggcaaacttaatccatacgttctggtaataaacatttcctaagcacatactatgtgtcaagtactcttctaggggctagggatgcaataagcaaaacagacaaaaatctctactcttatgaaacataaacagtagtccctcttgatctacagggtatacattgcaagacccctagtggatacctaaaaccacagataataccaaatgctatatacactatgtttttttgtatacacacatacctatgataaagtttaatttataaattaggcacagtaagagattaacaacaataactagtaataaaatagaacagttagaacaatacacagtttccaatttttgacagtttgacttacaatttttcaactttatgatggtgtgaaagcaataagcattcagcacaaacctcaatttaacaatggagttacatcccaataaactcattgtaagttgaaaagtcaaaactaccataaatcaacaagtattttcaacttacaatattttcagctttagatgtaagtgcatcaagtcaaggagcatctgtgtaattcacaattacatggatagaagattcgtacatactgcaaaccttagcaacctcagcacatgattttttttccttgtaagtcaagaacttccacctattcacttaaaaaaagtgctttacaatgtctctgtgtcacatccaaattgccaacatcactactcttgtcccgaacattattaagtaaaataagggttacttaaacactgcaataccatgacagtcaatctgatcgtggagagggtagtcacttagtaaagtgactaaaggacaggtagcatatacgtagagcatggatacgctggacaaagggatgatttgcatcctagtcaggatggagcagaatgcttgagatttcatcacactactcaagagctgcacacaatttaaaacttaggaactgtcaagggcttcaagatggctgactagaggcatctcctacttgcctcctccactaggaataaccaaaatagtgagtaatcacaccttgaatagataatccaagaaagaacactggaattcaatagaaaaatgacaagaaacacctaaagaaaggaaggagagggaaacaagacagcctgctcggctgggagccgagagacaatccccactgcggggaaacagtaagtgggagactccctgtggtccacattcccactgtggactcctgcaattctagccattggggagcccctaggacctcatgggctctgaaactaacataaggatctgtctggaaatggtgcaacagcaccactccactgaggaaaattgcactgggtcccataatccccctaagtcctaagcagctacaacaaggcaccattttgacaacccagcccacaacagactgagcactatcctggggcccagcagctggtgcacagacagaagtaagaaacaggctgccaccaccaggactgaggcacaagcggggcatgtgtccccgaccgccgacctaggctgccaccattaaaggcagcctcatgttccccagtagcagcagcacagcacagccactgctgcccctcacccaatcattccagggcctgggaaccaccctgtcccttcttaccacagtaggtgtctgcacatattgttggggggcctgatgacatgccagcccagcttaaccaggtccccatgccaaagcgtgcagactaggggcctggggattgtctccctcagcccactaccattggcacctgaacacaacacctatcctgaggatagggctaccccccacctgccgctaccaccacagctggcatctacctgcatgaacaacctgcaaatctagagactggcaggcctagaccatcacacccaccgccaatatacacacacaccactcaggatccagtgggtcatctctgcctttacccatactatgctggctacccagaagactgagagtgcacccacccacacagcctatcactgccactaccagaatcacagcaatccatctggaagcccaggaattggttcacctcaacccactgatactggtgccagtgtatgctgccctagagcccaaggacaggcattctcagcccactgctgtcaccactgaggcctgaaaagtgccaaacatggcacctcagtccccagcaaaacttcaccacagcctccattaatagtccgaaccctaaggcccccaaaaaatcacagacgccactgacactgtttatacctgaaaaaaaatcacagagactatactaccacacagacccagaatcaaagccaatgcactctgcccaaccaacatcatagatacgtcttcaaataaaaagtcctcccctatgaaagcaagttcaaataatttgaaaaagtcattactacaccagaggaaagatatcaatgtaacgacagaggaaacataaaacagcaaaaaaaaaaaaaaaaaaaaaaaaagggcacctccaaaggaacataataattctccagcaacatatcccaatcaaaaacaaatttacaggccaggcacggtagctcatgcctgtaatcccagcactttggaaggctgaggcagatggatcacctgaggtcaggagttcgagaccagaccggccaaaatgatgaaaccccccccactaaaaatacaaaaattagctgtgtgtggtggtgggtgcctgtaatcccagctacttgggaggctgaggcaggagaatcacttgaactcaggaggcagaggttgcagtgagctgagactgtgccatcacactccagcctgggcaacaagagtgaaactccatctctcagaaaaaaaaaaaaaaaagaataaataagctcagtgagagacacaagagaataatgaaaactactacaaaggaatcagaaaaataattcagaatatgaataacaagtttaccaaagagatagatgatattaaaaaaaaaaatctggtactgaagaattaaatggccagatgcagtggctcaagtctataatcccagcactttgggaggctgaggtgggaggattacttgagtccaagagttcgaagccagcctgggcaacatggtggctgggcaacatggcaactacccccaaaaaattagctgggtgtagtggcacctgcctgtggtcccagctactcaggaggctgagatgagaggatagtttgagcccaggaggtggaggttgcagtgaaccgagatcgcactactgcactccagcctgggcaatagagcaagaccttgtctcaaaaaaaaatatgtgtgtgtgtatgtgtttgcgtgtgtgtgtgtgtgtgtgtgtgtgtgtaccaacatcatttttcacagaaatagaaaaaaacaatcctggtcaggcacagtggctcacacctgtaatcccagcactttgggaggccaagatggacagatcactttagttaaggagttcagatcagcctagccaacatggtgaaaccccatttccactaaaaacacaaaaaaattagtcaggcatggtggcgcacacctgtaataccagctacttgggaggctgaggcagaaggatcgcttgaacctgggaggcgaaggttacagtgagccaaaatcaagccacttcactccagcctgggtgaaagcatgagattcggtttcaaaaaaaaaaaaaaaaacaaaatcctaaaactcatatggaaccaaaaaaaagccaatagtcaaaggaatcctgagcctaaagaacaaagctggaggtgtcacactacttgacaagatgtatatcacgtctatcataaaagaaaacagcatggtactggcctaaaaacagagcgcataaccagactgggcaacatagtgagacaatccccccagcccccgccccttctctgcaaacaaaattttaaaattagccagctgtgatggcatgtaccatagtcccagctactcaggaggctgaggtgggaggattgcttgagcccgggaggctggggttacagtgagctgtaatcatgccgctgcactctagcctgggcaacagagcaagaccctgtctcaaaacaaaaagaaaagaaaaaaccaacacatagacgaatggaacagaatagacagacaatccagaaatgaatatgtgtatctatagccaactgctgtgtgtgtgtgtgtgtgtgtgtgtgtgtgtgtgtgtgtgtgtgtgtgtgacagtctcatgctgccacccagactggagtgtggggtacagtgacacaatctcagctcaatgcaacctccacctcctgggttccacaaatctcctgcctcagcctctccagtagctgggattacaggcatacaccacgatgccaggccaatttttgtatggtttgttgatacagggtttcgccatgctgcccaactgggttcaagcaattctctgcccggcctcccaagtagctgagaatacaggtgcctgccaccatgcccggctaatttttgtatttttagtagagagggggtttcaccatcttggccacgctgttcttgaactcctgaactcatgatccaccagcttcagcctactattatactttggggccactattaggtacaaatatgggtcacttgaatataatcactgcaatactgccgcaatcaatctgataacggagacggcaactgactaacaggcaggtagcatatacatacagcatgatgctggacaaagggatgattcacatcctggtgggacagagagtgatttcatcacactactcagaacaacatgcaaattaaaacttactaatggtttatttctgaaattttacatttaatattctcagaccatggttaacggaaggtaatagaaactgggaaaagctaacatgtgactaaggcagggtactcttgtaatggacagaaactgacaaaaagcaaaatatattaagttacataatatattagaagataaatctgttaagaaataaggtaacggctgggcgcggtggctcacgcctgtaatcctagcactttgggaggccgaggcaggtggattgcctgagctcaggagttcaagaccagcctgggcaacacagtgaaaccccatctctactcaagtacaaaaaattagccaggcatggcggcatgagccttgtaatcccagctactcgggaggctgaaacaggagaatcacttgaacctgggagacaggggttggttgcaatgagccaagagcatgccattgcactccagcctgggcgacagagcgagacttcgactcaaaaaagaaagaaagaaggtagggaaaaaagataagaagtggaggagagggaaatagtcaagaaatagtcaagaaagatgttaaacttacacaaactaatctacacaggattcccacaaataaaatcccacaaaaatttagttcagaatccaagattataaaacaccctgtaatggccgggcacggtggctcacgcctgtaatccagcactttgggaggtcaaggtgggcggatcatgaggtcaagagttcaagaccagcctggccaacatagtgaaagcctgtctctactacaaatacaaaaaattagccaggggtggtggcaggcgcctgtaatcccagtgaggctgagacaggagaatcccttgaacccgggaggcggaggttgcagtgagccaagatcgcactattgcacttcagcccagacaacagtacaagactccaactcaaaaaaaaaaaaaaaaaaaaaaaaaaaccctgtatataccacattagatgagagctaatgaatgaatactagaaaactatacagagtagattataagagacttttgaaaataatgacactgttctttttttttttggagacagagtcttgctctgttacccaggctttttttttttttttttttggagacgtaatctcattctgtcacccaagctggagcacagtggtgcaatctcagctcacaccaacctccacctcccaggttcaagcaattctcctacctcagcctccctagtaactgggactacaggtgcccgccaccacgcctggctaattttgtattttttagtagagaacatgttggccaggctggtctccaactcccgacctcaggtgatcccacccacctcggcctcccaaagcactgggattacagacttacagacgtgagccaccatgcccggcaacactgttctcttaagggtaaaacagactaaagtaattcaaaattgtacaatgaaaaatacaaactgcctaacaaataacttcataggaaacaaaataataaaggaaatatgcatcaaggttttaacaatatatcttttgcggaaaagaataatagggcagggcatggtggctcacacctgtaatctcagcactgcaggaggccaaggcaggcggatcacctaaggtcaggagttcgggaccagcctggccaatatggcgaaaccccgtctctactaaaaatacaaaaattagcagggagtggtggtcagctactcgggaagctgaggcaggagaatcacttgaacccagaggcggaggctgccgtgagctgagatcacgccactacactgcagtatgggtgacagagggagactccgtctcaaaaaaataaaattaaataaaataaaaataaaagaataataggaactaggcttcctaaagattgtacttttattttaaaaattaagacatttccatttaacacttttgaagtatcaaaacacttcaaaaagttctggagatacaaagataaataaaataccttattgtacatctatataagtattataaaacaaaaatgcattgtggacatttctgtttcaaccatataaaaactattttaaaatattttcaagaatatgtgtgtgaaaagggatgctttataaaaagtgaatataatagattagttcaactaggtcagtatgagaaataaaaagcttacttagtttttctattaattcacaaacaggaaaaaaaaatctgattttccagttcccaaatgatttctcagtttaaaataaatcaattcaaaggtcaacaaaactgtatgcttgcaggaacctaaattatcaagtctgtcacttccaggaaactttgaagttttaaaatttcaccaattcacccaaatttcttgtaattatcattaatattaatatataaccaataatatctactcatgatagctagtaaaatcccagcttgcttttttacaaaaattgatacgctgatcctaaaattcacatggaaatgcaaagggcccagaatagccaaaactgtcttgaaaaggaagaataaagaggtcttccctattttaaaactcgccacaaatcttcagtaaacaaaaggcaatttggtactggtttaagaatagacacatagataaatggaaaagaattgagtccagataaatccttacatttatgctcaactgatttttgacaaaagtgccaaggtaattcaatgggaaaagaatagcctttcaacaaatggcactctagccgggtgcagtggctcacgcctgtaatcccagcaccttgggaggccgaggcggacggaccacaaggtcaggagatggagaccatcctggcaaacacagtgaaaccctgtctctactaaaaaatacaaaataaaactagccaggcctggtggcaggcacctatagtcccagctacttgggaggctgaggcaggagaatagtgtgaacccgggaggcggagctttcagtgagcggagatcgcgccactgcactccagcctgggcgacagagcgagactctgtctcaaaaaaaaaaaaacaaaaaaaaaaatggcactcttaacaattggatatccacatacaaaataatgaatgtaggccgggcgcggtgtctcacatctgtaatccctgcactttgagaggccgagataggcggatcacgaggtcaggagatcgagaccatcctggctaacacggtgaaaccacgtgtctactaaaaatacaaaaaattagccaggcgtggtggcgggcgcctgtagtcccagctccttgggaggctgaggcaggagaatggcatgaaccaaagaggcggagcttgcagtgagccgagatcgcaccactgcactccagcttgggccacagagcaagactccatctcaaaaaaaaaaaaaaaaagaatgtagacctttcccttacccttatctcacaccatacaaaaattgacttaaaatgaatcataggcctaaatttagcagctaaaactataaagtaatgaacacaggatgtaaatgctttaaaattagattgtggtaataggtgcaaaactctttaaatttactaaaaatcattgacttgtatacttaaaatgagaagtttttttcttttttttttttctttttgagacagagtttcattcttgttgcccaggctggagtgcagtggtgtgatttctgctcactacaacctccgcctcccgggttcaagcaattctcctgcctcagcctcccaagcagctgggattacaggcatgcgccaccacacctggctaatttttgtatttttagtagagaccaggtttatccatgttggtcaggctggtctcaaactccagacctcaggtgatccacctgcctcagcctctcaaagtgctgtgattacaggcatgagccaccgcacccagcctaaaattagtggtttttatggcatgtaaaatacagttgtcccttgctatactggggacattggttccaggactcctgcatagaccaaaatctgagcatactcagataagtcctgcaatggccctgtggaacccagtgatataaaaagtaagcccttagtatgcaacagtttcacatcccaggaatactgtattttcaattcgagtttggttgaaaaaaaaaatcaccatataaatggacccatgcagttcaaactcatgttattcaagagtcaactgcatatctcaatgaaggtttaaaaaagccacctctaggctgggcgcagtggctcacgcctgtaatccgagcactttgggaggctgaggcaggcggatcacgaggtcaggagttcaagaacagtctagccaacgtggtgaaacgccatctctaccaaaaatacaaaaattagccgggcttgctggtgcatccctgtaataccagttactcaggaggctgagatagaattgcttgaacccgggaggcggaggttgcagtgagccaagatcacgccactgcactccagcctgggtggcagagtgagactccatctcaaaaaaaaaaaaaaaaaaaatatatatatatatatatatatatatatatatatatataaaatggtatttttttttcttatacagacaaggtcttactatgttgcacaggctggtgttgaacttctgacctcaaacttctgacctcccacctcagcctcccaaactgctgggattataggcatgagccactgtgcccagctcaaattttcaaatatagagtacaactgtttatatagaatttacattctattaggtattctaagtaatctagagatgatttaaagtatatgggagaaagccgggcatggtggctcaaacttgtaatcccagcattttcaggaagccaaggcaggcagatcacttgaggccaggagtttgagaccagcctggccaacatggtgaaaccccgtctctactaaaaatacaataattagctgggtgtggtggcacacgcctgtaatcccagctactcaggaggctgaggcaggagaattgcttgaacccaggaagtggaggttacactgagccaagatcgcgccactgcactccagcctggtgagggagcaagactctgtctcaaaaaaaaaaaaaaaaactagcgggttttggtggcatacgcctctaagtcctagctactcaggagactgaggcaggagagcagcttaagcccaggaatttgaggctacagtgagctatgatcaagccactgtactcaagcctgggcaacagagcaaggcgcggtggctcacgcctgtaatcccagcactttgagaggccagggcgggtggatcacgaggtcaggagatccaggccatcctggctaacacggttaaaccctgtctctactaaaaatacaaaaaattagctgggcgtggtggcacgtgcctgtagtcccagctacttgggaggctgaggcaggagaatggcgtgaacctgggaggcggaccttgcagtgagccgagatcgcgccactgcactccagcatgggggacagagtgaggctccatctcaaaaaaataaataaataaataaataaataaataaaaattttaaagagatgatttaaagtatacggaagatacatgtaagttatatgcaaatactataccattttatataagagactggagcttctgaaaattgtggtatccactaggggttctggaaccaatcccccacatatcaaggggtgactgtaattacttaacaaaaattttttaaaaaatcatgaaagtatgtatttgtcaccagctcatgggaatcactattcttgaattaggtagcactaaatacctttaaatacctgatggaagccttaaactcagcagcaagttcctgaaaacatgccaacatatattaattattctgggtctaaaagtttgacaaattactttaaaatacagatgaaaacaaaataaaatgttttaaactgcaacaagaaaaatgtacaagttgaccagaagtttgaaacacttgactacattggtgcactgttaatcaaaatttatctgcaaaacagatttgcaaaagaaattataaacagggtagtaaatttcaaagtaatttataacagactaaggtcaagctacattagcaaagttggaaggtagcacttaagaaaaaactctgggccaggcacggtggctcacacctgtaatcccagcactttgggaaggccaaggcaggcagatcacctgaggtcgggagttcaagaccagcctggccaacatggtgaaacctaatttctactaaaaatacaaaaaaattagccgggcatggtggtgcgtgcctgtagatccagctactggggaggctgaggcacaagaattgcttgaatccgagcagcagaggttgcagtgagctgagatcgcaccactgcactccaacctgggtgacagagtgagactccctctcaattaaaaaaaaaaaaaaaaaaggccgggcacagtggttcacgcctgtaatcccagcactttgggaggctgaggcaggcggatcacgaggtcaggagatcgagaccatcctggctgacacggtgaaaccccgtctctactaaaaatacaaaaaattagctgggcgtggtggcgggcacctgtagtcccagctacttgggaggctgacgccggagaatggcatgaacccaggaggcggagcttgcagtgagctgagatcgcaccattgcactccagcctaggcaacagagcaagactctgtctcaaaaaaaaaaaagagaaaaaactctggaaagttatatggctctaccatgtactatttggacacctctggaggagaggaacttgttcaattttaacagtataaactttattgtttaagtagctaatatttaggccaggcgtggtggcttaagcctgtaattccagcacttcaggaggctgaacgggtggatcacctgaggtcaagattttgagaccagcctggccaacatggtgaaaccccgcctctaccaaaaatacaaaaattagtcgggcctcatggcgcacgcctgtggtcccagctacttgggagtctgaggcaggagaatcacttgaactcaggaggcagaggttgcagggaggcaaggttgcaccactgcactccagcctgggcaacagactgagactctatctcaaaaaaaaaaaaaaaaaaaaagactaactatcaattaggaaatatttacgtgtagcagtactaacaacattgagatggactaatttacagaatcccaatactttcgttctaattttttttttcagggtgttgctctgcatgattgtagctcactgtagcctcgaactcctgggctcaagggatcctcccacctcatcctcccaagtagctgggaccacaggtatatgccaccatgcccagctaattttttatttaatttttttttttgtagagacagggtctcactatagtgcccaggctggtctcaaactcttggcctcaagtgaacctcccaaagctctgggattacaagcatgagccactgtgcgcagctgcttccaaagattttctagagtggccaaaaccccagataatccatgaaagagcatgaaaagtattttaagggacaatggaaggggagaaactgctacctaatattctcagcaacttttcctgccctacctgacaagcgaatgatattgaagaggagggtaactaactgaacagactcttctctctccttctatccaggcacctactatcctgcaaatacgcagctttgaaggacttaaccaatgaccttaaaatctataccaggtctacagttctaggaagcgtataagcaaatgctgctatagaatttggattttctttaatgataaaaatgcaaatgactcacgtttggtcatccactccaacacagcacattctaaagaacaggagttcaaatcctccttctgccaaaagatgttgtgtcttcacacacaaataagtaattatggattatattactaccacaaatttctgtttctcactgaaggcatatgacattttaaaaaagaacaaaaaatcagaaaggaaatgtttcaagtctattttgaggtaaagcaatcaatttaccatttatcttcctcagacttacatatgaaagccccacacacatgcgcacacacaagatccccaaaatgttgacaactgttgaagctgcacaacggataccagagttcattatactattctatttttgcatatatttgaacatttccataatatgcagttttttaaaatatgcatgtgtgtgtctataggtgtttatacataaactcccaataaactgacatagaaatatccaattgttcaaagctttcattcttcaaaagtaagtgaatttcttttttttttttttttttttgaaacagtctctcactctgccacccaggctggagtgcattggcacgatctcggctcacagcaacctccacctcctgggtacaagcaagcgcatccagctaatttttttgtatttttagtagagatggggtttcaccatgttgactaggccagtctcaaactcctaacctcaagtgatgtgcccgcctcggcttcctgaggtgctgggattacaggcgtgagtcaccacgcccggccagaattccatctagctactttcttattctagaagttgtactgcaggtgaccagaccattagagaaggtctagtgaaagaaataattaactgccccagaataaaacaagcctaaccttgaaaagaggcaaagggaaaggtgctaaacagttattacaattaactgcatgtttatatttggtcctgttatcctctaacacaggtgggtaggtagaaaagggggaagtattttagggccagatttccttttgattctttaagttgatgggcaagagaggctggaataaagaaatctaaaaagtctccattataaatgataaccaagccaggcacaatggcgcatgccagtagttccagctacttaggagacaagaggggagaatcgcctgaacccaggaattcaaaactagcctaggcaacagagtgagacctcatctctaaataaataagttaatgaattaattaaaggtagaattgtataatatatgaattatacctcaatttaaaaacaatttaagccctatacagtgatgcatgcctatagccacaactactcataagactgaagcaggaggatagcttgaacttaggagtttgagaacagcctgggcaacatagagaggcctcatccccctcccacccccacccgaaaaaaagcattcatagctcatcttagtataatcagcaacttccaatgactaactatgctttcctgctagacatgaatttataaaacacataaaaattatactgtatctgcttcaattccttttttcatattgccattcaattttcacaagattactttaaatgcaatcctaaattcatcaccaatttaacttttgttagttatgtctaaaaataaaactagtcaaaattaaaaatactaactttgcagcaaattaatcttgcatcagcactacaaacaaatttttaaacttattgtagcaaaacataacttcgacagaatcaaagacattaattctcaagtccaaaaaaaggtcacaagaaattatttaaagtggtaaagggaaacgcagacttaggcatacaagccaagaaaaaaaaaattagagataactcctccgctagaacctccccccaatacttccatagcaacaattatttccttagcacaaaagtgatgtgttcactttcacaaaacctggatcatctaagtttgcacaattcccttcaatctaaaaaacagatgaaattgtttcatttaggtgagtagaattttgtgtccctatacacgaaaaaagtcaccatcagtgtgagtaaaccacatggctccagctttaagatcttgttccccaacccactgaaaagagtatatgcttataaaatattcatggacttaccaggttaaagacagtttctacaatatccctattggatacttctccaacttcaaccaaaccggtcaacacggcaaatttcattctgatgcccctgatggggagccctggtttcagagacaatgcacccccttcagtaggggtttcttctctccctccacctcccccgtcatcacctgttggtggcggggaagggacacgattgtcttcgctagccattgctagctcacgataaaggacaactcagagtcaccctgggacggcagtcgctgcactggtaatgagcacaacacacgcaatgcaaaacgaaagggtccctcttccaacttgtggagataccccaaagcagttgatgtggaaagtccttggcgtcgccctcctcctcttggagaatatttgtccaatctctctccccgaggctgacaacaacgccaaaccctattggaagattaaatatatgttaaataggctaggttttgttttagggttttgaggggacaagagggaaatagttattgtcggtcaagtaagttactaaaggcaccccactactagccacccgcttctcccgggctcaaaaagctgggttctgggtgaaggcaggtccaagaggcccccgaacaggctcactcctcccccactctcgtgcaggttctaggcgcagggtaacctctcctcacaggtgcactagaaagagaaactgtcgcggggaaaggagggatcggaggaaagaaggggggcccacaagctatcacagaggtagaaagttcttcctcacccagatactccggactcgtcctcaccccccgcccaggagcagcgagaccgaggtggcggcggagatccagggcaggaaaaggcgggggaagggggcggtgattattctaaatgctcggcccagtgggaggagtgaagcacctctctcaggcacctgagattcgacgggaaggggtggggaggtgtgtgtggtggcaggaagggaggggagcggccagagaaacccagcggccaccgcagggagagaagggaggacagagaggtcagtgcacctggtcgcagcctccaagtttccct

SEQ ID NO: 1851 - DNA, 205875 bp, Homo sapiens
  source 1..205875: mol_type = genomic DNA
ttatgaaatttatttccaaattgaagaggcagtgtatataaaggtaacagagcttgtgataatttacagaaatgtttgctacaacatgcacattatgaagtatttcaaacatatacatattaggtttcatgctgaataaataatccccccaaattaatttttatttttacataaaaatataatattgcactcttaacaagaccagttattctgcatattttctctttagataaatgatgaaattcggtttttaaaaaaagatgagtagcaaccctattctaataggggactaatttaaagttctcagtaaaaaaatgaaagctagacaatagctgcaattttttgttaacaaagcaaatcacttcaacgtgaataggagtaatctcatctctgcacctccatggacctcaggattcacacctggcctgagcacacggtgatctaaatgcagcctaggtatcactacatgtgtatgcagtttaaggttaaagcatacatggccacgtgctttctctcgaatctatcttgacagcagagactttggaattatattttatatggtttttaagcagaatgttttagaaagtctggaagttacaaaagtagtactgtaaacaccatatgaattaaatttccataacaaatgcacaagttattcttaggcagggatacatatttttatcccatggtaacatattactgagcttatctgacagtgttttcaaagccaataaagcagcaccccaagtaaaaatatacagacagccatcatatgggagagacagacggctccaagatgtttaggaattctgtctttatggtatgtaagtttgctgtggaatacacgagattttattattcttcctagaattctcagatggtataggttagtagaaacagaatgaaatggtttcctaaaagaattattctgcctcctgtttaaagtaagcttttataattctgttttggggaagaaaattcttcctgcagattagatcaaatgccttatttaggctgtgttcttaatacccatgcaaacttcttgcatactgaaggctttctattgcaaattggtacagattcaatgctctgtaaatagcagactttaagacttaccattgtgtttaaacctcagtgactcaactaaggatagtcaatatctagcgttacagattttaagtaaaatttttatgaagaaacagaatgtgtctgaaatccaagatacctgtattcttgtttgtggctgtcaaaaaaattctggttctcctttgagctaagaaagcaactggcaaaaactgcctaattttgagattcattcatagtttattttagtatttagatattccataaaatatttggtacagaggcacctactgaataatttgcttctcaaagaaagcaattatcaagtcctaaaaattatctttttttctttcctcttttggagcatgtgtgtgtggtgggaggagtatttcatggcagtaaacttttaaaatataattttagtgtgttttatataaacaatcaaccaaccaatttaaattctactggtccttttggaatcatagaaaaaggggagaccttaatattttctttggaataccttggtgggaaaaaattttaagaatatcattttaatgtaccatgcgaggcttaaaacttgttggctagtgcatattgacacaatcttccagattatcactaaaatagaacagaactttcctcttaggatcatgtgactcttcagaattttgtgcagatgaatagactttatcattatttggatggtttgtccagtcatccatttctttaggttcaacctcctaaaactggtgaagtcaacaaatctagtttggagttaaagtgctttggagaacgtgaagttcattcgcattcacccggctgcatagctgctaaggaaggaatagaacattggctgtttcaagcgctgctggtccttccgacaccaggcaatcacggtcccatcactgtttgctgtgtacaaatggtggccatcacaagaaaatgtaaggctgtaaaaaaaaaaaaattcccatttgtacattatatttcttaaaagtgtattagcatattggtcatcatactgaggttagtgtaaagaagttatcttcagtggcgcagagagacataaactaaatgactgcctacaactcattggttttgactgtaattctaacatagtcactctgctgacaagttgagatgctcataaatgcggtgatatagaataaaatcaggatcacaaagctcagtacattctattctttgcatatcttcttttgcctccttgtttatgctttattacataaacaacaaatatttgggtgtacaaaacttttaaaaatataacagtactatattttctccttataaagataaataagtattttatggctatatattatttccctaaaagagaaaaggaaaaaaatgtaacattagtaattaatttaggttccttaaactttaaatttagtacactgaaaatacatttaatttaataaagtaaaatttgaatcactttatttctaattatttaaagtcaaatttgttaactaagcaaagagtaactgattatttatctattttgtcaagcacccctgcagctatcaatcaccattatggtcttgtcaaatatgaaaggaaaaaatacagtctctatgattccagagacacactacaagcatgcctttccactagactctgagtcactgactcggattttaagctccatgaagacaaggagtgtggtctctcttgctgctgggtcacggacaacccgctgtgtgttaagtggttggcttttcatgatgacttcaattgcacatttctttaagtctgtgtgcttaaatacctctctacgaaaaatacaatcacaaattgtattctgaagcataagagggggagaagatcttacctgatgatgggcttatttgatttgggaaatgtaatttctctcacaggctttaagtcccatgtgctccataacctagaggggaaaaaaatcatctaattatgcaaactaaaattactctccctaaaaagccctctatatttgtttatttgttaaaaatcatgtggaaggaaatgtaacaaacaattaacagtagttccctctagggagtttgcagggggtagatgtgggaataagagaacttttaactttgtatacttccatactgttaatcttttatagttaacataaaacttcaaaactgtgctaaagctatctttattatttagaaataaaacaggaataactaaagaacctacaccccaaggtgagtttaaatctctaaatactgaatattaatatgcctagatattaaaaattaatttctgaaactcctgtgtccttatgaatgaaatcaaaaaaagagaatccaaattcctcttaccttacaattccattttctaatcccccagcgattacattgatagatactccctcaggctggttggagaaagccacggaacagatgatctccctgcagtggacatgtccaacgagatccccgttcaccgtccagagtctgaggtcactgcctccgccagctaaaacacccaaatcatccggcgggttaccagaatgtggctgtctcagagcccacatttggccccagaagggcaaccctgaagggcaagctcatttgtttattgatgaagtttgtagacaacccatgactgaagactgtataaatgaaattactacacaagttgcacagatttttctttttcattttcttttgagacagagtctaactctgtcgcccaggctggagtgcagtggtgtgatcttggctcactgtaactgcctcctgaattcaagagattcttctgcctcagccttctaagttgctgggacaacaggtgcacgccaccacatccggctaatttttatatttttagtagaaatgggtttttgccatgttggctaggctagtcttgaactcctgacctcaagtgatcagcccacctcggcctcccaaagtgctgggattacaggcgtgagccactgcaccaggccaagttgcatagatctttatgtattaatcaagagacaataaccagcgaaaaaataaaaataagaagaagcaatctatgtgtacagtaacaaggtaaaataatcatctttgtgtaattgtaatatttcagcatatgaaccaccaaatatgagttatgattgaaaatacttggaaagctaaacagtctccaaaaagtgaaggaaatattctgtgaaaccatctataagaagtgacttggccaggcgtggtgcctcatgcctgtaatcccagcacttttggaggccgaggcgggtggatcacctgaagtcaggagttcgagaccagcctagttaacatggtgaaaccccatctctactaaaaatacaaaaaaattagccaggggtggtggcgggcgcctgtagttccagctactagggaggctgaggcagaagaatcacttgaacccaggaggtggaggttgcagtgagccgagatagtgccactgcactccagcctgggcgacagagcagagactctatctcaaaaaaaaaaaaaaaaaaagtgacttatgtgacttttgaagaaaaaaaaaggtgtagtaaaaattacctgagttaaaacttaattcttaaaaaaagaagaaaaagtattcttcagaacatctaagattaaatcttataaagcaataccttattaattttttcttttcaaagattacagagtaaccaaaagtttttcttttagttttctggggttgggggaagcataattgcctgccatgctttataaacaggatggtttgggggctgatgatgatatgtccagccttctctggggaaatactctcatactgataaagcggttaggaggcacgataaagtttgatgacatagtctcactacatttaattttatcttttcattacatataagtagaggctttgcttctgtcttttattaagacaatgaaaatatttcatattttatagcaaagaaacatataaacaatgcttctttatttaaaaatatgccaaagaccgccaaataccacagatcaaaatgcccagtgtgttgcagcattattcacaatagccaagaagaggaaacaacctaaatgtctatcaacagatgcataaacaaaatgcagtatgtacatacacacacacacacacacacacacacacacacacacacacacacaattttctttagccgtaaaaaggaatgaagcatgcgaaaacatggatgaaccctgaaaacatcatgctaagtgaaataagccagacacaaacagacaggtactgtatgattccacttacataaaatatctacaatgggcaaattcagagagatagaaagtaaaatagaggttaccaggggctggaagctgagggaggaggaatggggaaatagtggtgatggctgcacaacactgttaatataattaatgccactgaactgaatacttaaaaaatggctggaatggcaaattttatttaaatatacattgagacacacatgcacacacacacacacatacacacacacacacacacacacacacacatgcccaatgttctactaagttttcccattgtagaacattgattatatctaaatatagcatcaagatgcaggagactcagtatgctaaagaaatagaattatagacaatattttccatgagtaggctacatttcaacctttcttttgaattaaatgttggctaaaatatttttttaaaagataaaataattagataagtactagtaaggctagaaggctcattgaagtcactggaaacatagccataaaagatattgaggtaggggtttctcgctgtaacccatagctaccactactgcatggcttaatccttcaaaataaaaaatctaaatgtgggcctggactctcaagtatggcctggaacttagtagccaaagaattatcctagcagctcactcagtaacttgggctaccacaaaaccaaataactactcatctgcctacttctgtaagtatcaaaatttgacagttacccaataccagattgctcgaatgtataatttaacacatcaactaaaagtcagaaacctaggcattcctaaaaagcatctctatccttcgtatacacagtcatgaaaatcaaaataaattaaagaaccaccccactgtgaatcttagaatattttactaactctatcttgccattggcaacagaggaccaggctatggatgtctcaccttagttcaaaggcatatattttgatccagtgatagaatggtaaacacacatacaacccccccagaaatcactgattacattttcacagtttaatacatttcacatcttatcactataaaaaccatatcccatcataagaactgagaaattatgatcaggaggaatgagcttgacaatgtaacttttgagaagatgttacacatacagcacaggcacataatatagttgtccctaggtatctgagagggattggttccaggacccctgaggatatcaaaatccatggatgctcaagtccttgatataaaatggtgtagtatttgcatataacctctgcacatcctcctgtattcttttttttttttcttttgagatggagtctcgctctgttgcccagactggagtgcagcggtacaatctcagctcactgcaacctccgcttccttcaagcgattctcctgcctcagcctcctgggtagctgggactacaggcgagtgccaccatgtctggctaaatttttgaatttttagtagagatggggtttcactgtgttagccaggatggttttgatctcctgatctcgtgatctacccacctcggcctcccaaagtgcagggattacaggcatagccaccgtgcctggcctcctcctgtattctttaaatcacctctagattatttataataccaaatacaatataagtgctatataaatagttgttatactgtattgtttggataataataagaaaaaagtctgtacatactaagtacagatgcaaccattcattttcctccccagatattttcaatctgaggttggttgaatccacggatgtgaaacccacagatacaaaggattgtctgtacgtatatacatacatagacatatatatatatattttaattttaagatcacttggatgatatccaataaatagtcaaaatttttgataggttaaatctgataactttctttccttcttggcctacaagaaaataggaggatgaactctagtctgggtcgctacagataaatttgacctctctttaaaaaagtaatttaaaaaattatgttccctatataccaagtgctctttatgatttcttttatatatgtatcaagagaccttaaaaaaagttgacaaggcctttttgttcaaattggaaaaaagttttacccattactctattatattgtgtgctacccagggacacctgaataccctactagtgagttggtaattgcagaaaaagtaattttgtttctcattctcatatgactagctgatataatatcacagatataaatcactactggcagcaggaaagtaattaactttacaaaattcaactccctcaggatcagtcctaactttcaaacactgccaaaacaagaaagtagagaactccatataaacaatcattatattatttccccagtattcctcttgatatgacacactaaaagctgctaatgcacaaatcaaggaaataaaaaatcatcaatcatttgcgcaaacttgtactaccaaagtcaactctttaagatcttttccctttgttataatcattaggaaataaaaatgttttcatgacattattttacaactgggggctaagactagcaaaaattctttcatatctgaaatctaatcatgactgaagatattacttctcctgaacacaagaatagatgaatgttttgtagaaacaacaataacaaaaccctaacaggtatctgtggtataatgaaaaataagtatttggtctttgtccctggttcctgggacagagtccctaaagcccttggaatttactgtcttctgtatgctaatgagatgactctcagtgggcaggactacatagcttcagtctagaggctggtcaccagaaaaatcaaccacatgattgaggactgaaacttccagataccccccaactctcatgcccacctcctggtgaggcaggagaatagggtctggaggcagggaacctaagacagtttcacactcacttcctagaactaaattcaaaggaaaaccctaactttccaggcctaaagaacaaaaggaccagaggctactccctttgcaaaactcccacgttttctgctggcagatgggaaattggctgtctgcaaccaatcaaactgattgtgggtggagtcttcatttgcaactttgtaacttcaccttagcctacgattggttgcaaaaagcaatcagatgtttccacaggagtgtgacctttgtaactccatttaagcttctgattggtggttttaggcaacccatcagactgattgtgggataccacttcattcacatgacgtgagcataaagtggccaatgggaaacctccgcagggtatttgtacccaagaagattctatatccaggcccttgagccgctgcttgggtccacttccacactgccgagtgtactttcattttcaataaattcctgcttttgttcttttgttgcttcatgctttctttgctttgctgggcattttgtccaattctttgttcaaaacaccaagaacctggacaacttgcagtcaacaccctctaccagtgacactgggagcagagtggggggtggggattgacctatgtaacaaaaccttcataaagttcctaaatgacaagggtaggagcacttctgggttggtgaacacaactatgtcagaaataataagtttctcttcaaagctcccttggtctttcttgctctgtacacaggccccaccccttgcttaatttgtaattagcaaacctctatatgcccagacatgcccagacttgttctgtaaactacctttcccaccttagcaacagtctcttcctcccctcctcttgcaaacggcatatttaccatatgtagaaaagtttaagtcttagccaataattgggttagattgttcagtccaactcaagccaatggggagaggacacagtaacaggagctgcgttagggataaaaacttttctctcctttgtttggtatgctcttgcaatcagacggatgcaggcagcacccttctgcagaagtaaatgtgccttgctgagaaatgttctgtctaagtgctggcttttctttgaggcactgagcacttgtttctaacaaaatgggggcacatctgggatcccattctcctccggagaagggtctccaatcatctcttgtgaggagacgtgtctcactgcagcagcctcaagaatgagggattgagacccaccagcatgatgaatataccgagactctcagcaacatggaaggaaaaggcctacagatgccatggtgaccaagtaattctgtgcacagaccaaggtaagaaaagccgcaggggcagtgaagtacttctttggtggttgggacatcctggaggttgaaagtatgtgaatgagatgcacaattaagtgcaaagcgagtgtggagtaaagtaaaggagtgcaagaaacctccagtggggaggggggttaagtctccagggaaagggtgcaagaaatctctagtaagagaggttgaaccccatacagtcaggaaactcagggacacatctaaaacttccaggatgggaaataaccctagtaaaacaaaaactacaaagagcaaagcagataatatgattccctctgataaccctctaagtctcatgttaaaatattggaaagataatgaaaagacagtaaacctgagctctatttgggaaaagaaatggagctagtatttaaactatttattttcacaaggattacaggcacctgccaccacgcccagctaatttttgtatttttagtagagacaaggttttgtcatgttggccaagctggtctcaaactcttgaccttaagtgatccacctgcctcagcctcccaaagcgttgggattacaggtgtgagccactgcacccagcccaaagtacctgtttttatggagtttacattccaatggagaagacaaataataacaatataagcaaatatatcaactgctataaataaaaggcagggaatagggatagaatgcattgaattttgtcaaatgcttttttctgtatcttttgagattatcatatggcttttgctcttcattctgttaacatgatatatcacatttactgatttgtatatgttgaatcatctttacatcccaggatgaatcccactgggacagaatgtggggagggttaatactttagataagatggcttggagaagcctgtttgaagagataacatatgcagaggccccagtgaggtaagcatatgagccatataaatatttagggaaaaagcattctggacaaaggtaaaagcaagtgaaaaggccctaaaatgtaacttacttggcatgtttaaggaataacaaagaggtcagtgaggttatagcatagtgattaagagagaagaatagtaagaagtgacataaggaagaaagccaggtccttatagcctggcgtagatatgtaaatgggaagcaattagattaagaagaggatgacataattcgatttacctttatgaaatatagagctacagtgtgaaagttagactgaaaaagattaaagaggaaagcaaagaccagttaggttattatagtgttctaggtaacagttttggactagtgtgatagatgttagggtaggagaagttagaagttagattcagactctattttgtaagtagagaagataatgtctgctaatagcttggatataaggagaaagaaggagaagagtaaaggatgactcaggtttttgacctgtcaactgggtgaattctgaaattcagagatgaggcataccagagaaggaacaagtttggaggaatgtagaatcaagttttgttttggctgtgttaagttgaaaatgctgtgtaggcaattagatatccaagtctggatttcagggtataatttggaactggaaaaataaatttaggagtcattagggaataaccatgactttggataagatcacctagtacagctagagaagagaaggtagcaaaagacaagagacctaaggtatgccatcgttaagaagtagacaaaaagaggaggaaccagcaaaagactgagaaggacccaccagtgacctagaagaaaaatcaggagactagtattctgaaagccaccagaagaaagtgtttcacaaaagggaggtagtattgaatggtgtggaatgttgcctgtatacctagaaaaaagcaactttggctgctttttaagtgaatgtgatagagtttgtactgcaaataactttccatattgcttttcaaatcatgatattttagttcttaagatcatgtagaactttccattgtgaaaagggatttgattacttttataactaaagaaacttttctaaacttaattaaaaaaaattaattctagaaactcgattaccatggactaagtgttttcccgttaccctattaagagtctgaactgctcactagaaagatatcggcttatccccgtataaaatgctttataggttgccttatttaaattccactactgacctcccaacatttgagacaaaggatcagtttcttagaaactatgtatttagtctgtcttccaccctttactcactccctcaagactcaaagcctcctagcacaaactccacccctcaaactcccagttcaccgacaccaacccggagatcacatccttatcagaagttgcaaagagggaaagctcgagcccatctgggaaggaacttacctggtgctcttaacaactgaaacagtaatccaaactgctgaaaaagggtagacccattatacccgagtcaagaaagcactgccctcttcaaagccatggaccactgtcccagggccaactcccaccaaagcaatgttaaaaagaaaagtctaatcagtctgtctctttttttttctcttctctttcccttaaccaccccctccattttattattaatgtaactaagtcaagctcaccccaaaatattacttttaatgcttgttttgttataccctgcaggaaccttcaacgccaaagagaaatagcatcagaaaaatacctctgcccctccagggaagccactaccgcccccttatcccgcctatggtggggagatcagcactctctccccaatttatgttctcaatgggcatatgttgtttagaccaccaaaaatcaaggttagacatcctcagatgattgcaccaccctaaagccttacctccatttcaccgaaggagtcaccgccccccacaactgtcacacccaccagtgcaacccactactcatctctattactatccctacctctagcaactctaaccccaccttaggtgcttctatggtctaggagaaaatgccgttagaaaggactctacaggcttctttgaaatgcgctttgtttcttccccgctatcctctattgttaccccttccccaagcccatccaatcaaaccatctaccatttcatgcccaatgacaaaaccaaagtagttataataaaagtcaaggatttaaaacaaactttagccataacaactgggtaccaagatataaatgcctggctgaaatggattaaatattccgctcacaccttaaataaaagcgattgttgcgcttttgcaacaggcagagcagagacccaaatcgtcccctttccacttggatggtcctccgacccacagaatatgaactgcatagcagctctcttccaagaccccacagcccggggcaataaggcatgccagtctctcgttactattcccagaagttacaggctctgtgggtcagccctccagagctatttggcctccaagtaacaatgtcaattttaccttgtgtctctcacgacagggggaatatttggcattccttggaagcctaacaggacgcagtgaatctaagccttttcaagagttaaccagcctgtctgcccttgttttcatccccaagcggatgtatggtagtattgtagtggaccactattaagtactctgccaagcaagtggagtggcatttgcgctctaatccaattagccatccctttcaccctggcatttcatcaaccaaatagaaagaacaatcgtaaaaaaaaaaaaaaaagtgtccccctcgggtcttttgatcgtcacatatatataaatgctatcaaagttccacaagaggtgctaaatgaatttaaagccaggaatcaaatagctgcaggatttgaatctatattgttctcatgggtaactgcaagcaaaaatgtagactggataaattacgtttattataatcaacagtggtttgctaactatactagggatgccattaaaggaatagctgaacaattaggtcctaccagtcagatggcttaggaaaatagaatagcccttaacataatattggccaaaaagggcggggtctgtgtcatgattggagtccaatgttgtacttttatccctaacaacacagcccccagtaaaacaatcacaaaagccctacagggccttaccaccctagcaaataaattagccgaaaagtcatagaaaaatggtttagaaaatagaaaggactcataacatcaatctttatcccccttgcaattgttatcagtgtactcattcttgtaagttgctgcatcataccttgtattcgtggatcaaggcaaaggcttatagaaaaagctcttaccaaaacctctctcgattctcccccgccctactcaaataagttcctactcttaaacaaccaaaaggaactacaaagccaagagatgttagaaaaatttaaggactctgaagaggaagaagtataacatcaaaagggggaaaagtgtcagaaataataagttccaagctcccttggtctttcttgctctgtaaacagcccccacccttgcttattttgtaactagcaaacctctatatgcctagacatgcccagacttgttctataaactacccttcctgccttagcaacagtctcttcctcccctcctctcgcaaactgcatgtttatcatagttagaaaactttaagtcttagccaattgagttagttagattgtgcagtctgactccagccaatggcgagaggatacagcaacaggagctgtgttagggataaaaatctttatctccttttttcggtgtgctcttacgatcggtcggtcggacgcaggcagcacctttctgcagaagtaaatgtgccttcctgagaaatcttctaagtgctagtttttctttacggcaccaagcacttgtttctaacaactgtgtgccagaacatggtgcaccctaactccacaaccctgactccaggaggacagacactccagcactcagggcacttccagacctggtcctgtgcctcttcagccgctgttcatttctatcctttataataaatgatagttgttaagtataaatagtgttttactgagttctgtgagtcattctagcaaattattgaacctgagggtggggctcatggcagcctccaaatttgcaaacttctagtgtcacaattgaactgcatggtgggacacccagttggtgtcagagaactggttagtctctggaaaaacaccatacattttgtgttagaaaaaaagaaacaatgtaaaaaatgctagcaaaggataggggactacccactatgggtatgtccaacactgaatggacagaaagaagcaaacagtttttcagaggatcctttgcatcttaagacccttaaaaatagaaatgcaaacagaaaattcatgaattttctaactgttcttttctgctggatgcattggtttcttaacatgtatatatgaaacaacaacaacaaaacactcttgattaggtgatatatttttgtcatgtaatttttaaggcaaactatacttccatttactattctatactattgctctctgtctgaacctggaagacatatattcaagctggtcatctgctgaggcttttcatttagtcaggagtgttaaataaaatttacgggaggccaatgttttagactgagctcctgcactaggccctaacataccagatcaaacaagaatggagtagtcacttgtgcgaggtgacacataatcaaactgaacttggaaatgggctagttttccaaaaaaacaggagattcacagcaatcaatgacaggggatcactcaagttgagctggtatgataaggaagttccttctgctttaatcctctaaggaaagtaactgtggaatgatctatctgagttttgttccttgtttctgctttcttcagctttttctgcctatgaagcctacctcctctgctcggctctctggggtacctttctgtttcatagatggaatgctgcctgattcatgaatcattaataaaagctaattcaatttttcagctcaatttgttaaaattttgttctttcacaggaggaaggtaacaaagtcaatagttacaaagcagaagcaaaaaaggggagaaaagtcaaaaccaagaaaactgaaaaaactatgtaacaataatttgcttagcttaacatgtactcaaatgcaattttacatgtatcaggaaaatagttaaattatgacaatactaacttctgcataagctgaggcctaaattgatgcactcagtcttggaccatattgtatttctatacacatacatgctgttaccaaagtatttagatctggcagggacctgagagaatggctcgacctaggagtaaccactggccgaatgcgctgttagagcaccagccagccctgtgctttgggttggagcaagctcacctgaatcacacacagtagcaatatcacctgaggtttcactggcagagacagctgtgacagggcttttgtgtcccgccagactttgtacatagcataacctgaaagaaaaaagacatgaatttgtatatgatcattaaatataattacattctcttattttgtaattcttcttctcagtctatgtacctattgtacataaggcatacatgttttcctatctgattgtatgacttcaataaaatataataggtaatcttactacctttaagcatgtgtttcatggttaaaatgattataacgtaaagacattattttggtttatctatttcatatagtaaaaatggatatattaaaaatgctatgtttgatttggagaccttcttctgtacctgtttaaatcccatatgatgcaggttccgtctctgctcacacttatcagtatactgtatggtttgcaaacaaataagctggttatctcttctgtgtgaccatagagatgtatttgagtctccatttctatttctgatggctgaaattttaaaattaagtatgagataaaaaccacaacaaaaagtactctagtatagtatctcaaaaataaaacaaccaaagtgactcaaatggtcttctcaaacatatcattcttcaatcctattcagagtaaaacaaagaaagaaattaaaaaatttttaattcctcataatttccagttatctggttttcatttttgtctattcttgtccaatctttgttcaaatatacatgtatttttatagttgtaatattgccacataaaaatttcctattttatattttacatattctcctataagctttttctaatcttgacattgtcttcaaaataatttttaatgatgttataatattctatacagttagtaccccacaatttacaactatccttcattgatagacacttaaaattgtttctatttttttcaaattatagataataccataaattcttcatgtataaaaggtttttagtagattagagggcagacctttgggaaataaataattaaagttttttaagaagaaatacttctgtaaaaaaaaaattctgggcatggtggctcatgcctgtaatcccagcactttgggaggccgaggcaggcagatcatgaggtcaggaggtcgagaccagcctggccaacatggtgaaaccctgtctctgctaaaatttccaaaattttcctagtgggtttgtgaatattaataattttatagttcttgacagtgtactttcagaaggtgtcatgcaaattggtgatgttaccaacggtaatgggccctaatgctaccgatactcagcagttatggcttgactttctaaatcaaagcttgcaaactggtgctctgagggccacactggctcacggataccagatgtccacacagggtttgactcttgctttgttaggttaactattatcataaagcatttcaatatttccccttcaaaaatatagaaaagtagaaagaataagtataataaagagctatatactgactacccagttaaacaaatcttaacattttatattatcaatttattttttaaataaagcattaaacattgtacatataatttgtgtactgttctacatcctatttcttctgtcttgtcagaagttactactagcctaaattttgtatttatactcctatgtaagtttttatacttccattatgttactatagccataaacaacatactgtataatacatataagtattatattgtatttcatgtttatgaattctgaatatatggtattattttttaggtatcttctgcatcttaccttttctcaaaaacaccattgtttttgaaatatatctgtgttgatatattaggtacagctatctatcttagctgctatgtagtccagttacatatttttatagacataaaaatacatattttacacttaaagaatcaaaagaccaggcaataccaggctcacattattccttgtaacaactggcttgagctgtgtagcaactgcctgtttagctagggcgtgtgaccttcacctgaaaacaatcacagcgaccagatcagcttttaacaacagcaagagtagtaagcctggatccctgggccctccctttagagccattctggctctcagattgtgacactctccacagccaggagtctgcagagccactgggatatacccataacccatttcagatcatgctttgaggtatgtaggaccaaggaattccctgctctaaaggacctgagccccttccttttctgcttgggttctgcagcattgagtttgtgatttggccccactctaaatctttgaaaatttcctaagtttcaagtggcaatcaaggttgctttaaatgatatttattttattataacttttaactttttcataaatttattttcttagctgtatttttttgtgcctggttttgtgtatttgtcactacattataacatttacttgtaggaattcctctatttgtggaacagaatgcaagtaacttccttgtttctgccagatgacacccactaccacaccagcctggggccaccttaacgcaaagtgaagtctttgaggatcctagacaaaccagggaattccagggttctcccatgcaactcattttcattctgagagagcagaatgaaagggaccagccttttggaggcgggctctcttggcactccccagcttgcttagttcctgggtgccgttttccatttcttccacagaggctgtccaaggacagtgtcagtgtttcaggattgatagtgtcctcagggctaaagctccttcctgcttatttacctctctggcttggtagtttcttactagcttgtcagatcttcaatgcttttaaggctctctctctctctctctataaatatctatgtatacacacacacacacacaactaagactgaataaaaatatattttatcattatatgtttacattatattaaaatatatacttataagttatattaaaacatggatatattttataaagatatatttttgtatatatattttatccactcttcatcgtttcaggggaggattattctgaacaacttttttaagaaacagtaaatctcttgttggccatcggccatgatcatagttttgtttatttgtttttgttttttgagacagggtctcactccgtcacccaggctgcagtgtagtggtgtgattatagctcactgtagcctcaaactcctgggcttaagtgatcctcccatctcagccacctgaataacaggactataggtatgcactaccatgcccaactactttttaaatttttttttttttgtggagatagggtcttgctatgctgcccaagctggtctcaaactcttggcttcaagtggtcgtcccacctgggaaggcctcccaaagtgctgggattacaggcatgaaccactgtgactggcccatggatatttctaataaggacacacaagtgattttctttttttttttttgagatgaagtcttgctcttgctgcccaggctggagtgcaatggcgcaaccttggcccactgcaacctccacctcctgggttcaagtgattctcctgcctcagcttcctgagtagctggaattacaggcagctgccaccacgcccggctaatttttgtatttttagtagagaagaggtttccccatgttggccaggctggtctcgaactcctgacctcaggtgatccgcctgcctcagcctcccaaagtgttgggattacaggcgtgagccaccgcgcctggcctacaagtgattttcatattacagagagagacaggtaatgtggagggcaacccatacatttattcatccaacaaacattgttgagtgtcccctactgtgtgcctgtcactgaaccaggagctggggatacagagttcccctctggcagctccatggcagtaaggagtgagggctaccaaagatgattttcacaaagaactccggggacccacagataagtcgcttcctcagactggggacagggagtgaaaggaggattccctggaagacggcatatgaactgaagttttgaagaactggcagaatttactcaaagaaaaatggctgtcaaagggcactctgggctaagaagacagcatgtgtgagggaaaggagatatgaaagaaagtggcactgccaatgttactgggagcagggtaggtagggagcaggaagaaacgtggtggtgaggtagagggggcagtgaggcagagaggggtcagagcacggggcctggtgtgtgatgcctagcaacctacattttatccccgaagcaataaagggtcactgaagtgtctggggcaggactaatgtgatgcagtcggcattttaggaaggccatcatagagcctacaaggagactcaacttccagggacatgagactggtggccaggacaccagtgagaaggtcaacatagggacccaggcaggatgcaaaggaatgagctggggcaatggtcagggggacatctggaggagacaggtttgactcatttctatttatcctgccaagaattgctgtgattctttaatccaaaatgtaggttttaattgtaggaaaatctcagtcatcatctcttcacactgggcctttcttccttctctcatcctgtaactactcatcacatttggatgctctcattctagccctcatatcccttctttcctcattttttttctttatctttctattttatattctgtgtaatttttttcagttcattaattctgtaatctgctgcttgactagctgttccaatgaatcagctgtgacacgttgggcaagttacaagaaggattaactgtgtgtttcagtagtctcatgtaaaaatggagataatgacaaaacctacatcaaagggttattacgaagatttaacatgtggctcacgtctgtaatgcaagcactttgggaggctgaggcaggaggattgttgagcccaggagctcgagaatagcctgagcaacatagtgggagcccgtctctagaaaaaaatttaaaaagtagtagggcattgtggtgtgtgcctgtagccccagctattggtagggggtcggggatggggctgaggtgggaggaccacttgagtctgggaggttgaggctgcagtaagccgtgattgtgccactgtactccagcatgggcaaaagggcaagaccctgtatgcccaagaagaaagtggagaaagagaagagcaacaaggaaagggaaggtgccttagctcaacaggctgctggcggacatggagaggaagccccagagaagcatgtggcggacaagcaatgagaagcatgctgtgcagcctcaggaagcccacagcaggcactactgatgcaggagaggccatgagccaggtgggagataagaaaggaaagtatcagacaacctggggctggaacacaatgcacagctcttagaataagatcatcctcacatctgttttatgcttagggccaacagttaaaaccatagaaatgtagtcggatgaaagaatatagagaaaaataaagatacttgagtcaaaaaccaatacatcagaaattgtaaagagcttagaacaatgcctaatacaaagtaagcagtcagtaaatattaactattatttttattatgtcatttctagaagttctattttatttttttccacacatgctttgtttttcttcagtgtcccaattttaaacagaacaactatctccaattcactgagtacagattagtgagttacttcaacatcaaaactaaaatgaggttagcgttctacttgataagttacaagtttggtctccttgggccaatattttcctaaagttttaggtcattctcctactgaccacagtcaatcccattcattattgtaaaaaatatgtcagaagaaacatagagtacagatttattgacctattctccaccttttactctgtgaaatgagtaacagttatgggtaaacacaacataggggtcctaatagtagtatttgataattttttaataaactctgcactttgaaataactgcaaaggctaatattactagacaattcactgatgggtcagaaaataacttccagcgggtcgagcaggtctcttgtgctggcaccttcttttaaatattgttcttgaatgaagtaatactaccttgtataagctgcacacatattcttctgccactctcaagttagataacagatatataggtgttcacttatacgaagatgatgtggacacgttacttacttcgtgacagaataacccgacagcaactattttaaaatcagttatcacatttagaagatattctcctctaacatttaaatggcttataggttacaatcccatataacgagtcaacttattcatcattacctagaatgcattttagaagacttttatcttgggtgcttcaacagaaacttacggtgctcaaagttagatatgcttactagctaaggaaggcatttcctaagatccccttgaaagtattttcaaacaaggatttggccacatcctatgtggcacttggttggggggcccatcttttgtctgtgttaaagacaatccaaaggagaacatgaacacttttaaaaccatgcattcagtgggtcaggaaagctgaagaacagaaaccagtgaacatgaggtgtctcctgctaacctcacaagctcagggtcagaaccacaaccttagagatgccagaatagcaacacgatccctgggaaaaagcaacaacaatgtctacaaatacccaagtaatctcccaacaaaacaaactgataaaactacactactaagttagattttttggcactgttaaatagtaactattaatctcatgatttgattacctaatacttaggtggaaaaaaaatcctataaaaattagctgaaaaatctgctttaaggcaaatatataactgaggacagctaagcaacataagccttcacaagtgtgtcatgacctcaaaactaaaagaaatgtatgtcttgcagtatttaaattgtaatagctatgctcttgatctgcttcctcaaagctatcctgtgcacaaatactcctatagtgacagcttaaccttttttttttaaacctgtactgcacactgtgttagtgcacaattaaaaatggagaagtagggaaaactaagaacaaggctgttcaaagtgttggcaaaagcaaaaggaaataaaaagcaaaagataaagccaggttttaaaaaaggtgtccatgtcatggtgcaaaatgatccaagtgcacaagctgacaactgccctagcagcagggtttagaatcgatttgtaggggaagtcagaaaggggagctcagaagattaaaggtaatggcagtgtgaatattacagatgttataaaattaacattcattttaagcctttgggaatcaaaaggtgataaaaaggagacattcaaaaagttatgacacttatattctctgcttataaccttttttaaaaacaatttcagtcaggtctcactctgccgcccaggctggagtgcagtggtgtggtcacggcttactgctgtgatctcgaccttctgggctcaagtgatactcccacctcagtctcccttgtagctgggaccacaggcatgcaccaccatgcctgaccaatttttttatttttgtttttttttggtagaaataaggtcttgctatgttgcccaggctggtctcaaatttctgggctcaagcgatcttcttgtcttggcctcccaaagtgctggggccacaggcatgagccaccacaccctgcttatattctttagcattctttttatcatggcatataagaacctcatcactggcctcaatcttttcctgccctgcttttgtcattcttccccaacacgttacactctaaactacacaggaaagtatttgccaccccccaaaatccccatgcctttgattccaggctcttgtgtaaactatttcctctgcctgaaatgttctttcctctttcctttacttacagtagattgatcccttaggatccagctcaagtgtaacttaacaggctccctgatgtctggatgtccttcttctgtggtcctctatcctgggtgtgggcctgtcttagagcatacactccactgttctggctccttaacctgcccttctttgcttcctgcctggatcactgcggtggccttctcgttggtgtcctggctcccagtctcatgcccttggaagtgtttctccttgcaggctctacagtggtctccctaaaatgctgactggatcatataactcctgtttataccattttaatggctccttagactaagagacagaaacaaaatatggtcacatttatacctcagtgaccatgcaaagaaacttaacaagagttcaaaagggaataagcttggaaaaaaaagtaagaacctggctgggcacagtggctcacacttgtaatcccagcactttggaggccgaggcgggtggatcacctgagctcaggagctcgagaccagtctgaccaacatggcgaaaccctgtctctactaaaaatacaaaaattagccgggtgtggtggtgtgcgcctgtaatcccaactactcaggaggctgaggcagaagaattgcttgaacccgggaggcagagattgcattgagccaagatcacaccattgcactctggcctgggcgacagagtgagactctgtcttaaaacaaaacaaaaaaaaaaaaacaaacaaaaaaagaaaacgaagaacctgggagtcaccctatgctagaaatacaggtttcactcagtaaaacagatttaatactataaagaaaattataatggaaaaaaatgcacagtgaaaattctgtatcagaatgatgattactgagttatcaacctaaacttgacacatatcctcaactgcaccacaggcagttgattcaagaaacaaaaacaggccgggcgtgatggctcacacctataatcccagcactttgggaggccgaggtgggaggatcacttgaagccaggagttcgagaccagcctggccaacatggcaaaaccccatctctactaaaactacaaaacttggccgggcgtggtggcacatgcctgtggtcccagctactcgagaggctgaggcacgagaattgattgagcccgggaggcagaggttgcagtgagctgagattgtgccattgcattccagcttaggcaagagagggaggttctgtctcaaaaaacaaaaacaaaacaaaacaaaacaaaaccccccaaaaacagtaaattaaaagaagcattgcataatctgtcttattttttcccgttttatgattcaactccaaaatcctgggagttcagtgaatggctgaaaaataataaaatttcttccagtaagtggtacaaatccagacagactacttagattttgctgtcacttagtttacccagaggttatcggaatgttggacattagggtttctaagctttcaaactgatagactcttacagtatactcctaaggattcaggttgctatcgcaaatacaggtaagcaccaaaatgtcatttaaaagcctaaatacaaaacagatctaactcaaaataccgtctctgaaaaaaaatgggactactacaattgttttcaagatttttcatgattctaataaaccctaaagcattttaagacctaatgtagggagaagattaaggtataaacattttaagttaatcttatgcaaagtgaattatacttcataaaggctttcttcccctcattgacaaagtcccatactacccacacagaagcccagaacctaccgtgctgcttgtaaatctgtttgtgtaggctgtgatgacaccgcatttgcttccagtaaacagctggcaactgtcaggcacccaagcacaactagtcacctttgaaaaaggaccaatcaaagattatcatgttttaaaagaatgaaacttaaagtataataaaaataaaataaaagaatgaaaaatacttctacttttctgacaactattttttttaactctcaaaaatgttaggtaaacatttcttgaaacagaaacgtgtcagatatagtaatattccgtaactttgagccaaatgtctaaatgttgtttccaaattaaaatatattataatgcatagtctatgtctatacgtgcctgtgtgtggatatatgtgtatatatatttagataaatttaacaaaatgattcaggattgattaaatccaaggttgagtgtgaatgtatgtgtacttcacatatttatttgctttttgcttttattttcctcgttttatgtctttggtggggaaacaggtacatgtaaacagaggtattgcttctaatagttctaaagattgttaagcaggggaagaaagaagataaatgtgaatgtaaaagatgggattatgcctttggtacaaaatccctcagtcctaaccatggaggcaccactcaggtttgagtcaattttctatgtggcctgacaggtcctcttttccatgctagctgacccccaccctgagcaccatgtccgcagcaactgtccccaactgctctcctgtcccacctcccccacactcacttcactaagcagatggagacccccagctgcacacctcttcctctcctctcctctgcacctcaacatgtttccctgtcttctgattcagagaaagaaatgtctgctttcaaggtcagccttgcctcatcctcaggcttcctcagaaaccttgttttctttttcttacagtttcaagctgtctcttgctggcttccccccttgcactacaagtgtgttcacgtctctgctaccttagaaaatgactttctctgatctttattcttcttaactcccgttataccataaggatccattggatccaattttatgttttcagtttctttcttgagtagttctatttgttaggattgatacttcataaattttattctttcttggaggtcttccaaagaacaaagagaaaatgcacttttaaaaaatacacagaataaaactcattctgtcttggaattaccacatggatccagtgaatcaacctaagttacattacaagatcttaataactaacttgtttttctatatcctgaaacatttagcgatttcatcattctaaaaattatttcatcactactcatcaattattcctaaatacgcaaaaaacaaacaaacaagcaaggaaatgggagaatgatggaatctcccaagaggataatctaatatgtgaactaaatcgtcatcttttggttttcttattgcattgtccaaagtatagtgtcatctttcaggaaagtataaaagaaggctggagacaccacttctgtagtctacttttggctttcattgaacacggtggagaattcagaatttttcattttctaccaagaaagctgacagaggaagatgtttcacaattatgagactaatcacaacatgaaggcacacagccgtcaggactctagactctactgatgatgatgaaattgatcatataagtgaaatctcagagcgtgagtctttatataacaaaatcctggctgggcacagtggctcatgcctgtaacccagcactttgggaggccgaggcgggcggatcatgaggtcaggagatcgagaccatcctggctaacatggtgaaaccccgtctctactaaacatacaaaaaaattagctgggtgtggtggcacgcacctgtagtcccaggtactagggacggtgaggcaggagaatcgcttgaacccaggagggggaggttgcagtgagccgagatcgcaccactgcactccagcctggcaacagagtgagactccgtctcaaataataataataataataataataataataataataataataacaacaacaacaacaacaacaataatatcctagctgaattttctcaaatcaaagaattaatgggtgaacaaaaatatatctttagaaatgtatctctagatgaaaatgcaatatagtattctcatccagtttagtcatttgactcaaagtatcacacaatgtcatcacatcttgttttgctaacaggacttgtgatagtgttctttcatctttattttcatctattatgatacaaataattttgcaatgtttaaattcttttatatacatgaaatattattcagcctttaaaaagatggaaatcctgttatttgtgataacacaaatgaccctgggggacactgtattaagtaaaatctgccaggcacagaaagacaaatactgtatgatcctgctcctatgtggaatctaaaaaaagctgaactacagagagtagagtagcagtagccaggggctgagagtgctggtaatgtgtgtggaatggagagatggtggtcaaagggtacaggtttcagttgtgcaggatgattacgttctggagatctaacgtagaggatggtgactactgttaataatactgtgttgtattcttgaaatttgctaagatagtagatcttaaatattctcatcacacacgtaaaaaatgctaactatgtgaggtgacgaatgtgttaattagcctgactgtagtaatcatttcacaatgtatatatacatgtattaaaacatcacattgtataccttaaatatatacaattttatttgtcaattttatcccaataaagctagaaaaaaataaaaataagaattttaaacaactttattcaagctttggatctgctaaactaacaagtcaatttacttggcaaaaacaatttgactaaatgcttgtctttgtactggtgaaaataaattagtgaatcggaaagcatctttaaagttatttgttcatctttgtcctctcttcacaccacatcaatctaatgtaacagtacccaactcttaaatagaaggaatgcctagtaattaaaggtgtaaagaatttgattgaaagcttatgttatatctttaacattgcgttgaaaacattcaattaatactgatgatgatttcatttttcttcacttttcattggaaagtcaagatgtttgtaaatacagattactgatgacagcaatgagttaaatctgctcataaatttgtgtcagtgtattttgacaggtagaatgtattgtatatctaactcccactgtacatatttgtctgtttttcccaatttataataatcccaaaaagggtgcagtaagggacatactgattctataatatgtttttgtgttttcatttattttgtagactcatttccaatttagttatactacaagctttgccatgatttatggttataacttgtttgtgtttggatatatatatttctatctgcatacaaaggctctggttaatgcagcctgatgtttcaaaactaaaaaaaaaatcttattaaagttcctagtaaagttgtttttcactgtctctttattcttacttctgtcagtttcctggtaagctatataacaaatggtggcaatattttggtcagggatattgagggttatgcaaacaaggcactgctcctcttgctttcactgctaaacattcccctaagtagcttcctccatttctaaagagctcagggaatgggatacattttaggacacatgataaggcagcaggtgttatgcaggtaatggaaatcagaggatgaatggtaagagaacttcccatggaaagagagtcaaaaaagaaggctgtccatacgatttacagtctggaacggttgcagcagcatactgtatatttacatggtattttacagtttacaagtttcttttttttttttttcccttgagacagagtctcgttctgttgcccaggctggagtgcagtggtgcaatcttggctcactgcaagctccgcctcccgggttcacgccattctcctgcctcagcctcccgagtagctgggactacaggcgcccgccaccacgcccagctaattttttttgtatttttagtagagacggggtttcactgtgttagccaggatggtctcgatctcctgaccttgtgatccgcccgcctcggcctcccaaagcgctgggataacaggcttgagccaccgcgcctggctacagtttacaagtttctttcacaaacactggaaacattttacagcagctttctgagaaagaagtgtgagtactattatcttggttgtaatgaggaggaaagaaactcaagtttggagagattaagttactagtcaaaggctgcagttagtatataacgaagctgggacactaacaaagatcacagggctttaggcccaatgttctttctactatacatgatgtctgaataaccagtccatttaggaaaaatcaggtataaaagatggcactatggttacagaaaatgacctaatgacaaaggtgagtgaacactgagaagaaggcaatgctgatttggttcaaacactatgcccttcactgatgttgagcaggagattttgataatattctctcaatgagaaaatgggtagaaaacaaatttgggggacacaaatagtggtagttaggaagtctgtaagtactataaacatcagattctctcttttttttttttttgagatggagttttgctctggttgctgatgctggagcgcaatggcacgatctcagctcactgcaacctctgcctcccaggttcaagtgattctcctgcctcagcctcccgagtagctgggatttacaggtgcccaccaccatgcgtggctaatttttgcatttttcatagaggcagggtttcaccatgttggccaggctggtctcgaactcctgacctcaggtgatccccgcaccttggcctcccaaagtgctaggattacaggcgtgagccaccatgcccagcctaacatcagattcttgactggacaaattgcaggatattaaaaactggctgcttggctgggcacagtggctcacgcatgtaatcccagcactttgggaggctgaggcgggagaatcacctgaggtcaggagttcgagaccaacctggctaacatggtgaaaccccgtccctactaaaaatacaaaaattagccaagtgtggtggcacatgcctgtagtcccagctacttcggaagctgaggcaggagaattgcttgaatccgggaggcggaggttgcagtgggcacagatcacaccactgtactccagcctgggcgatggagcgagacttcatctcataacaaaccaaccaaccaaccaaccaaccaacctagctgctatcagtctgactcttttttttttaagatggagtctcgctcttgtcacccaggctggaatgcaatggcgtgatcttggctcactgcaacctctgcctcctgggttcaagcgattctcctgcctcagcctcctgagtagctggaattacaggaatgtgccaccatgcctggctaattttttttgtatttttagtagagatgggttttccccgtgttggccaggctggtcttgaactcctgacctcaggcgatctgcccgcctcagcctcccaaagtgctgggattacaggcatgagccactgtgcccagccagtctgactcatttttatgcattaaccattataaagataccacaaaaacgtttacatgggccagacacagtggctcactgtaatcccagcactctgggaggccaaggcgggtgaatcatttgagtccaggagtttgaggccagcctgggcaacatggagaaaccctatctccacagataatataaaaattatccaggcatggtggcacgcacctgtagtcccagctacttgggaagctgagggaggaggatcacttgagtctgggaggtggagggtgcagttagctgagagtgtgcttttgcactccagcctgggcaacagagcgacactctaaaattaaaaaaaaagttggccaggtgtggtggctcacacctgtaatcccagcactttgggaggccaaggcgggcagataacaaggtcaggagatcgagaccatccttgctaacacgatgaaatcccgtctctactaaaagaatacaaaaagtcagctgggcgtggtggcaggtgcctgtagtcccagctacttgggaggctgaggcaggagaatggcgtgagccgggaggtggagcttgcagtgagccaagatgtgtcactgcgctccagcttgggcggcagagtgagactccgtcttaaaaataaataaataaaataaaataaagtgtttacctggtactgttgtgaactttgaataaagtttactggaggctcactttgtttactcttcaaccttaaaatattatcagcatatccccagctcaggatggctgaccactgaatgtccgtactgttcatgcttctcacacctcaaggagaaggagaaagaaaagtatcagattgtcactgctcgactgttacatgacagcccaaaactggcagattaaagggtgaagtttacatagcagaacatatcatttggtgcaagaccatctttaaatctctaaaatggaacaattttttagttttattcctttaatgctaacagggttctcagggtgggattatattttttcacttgtgttgttttgactgggatttgtttgactcagaactaaaatttctgttaagaaattattataaaagacagtaatagtgaagcttactctattcatgttctgagacaccttttcttttaaaaataaatatgaactagatactatttaactttctagatacccaggatagacaactgttagtagcaggaagataacactgctagagtggaagcaacacctagcctgagaagggatcatttaatcctgtcaactgcaggactgtgtatggtagaccttcattcaattcaaggaggctctgttcttctcttcttcttcttttttttttttttttgagacagagtctcgctctgtcacccaggctgaagtgccgtggcgcaatctcggctcactgcaacctccgcttcctgggttcaggtgattctcgtgcctcagcctccccagcagctgggactacaggcgctcgccaccatgcccggctgattttttttttgtatttttagtagagacggggtttcatcatgttggccaggctggtctcgaactcctgacctcaagtgatctgcccgcctcggcctcccaaagtgctgggattacaggcttgagccactgtgcccagccctctctcttttttacaacatagtatgatgttctcttggcataaaaatttggaaattttgacatcatttcccagtactattaattatctatgctttgttggtatgctgaatatagctaaatgcagcatatatgctgtaaatggtactgcccttgaaacttgcaatgttttaagttcctaaaggagagacaatgtgctttatttattccagtacctagcagaatacccagaagtagatgagtataacaaataaatatttcttgaatgaatcaacagcatagtgaaaataggcaattcacagctttttgttttgctgagtaaaataagaaatgttgacaacattttgtaacaaaagaattggaatatactcactaaatagaaactcctctaaatataagctgctagggaaaggaaccacatatcatgagtcttgagtcctctcaaaatctgccatgatgcctggcatgcagcaagtgctccataaaccaaggtttctcattccagtaccacaagaggcatcatctttttttttttctttcagaaaaagaaacttctcctttaactattaggacagtatatcttaaataggatctattaaaattgaatctaaaattgattttcagcatgtataagcttggactcaagccccagagattctgatgcagtgtgtctcttgtgttaacaagtgacctaactttcatctgtaagctacaacattgttcagtcaatgcctctctagaatgtctatgtggactgttccttgctgggtctagtgttgagtgtatgtagtaaacactgacctctcccagaccctagggtatttacaggccaataagcatttattaagcacttagaatgaaccaggcactgtgctaatcatccccatacattattgtattgaatccttacagaaaattaccctgtgaggtaaattattttgttattcctactttatagatcaaaagccaggatttgcaaagcacgaagttaacttccccaaggccacatagctagtaagcagcagggcaaggatgcaaaactcaggaactgcctgtggaggccatggaggaaactgttctattaaactactgctctggacatacccaggttctgacaaattccaaatacattgtgcgaagaaattaagtgtaatttgagcgaacatagctattaagggcacactaagggttcatgactgtagtggcacaaataagataggcttagaatatgtttgacatgcttaagtcccataatgcaaagtgataatacctgctctttctcttttgctcaacagagagaaactttacagtactctaatttttttttttttttttttttgagacggagtcttgctctgtctcccaggctggagtgcaatggtgcgatcttggctcactgcaagctccgcctcatgggttcacgccattctcctgcctcagcctcccgagtagctgggactacaggagcccgccaccacgcccggctaatttttttttgtatttttagtagagacggggtttcaccgtgttaaccaggatggtctcgatctcctgacttcgtgatctgcccgcctcagctttccaaagtgctgggattacaggcttgagccaccgcacccagcctactgtactctaattttttaaaggtaaataattcacacatgttggtactttggtattattagtaaattacttgtaaattgcctcataactaattgtaacatactagtaagaatgaaccattgataacacaataattatgattaaacagttctaccctatcctattaactcactaaacatagataaaacggtatgcatcctctcttatttctaacaactataaaacaatcattcatttcatgacagaaataagagtgagcctaaaagaactatggcccagctagcatacctaatttctttaagtgactgatgttttctctgggtgctggcacctttgtattgcaggttgggtggaaggctatatatggctcccaaagagcacagtgcacagaaggtaatggtaattgccagcagtgctggctgctaacaggcatctagtccacacactggcttttaggcaagtctgcatttaacctgatagaaacagatgagtgccctaggtcattcattttggtgccccatgtccacagtaagtaggaagagttcttttgtttctagtgaaatggctaatttggaatggctgagggactgctcaaatgcaaaatgtccctagttttccagtgtctagttgacatttagaaacatgaagaggcctctactgcacagcactttcccacatgttgcttttagtgagtcagtatgtggggagtcagaaaaggattggttttcaggaatacgtgtctttaaaacctattttcaaggctatctcgacatccttgttgtgtttgttgcttaaacccatgactatatcttctgagatggtagatttgttggtcaaatacgtctgtctattctggggctcaacagcctcaaagtgtacatttctgccaaatcgataacatcttcattttgtgaacataaccatctattcttgtccccttcaagttcctcctctcatttcaaatagcactgcatttaactctctgttttttcatgtagcatgttttcattcctactttgcactaaataaccacaaatttgagctgagtttttccaccaaggactcaaagtagcagcacagatgagctagaaatactcaaatctcacgaaagatatatccagaatgatcttcgttacattttattttaccttgttccttgctatatgtcatcagaagacagaaattccgtgacaaaccacagattgctctggtgggcagagcctggagagagccaaatctttctccgtggggctggctgaagcagaccacaggtactggagcactgggggaacccacgtattccccccatttcaagccttttatccatgacaaaggactctaaaatgaagaaaaataaaaagtatggctttttaaaaggtggtaagtgtagaattacttctaatttaagctctaaacaaagtaagagaaagtaatatggattataagctctgtaagggcaataattattttacgcatttttttttacttccccatgcttagcgtatagaaatatttgtcccttatttgagttttactctgtggttctggcctaatttgcatgaaaatatgtggttaataattcaaaattccttgaaatttgagcagagaaaaaaatttagtacatttcttatttctagttgaaatacctaaactaaagttgatacttactggaggactgtaatttggtagtatgacaagccatatgtacatatggtaatagaaatcaagaccacatgtagcacaggaaacctcactcagctatgagctccttgaagagagggaacacctctgattcatctatgtgcctggaacatagcaggttctcatctcaaatagatacgtgatgagtgaaagggaaagtgtttatctatggaacatattgcgaggattagagaatctctagccagtactagagaagaaaagagatgagaaagaattgtcagtgaaaaataaaaggtagagcttgaagaacaataggatttgggggaagaaaggtgagtgaagactctagagagatacccatttggctgcccacgaacggtaatgaaaaggtttcctccacttcaagcaaaaacagttattaaaaagtttcaaaatgaagaagaaaagacatgatgcccttttaaagagtttccccaaatagttctattctttttgttctccttatgactgttttatcctctactgaactcttcttttttaatggattccctccttttatacatttaagagtttaacccattattttactttcaactcttcagaggaaatgctacataaaataaaaataatatattaagcaattttcagtcatttctgtaaaaaacctgatttttagtgaaacttgcttatgtcattttccaaataaatgaaaaaaaaggcatcactgacgtatagactatcttttaaaaaaatcgtgccactttaggagctctaataattctgtcagactatttaggggacatgttaaatgatatcatagtggtctaaaaaatgagtatctctggaaaagcttaagagcttcaggaatgctcatgtgggaacagagacgttagggtcaggcattttgaaaacaagcttctaaaattttgtctaacagtgtttttttgtggctcccctgtgggatccaaatctatcaatattaaagttgagaaaggccgggcgcggtggctcaagcctgtaatcccagcactttgggaggccgaggcgggcggatcatgaagtcaggagatcaagaccatcctggttaacatggtgaaaccctgtctctactaaaaatacaaaaaaatttaactgggcgtggtggcgggtgcctgcagtcccagctgctcgggaggctgaggcaggagaatggcatgaacctgggaggcagagcttgcagtaagccgagatcacgccactgcacttcagtctgggcaacaaagcaagactctgtctcaaaaaaacaaaaacaaaaacaaaaaaaatcaacaaataaagttgagaaaaatgtgtgtgctaaattttagttataatttatcattcacaattccttgccaggaattcatataaaaggaacttccttttatatgagttgcagagtttaaacttctagtttttcaatgacacagaaagatacaagggcaactgttttatatcatagcatatttatgatcattattctcctttcttttttttactttagttctgggatacatgtgcagaacgtgcaggtttgttacataggtatacgtgtgccatggtggtttgctgcacctatcaacccatcatctaggttttgtcttgatgctctctctcccatccccaccaactccaccgcgtggccccagggtgtgtttttcccctccctgtgtccatgtgttctcattgttcaactcccacttatgagtgagaacaagcggtgtctggttttctgttcttgtgttagtttgctgaggatgagggcttccagcttcatccatgtccctgcaaatgacatgatctcattattttttacggctgcatagtatttcatggtatatattttctttatctagtctatcattgatgggcatttgtgttggttccatgtctttgctatagtaaatagtgctgcaataaacatacgagtgcatgtgtctttagagtagaatgatttatattcctttgagtatatacccagtaatgggattgctgagtcaaatggtacttctggttctagatccttgaggaattgccacactgtcttccacaagggttgaactaatttacattcccactaacggtgtaaaagcgttcctatttctccacagcctcaccagcatccattgttccttgactttttaataatcgccattctgattggtgtgagatggtatctccttgtggttttgatttgcatttctctaatgatcagtgatcctgagcttttttccaacagtaaccaaaacagtatgatactggtaccaacacagacatatagaccaatggaatagaacagagacttaagaaataacaccacacatctacaaccatctgatcttcaacaaacctgataagaacaagcaatggggaaaggattccctatttaataagtggtgctgggaaaactggctagccatatgcagaaaactgaaactggaccccttccttacaccttatacaaaaattaactcaagatgaattaaagacaaatgtaaaacccaaaaccataaaaaccttagaagaaaatctaggcaataccattcaggacataggcacgggcaaagatttcatgacgaaaaggccaaaagcaattgcaataagagccaaaattgacaactgggatctaattaaagagcttctgcacgtcaaaagagactaccatcagagtgaacaagcaacctatagaatgggagaaaatttttgcaatctacccatctgacaaaggtctaatatccagaatctacaaggaactggtacaaatttacaagaaaaaaacaaacgacctcatgaaaaagtgggcaaaggatatgaacagccacttctcatagaatatttaaagaggagtgctttattgaaatgctttttatacagctctgattgttttgaacttcaatagtgaactgaagttcacacaagcatacctgggtcatccagatgacccccttataaatgagtactgttgcttggtttcaaggcttgtgtttgcattttgtgtagatgtcaagtgaaggcccacagagtcaagaagcagtatggtgtcgaaagtttcaccgtggttcaaataaagaaaagcagtggcataaatgtcattacacatcacacagaaatgcagcaaaccaaaccttaaagaatttgcatcagagaagacattaatttaaaaaatgctgagtgtctattatatgcccaggaccttcctaggaactggggacacagtaatgaacaagacagacaaagtccttgtgtttatggagttacattctatttgggatgggagtatagacaaataaataaacaaatacatatacaatatgtcaggtgatagaagtgctatacaccaaaacaaagaaggggaagggatctgaggatgacggaacagctgttttagacataattagacttagatataatcagagcttttggaaagcatttaaatgggggtcagggaagactctgaggaagagatgtctgagcagagacttgaatgagatgagggagcaaactggggatatatctggggagtggttattccaggtggagcaaagagtcatcacaaaggttctgaggtgggaatgaagcaggctggtaccatgttcccactgcgagcagacatactgctcagatacaactttaacagctaacgagcagtaagtatagtagtaaattaaatggcatttattaattttcagggatgtattgtaaaattatgctgacatgttaaagtgacagattgggctgggtgtggtggctcgcatctgtaatcccagcactttgggaggccgaggcgggcagatcatgaggccaggagttcgagaccagcccggccaatatggtgaaaccccgtctctattaaaaatacaaaaattagctgggtgtggtggcgggcgcctgtaatcccagctactcgggaggctgaggcaggagaactgtttgaacccgggaggcagaggttgcagtgagccgagattgtgccactgcactccagcctgggcgacagagcgagactcatctcaatcaatcaatcaatcaatcaatcaagtgacagattgtagttaaaaatagtgaccctggtaattacagtgactaaagtgatttgtgaagcttcaaaaacagaaaacaaaaaatatagttttctattatgaaactcaacacttgtaatttagttttagcaaaacaacactgtctaccatattaatgctttaaaattgaatttcactggtggaataagttttgtttgtatttaacatgaacatttgacatatgtgagctatgagcgcaaataatttatatccagtgttctgtcttacataaagtaatattacaaggaataatagtcaaaacaaggtgtaggtgtgtaaaaaccttttcctcttaaaataggtcacagattactgcactttgagatacactgagttatttcatctttaaggtcctttacaacgtctttcccttaccttttcattttctgtgatttccttctgcaaacccttacagtgcttacaattcacattctactatcttatgctgtttttataacgaagaattgagttgaagattaaaatccactttagctttaaggcttgcttgatttttctattttgaagtaaaaattatacctacttcctatttttggaggcaatacttcttatcattacaacctgaggaggccaaagaaatatgtaaagttccccttaggtataaaccaaaacatccgcatcactggtcaatccttttgattgtagatgataaccaagaccatggtatgcatgtgtacactggcacaccaatgctcaaactattctctagtccttctcttcttgcttgaaaaatcctattatgtcactgccctgcgaggctttccctgggaataacaattctctctgctccctgagggaggttaccgtctgaaacgatgaattcttttttcctctgagctccccaaagcactctctcatatcgctaacacagcatttacctcgcacaggattctgctttcgctgctgcacctgtcttgcactgactggcacacagctttaggccaggaccatgctattcatcacctgggagagtgcctggcatcacaagagtctaatcaggttttgctgcactcgattgaaatccaaatgacataccggataggtgatttctttgacctgttctcgggtctccctgaaagcaaactgcactagcaaccccacagcagctggaagctctccttcaatattgagcttggctccaggtctgctcacatgggccatgtggaacagctgacggggagtctgcccgtaggtttttatcatggtttctagcgctcgtctctgaactggatcttcaactgcagagacatccattccaaaatatgtctgcagagtgaaagagtaaaggaacaagacatatgtagtaaaaagaaagacttgacaataataccaaagggaaaaacaacactttgttttatattctaggttatggaaaaaatgcttttgttcaggttaacaatcactcatggtctcactgagatcagaagtatcaatgtttctgaataggtgaacaaaaacaacgtatcttgactgatggttataattagttatgtttataaaattagcttttaatttaagatctgagaatatcatatatgacctgatactaaattattgaagaagttgcttatccaaagcaatatataggaaaaggcaaaaatgaagttaaaatacaatgctggtagatagttgaagagataattatttaggttctaatcaatattggggataaaaccaaaagagcagcaatgaaaattcaaagctcttaaatgtaaagggtattattgtactaataaaattactgcactaagaagcatattttttcttagtgtcattatcccgtagagtcagatggagagcaatgcacatttacttatttctaaagctggcggtcagtaattgagtacagatcagccatattttgtacatatccacttgatggcttagcttttcgtatatttaatcagtcatagtggctttcattacatatctagacataacatttctataaatgccaaaataaaattccaaagatatttcagaagttaggtcatcttcaactccattctcctcaccacaactcccagcaccagtgatcaaatcctttttttaaaaaaacctttaggttcagcagtacatgtgcaggtttgttatttgggtaaacttgagtcacaggggtttgttgtacagatgatttcatcacccaggtactaagcctagtacccagtagttattttttctgatcctctccctcctcctatccctcaccctaaaataggcaccagtgtcgttgttcccctctttgtgtccatgagttctcatttagcttccacttacaagtgagaacatgtggtatttggttttctgttcctgcattagtttgctaagggtaatggcctccagctccatacacgttccaacaaaggacatgatcttgttcttttttatggctgcaaagtattccatggtgtatatataccacattttctttatccaatctgtcattgatagccatttaggttgattccatgtctttgctattgtgactagtgctgcagtgaacattcatgtacatgtgtctttacggtagaatgatttacattcttttgggtatatacctagtaaagggattgctgggtagaatagtagttctgtttctagctctctgaggaatcaccacactgccttccacagtggttgaactaatttacattccctccaacagtgtacaagtgttcccttttctccagaacctcgccagcatctgttatttttgactttttagtaataaccattctgactggtgggagacggcatctcactgtggttttgatttgcatttttctattgatcagtgatattgagctttttttcatatgtttgttggtcacacgtatgtcttgttttgaaatgtgtctgtttatgtcctttgcacactttttaatgaggttgtttttttcttatacatttgtttaagttccttatagatgctggatattacacctttgtcagatgtacagtttgcaaatattttctcccattctgtaggttgtctgtttactctattgatagttttttttcctgtgcagaagctcttaagttagatcccacttgtcaattgttgctcttgttgtgaatactttttataaacacttatctaagaaaggccaattgcaatggctacttaatgtactcaaaaaatcaaataaggattgatacactcctgtagctagaactgttttaaaatttattttaaaatagtgcttttcaacattctgtggtattcatttctaagtgaaccccatgtattagtgaacggtcattaagggcaacaggcatctctacatgcctttttaaaaagttaacatttatttgtgcttaattgtgttagcagacattatcctacatgaatttccttcctcatttatgaggttggttttattattcacatttgacaagtttgtacattttggtacagagaggtcaagatatttgccctaaggtcacacaacaagtggcagagtcacagagtgaggatctgaactcaatccttaattcagagtctctgcacttaatcgccatactttgttttgccccattaaataagttttattaaattcttaacgatggcataaactttatccttctaaaagttactaaagtcccaaagaattagtgaaaaaaaattccagtcagatgagaattaccatgtgtatttcagtcttcagatacttttttttaaaaaaaaaattgagacagggtcttgctctgtcaaccaggctggaatgcagtggcacgatcatggctcactgcagacttgaactcctgggttcaagtgatcctactgcctcagccttttgagtagctaagattacaggagtgtgccaccatgcccagctaatttttaaattttttgtagagacaggttcttaccatgttgctcaggctggtctcaaactcctggcctcaagcgatcatcctgcctcagtctcccagagcatttgggttataggcattagccactgtgcctggcccagtgatacttttaatgtaaattttatataagaataactgaaaagatggttcaggattataaacaaaaagggtataatgaagttaatgttaagattcctaattgctctttttatttttattttttatacagggtctcactctgtcacccaggctggagtgcagtggcatgatcttggctcactgcaacctccacctcccaggttcaagcaattctcctccctcagtctcccaagtagctgggattacaagcaagagccactaccacccagctaatttttgtatttttagtagagacagggttttgccatgttggccaggctggtcttgaactcctgacctcaaatgatccacacgcctcggcctcccaaagtgctgggattacaggcatgagccaccatgcctggcctcctaattgcttttaaagttgcattttggaatcaaatgaagctcaaaaatcagacccgaagccttgcatttattttatacttgatggagtttaggacacacaaccccaaaatttcgtaccctggcatactgaaggaatctgaggaacagcatgtgcacgaaggactttttggctttcccctgaagcagatcataagattttcacttaggagttaccctccctatacctgtagtaaagaagcaccctcatttcagaagacaaagggacacagaggaatctgaacaaacaggtcctgctattcccctggttaatcacacttagctcctactcctttgtcctatcatttttcttcatgacattccattcctcatcaaaccagacataaaaacattcaggtttaactacttggggtcttatttccacgtgaagcctcccgtgccacataaaacttgcattaaataaatttatatgcttttctcttgttaatctgggtttttgtttttctttgtttttgttattttgcagaggctccagcaagtgaacctgaggaaaagaaggcattttttctcccttacatattaatattatatgtaaagttgttattcaccaatgaaactatattattctccttttttagaatgaacttttccatagcatttatcttctattagaataattaggaagcctatcttattctcttttctagattataaatctcttaagaaatttaattttatatgacttcagacgtactcaaaataattatggaacaaaatgaactaatgagctttttattttaaagctacttttggggaatggactactggcctaaataagctcagatatggagtggtctactgtaggttctgtgtgtgcactttacctgtatttgttataaacgcttgtagatttgctacagtcgacacagaaaattacagttagtggagaagtccttcagatatttccttttaaaaggaagtatctttcttttcagaatctgctttttcacctcccactccttgagggatttcctttcagcggcctcatttggactctactactacatccaggcaggcccatctaccttggagaggaaagttggctttcctcctaacccccttcaccctatttgagtcttatttacttttgcatccccagcacctagcaaaataaatgtttcctgaagaggtaagattttttttttctaaagttagtctagccaacaacatcaaaaagtatacttgaaaatgtaggccagacatggtggctcacgcctgtaatcccagcactttgggaggctgaggtggtggatcacgaggtcaggagtttgagaccagtctggccaagatggtgaaaccctgtctcactaaaaatacaaaaattagccaggtgcggtggtgggcgcctgtaatcccaactccttgggaggctgaggcaggagaattgcttgaacctgggaggtggaggttgcagtgagctgagatcacgccactgcactccagcctgggtgacagagcaaggctccatctcaaaaataaataaataaataaaaagtaaaaatgtaacaattctacttctaggaatttatcttaaggaagtaaagatgtacataaaaataaccatagaaatattaattttaatagcaaacaaatcctaactaaatatccaacaatagaagactgctaaataaattattctatagctatacttaagaatataggttgagtatcccttatacaaacatttggaaccagaattgttttggatttcagggtttttttggggggggattttggaatattagcattatttacttagcagttcagtattcttaatccaaaaatctgaaatctgatatgctccaatgagcatttcttttgattatcatgttggcactcaaaaagtttctgattttgaagcattttgaattttggatttttggattaagaatgctctacctatagtaagtagccattaaaaataatgtagaatgatacccaatgacttgaataaatttaagattatcttatttagggagaagataaggttaccaaatagcattattattattattatataaatggaatgatacatatgtatagatagaagtctaaaggtgctttcactatttatttctggatggtgatattaaagtggactttaaaatttctccctgttgctagtctgtattttatacatttttctaacaaagtacaagtactttttctgtaataagaaaacatggtgccattttaaagtagaacatgtatgtaggatagtgtgcggaaaagagttaacatagcaagattgactgctatctctggaaaggcctgcttgcaaagttggctcttggctgttgtctgggaacctggatttcaggagaggtcctaccattccctaactgataagagtggcttactgtgcctaaactgtacaaacaatgcagtttataccgaacacctgctttccttctgaggctggaatttcagtatgtgcgaggcagagggtgcctacgttgccaatctcaataaaagtcttgcacactgagcctctaatgagattccctggcagacaacatttcacatgtgtcattatgactcgttgctggaggaggctgagtatgctttttgtgctttaccaggggtagattcttggatgtttgtgcctgctttctcccagactttgccccatgctgattctactttgtatcatttactgtaataaacctgagctggaaggatgactatatgctgaatcctcaagtccacctagtgaatcatcaaacctggggattgttttggggcacctctgaaaaagatagtatcttgtttttaaagagaggaaatataaaacctgaaaaatcttaggtgacagtttaatgctactaccaattctctttgataacttgagtgttttaaaggaatggccgaacaactaaccttaaaatattcaggttctatcttatataaatacagattgttttaaaagagtcacttacagcaggatgaaaaacattgatcgcttgaacagaagccttccccttttgcttatacccaaacaccaagtcaatccactgacagatgttctgcgacacgtagtcagactctagagcctgccgatggatgaggataaaaagacgaggatcattacgcgcccaagggggaaggttgacgtgattaacccgttcaccattctgacgcacaccaaaatcaaaacctaaaagagaagattaatattaatatttaactcccccacagcaagtttcattcagctacagagcaggtcttaagagttcacaaaaatagctgtttgtgtgctacaaccaaaaaagggaatagcaaggaggatttacattttgaataagaaacaccactgctcatctacttatgtacctactaatagggctatgtgagctaatgctatcataattaaatttgagatctttcaactttatccttctaccactttacaacatattgaagaaaaggagaaaaccattgcctactaattccaatattctgactattcacatcttcaagggcattaagtacttaaatatctattcaattgtaaacctgattagaatcaaactaaggctttgtagaagcatttctaaactattggtattaacattttaataaatttaagattatatttagtaaatattagtattctatagtttaaaaactcaactaatataaagtatacacattgttagaatgaattgccatagtctattaattttataagtctatgggtctgttctgacttcctttctactaagcattcctgtagatagcaaaattatcccaacacaggaaataagagggttcttctgtgatgtaaatgagctaatatctaattgtctcatcagtataaacaaaaatctcagaagtgtttatttaaaaaaattatcctaaaggaaatgttacctttaaacagaaatggctttttgtgctacattttctagtttgctgaacaccataacaaaaattaaaaatgaccttttaaaagctgattaagttccatgtaaaattaagttgctgtctgtctactttttgatcttgtaaaaacagttagaaggatcttcaccaaaatacttgggaagtattttgaaatgatatgatatggaatataaatcaagggtttatataaattcacatgggatggggatgtgagcatctcagaaagctcagcagtcatcgtacagagcagctgcatggttgatttaggatggactggctgagcacctgcagaactccatgtgtgtggcttcaggagcggcagcagcaggaacttatttatttaacagtgaatgaggcatctgggaatgggctggggatggggtgcataagggcatttgtacaaactcaatctttcccaactttcaggtgttctgagggaacatctgactcctgacccaaagcagacaactgacatacgagagtcccaggggaacactgataggaaatgatatgatatacgctgtaaaaaactgtgttttccaaaaatggctataacagcatttcctgtcttgcatgcccttccagaatcttgctactctccatcacaaggcaaagtctatcttcctttcttttgaatctgggaagacacttgtgactgcctcaatgaataggaagaatacagtggaagtgatgctgcgtggctgctaagaacaggctggaaaaggccatgcagcctctgttcgtctccctcttggaacacttgtctttggaaccctgagttgccaagtaggacatccagggctgccgtgctgtggggaagcccaaaactagcccacacagagagaccacatgaaaaaacactgacattgcatgaagagagggtgatgtgctccagctgcctaaggcttcatctcctgcctgttccagctccagaaaacctgaaggcaacagcatgagacaccctgagctaaaaccatctagctgagctgtttctgaacttctgaccaatttcttatttctgaccaataaaaaataattttattatctgtgattgataataaatttattattgtttcaagccattaagtgttgagattatttgttatacagccacagatagctagaacatacatataagagaccatggacagagaaaacaaggagtagatttaaacaggagtcctaaatgaaaagcttcaaggcaggtgccccaaattgcaggtgctgatgtttgactgaggcatttctcacttgagcaacactatgaaataagctccagggtggcatgaatctactgatgattcaataatcaatcaaacaacctcagagacacagatactatacaacaaaattccaatgtaatttgcccaacaccaacttcttaaagctgtttcatatgctcttaaggatcacataaaattatagaattaagtaatataagaaaatgacccaaagataccccttaaagggttagctgctcttctatttaagaatagctaaggttggcagccaagactgttagttggcatcacagaaaatttgattttatactccagtattccttttggttattagataattctgggcagagtattttatttttattttggtcattcctcataaaataattgagatttcagttaatttacattttgctttcaataaagtcatacctcttatttttaaagtaattagcacattataacttttgtattcagaaaaaagaataaagcaatttctataataaaattaaaatacatatttacaaataactttaatagttaaaagttacagttttccaaacatatttagtcctataaaatacttaaaatcctcaagcttatttgaaaatagaattatatacttaataaaaaacattttctcttatttggggactcaaaaatttttaggacttaaaaaagctattttcatttttggaaaattacaaaataaccacaagccctcagaaatataaattaaaaataatttattgctataccttcacggttaactaggaactctggaagatagaaaaactctgggataagttctttcacatcagtcatagattcaaaagatgagagtcgccaagttgtatttgtagaatgaaaagttctgtctggaatgtcaaaactttgatctataaaaaaatacaaataatacgattaagacacaaagacctaattctatttgaggcctatcataattaatttacttttgccacttcaaaaagattaaaataatgctaattttgtttgcccatagtttaaaagaagttattcatgttcttgaaaataaatatttctataaacttgagatcatattacatttttcatctgtattatgcttttgtaatatatattattagattagtttatatcatctatttgtttaattttcgtctatctatcaaagtagaatgaaagttccacaaaaacagggccctgggatatcacccacaccttgcacataatgggtattcaatcatggtttatttattgaatgaatgaataatgaagaaggaagatttaagttcaagtaggcaaacagttttttccccatcaggaagcatgattccttcactttgaattgttaagactactttttctcctttcttttctttctttcttttttttcgggggggtgcgtaggttacggtgcattgttttttggtgttctaactctgagctaaagaattgagtaaaatttcctgtgaatgaaaataaaaataagcatagtcactctttcgttcattttttttccagggtagactattaataataaagaattaagtttggactctcttttctgccaacaatgatcagactttctagccatagggaaaggcctagaatattaaatgatatccaaaagctagcctctgaaaacagtagcagtttacatgtttcttaggaaccatattgcatcatctaaaactcctctgaacttgttgaaatttgaacacatcttttcatttggagactgccacaaacacatcgcagcatcaggtttcttctcccagccttagttgctctgctgagcaacatcttctgtcacttgtattactttctcatctattctgttgagtcaattggcattggctggccactaaaaaaaatctgggaagaaataaggtttagaaacatttactttttctcagaaagtaaggagggccacttaaagaaatacctactaacttagtagaaaaagttatcaatcaaaatggaattcagaaaaattaaggtaattctcaaaaacaaacaaaaaaactaaaagaaaaattaaggtaattttgtaaggctatggtgaggtcaaagtatctggagctaagactaaggaaatacggaacaagagtagcacattgggtaggttctgttcagattttaagattctctgtattttcctacattttattaaacagtactactacaaattcccattatctagaatatgcatatattaaacctgtggttctcaaccagtagcacttttgccctccaggggttatttggcaatgtctagcaacatttttgattctcacaactggggggatggggtgtgggtggtggtggtaccactggcactagtagggagagaacagggatacagctaaacgtcctacaatgcacagggcagctcccatgacaaacgaattatgcagctcgaaatgactacagtgccaaggtggagaatccctgcattaaaccaaagccaagaaataaattcaaaagccaacagatatcacttgaaactaatgagatgaaagtgaatggagactgaggtagtcctaggttttaaacaaaatatattcataaatacataatgaagaaaacataatatatgaatacattcataatagtaacatgaataaaaatattgataaattttagttgattggtagttttatattaatgggttcttgggctacattaaatgaaatgtagtcttggatggagggaggtaatagttctgttaaacactgtaggggcccaaaccacatctgaaatattcttttttattttgactgcctttttcttttcatcaagagcattcacaaatcagaacatgtccagaaagatcttcagaatagtgacaggcttggaaaccacagcaaacaaggatggcttaaacattggttttaaaaactctttatttagtacaaaactgtcctatttattttttggtattccttccagcagctgggataggaccatgcatccaggaggccctcaatctgccgtcaaattaaccaaggataattagccaggggaaaaacaagagagagagagaaagggaacaggccaacaattttcaaatatttgaacagctgtcatatagaacatttgttctgtttacttacagagagacaaacataggaaagccccttttatagaccaataagagtgaatacaaattcattcctccaataggttgtacatgagtaaaaagcatgaagtagttcaagaatggttgagtaaaagaatggataatgattcctcaaagtattctggattccatgagaaacagctatagaactaatatcaccgttctcattagaaactacaggtgagtatgtcccaatctccacaaaaatacaaattcactcctatctaagtcatgttcaggcctccagtctgtcacttaaaatgctgatgtagaagattattaactacaaagctaccacagtgaagttgccggtgtgcgtcttttattaactagttataataaacctcaataatgtacttgcctttataataaactgcaataatgtacataggctccaaaggtaacttactggatttgaaataagtattaggtagaatgtctttaaaaagtgaactgcataaactttaaaagggtaaattttatggtttgtgaattatatcttaatttttaaaaagtgaattgcatttttataaacttagacatttaatttgaagctaaaatttgagacattagcaagatgatttggcttactacagcttttttgaggagcactttgggcaaggaataaatagaattctttttcctgtagtttgattagtcttaatagttcttaaaatgtcagtcctaagttgttgttgttgttgttgttgtttctgatgacccaacatgactttttaggcagttattaaattcttaccttgataggctaaaaacattttagtgaaaggaggcatcctgaccaggaagtgaagcacagtgccgctattggaatagtgggagccatagtgatagggctgcacgggaggcatggggtcatcttctctggctcctttgcggtactcttcctccaagtactgaaagaaacggtgaatccagagaattcatgattgtgggctccaggcaacgctagaaaagtgctggatgtttttttttctctccttctctactacccctttgaggccattctccatggctggccctcccactcttacccaggagacttcagcctccttgagtgtctgggagtcttctccttggtgcctcactaagacccaaacactcagaagcatttctcatctccaccttcactctttcattccctcatagaaaacctacctaactttgagcactccacctcctaactaatggctcataatgtctaagctgatcaagcacccaacaaatgagaggtgcttctgtcactagagatgtcttcatttcaaaagagtttcaagatgtaatgctatgctgtctagagaactgcttctctagaagtagaaatgcaatagaaatgtaaaaactatgtcacattattggtaataatataacattttaagtctgttttacagtgcagttatcagagataaaaaaaaaaaagaatatggtgatttttcactactcctatcttcccatcataaagtaggaagttcaaccaaacatttaatatctgtcactattcttgtctcccatagcttctgtctggttctgataacaaagtcaggtatagtgaattttcaagagttacttcttgatttccacagcaatgacgcattttcaactgctgaagaatcaagtagtgacagtcataagatgcttagagggatgtttcaggaactgtggcataaaataatgtgatgaatatgagaaaagtgtttcagttgctcctgtcttgatactcgtgaagaatgtaatgcgtagctattgtgatttttgaatttccaatagaatttcattaatattaatttcacagaaaaaggtaattcattttatttttaaaatgttaaaatctgataaatttttgtttaataaaccaatgcataatttcctgaatatgactaatggttatgggtacattataaatatattaacactattacataaataacactaggggatacgaatagcaggtccctggaaatctttgtgatttttataaggaatgtgactactaaatactggaataaacaatgagttactggctttcaatttatgccaaaataagtgtattctttttctgggcaaagtgttctcagaaaatcaggatagaaaatgatatttcatttcacataatgatttctagttgtctgtcaatcctagtacaagaaggtaaaaaatccatagtataaatttaaaattaggtaaaacacaagtctgtaaaacaaaacacaatttttcatttaataaagtacgagtaaaaacaaaagctaccttgtatgtgtccacataacgatcttctttttctttatactgaacagctataggtttagagagatttctgcaagaaaaggacaattttaaaaattaaatattttgatactgtcaagattaagctccctagatgtctgcatcttgtaagtaggtaagtggtcaacaaaatgctccacccttatttctctgcttaaacatattgttttgtaactaacagtcaccattcaaaattatgatttcagaaattaaggtagaattttccccacagagccaggccagtattaggaattcctgacttacaagtagcctaaataagaagggctactactatccttctttcccttacttctgcagcttcctctagagtcataactgatgttgctcgtgggagcagattcctagaccaagccctgaaagttagtgtcccattttccagactctacatccagttaggcggtgtagaatgaagggcagtttcgacagaacttaggaacagaggaagatgctgtgttattagcctagttagttaaaactgaagaaacaacacgtgcttaaaatgaccaagctgagatttggagactgagaactgaaataaatattttgctacctagttagtagatggggagtaataccattgcgcacagtgtagagtatgtatgcatgcgtacaaatctgtcagtgccggtgttcacattctgtgaacaccacatgacaccattccttgaagcaggagaatgaattctcatccctccaggaatgaatcctcacttttacaagctacagaatcatgtggtgtccctgtgtggcacttgaaggagcaaaagaaaaagctctgatgaagaagggcaggctcttttggctgaggaaccatctggtctggcacaggcatgggaccacctggatttcaacctgcagcaccataactagaccaacagcaagatttgcctacatttcagtgagtcaaaccaggtctgcttaaccacatgttgatacatctttttttttttaatataaattactattttctaggaatgttgaaattagttgtattaaatgcactaattttgtctttgagatttttctaatcataaaaaccttgttaaaaagcaaaaacaatttatagaatagatacaaattaacatctaaaaacagagcaaaatcacttaagatggctgcctacatttttttttttttcactctggagtgaagtggcgtgatctcagctcactgcaacctctgcctcccaggttcaagccattctcttgcctcagcctcccaagtagctgggactacaggcatgcaccaccacgcctggctaatttttgtatttttattagagatggggtttctccatgttggccacgctggtctcaaactcctgacctcaggtgatccatccacctcggcctcccaaagtgctgggattacaggcgtgagccaccacgcctggcctgcaattttttatagatagtataaataggggtttttttttttggacacaagctatgttaatagttgtagctgaaaaatacaaaattacagttgagcaaacaataaactaaaaatcagccacaatactattaccctaggccacacatgttggtctatacacacccagatgtttttgtatttatctgtgcaagcatattcactttttttttttttcagacagtttcactctgtcacccaaacatgatctcagctcactgcaacctccgcctcccaagttcaagtgattttcatgcctcagcttcctgagtagttggtctcgaactcctgacgtcaggtgatctgcctgccttggcctcccaaagtgctgggattacagacttgagccactgcgcccagcttaaatctgatttcttgagaactgtctgaattaggcccactctttggcacttacagctgaaatactctagtatactaagtgaaatatttggagtccatttttctttaaactaaacatcagaatattttttcatattaaacgaacaaaatattccctcatcaactaggactatttggttactctaaaatacagttcattcaggaaaggcagaataaatgctgaattctgttcctttaattgccaaatttcaaagtaaggaattggtgccctattacctctaatgggaccaatgaattttgtttcactgtgtttccttggccttttaaaaagtatcactatgaccttacgtttctttttatttccatgtgtttcaactaattgcagtcattattctttttattctcagactatcctatctttggcagcgagaggcacttcaagttggcttctgagtccttttctatttttattttttgagacggagtttcactcttgttatccaggctggggtgcagtggtgcaatctcggctcatcgcaacctccccatcccaggttcaagcaattctcctgcctcagcctcccaagtagctggaattacaggcatgtgccaccacggccggcaaattttgtatttttaatagagttagggtttcaccatgttggccaggctgctcttgaacttcaggcctcaagccatcagcccaccttggcctcccaaagtgctgagattacaggagtgagccaccacgcctggccaacttctgagtccttttgacaagaccatattagtttcctcgctttctgacacaacaaaacatcctaggctcaccttgtctattttcttctaataaatttagaagaaatgagagaatgggaaatcaacattttgcaacctctagtgaaataattgattcaagcaataatcatcaatggatgaaaccattaggtacaaattcaatgggagcctgagcccacagatcaaactgagcaccattacagtggaatatcataggcttcctgatatgatacaatataaagctcactcctctcaaccatgcagaatgataaaaaaaaaaaaaaggaaaatatatataaagctcacatcaccacctataaaggattcttgccaaaaaaagagttgaacctgaaactaagcaagacttttccagtctctaggaaatacaggggttatgggaacaaaccaaacgacgtcatgggaagcaatcagaaaatacagaatgtgaagcctccaaaagaataagtgacctggtttttccaacaagtcaatgtcaggagaaaataaagagaaaaaatacacataaaaaataatggctggctgggtgtagtggctcatgcctgtcatctcagcactttgggaggccaaggtgggtggatcacaaggtcaagagatagagaccatcctggccaacatggtgaaaccctgtctctactaaaaatacaaaaattagttgggcatggtggcaggtgccggcagtcccagctactcagaggctgaggcaggagaatcgcttgaacccgggaggcagaggttgcagtgagccgagattgcgccactgcactccagcctggtgacagagtgagactctgtctcaaaaaaaaaaaaaaaaaaaaaaaaaaaaaggctattctaggtatatgttcagagatatagcaaccaaacatgacaatggacctgattcaagacaaccaactataaaaagctatctttgagagaagcaggggacatttggaaatggactagatattagatgatatcatggaattattgtcaattttcttacatgtgataatagcactgtggttgagatgttctattttttaaagagatgcatactgtagaacaaagaagtgacataacaagatgtctgcaatttgccttaaataagaaaaaaaagttaatgtaagtttggcaaaaatcttcataattcacaattgttgaaccagggtgataggtatgtggggtcttatataattcttctattttgtgcatgtttgaaatttttcataatgaaaactttaataaagaaatacaacatatggatggatgaaccctaaaggtgatgattcttttaacttacctgtatatcaacagatcattgaggtcaagtgtctcactaacgtagtcagcaagtataaatgggaacacaggatactgcatgagatcattgaaggatcggccagcatgtttgtttaagtgagtcaaatattcaaaattagtaatttgcccagtataccataaatttgtcagagcggtgatgttaccatattccagaagattagggaggttatttgtgagtatattgtggtatacatcatcacgaacctaaaagggaaggagaagaaaaaaacccagatattatttttagtcttattggcacttttctccaaagaacccatgacattatagacatgttacaaatctcatgtcctccaaaaaaagatttttttctcagtaacattaatgggtagagaactgagattcaagtccaggttgtcctccagaggctgggctcttcaccactatgctttactgctgcagaaatatgttaataaaaaccttctaagaaaaagtttgtatagaaaagtcacttaagacacagatactaaaagaaaaaaaaataaggaaaaaagaagagttttcttctaaataaatgcaatatggtgtagtagaaacagcacggtcttctgaattggacagatctggtatattttcctgctaaccttctgtgctacagttaccatgtctataatatgggagtgataatatttctctcataagaattaaataaagtatcctatgtaaataggatatttgattttcactactgattgaaaacatatataaactcttttttagagattcacaatagttttgtcacagaaaaggggtattggttcttttaaagcaattaaataatgattgctaataaatgaaaaaaacagacaagacgagctttgctaaaaacagatatgaaatacccattctaagcaggtatatgcttcagacacaggaagaagagccacagatatggataatgagagagtgaacttaatgaggaaatgtactggtagttgtggaataggcaaaaccacagagaatagaacatcctaaacctgtagcctaaatctgaagtttgccaattgttagcgctaaggtccacggaaggggatttatgacagactataagccaagccctggaaggaaaaggaggcattcatttattcaacaaatatgaactgaatacctacataccagtagtgttcaaaattctgaagaactggaacttaacaaagtaaagacttggcattctactggggagaggcagaaaatgctggatgctaatacatcctatagagaaaaacagaccaaagtaaaggaggtaaggggtgcttggtggagagggaggggtggctactttatagagtcagggagggcctctctgataagaagatatttgatcaggaaacttgaaaaagtgacaaagcaaatcattaggatttctaaggagaaaaacattccaggcaacaatgaatgcaaagtccccgaggcactggtgtgcctgacattcaaggcatggatggagtagacagagcgagggagagaacagcagacaatgacgtcagagaggtaacaaggtacgagattatccagggctttatcaggttattggaaggactttgcctttaactgaatgtgacatgaaagtgattgaaggattctgagcagagaaaagatatgatccaacatactttagctgctgtgttgagaataatctgaaggggggctaaggggctttctatagaggagagcagagaaatggtagtgaagggactggaggtcaagaaagggtttgtcaaagtcattgtagctgaaagtcactacagcactgagcaagttttttgttttgttttgttttgttttagatggagtctcactctgttgcccaggctggagtgtaatggcgtgatcttggctcgctgcaacctctgcttcccaggttcaagtgattctcctgcctcagcctcccaagtagctgggactacaggcatgtgccaccatgccccgctaatttttgtatttttagtagagacggggtttcaccatgttggccaggctggtcttgaactcctgacctcatgatctgcccgcctcggcctcccaaaatgctgggattacaggcatgagccactgtgcccggccctgagcaagtttaaactacttcgtttcagtcattttggggaatcagaatttaacacaattttggaggtcaaaaataatcatcatataaccaaggctttcctttaattaggactaagaaatatggcaatttttatttgatttcagaaacagtatggatgcaggaaggccagttaggaggctactgtaaatgattctggcaagaaatgatagtggcttaaaccaggatggtagcagtggaagcagtcagactctcgatgtattctgaggacagagccaacagaacctattaatagagtgtatgcagggtatgagagaagaacaagagtcttggataatctcaagagttttggcctgggcattggaaagatggagttgtcatttactgagatagagaaaactggaaggaaattatggggggaagattagaagttcagttttgtacaggttacgtttgagatgtcaattagtgacttctaaatggagacatcagtcgggagttacaatatgtgagtgtggcattcaggggagaggtttgggtagtgacataaatgtgtaagttgttagaatacagatggtattttaaagtcataagactggatgagaagagaagaggtctgaggaaggagccctgcaacacaccaaggaggcgtctgcaaccaagactgagaagcaatggctggtaaggtataagaactaagagaaaatggtaacccagaagcccagggaggaaggttttatttaaggagagaaaaatcagctgggtcaaatgctgccaataggtcaagtaaaatggggacaaagaaagattatgacattacgggtttagcaacatagaggttaccgatgaccctgacgagagtggtgagaagtctgtctgaagcatttcaaaagaaaactggaggcagcaagcatatgcaactttccccaacagtttttccataaaggagagcagagaaatggtggccgaagggattagaggtcaagagagtttgtcaaagatggaccctgctacagcactgagcaagtttaaattactcctttcagtcattttggggaatcagaatttacctcactgtggaggtcaaagacaatcctcatataacaaaggcttcactttaatcaggactaagaaacatggcaattttattcgatttcagtaaaccttcatgtaatcagtatgagtatagttacagtggcccatgagcacttaaacaatatatatcaattaataagggtgaatttaccttggtgttatcaaatgccaacaggagtgttctgccatttgttagaaagatttctacagcattatctctcaattgccaccaacgcttgtgaacttctttaatttcttcatatgtccaggaaaatgatgctggttccaactctccctgaaggctctaagacaaagaaataggcaaaaatatttgttttaccggaaatataaataattactttaattttagattttaaaaagcatcaaaataaaacagaaaatctttttgtggcagatggcagataagattacctgaaaactctcccaatgcaaaacacctcaaaatgaatgataaaatttagaaataaaaaaaataggctttattttttagactagttttaggtttacagaaaattgagcagataatacagaattctcacgtatcctcccctcccttggccctgcactcacagtttctctattattaaatcttgcatttggtgtgggacactaattacaattgatgaaccaatattgctacaatttttcttacctaaagtccagagtttatattcactctttgtgttgtacattccatgggttttgacaaatgtataatgacatgtatccaccaaatagttttattgccccaaaaaccctcggtactccacctactcatccctcctttcctctccccaatctctggcaaccactaatttgtttactgtctctatagttttgccttttccaaaatgtcatatagttcgaattatacagtatatagccttttaaggttggcttcttttactaagcaaatatccttttaaatacatagctgagcttgcaagaaaacaagggaaatgacatccccagaagtcaaaaatgtagaggaactggaaaatcagcactaagcagggagtgatactctggttgctctgttgtatgtgtctgcatatgcatgcatgtatgcacataccccagtttcagaaacaaattgacgtaggttcacagcaacttgaggacagaagatgaggccctgggcccctagaatcagggtatggaattgagattgcttcagaaagctaaaacctaggaagggatttgttcctaatgaaagattagacaaacaaatgtgcccatcaataaaggggaataggccgggtgcggtggctcatgcctgtaatcccagcactttgggaggcggaggcaggcagatcacttgaggtcaggagttcaagaccagcttggccaacatggtgaaaccccatctctactaaaaatacaaaaattagtcgggagtgatggcaggcacctgtagttccagctactcgggaggctgaggcaggagaatcacctgaacccaggaggcggaggttttggtgagccgagatcacgccactgcactccagcctcagtgacagagtgagactctgtcttaaaaaaataaaaaataacaaaataaaaataaagaggattaaccaggaagcaagcttgtctcttttggcctggagcctagagcatagaaaaaaagcctctctctgagaattcataactgtgggcctgccatcatatagatttaggttaaatccatgtctggatggcctggaaacgcccgagctgtgaaacagttctcatgcttccgagtcattcagcaaagggaaagcagagtctctggaggagcattcctggaactaatggggcattcctgcaaataaagccccactcactaaatgtaagctgacagatcaacacataccaaatagatacattcccctgctaggtggtcaacagaagaaaagaagatgagaaaagaatcactggaaggttgaatctgcttgagagtattaatcctagtgtactcagacaaatccccacattctgaaatgaagaggtagggaccacagggcctacacatcctaccatcactaggtccctcccaaagtacaaaatcaagaaaaacttaaaaaaaatgcatcttaatcttttgtaaattgtaactgaatacataaattatgctacttaatgcttttaatagagaaataatgaaaagtttctactaaagtttaaaactagctagaatttatctcctcaaatcaacctgcatcctagttttcttttttaaatcagtttttttccttttaaaaaaattgcatttacttactcttctgtgttgactaacaggaagctcagagcaaatttaggactcaattgccaagaactattttatcctaggctctttatctttccaaaaccttaatttttttttttagattcagattatcctactctatgtgtgttttactattgttcttggtccaaaataatttttataagtagaggcagggaatatattatgaataaaataaaatgtcttaatgaaaatgtaatattttcatacttaaaactgaattcttcctttgtttagtttcaacattcattcaacatatattaattaacatctatgcgcaaggtactctgctaagtgctctgcatgaaatacatctgtatgggtcaaaaagggggcatgaaatatttgtacacacatttgcacacacaacgcaagataccaaatgttatataagaagaaccaacattacaaaagtacataggaaagaaggatctttcaatctattgagaagcaagggcatttttagatttgaaaaaaaaattttcctctttatttaaatataaaacacatttatagcatgcaagttgacttaaaattaaatggtgtcttcccagaccaagtatttgtgaatgtatcctcaagcactgaaaataaaccaacatattcgacagatggactcagactcttctgtcacctcatgtcaaatggagttaaacacaaattgagtagaatttttaaggggaaaaactgtcatcttttggacatacaaaaaagttgtctcatacatcaactattaaattccttggctgataaaaggatccatcttgaaaaataacataactatattttactatctgggacataccctgtggtaattgctatataaatgagaaaagaatgctgttcatatttctgactactttaaatactttcatgactttttttttacatttattttataaccaaacttcatgttttcactcactactttctttctttcttttttttttttttttgagacagagtctcgctctgttgcccaggctggagtgcagtggtgtgatctcggctcactgtaacctccgcctcctgggttcaagcgattcgcctgcctcagcctcccgagtagctgggattataggcgccaccaccacaactggctaatttttttgtatttttagtagagatagggtttcaccatgttggccaggctggtctcaaactcctgacctcaggtgatccactcacctcagcttcccaaagtgctgggattacaggcgtgagccactgcacccagcctaatttatttaaaataaaatatatattagtaattaaaccacacataatctcatttagtatatccttaggaattcccggctttagaacttttctgaaacaaaaagcttatttctcctattacaggaatctcaaaaaatattttaatggcataaaagataattcaaataaaaagctttattatacaaaaaatatgtctattttctgattaatatcagtctgtctagaataataacaattatcattattaagctatgtgaatatcagaattacttaagttattcaattatttaatatttttcctttctttctgaaggcaaaggtacttgatagtgaactgggagtggcaaggaatagatatttgttgcaacggaggacagtaataagaaggaatgaacataaattgatataataggagcatttagaatatgacttatattaactgctatgatacttgggccataagccagaggagatggtacagtcttctttttaaaattatatttaaaaaaatgtttggaactcagaccaatctatacatagagtgacaaagaatgaactctaatagttcttccttctctctagttatactgaattgatacatttttggaatctgtctagatttatgtaaatacagacttaagcctctactcaccgaactttcaactgtatcagaagcattatcttccacaaaatacattccacatttacctgcagaaagtaattggatataagggttttaaaatgtatgtgcacactaccattcatggtttaatgcatggtctctggagtcctttggtctgaatttgaatctcactacctcgacacagttcctggcactcaataaatatttttgaatagtatccatgaagtcttgggcaagttgctttacctctttgtgtcttaatttctttattaaaaaaaaaggttgcagggagctctatttcacagagctactatggaaattaaattagaatatatgcaaaatgcatatgtgctcagtgctaaataaatgttggctatttattattaccattattcttacattactagcatatagatttgctttattttgttccacactaattgaagtcaagtggtaaaccaaattatctagccaaagggaaatccttaattattttgcagactgagacactcaatagggtagagtaggccctaaacatagcctccaactttttcctgtttcataggctggctgttgctaacccatgtccctacatcgtgttttaaaatgttgggaacttctctgaggttccgccccctgcatgctcatcaccctcgagtagtgaagtagtgaagtagtgaagtagtggcatggctagctcagagaagggtactatctccatccttgtgacggtggggctcagtcccagcaggcttgaagctccatatcttggaccttggaggctatagcttacaacattcattctcgaatttgaaggtacatcaaatcactggagggctcatcagaacatagactgctgggccccaccctcagaatttcagattcatcaagtctggactgaggcgtgagaatgtgcaattctaagaagctcccatgagatgctgatgctactaattcagggttctcacacttggagaacctagcctacagcatacagattgattctttaagggaatagagatcaagtggtataattgttttccttcatattttgagaataaaattttcaaacaaatataactatataggtatctatggactaacaatcttgtcctttctctcagaagcacaatagagaatataaattatggacaatcttaaaatagacatatttcttatggacagttatatctgataaaatagtaggtaagatatcaacaatttttcactttaaaaaatctaaattggcatataataaaagaaatggttaaatataaatttgcatatcatgaagaaacaattttataaaaactaaaatgctattcatgtgcttttcagaacacaagatatcatttcttcacattcatgactcatatgcaattacatataatgttaaggcaaattagcctatatgatactacagaaagtttatccaatttaatggcatgctgtcaaaaaacactttaaataatctaagaatcaaataaggcagggtgaatatgtgcaaaattcttcaaaatttgacttacctagtaacaattcaccagctgtctctctagatggtgcaacactgatgcatcttcgattcactctgtcaaaacatatttaaaattactatgactaaatgttctgaccaatttcagagaggatatgctttattttacctagtaaaagatttctgcaaagcagactagatagagttccaatagcatgaggtatcttgtcgaaacccacatgaaaatattagctcctttttagcattctattagaagagaaatgactgaaacgcctagaaaaggctaataatccctataacctgtagacagaatatagaaattaagttatttaaaagagatatcaatattttatattttctaataaataagcaaacattgtttcatgcctctgatacttcagatacattttttgtgtgtgctctatttatttttgtattattattttgtattatttatttgttatatactattattgtattatttacattattatgaaggtaatttatcaaatacatttttaaaaaagcctagtattctaggaaaaacagaggatttggaatcagaaagttcctttgtgttcttagccaattatcttctttgtgtctcagtttttcatctatgaaatgggtataataacaaccacaataactgcaatgataatactatcaatagttaatatataataacatacttaatactcaacaacgctatgatacctattattatttcttcatttaatagatgaggtaactgagacagagaggttaggtaacttgcctaagattaaagagctagtaagagcaggaactggaatctaaacctttaatcactacgttatattgctgcttgatgataccaccagcagctctatctatattaatagatagagatgttaaacagtcaattacaaaatatgtgtgtgtatacatatatatgggtatatatatatgtacccatatatgtgtatatatatacatatttatatgtgtgtgtgtgtgtgtgtgtgtgtgtgtgtgtgtgtgtgtgtgtgtatatgtaaactaacaagggccagaacatgatgactgaaatcccatgaactcttgctgtcagaaatgtcatttccttttggattttggccatataaccttgtcctcccttgagcctttcctgtttaggatttttctgaaaatgatggcattatataaaataaatattacataaacactacaataagctgttgtatattcatgaaagagtgaaggtctattgattcaaagttaccttatagattcacttgcagctttgtctttgacagtagaagagaaagaagaatgagttttgtcttcaaacaggtaagagagtggtggtttgacaacatctgttgaggagaaaagtaaatattatctttatctaatgaccatagttctctgctatatttatatgttgagtcaagaagccactattaccttctgatttctgtctatccctaaggagatacttatttggaatagttaaataacatctctgtaaacgtctcctctctcgatttggcccttctgttggatccaactgccatgaggttggatagtagatggggtcataccatactgctctgcaagtaaaaagattaaagggtgttttaagtgaccatccaggacttgtagctataaaaaaaatcattatagagattgagtaagtaagtcacaactgatctgttaatttaaaaactccaaatgtttatatatttgatcagggaatgcatatacaagtagaagtaataaaatctaagtgtctttttgctcctgaatcccagtctcccagttcctcgcctgaaggcaagctctgcttccagtttctttcaactattaaattttttaaaagatatgtaatgactactatgaacactttagcaacataatacaacatgctggatttaatatggttaggtaaattttttttccaaattaattttttacatttcccattttgcattttttttttttttttttttgagacagagtctggctgtgtcgcccaggctggagtgcagtggcgtgatcttggctcactgtaatttctgcctcccgggctcaagcgattctcctgcctcagcctcccaagtagctgggattacaggctcccaccacacctggctaatttttgtatttttttagtagagatggggtttcatcatgtcggccaggcttgtctcaaactcctagcctcaagtgatccacccacctgggcctcccaaagtgttgggattacaggcgtgagcgccctcacctggcctcattttgcctactctctaatgaaacaaataaaatcaatttctttctgtggtatgaatcacatttttaaaaagattttaaaataaattttatcttagatgaaataagacaggaaaaacatattaagtacatttttagaaataaataagagaaaaaaatacccttattcataccctaaacataccaaaatactggtagcggttgttgtcttttttttttaaaacgtgcatctgtttttaatttgtagttatgatcattatgatcatttttctataacttgccttattttactgaaacagtattatctttatctcatcattttgaatggctgcccaataaagaggtagatgcattgtaatgtatttaaccatattacggtttataacttgtttctaattcattcactagcataaataatgcagagatgaaaacttttatgtttactttctttttctttttcttttttgacagggtctcattctgttgcccaggccagagtgcagtggcatgttcatagctcactgtagccttgaactcctgggctcaagtgatcctcccgcctcagcctcccaaagtactagactacaggtgtgagccactgtgcctggcctgccttccatatttcgaatattttccttaggatagaatcactaaaataggataactgaagctagaagtaaaatgtttttaggatgattaatacatattgtcaaaatgtacaatgccaccaaagttctgagtaaggacagctaatatcctgcggtgaatattagcagccaaaatttttgttaacataaaaagtaaaatgtggtatctagaggttctagaaaaccaaattagcctctagcaatattgaatattttcccgtgtgtttggtaattcatttgtcttatgtgaggaatgtgttcatgccttttgctcattcaaacttctgggatcataatattttactttagaatctgtgtaagtttttcaaacaataaaaataactttatttgctgaaaatatatttccaggcttttttgttcttgttatggttgttaaatacactggaaaaaattaaggttaaaatccattgatttatttgcagtttcttctattgcatttgagcttagaaagtcatctatccttcaaagagttgacaaatatcctattatcttctactttataaacttttcgagtaattcttttatccatatggaatttactttagtgtctaatgtttagtgtattttagtacaccaaagtcacatgaataagttatcttaactaaatttagagaataataccttgatttcccgctttttgttatttgtaatacatattttaaattagttagaaaaatatatttttctcaaccatcctgtttcagtgatttctctattcttttacagaccatattttaaaattaagctaattttactatctagatgagctactgcccccctcattacttttcttcctcaagaattaaaaaaaactcatatgattattctttaagatgaaaaaaacatcacaaatgattaaacaaaaaattgtttaatgaaatgattttatgagtctgaattccggaatacaaattccgtttaacatcaatatcttaaatcttcatggaagacaattttaactgacctcccgcagcttacctatcatgtgtcagctgctgaataagttcctgccaatgtctgctggcactcaaatctactttatacattcctctaatatgctggatcaccttttttctctcatttccttgggagagagacactgcctgggtgatatctgcagctattttagatatatcctttgattttgaatccagacgctgaaagagactaaacaaataataagattgtccatagttaagcatacatggaacgtatttatcagaacatgatactttaaaactaaaagtatatgtgaaatctaatggattcctaaaatacatgcctttggaacatataaaatcttacctttgttgattattgttaactgttttctgccaagcagctttattcactccttcttcagtttcatatttcttttgttcctagaagatttagataataatatactatataaaatttattatttctcacctaacattgtcacagagcccaacaaactaattttaaaacccagttaacaaaggaaaaacaattgtccctaggagaccagaatattaaaataaatgaaccatctaaacaatgttataatgttataattctgtgtctatataatttaggtcacataagttagagtagaatggttaaccagggttgctaaacctgatgagtttacatagttgcttgcctccttactctgctttttcattaaagaacctctaactcaaggtatgcttcagcttgcttgtcactttaaaaatctttccttcactgaaggctactgataatggatactgatgaccacagagaacaaaatgctccttaaaataagcctattttttctcacatagacaaaagcaatatagtatataggaaaaataaaataaaataatcatttcaagttcatcatcaatgatagcctgttcttaaaaaagtagtgtcaatcattctttatctatgatggaatctcctaagaaagtactatggtttcattgactcacctctttgatcattttaataaggtctgcttttgttgatgcactgggagggatgcacttgtgaccacataacttcaaagcattcataagcagttctgctgtgcctagctcttcttcagtcaattcaccttggtgattatgtatcaactctgacaaatacaaaactaacttggctccatgctttaaaaaaagtaataattttttagtcatttagaattttaattcttacatttaaattacttagtagtaattaaattatattgctagatttatttggttgcatctgatttaaataaagcacctacaaaagacattctgaggataagtacagaaatctgattatgcactgagtatttgatgacagaggattaatgctaattttgttagatgtaataatgttatgttacataggaaaacatttaaaaaaaagaatttagaggtaaaatatcataatttctatatatatgttaaaatagttcagaaaaagaagaaatgatgtcaatataataaaaatagtaacaactgttaaatctaggtgatggttccatggtatttattacgctattctttctagtctctgtatgtttgaaattttttcatataaaatatattttaaaaagcaagcaaactagccagctagcttttggggaaagaattttggaaaggacttgctaaaggaatacaggaaagaaactgggataaaggaagataatttttagtttttctcacagaaaaactgaactagaagggaaagcttcctttagaccttaaaacttactgactcttcttcctttggtgaaatttctggaactaaaacctatctttagtttgtaagcattcactactccctagaacaaaaggtgaaaaactcgcaaaccccacgcagacaattctatgtatgtatccatggcagagttgttttagccaatcttttattaacaggccctaaaaccaaaattcacagtgttacttaagataatgacaattggcctttgcagcacagacctaaaccaaacgttcattcacggttttttaagtggcccttacatgctgtagatattacacctgattctactgtgtacagtatgtattatttagacaataatgttgccaacaagttaaacatatatattttactttaaaaatcagcattgacacaaatatcactgtatttagttttatgacattttaaactgtgaatagtattaaatgtcagcaaatggatctggaaatgattacattttgggtgatatttaaattaacatgctgaatcacatcgtgtcatttcccaaaagcaaaagatgaacatatgcaatggtgaaaatagtacagctcattttaatgcaacattttaaattagtcagagacagctgctacctgaccaaaagagaaaaatgaacagaagctctgtgagtaaaaggcctaaagagttggcaaataaataaaaacggtacatgactaaaagactttcctaagtgtgtcttaaaggtaatgatcttgatataactttaaaaatatttcagtttggtattcaatgacattcaaaaattatcttgaaaaactatcagaaatgtttttattcattgtgaatatcaaaggaaacacatgattttcttaaacgcttaagttgtttctaatatctcattttaataccctctgatcacttactgatgatcatttcagggactataaaaggtgtcactgggaatagataacaaaaaactcttattttcagcccttaaaaaactgatttaaggaattgaatctgttaaacatgaatccttagaaaataataaagtgctaaaatatgtaaaatatttcttttcaaagaaggttctaagaaggaagagttctgagtagactacagaaagggagaaaggttttaaagaaggtatagagtgatctgggtcatggccaaatgaatggatagaatgaggatatagatagacaaaggagagagaggtgttctgtgctggtggacaatatgaataaaacagcatgactgtaaaaataaacaggatgtgaagaggttgcaagacacaaagatatgattatcttgaaaagaagagggtcagcaggctggagagttaatcagaatcaagttgtaatggcaaagaagtctggggcttaaaaaatccaggcacattccaaatgaaatacaaattaaatgtatgcagctgtgaaaaggcataaagaagatcactctgtactactatgtaataatgatctctaggatatactaagtgaagaaagtaaggtgcagaagagtgtgtatactttgctatctttctttgtgttatgaagtaggggacagaatatttacatgtgtaaatacatgtatacatagatttgcttgtatcttcaacagaaaaaaaaagtcagttacctacacagagagggaaaaaataagaggagcggaaagggataaaagctagaacctctctgaatgtgctgtttcacaacgttgcttttagaaccatgtagacatttcacatgattaaaaacaaaattaagcaaacaaacaaaaacccaaaggaatcccaaaaaactataaaacaaactggaaaaaaaagcctacctacctatctaattggttgaagttggcagcctgaccaaataaagaaaactattttaagtgcttttataatacagtattttcactgtataaccataatagtatgctaagaaaaaaagaaccacaaagacatcttcaactgcactcagcaggattgttattagtgatcatgttgatcatcttattttgaaaatgttatatatgtagaaagacaaggcaaataagtgattatgttaatgttaggaaccaagatatcaacattagtaagaaatacaaataaaagaatccaagaaaaagtgaaagtataaactcatgacttgtctttctaaaaaaatacttatttcctagctttgtccactaaaaaaggctgagaagaaatgacaacccaggagaaataaacatacctagtccttagatttgtagtctctaaatactatcatctccttaaaaggatataaggtcttcttgggagggaagttaggttctaggtttggggaaggaattgcataaggtgggcctgggacattcttctgtgccagaaaacaaggaagtttaatcatattaacttgttaaaatgaaaaaggccatgtcgacacaacaacttgaatctacagaggtgttaattttaatatcaaactgaataatgactgcaatagactaaaacacataacatttattttaaaatacctgagctcctaatgacactccaaaaataaaaacaaatacaagaattagaggctactaggggcatgaattcatcattccaaaaattaataaacagggaaggaaacagcatttatcctgcttttccttgactgactgtatttaaaggtagcgaaggtgctggagccgctgccgacgagtctggatctcactgccgcgtgccccaacacccgccggacgtgcattctcgattccttttgtttccaagtccaatatactctcaagtatacgctcaaggatcagcttattcacagtcttctaaaggaagaacagatcctccagaataagattacagttgttggggttggtgctcttggcatggcctgtgccatcggtatcttaatgaaggacttggcaggcgaacttgctcttgttgatgtcatggaagacaaattgaagggcgagatgatggatctccaccatggcagccttttccttagaacaccaaagattgtctctggcaaagactatactgtaactgtaaactccaagctggtcactatcacggctgaggcacatcgcaagagggagaaagccatcttaatttggtccagtgtaatgtgaacatctttaaattcatcattcctaatgttgtaaaatacagcccgaactgcaagttgcttattgtttcaaatccagtggatatctttgacctatagtggcttggaagataatggctttcccaaaaaccatgttattggaagtggttgcaatctggactcagcccaattccgttacccaatgggggaaaggctgggagttcacacattaagctgtcatgggtgagtccttggggaacatggagattctagtgtgcctgtatggagtaaagcaaatgttactggtgtctccctcaagactctgcacccagatttagggactgacatagataaggaacagtggaaagaggttcacaagcaggtggttgagagtgcttacgaggtgatcaaactcaaaggctacacatcctgggccattggactctctgtggcagatttggcagaaagtataatgaagaatcttaggcgggtgcacccaatttccaccatgattggtggaataaaggatgatgtcttccttagcattccttgcatcttgggagagaatggaatctcagaccgtgtgaaggtgactctgactcctgaggaaggggcccatttgaagaacagtgcagatccactttgggggatacaaaaagagctgcaattttaaagtcttctgatgtcatactatttcactgtctaggctacaataggattttagttggaggttgtgcatattgtcctttttatctgatctgtgattaaagcagtgatgttaagatggattgggaaaaacatcaattcctaaggttagaaataggaatggtttgtaaaatcctacagtatattctgtaggtactatatcctgtaggtagctataacttgtagtaccattctgtaggctggatggtactaatcttgtgtagtcctaaactggtttgtgtgaaatagttctgacacctctaaggcaccactgccaatgctgcacatgctgcagttggcccttgagccagatggatgtttaccgtgtgttatataaataacttcctggctccttcattgaacatgtctagtccaacattttttcccaatcagtcacatcctggatccagtatataaatccaatattgcatgtatggtgcataattgttccaaaggatcttattttgtgaactatatatatcagtagtgtacattaccatattatgtaaagagatctacatataaacaatgcaaccaactatccaagtgtcatactaactaaaacccacaataaaccttgaacagtgaaaaaaaaaaatagaaaaaaaaaaaaacgtagtcaaatagttgacaagggaaagttcttccctatagtaaagtcagagcttatagatgctgatggaatgagagacttagagaaatcactattttgtaactctttaatgaaaaagtggatcttggcaattatcatcagtggctgctaaaactattaggttaaagataatatcctcagtcttcgtgggtgaataaacaactggccttggtgacgaaatggattgagaaagagaagaaaaagtcaacgacaaccacagttaaaaatttcaagctgaaattcaataatgataccactgacagacacgaagtagtgggaaagggaagatggtatgagaaaaagtggactgttaacaccgcagttgaattttgatggatagcaactttgctgagtataaaggaaagaaaaaaacaccatttcaaattctccacagaaggaaaatacaggctaaatatgcttctgtcttgggaaaaggaagacagtgccctcagtgtacttgaaagtgtcttaatactggaaaaagcacctaaaagtattccttccagatagttttgactcctaatatgatatgtgttttccatgtattaaaggggatacctatcctttttaatatatcctctctcatctctattgaggtataacttacatataataaagcatagatatattaagtgtttctatgagttttgacaattgcatacatccatttaaccactactcaaaataagaccttatttttatcaccccagaaagttcccttaaacctctttccagtcaattccctttctcaccgtcccccttccacagagacaactactgtcctgaattctatcgtcatatcttggttttgcttgttccttcagatgaatagaatcacagattgtactcctttgtgtttggctgtccctttccccactcaatgtttctgagattcatccataatggtagatgtaccagtagtctgttcctttttagagctgtataatagtctatatggtgctgtagaatagtctatacagatttctctctacaggtataaagaaatcacaatgtgtttgtacattcttctgttgataagcatttgaatatttgtagtttttggccattatgaaaaaggctgacatagatattcttaaacaagcttttttatgaacatatgttttaatttctttttcaggtaaatatctaaaaatggagtaacatggtgacaagttaaatatatgtttaattttttaagaaactgttaaacagccctccaatatggtttaatgtaccttttaaactttccaactaccactcttgaagtgataaactttatacactctgaaattcttttaggtattttgggtttgattattccaaatgattaataatttttatctattttaactgaccacatatatttttgagatatgttatatatactgttgtttgagctattcaatatagatgtttcacaggtaatataatgcttttttaaaaagcctccaaacaatccttaaataaaacacttcaagatgtgttaacacattacaaagtttctgacagaaactctgaaacagaacttcttaatttaggcactagaaaaaagattgggaaataaacacagaggttaaattgagcctgtgtgaaagcacctgagaaagaccttaggttaaatttgcttggtaagaaaattatatttataaattaggcatgaacattcagtttaatttcagttcttgttttattcagactttgtatttcaccaaacgttttacttctcttatcaaagctgagatacttacttgtagggatgggctgagacagtctcgtagtatttcctgatgatttggttcatgaactatttcaaaaatttgctttctctcttgtgcagcgtgggctggcgacaaaatatgcactagtagtctcccaagctgcattcggaaggtctccttacaagaccacagaattttagtccattgctgcttggaaccactggctttacttgaaccctaaaatcaatcaagataggaatgaattaggatcagactgcttaagcaataccatgctagcctcaacacagccctaaagaagattatggaacacgttttattccagattggttttaatagtcaaaattagaaagagatatacatatccatacacataggagtttaaaagagatgggcatacaacattcatagcagcatcactcaaaatagccaaaaggtggaaacagtctgaacgtccatcagtggatgaacagataaacaaaatgtggtatatacatacaatggaatattattcatccttaaagaggaaggaaattctgacacatgctacaacatggatgacccttgaggacattatgctaaataaaataagccatatataaaaggacaaatattgtatgcttctatttgtatgagatatctagaacagtcaaactcacagagacagaaagtagaatagtgattactgggtaatgggggaaggggtggtaaaagttattatttattgggcacggagtttcatttgggataattaaaaagttccggccgggtgtggtggctcacacgtgtaattccagcactttgggaggccgaggcaggtggatcacctgaggtcaggagttcaagaccaacctggacaacatggtgaaacgctgtctctactaaaaatacgaaaattggctgggtgtggtggtgggtgcctgtaatcccagctacttgggaaggtgaggtaggagaatcgcttgaacctgggaggtggaggctgcagtgagttgagactgggccactgcactccagctggggagacagactgagactccatctcagaaaaaaaaaaaaagttcctagagatggatggtggcaatggttgcacaacaatgtgaatatacttagtgccactgaatgtatccttaaaaatggttaaaatggtaaattttatgttatatatatatatatatatcttaccacagtttaaaagaagacatggacaacgaagctaaagtcctaagccatgaaaaaattaccaaaggctcaaaaattataaattaaaaaaaagcatcaaagaacaatgataaataagcctacactgattttgcaataaaaaagagaaaggattcataataaagacttgaattgtgctacattattgagtataatagtcacaaattaagcactgcatatagcagtacccccttacctgtggttttgctttccacagtcaaccatggtctgaaaatagttaagtaccgtataataaggtatttactcattgtaaaaagggagagactacatttacgtaacttttattaaagtatattgttataactcttgttttactattattgttaatctcttactatgcttaattcataaattagactttatcataggtatgtatgtatgtgaaaaaaaatagtatatacaggtttcagtaccatctgtggtttcaggcattcaccaggggtcctggaatgtatcctctgaagataaggggaaactactctatgggtttaccatagagtattccctaacaattaaccaattgttttaactatggtcccactaagcctagccaaatgctgatcaaatcacctgtatctggttcaaaactggaagcagtacattcagaattcattctgagttttaaaaacagctcctctctaattacatctagtcctaagggccctgtttgagtgactgagttctaagtgaatctgtacttggttttgctgttcagagctaaaacaccaaaatctagtttagatttagagattgacatgtcatgatttacgagttctgctagaattagattggcttttgctatctatagagtaaactgaccgatttgttccgttgtgtcaactgtaagtgacccgcagaaacccaagtgagatgatgataaatgaaccctgacacttatcagtattctctacataattttaaaggtgttaaacttaggccaagatctaaaattcataataattagaaaaatgagagtaagtagccataaatacagtcctttaaaaagaaatagttcatgtaaactcccatagtagtcatcaatgatgatgatctactcttttctgatgctgatcttactaaacaacactagaaaatgtcttctagggttacaggcttaaaaagcaatgcttcatgagttgagtcattttggaaaggtgaattagcaatatatattattctataattaaaaattcaagttgtccgagttttaaaaagctctctgaaagagcacaaagaaatatgattttgaaaacgtataatacagtcaacataaaacctctatttcctttgtgtgaatgaacatttcccatgtaattaatttacttacaatagatactttgaatccttctaccagatatgtaaaaatttctttctgaaatggattgaaaacagaagactgttcatgatgaatattttcctcagaaatttcggtctggaaaactgaggtcttgctttgagttacattttctggagttctcaaaatgtcaataatgtctgaattaaattctttgaattgaaaaaaagaatacaaaattagtcatatcactgctatcttgccattataaatagtaataatactggtaaaaaatattgtatttaattactaattcagttatcacaatttaaatgtgtatcaggtgtattagatgtaatagatacaatgtagtagaaagtgaatttacgtaaaataacagaaatttgaaaatgcatgtcatacaattccaaattaaatatttaatggactaatgaaggtaagttaaactgcaaaatgactaaaaccataagattattatacaaatcaaacataaagatcatgtcatatttacatgagtggatctacagagctgtttctctgcatgtgctatacatttacgtgctgtatatgtgataatcatggttcaatttcagagtttagtctgggagtctgttgcacagaatgtatattagaaaagtggaaaaaaaaaaatgctggggacgatggctcatgcctgtaatcccagcactgtgggaggtgaaagcacacagatcacctgagtcaaggagtttgagatcagcctgggcaacatggtggaaccccatctctacaaaaaaatacaaaaattagccgggcatggggtgcacacctgtagtcacagctactcaggaggctgagatgggaggattgcttgagcccaggaggtaaaggttgcagtgagctgagatcataccactagccttggtgacagagtgagaacccatctcaaaaaaaaaaagaaaaaaaaaaagagagaaagaaaagtaaaaaaagctaaaaaaataataataacttgagtttatcatgtttttctagtcattaacaattactgttttctttttcctgtcttcctcgggttacctgaacatttttttagaattccattttgacttatctatagtgttttttaaaaaacaatcttcagctttattggaatataattgacaaatagaaattgtatataattaaggtgttttgatatatgaatacattgtcaaataatcaccataatcaagctagttaacatatctatcacctcacatagttaccacttttttttatgtgtgatgagaacatgatttatagtgctttggagtgtatttctttgaatagctttttttagtgggtgctctaagtattacattttaagtttgtacatatatattcattagccaatatggaaatgcaaattaaaaccacaatgagatatcactacacatctgtcagaatggctaaaataaaaaatagtgacaacaacaaacactaggtaaggatgtaaaaaaacttggaccactcatacactgttgatggaaatgtaaaactacagccactctggaaaagtttggcagtttcttaaaaaactacacatgtaattaccgtatgacccagtaactgcactcctgggcacttaccccagaaaaataaagacttatattcttacaaaacctgcacataaatgcttacagaagctttatttgtaatagccaaaaactggaaacaacccagattcatacatccataccacaaatatcactcagcaagaaaaaaaggaactattgatatatgcaacaaccagaatgactctccagagtattacactgagtgaaaaaactaattccaaaaggctacatactgtacgcttccatttatataacattcttgatgaaacaaaaatatacaaatggaggacagattagcagttacagggctgagtggctgggggtgagaggaaagtgggtgtggctaagagaagggcaatatgagagatccttgtggtgctggaaatgctgctgactgtatcgatgttactcacctggtgatgatattatactacagttctgcaagattcatgggggaaactgggtaaagggtacacagggtctctctctgtattattccttaactgcatgtgaatctacaacgatctcaaaagatcatactggaagtgccatatggttttaaactggtcagtctgggctagcatcgaacacattcaaagtggacttttattcaagacttatcagttccaaataagaaactcttaatactatggatgttaagaactgaaaaataatgctgcttaaacatctgaaaaccaaccagtttcctcttagattacttctctttcattttaaaatctgaggaaaaacaaactaatcctatagtcttaccttgataaataatcctgttgactgctaaaacagtgagcctctgtagtctctgcgcaagttccgtttcagttgcttggctagggttctcttggctcattctccgttgcatcatcacatgaagctcatcatttgccactgaacgcattttcatcagaagcgattcagtttgagcaaggggaaattttcgaggacctttaaaagtatataaattaaaacatcaaatcccagtgttaataaggatcaaggaaactatttttgctgaaattttttgattaccagaccatgaaaacaaccttatttactacaaagtcaatttatagaaaggaaagagtgattaagagaaaatgatgcttctccctctttgaagaagtgcaacagtacttttggtttcaaagtcctaaataacaatgttgaagctagtgacacagcttagtaaaacagatgtcatttggcaaagttcgagttaaaaagtattaaatgggctcaaatagttcagaacattttgataaaatagtttcaaatactgtttcacttctttgtattccaaaatcaagttttaatgcacataattttttagtaagaatactactatttctgggtaattactgttgttgaatttcataaagtagttttaaaaactgtgtatagtgacaaagtagaaatcagtcaatgaaagtgaagagatcaggaaggtgaatataattccagtgatttgttattaaaatgatttaaaacatatgcatcatttggaattcaatgctacaaaagcatttcctgagaaaggtttcctcagactgaacagagaggagtggcattcctgcaccattactgcacctgctccaggaggtacaacacaggtagtgcatccaggagaaaactggggggatgagtcttgatttaatggaccgaaggagaagggcatcggaagttgaccataggaaccaaaatgatgtcttggtagatgaggaataatggaacccttcattggaattgaacctttgttttaaattatgaaaacatatatcaatttctataaataacctctacaaaaattacttacatatgactaaattataacaggttttaaagacttatcctgtaagatatttaaatattttaatgctattttagattgctcagtattttgggtaattagtattcttaatcagttaatgtattttgatagtcacttttgaggcaaaaaaaaaagaaaatacaaaaattcatatcctgtatatattcaagagttttactgtcaaacaatatacttagtttaagcagattcttcctaatgtctacatctgacagctttcatgctgtacgtgcagctgatgattgtaattcagcggtatgataatacactgaataaggaaatgttaagtaagtcttctttagtactaggtattaatactagaaaacgtgggagggtatttcagcactcctgctatgaagccacacagagctagtgtggccttaagcacatttctttctaaacctcagttttctcatgcataagatgtggattagaaagaaaacagagcttacttcaccggtagatatttatcactatctaacattatattaaatatatttgtttatatgcttattgatcattttccccagtacaagttccatgaagactgataaaatagcaactggtacatggttggtactcaagaaatatttgatgtttgagggctgaataaacggataaagaaagagttgttttgttgataaaataaaataatgaatataaaacataatgcctgtctcattctcacaaataataaaatacttttaatggttagtattattattggctgaaatataaagttcatttgtatgtgaattactaatttaactgtgtgtatgtgcgagtgcatggcaatttaaatatatgtctagcattctaaataatatcctaatgctgactacttctaccttcatgcattaagggtgatgtgtaaagtttttcatactaataagcagacaagtaaaaaaatacatttaaaagtatatattgctaccttatttataatagcaaaaaccaagcaaaaaaacctttgtttatctataaaagttacagaagattatccacatcaaaataatagattattttgtaatcattaaaaataaaagaatatttatgtttcttaatatggaaaaatatctataatgaccagaaatagaaatcaatttataaacagtaggtagagcatgataccatttaggtaaaattacatataaagatatgtatagatatagatatccagaccaaaaacagatatagaggttaaggagtcagagctttgttcactgggcagcaggcaacttggaactgctgagcagaagaatggtaaacctgaatgaggttgtaagattaatctgacaataaaatggtatctaactcctctagcaatgcaagaacttaaggtctagatgtaatgacggtactgctgaagaaactttggttccaagtcatggatatcctggggttcagggcttgagtaaatttgtctattatcagagtctggtgtgtggccataatgcaagctgcagctgctggcagtccccacaactcctgctgaaggtgaagggtagtggcagtggggctggaggtgtcactcatctcagtagttttcaacaaatgctaaatgaatctatttaggaatcccccctaccacacctaaacatttatcagtaaagagaacggcttgagtctttgaaggaacaattcattacctaattgatagacatgacagaaatagaaatccctctatgtccctttagtatcatggacaaatggacttgaattagtttttgtaaccacactgctcagaaacagaagagcttcagtattctgcagtttttgtacctgtagcatacaaagccaatatacttttgaagatacttttaagtaatagtggagaaataaaaagcacaatcttctccaagtatatgtgtaaaaaaacaacttagaaacaattagaaagcaacaaccgaacacatataaagtggtattttgcaaactagattcacaaagacagaatttcaataagggtagtacttaaaacaggaaggattcttgagagagacttcagagagagagagagatgggtcctaagagataccatagacctgggatgagtagatgtggtgcaggacacaaaggggtgagtataggggtgcatgtgccagcagtccccagttctaggatgcagtgggtcttaagatgaggaagctggactggatgacttttaaggtcttttattaagctaaaaacttgtaggattctgtaagtctcctatagcttgcagcaatcacatttacttagagtgaaaaagacaagtccaagtataataagcagctacagaagtcagaaaaaaggacagccatctagtgaaaagactaaaagttcattatctgttttaaaatgactcaaactaaaaaaaaataataaacttgaagttacgtagggctctaaggctcaaggtgacaaaatgctagtatctaaagagagagactaaagactgctagagaaatcattgaccaaatgggaaatagcaagaggactattgtgttagcccaggcacaaggtgataattaactaaaaccagagatctagagatggaagcagaggaggaacagatgtgagaatgagaagtatcaatacaaaagaaacagcaggggtagtaaaggtatactttctgatatcaagagagggcaaattccatctaagcagtcactgactacataaggagtcctgcaaaggaaaggtgtccagcaatcatgttttggcatgcaggaagctgagcactaatgctagaactgataaagaatctgtttctactcaggacaaaagagatgtacaactgggagggcagctcaagaagagacagtgcattcagatattaaataaggaagaatgtagagggcagtaagtttagttacatagatgttttagaagttttatttatataagtttgatttagcataatttaaacatactactgcaaaacaatgggtacttggtagcttttctttacaagtgagtttttcacatggtttaaaatttttgcatagcattgaacacagaagtagcttaacacgggtgaaagaaagatttgaacttaagtgaatttaagacagtaagagtgattaaatttcaaacaatttaccaaatactctggagatggtgtgtgtgtgtgcatgtgtacatgcatatttatccactatgtatatatatgtatgtgtgtatatcctgtgtatgtggtgttcatgttatctttctgggtaaagatgatagcagattttgtagaaaaaataaggaagactaacaatattaatgtttattatttgatgacattcttccttatttaatatctgaatgcactgtttcttctttagctgccctcccagttgtacatctcttttgtcctgagtagaaacagattctttatcagttctagcattaatgctcagcttcctgcatgccacaacatgattgctggacacctttctcagagacttccctaactcctgatgtagattgccctgttataatctctattcctaccctctacatttccctactattttacaatctctgcaggggcagaatctgtgtctgtttttttcatcattgtatctccaatatttagcacaatgctcagcacatggtaggcaggtgctcaagaaataactgaatgagaaaagcactaaaagtaaggagcagaatagtttccttcaggaaaaaatctttcttaaattttatgtaaaacaagaaatattttaaaagtgtgaatggcataagaacataggaaagtcaagctagcctcaatttatggttattaaaatatgatttcaatactcgccagcaatgcttttccgcttttgaactactgcatgatggggagcagaaggtgactggagtgaatctgtgaggttttcagagtcatgatttgcggtggtccttataaattccatagcagcctggagaactctaagctgtagtgcaacagccatatctaaaaacagaagatactagaatgttttcaagctatgtggttactaattttttaattgaactgattttatgtatcatgacaataatgttttgatataaatttttaaattttgatcagcatggggatgatggtagtagacatttttaaattcttgttaaaagcaattttaaagcaaatttacaaatggtcactaaaaaaccttcaatggaaaaatattagctcataaatttatttcattttaaaaattgtttcaaagaacaggctttttttctatataaggcaaaagtttaaccggcaattatcatattttttgtttcatattcactttaataattaccattaaagaaaactaaagggtattactatgcaacatacacttttaaattctacttggtaagaaaaatcagtgacatctttcacttatgtattgccaactactaactacatgggggaatcactttttctatttttgccactttttcaagcctttttaggcttctttttaaaaactgatagatactattacaaaattaatgttaaacttttagtaaaagagtttctaagaagaaagagattgtgctcaaataacaggtttgtctgttatacaactccctccccaaattcataaaaattaaatcttactttgtgtcctcttgtttttgctattttgaagatatccaagcattacaataaggtcttcaataaccctaaaatattgtgagcctgaggaactgcaagcatgaattgtaactgctatgaaaagttgctgtatatcacaagcaagcaatttatattcactcatgggaatgctaaagataacaacaaaagaagaaaacagaacatttataagaaaaagaacaaataatttaagacacagctaactgatttaaatggtttaaattcctgttcgaccagcttgcactcattcatgcagtcattcagtatttattcatgcttattctatggcaagtaatatgtagtatgtatgctagaaatagaaataagatacactttgacacctgtcagaaatacatagttttacagagaactggacaagtaaacagattactataaatagtaaatggttgtaagtgtaacactagagattaatacacgatactataagaacacataggcagtttctagtccacactaaggatgaagattgtgtgggtatgaacaggaacattctgcgaagacttttcagagaaggtgaatttgactaaattaattaacctctctgaatctcacttgtataaattagggttatttttaggactaaaagaggtaatagatttgcatttatattatttataaatatccaataaatatgaattagttacttctggtcttcaatcttaatcttgataatctacctcaatgtacgatattaggcctacaatgcttctctccatctgggttttccaaatcaagaaagggttagaaactaacttgggccagttaataaagtagcatacagggacattcagtaaatacaatttcttgctttttttttctttctttctgttattattatttttttacttttattttaggttcagaggtacacagaaaggcttcttacataggtaaactcatgtagtaaagtaaactaatactaaagttttcctgttctaaagtatttatcagatgtaattttaaataataattttaaacttacttcttttctaatccattcagggctgctactgtattacataacacatagagtagaccattatccagcaacatatctgctaccttagaacaagaatttaaaatttggagaagaagtaaaagagcattatgcaagagtatgttgtcatatagagaggtctctattagtcccagaataggaatgacagaccacttctgaaacaatcccatgtttctcacatcttccagatcaaatctataataaataatacagttaagagcacattagaaacaatcacaaaataagaaaatatgatagcaactatgggtcatcttgctaacttgattttgaagtcataaaaacaagttgggggagtaaggattcttaacctgtttttaaaatgacagagtccctccaataatagggtaaaagctgttgctagaagtccatcccaagataaatacacaaacattcaagtgaaatatgcatacaatttcttggttttaactgatttattttaattcatccatgagccctttatgtccaaagaaactatgtttgggggcttcaagtgcacaggaaaattattattattattttacatagtatttgagagacagtgagctagtaaaaagaggtctagcaaaagggaatgattctcgagttcttatcccaatacaacttgcctctgggatggaatgaaattagctaagtattttgtgcctcattttccttatctgtcaaaaatatgtggtgatatatgtcctcttttcttctcaaggctattgtgagaatcaaataaagtaatgcacaattgtttcgtgaaagccaaaagttgtatgtaaatgaaaagtagcattgaaactaccataacaatttagtaaattctttaaggtctgaatttgtctatcacaataaggagacacacgtttctctctattctatcataaacagaaattacagcttaatttctgccaaacttttggtttgggagaaaaatattcttttatttttacacttatttgctaatccatcagcattctaccagggtcaaaactcagcaatcagtgtatccaggaattctaggtgagggatttactcctctcccagatgacctgaaggctctgaggagagtaaggcgttcctatatggatcctttatgtaatctgtcactgagaatacatgagctatctttttttcttttcttttcttttttttttttttttttttgagatggagtttcactcttgttgcccaggctgaagtgcaattgtgcaatcctggctcactgtaacctctgccttctgggttcaagcggttctcctgcctcagcctctcaagcagatgggattacatgaatgtgccaccacgcccagcaaattttgtatttttagtacagacagtttcatcatgttggtcaggcttgaactcctgacctcaggtgatccacctgcctctgcctcccaaagtgttgggagtacaggcttgagccaccacgcccagcctcacctgtcttttcagttaatcttctcatgttaatactatctgccaaatcttagctatcactttcatctgatgcagcttttatttgtttctagtttctaactagtgaatgaactataaaggatgaagttatattagaaagaacatcatatggcaaataatacattgatttacctggaaaattacttttagcagattttttctaaaggtgaccaaaagatttcgttaagagtgagttcactaaattttacatttaagacaaaagaccttgccgggtgtggtggcccacacctataatcccaacactttgggaggccaaggcaggaggatggcttgaggtcaggagtttgagaccagcctgggaaacactgcaagacccatctccactaaaagtaaaaaaaattagccaagtgtggtggtgcgtgcctgtaatcttagctactcaagaggctgaggcaggaggatcccttgaatctaggagttcaaggctgcaatgagctgaggcatgactgtgtctctctgcactccagcctgggtgacagagtgagacattgtctcaaaaaaaaaaaaaaaaaaaaaaaaaaaagccaggcatagtggctcacacctgtaatccctgcactttgggaggccaaggcaggcagatcacgaggtcaggagtttgagaccagcctggccaacatggtgaaaccccatctctactaaagatacaaaaaactagccgggcatggtggtacgtgcctgtaatcccagctactcaggaggttgaggcaggagaatcgcttgaacctgggaggcggaagttgcagtgagccgagattgcaccattgcactccagcctgggcaacagggcgagactccgtctcaaaagaaaagaaaagaaaagaaaagaaaagaaaagaaaagaaaaaagacaaaagattcccaattatagtggagggaagaacacacttactcttcatcaaggccaatatgtcgaccaaagaacatttcgatgaagcattctaacaattcttgagttcctcgatgaagatacaactggttggctagcaaggaaaatccacgattcttcagaaatttatctttttgttccttagatgctctagcaaaatatgcatctaatagctaaacaaaaaatttaagtcaatttagataatgcattaaaattaaatataatatatacaaatcagtgtaacacaactgtatttgtaaattaagttcatatgtacagaagaacacagaaagcttaaaaaaatgccaccaccacagcaaagcagaaatgaatttgtctttggctactgtggaatgctaatgatgactccatcttggagatcttaatgtttctctcatggggaaactggcatttttagctgagcatggacacctggtagactggcagccttagttgagtataaatagaatatttgtacctaatgctgagagggaaaaaatccgtaaactatgctctctctgcaaatctatatctatatctatatctatatctatatctatatctatatctatatctatatctatatctgtatctatatctatcctagacctctacttctaggcttcttgacagattatttatcctgagcacaggcctgaatttccacccttctctagcatcttaaatgcaacacgtgtaataccaaattaatccttccacctctttctccccttcaatgactctcacagtagtgatagactcctttcccccagacacacatctatttattcccctactaaaaaagctttctaagtttacagcataacacaaaatatactttttccatgaatccttccgtttcccctatgctcaattctctattaatactgccactgcagtactcatcacagaatttcttacgttttacttagttaagtatgagactctcccttctagactgtgaaattcttgaatgtaggggcttatattatttccctttatatactatattgcaactagctcagggacttacacatgaaatgcgagctcaatactaggttgtattgcaagtgattaaacaatacctacatccaagcaaactaaagaaaaatgagaatctttacaagattattttaatattgggttgttttctaatggaaactattcatatcaagcatttactcattcaataatatacttagtacctattacacaagatgcccaccctcatggagcttatatttgtgagaaatttaaaaaacaagtacacagattaataagataattacaagacataaataggatgctatgatagaataaataataagtaagattagagggaagttattttgataagatcatcagggaaggtctttttgaaaaggtgtcatctaagctgagagctgaagtaaatgtctaaaatttgatagtacactgaagaagagatttccaatgaaccacgtattccttgtaatttttacaaaagagatttactaagtgttcagatatggggatttattggtagatttaaaagacatattgatatgaaccaacatatggagggggacttaaagctggatgatgcaaaaatatgaccatgtaaccaaaaacccctgtatccctaaagctatcaaaataaaaaaagtttaaaaatatatgagtattaagtaacaaactatattagttcattattctaaaatataaaagagagatttaggtctactttaatgtatatactcaaaattttaaattacatatatatttatttttctgaattaaaataacatatctagtatttgcccttactttaataacaccttgttgtatagctggtgatgggtggttaacgaggaccaaaagtgtatctgcttgaataagcttgtccatcacatcttcaagcaaaacatcaggcaggataagaagaaccccacttaggagttcatataatccacagcatataggtaccaaacagtcttcagttacactaaaacagagaccaaaaaagtcttactaacatgacaagaaaagtacttgatgattaccttaggaactgtgacaagtagtagcattttttaacaggtgaaacaaatgttcataatgcttaagaaatgtttcctaatttaactgtgattaacaaatttaccatcactttttatcattgatttttttgggcatatagtctactaacactattcaattgtacatctctgatgtctaatacagtagtcactgtcacttatgctatttatttaaactaaaaattcagttcctcagttgcatcagccacatttcaagtgctcagtaggcatatgtggctagtgctgactgtattagacagcatgaataaaacatgtccatcattgcagaaagtttcactggacattgctacttgagatgctattggaaatgttttttttttttttttcaccaaggaagaaacagctttattaggagtctaggcatgtcagaaaaacccagttcactcacagagaagagaggcaaatattggtacaggggaagaatctagcattacagaatatcctctcaagaaccaagtgtgaaaataaaacctccatctaaatatcctaacaaatgctgctgggtttagcccaggtgaaacttctggaagctcctggtgaaaggagatttttttcataaaaggaatgctctctagcactgctgcatttcagctccatataaagttatgggtctgcgatagcagaagtagaggaaaatataagggggatatctcatcaccaaagcaaggtcatctgtgtccaggtgacagaggaaccttaagtttctggagagagaacaaactggggtagcagaaggaaaatggctgaagaaatacaacgcctaggcaatgtctgtcataacatggaggactctgtgcagtctggtgacagcctgtcctgggaaacactggtattgctttctgaggccattttagctttcttctgacttcatccagagaagaactgccaatgttcagcactaagacctgcattataattacctgagtggaatggagcagccaccctatgacacctgttcctcttcccttctggagccgtcacttgtctctgatcaagtaagatgttactcaggacaggcccagtctagaaatcactcccaccttcacatgagcaccaagtggacagaatcattctcatgagtcaaagctctagataaatcctatcgtttctctgtcctgaagaattttccttaataactataaggaattaaaccacaatatatattttttaagtgctacttatggtttagattttggttaaatatggaattcaatattatctagtcttaaaataaggaaaaatatatctttctgtttgttattattatgtatataaagaaataaacttttctgtttgttgtattataagtggcataatgaagacgtttccagaggggtagagagtctttaaagaatagtaaaataaaggtgggaggagtgtacaaaaacacataagtacctgtgagcacttgcagttcggttgtaatttggctcataaccaagagaataggcaaagttttcccaatcatcagtgtttctatcaacaagacttggccaacggccaacagctgcagatccgttctgtgaaggaaaagctagcccaaggcttgcaatagtgctgtggcttcgctggaaggaggccaatccctttaggtaatcaggtcggcgtgggcaggactcatccccaggactgtcatcttctgacctgggttctgctcccaactgtttatgatctgctttgaccactggaaatcccagcactccctttgggacatcactgacagagacctgggctgagaggacagcttccatttcacaaacagtttttgcagactcacagctactgatgaatgcgtcctctttgccttttttcagtgtgtcggaactccccaaagaattttgtttctttgattgggtggcaacataagtatctgcaatattttgtaacctgtcgatactacaacccaaacttccagtcagtttttgtgattgcgttagtagtgaagaagtagggaatgctggtaggcttctagaacgcagcatatgggcggccatctgttgtggaataatattagaggaattctctcctggtaagagtagatacaaaaatactacttaaaaatctattaagtggaaccacctctcttttgcattataaatcacaaccacagcaaaagcccatttatctagcactgttaaaatccatataggttaattttacaagtaactaatgcttaaaattcctttactttttcttaagagacagggtcttgctctcttacctactgaagtgcagtgacacaatcacagcttactgcagcctctaactcctggactcaagacagcctcccacctcagactccaagcagctgggactataggcatgcaccccacacctggcttaatgcttaaaattcttaaatgccaaaactatttttattttaaccactttttattaatatcttcccaaaacatatgttttttcctgtcttcttaacaaaatacagtattgactgaatgattcaaagtcattaggattaatggttctactgtgctgaatttaagtgaattaagtgaaactcaatttacctcaggctagcagttaccaggatgtagtggaaagagtgtgggctttgcaactagatataattggattcaaatgatagtgaagtggtccaaggtaaatcacttaattgtactacagtttctacaaatgtaaaatgagggttcagaatatctactttgcagggtggctttaaagattgagattatatttgtgatgcacctagcatagagctcaacatataacaggtgctcaaaaaatggtagtacttgttgttactagcctaaacagccctagacagttctctctctcctccatttttgcagtcacttcttgctgttattagtgagaatagtttcttttcttgtcacagctctctaatttactgcttctaatattctatgcaggaagacaccagaaaaattattttcattgtagtgcatgggatacaagtgcatgccattcaaggtgtggtctgtggactggtagcatgggcatcaataccacctgtgggattgttgggacttcacattctcaggctccaccctagatctactgatacagaatgtatgagagaggggcccaggaatcagtgtcaacagctctccaggtgattcttttgcaggttaaaatttgagaccatgaacacagagtaaacaggcattaaatgaactgctttagagcatagactctgtggcaataaaatagctccatagctcagaatctttttctagttatttctggatttgggctagagggctaaagttgccaaaagattctcttcaaaagatctggaaaaaatgggggtatgattgtatttgaaaatgtttcaacatgacagatgatttaaaaaacaaatatgtcctgtaaaattccaaataaaactaattcaaaaaggccaggtgcagtggcttgagcctgtaatctcagcactttgggaggcagaggtgggtggctcacttgagcccaagagttcaagaccagcctgggcaaaaaggcaaaaccctatctcatttatttaaaaaaaattttttttaaaaagaaaaggaaaactaataaaaacatagccttaaaatattattataaaagagcataaaaagtgctagagaataactgaaacactttggcaggaaaacaaaactagagactaatacctatatatctagttctatctatctctattaccatctcacctgcagtatttaataattaggattgaagctaaagacaagactaggttggactgacaataagagcaatgtcccagtatggaaaaggacagtagtcaggaaaggaaaagatgtatggtcagtttgcaactagaaaacctgcacctattcttttcttctataaagtagcgatgagactctgttaagagtcaattaggaagatagaaaagtactgtaggcttaaagacttgaatacacttactatggaaatagaagagggtattgattctgaacatacctaaaaattacagggcagcctttaaagctctgctacaactttcagcagtatgacaatggttagactgaggcgaggttagcatttttcagttcaagaataccaataggctaaggggacaaggaaactgagatactttccaactgagtaactgctgaagttattggctaatgtgacctaggctggatagggaaagcgagacaaggggaactttggagtgtgattaaaaaaaaaacaaaaaaaaaccagaaagatgggaggctgtcaattagagaggatgaatgcatcccctttgccttttttcagcatgtcagaactcccccaaaggattctgtttctctggttggctggagggctaatgatacagaaagattctgttcaaatgagaacacgtggacacaggaaggggaacatcacacaccagggcctgttgtcgggtggggggaggggggagggatagcattaggagatatgcctaatgctaaatgacgagttaatgggtgcagcacaccaacatggcatatgtatacatatgtaacaaaccggcacattgtgcacatgtatcctaaaacttaaagtgtaattataaaaaaaaaagattctgttcaaaagacttggaaaagaaatggagccatgattgtacagtatttgaaaatgtttcagagtgatgcatgtgattgaaaaacagatcatatggatagaacaaagcgggatattgtagtttcacaggtgcttgaaagcattcttgatgatgataaagtccaagacagatgcatgcagagcggtaagacaaagtagagaaaaggtaccctgagtcaaaaaatgtgaagctggagtattgggtggccatttatctggcaagtgaagttgtccagaatgatggttttaggtagacagaagagaataaaagtttttaaaaagcttctgaagaaaatggtaaaataaatcagaagcttgatgaaagacaaatgactatgataagagaagtcagagaatgccagaacaagatagcatgagcctcatccattttctcaatgctcttgaggacctgtgctgggtgtctcttgttagattgaatgaggttgtactacatatacttctaaaatatgtacaatttaattatctaagaatattcagaactaaaatgagaaggtcatacttccattattgctatttttaccttcatatggtgaagcagtaaaaccagatgggcttattaccataaatccagggctcataagggaccttcctccactgctggaatgcctcaggtacatgattgaccgcactttctcctgaaagatcttgccatctagaatccaaattttttttgaaacagcaaaatttttaaaaaggataaaacgaaaatataactttaaaagcagatcattaaattcaaattttgacaaaaagatgtttaaagagaaaaatatatagcatactttatattaaggcacacgatatgtgaatacttactcttcacaattttttagtacagattttgctgttgtttattatttctggccacattaacttctattttcttaattccaactgtacttatagttatttctatggtttaacatttaactattcacttttatatgttattatcatctctcaagggagattgttcatccttgaggaaaggactgtgtcttttatttttatatatccccttcagtgtctaatatttgtaaaaactaatcatttctgagcttcatacttataaattcaactgcttggtttcttaaacaaatcacaaatgcaacaaatctaaatccgaatcatctttttgccctaaatttactccttctgttttgttctttgggaagttcccatgtggtaacctggagctacccttgaccactacctttcctttatccatggcaaatcagtcaccaggttctactgactttttccctttttttgagacagtcttgctctgtcgcccaggctggagtatggtggtgtgatctttgctcactgcaacctctgcctccctggttcaagcaattctcatgcctcagcctcccgagtagctgggattacaggcatgtgccaccacgcccagcaactttttttttcttttttttttaaggagagacgaggtttcgctatgttgaccaggctggagttgaactcctggcctcaagtgatccacccaccttggcctctcaaagtgctgggattacagcatgaaccaccatgcctagcatgacttcattttttgtttcttgacctcttctcttccctaccatagtgctataatgcaggctttatcatctctcaactgggttactatcacagatttctaaatggtatccttgatgagcatctcattactctcaaatcctcacagctaccagaattcgctctctctcgaatgtcaactcctgcttaaaaccttccagtggctttctatgcctccttaccaccttggataaaacccaagcttcttgtccacaagaattaccactatttgtccctaggtccctcccaagccttgtttcataaattacatttcagcaacaccactttctcctagttccctgtcaagctgtttcctttacctggaaggcccttttctctttgattcttactcatcctttaagattcagggcaggcatcacttcctctgggaaatccccctcagtcttcatatgctctatgctaccagaaaacaaaaatgttgactgccttatcactgtgctttccacgtggcatgatataatcgtttctttatcctctttccctcaactaggctgtaaacgtcttaagagaggggaccatattttacccatctttgtaactaacccactctcagaatctttatccacagtcctttttccatgaaatgtgctaagcctaccacaaagtcatgctatctaatttcatttggacatttactgctgcttattttattcatttactacatttctttttttttcttttctttttttttttttttttttttgagatggaggtttgctcttgtcacccaggctggagtgcaatggcacattctcacctaactgcaaccaccgcttcccgggttcaagccattctcctgcctcagcctcccaagtagctgggattacaggcatgtgccaccatgccaggctaattttttttttatttttagtagagatggggttttgccatgttggtcaggcaggtcttgaactcctgacctcaggtaatctgcctgccccggcttcccaaagtgctgggattacaggcgtgagccaccgtgcctggccccatttactacatctcttaaaatggctattgtacaaccagttttccaatgtaaatttatgactcagctttcttgtaggtacattcttgctttctttcttacattacatttccctggttcttaaaaaaaactgattattccatctttctcttttactgattcttcattcttgtcctaccctccaactagtaatactaccagcagttctttccttagctttctctttccttctcttgctctacttttcttcagtggtctcatctgttctcagagcttcacctcacttctatgtggacagctccttataacctacccttccttcttcatgctgtaaccctcattcccaattgcctactagaaaattatattataaataactgcagggcacctcaaatacaacatatattatacaaccaaagccattatcctttttccttaacacctccagagtcattccatcctaaacttcccacttctcaatttatccctcctttccagttccactgttactatgcccagattctgttatcctgtctctcacggactactataattggccttactgcccctagttccttattcctgaattctactgcaataatttacttatagcctttgctcaaaacaaacaaataaaaccctttcaatgacctataactagaatacaagttcgaattctctggccttacattcaaggacccatttgatatgactttagggtaaaaataagtaaatggtggtcttaaactgtatttatggcattatttctcactattcctttacagatcccctatatataggtaaaactcattagtccttattttctatttccttttatcctccctttaaagtcattgtctttacctggaacactaactctccaatctacctatcaaattctactcaaaatcttcaatgtctacatcagatgtcatgtaacctattaaatattctctccacagtggtcggatgaaaccctctgtccactgaaatctcattagttcttcttttgtgtctctttgatacttaccaaatacacattttttttttttactgtagttatttgagtctatgtctcctttctccacttggcatttagactccttgaggacagaggccatgtctagttcattctataactctctgccctatcccaaccccaatatgtaattagagcagcacagaggccattcaaatgtcaaacaaatgtgaatcaagtgggaagaataaaacaaaagtggaaatagccatgatctaacaaaaatgattatacctacctatgtgcaaagaaaagtagaagttcgtgggattgtgacaaacgtaagtattagtaggagggtgaactgctaaaaggaaattgaagataattgtcaataattccaaatctggaggagatccaaggacttctgctataattttcacaaatgatctacaaacctctcggggcatgggtgtgagttgcccctctttgtattcctgaaaaaataaaaaaaactctctttagatttaaagaattgtcaacttaactaagatttttcatttaggcaaaatattctttttaagatagaattctgttggtttactactctagtctgatcatacttaccattaccataacaactcattaaattgagttatttcctaattcaagcaatcttgttattaaaaattcattaacacagatggcaacttaattctagcccatgtatcttaattaactgaggcaaacttatataactctcacaagcgtggtctcaaaagccagacttcctaggtttgcattctggtttctccactcactagccatgtgatcttaggtaagttacttaacatctgcatgcttcactttctttgtctatgtgagtaatactagtgctactttatagggttgttataaggactaaataacataaactcttagaatagtgccttgcatataggtaagccccatataaatgttagtgataaactacaatcactactattactactgctactatcttttcttctccttttactactactactattagtaatattagtataggattaggacagaaaacttttgatggacaaaactcgttatactaatacaatatgctccagtttacaaagctttttttcacaacagctctatgagaggttttagccctcatttctagaatatgaggcacaaagaggttatttgactagtgtaaaccacacataaaatatgtaggtagtacaattataactcaaactcaggcctctgaactctttctactgcaccatttactgtctggaataatgaggcttggcaaaatgccaactaattactaaaaataaagctgtatataaataaattgcttatatcctccaattccatctccccagtgggtagcagctggcctccagattaagggtatgggaggtaaaattcctcatcttccctcttcatatgtccaaatatatatctctacatccactcttcatttactcttgggtattactgaattggagtacttaaaatgtagatgttaattttgaaacaatttagttcgactacctcagatttaagaagggaacactgagtctacagaagaaaacacaaaactcctttgccaagttctcatagctgtcaagtggcaaagactaagacaggaacatagatctcccgacttccaattcagaactatttctgctacaaccatctgcatttcttctaaaccatactccatgtatcttcttaactttcttggttgcagcatcagtgattcattcccaagtccagcccaggttacttctatcttgccctctccactgactctttatcaatagtcactggtattctattttattatttttttaatcccttaactttaccttatatgaacattctgtttctgtctttgcttttgctgctggactttttaataatcatttgttctcactgccttcaatgatctgccacacatgctgtccaaagtccctgaaatctggctcttgccttatccatgctattgaaatcttgtaagtcattaagaatttctgagtcaatggccctttatctgcctacattttctctgaactttctatatcatttggttcaaggtatcatcttcttctctacatgttcttccccctctgccgacctctggctttcactttactgagtctcctcttagcttttcaattactctttctgtatctctttcaatagcccctttttctggtttcacatcctgaaaatgggtatctcctgaggtgtaaacctcagtcctctgattctctcactacgtttctctgtcttggagtgcttctctatcctgatggcttcactattaccagttcactgttgctgaatatcctgctgtaatttcaaatgtagatacaaaaactacaaaacttacaaggttgcttttttttcttatgaaattattgtttttctggtctcccggcttgaaattttatgttatatttgactcctcctgaagctccatttaaaaagaatcaagtcctatgaattctatccttataatctctcccatatttgctccctactaaacactcccattttaatcaccagggttcaggttctttatgctgtactcacaaatgaatgaaactgccttacatccaatatactaccaatttattaatcttcctaaagtgcacaaacactctgaggtaacttaaaggcaaagactaagttcatttctttataaacttcccacaatacctgacataaagctatgtttaataaatggctgttaatttgataagtgggctctttgaacaaacaagggtaaagaactatacatgtaaagaaaaaaatttgtacctagattttttctagcatttttgtaaataatacaaaagtgaaaaaatatatggaaatctcaaagtttataagtgccacttttctgacatgcaaagactgaataagaatatcacattgtcatatgaacttaatgaaaattggccaatatatttcaaaatggacatgcgaaggaaaaaattttgaggaaaactgatgtataaatgatgcataaaacactcagtaagcaaggggcctgaaggatcaatcgacatattctattccctacaacaatagtctaatttaccacaggggccaagaaaggcaataaaatgtttttgtgtttttggaattcattcatttaacaaatatttatcagatgcccaggtgtgtcaagtactgacattacagtgtgatttaaaacaaaacaaaacaaaaaccatatccctgctttcaggaggcttacagagggaaataaaccataattccataaataactaacaaactgtatgtacatagtgtataaagggaaaaagactaatttatatggaaagggcagggaaggtatctctcaggaagtaagtcttaagttgccacgtggaggataagtaggagttggccagatgaaaagaatgggatcaataattgttaaagcaaaaagaataccatgtactctgagacagaaaaaagtcttacttgtttaaggaagggaaagaaatccagggaggctgagtaccataagatgaagctagaatggtagccagatcatataagccttctcatattaacacttcttacagatgttgtcacagattttgaattttagcccaactataatgaaaagcccttagtgccaccgaagcaaaggcgctcaaaatataaaatattactgatctcatggagtatctgtacttatctaacttgacaaagttctaatcgatgccttagacattaaaaaaaacttggaaaattgtctaatataccaaccaagcagatatttatcaatgccttttatctgtttggttggtattagatgatatcaataaaggcagagaaaaaaattaactaaaagggccacagcatagacattacaatgtaactgatacaattagtgtcactttttaataaaaattttggatacagtttaaaatgctaattctagcatataaaatagaccgttagcaagtttatatttattaaagcaatacatatttgtaaatatttatttaaggaatatggaacaagttaaaattcattaactattcttgctgttcaaggcagtacaaaactattattctatcccaacataaagaaacatctaagaaatttagtaattgtacttttgtaattgagttaggaattatgacagcgtgatgatcaagctgtaagatgcagcagttgaaaaactcctgtactattttttgaaagaagagaatctggagagaagatggaaaaaaaaaagaaaaaaagtcccattgaaagtgccacaaaaatttgatgttcatagtattattaaacaactgtggaatatatttccaaaagtaaagttacatgaaaagtacctgcaaaacctgacaagtcagtagaaagtgatgaaccacttgagctttcaataactgcttaatattaaacatctgctggtggtgatctgctctgatgaggacttctagagctgctagcaaagtttcccaaacaccttgctgaagagataaacacacaccaataagcacatacttactgaaaaatatgcagcatgctttttggaagacacacaacgcgcaacaatttaacattgtgtatatattcagtatcaaagattacatgtctgcaaaaagccaatgttaaaatttattccctattattttttgttgccaataggctatttctaaatagctatgttgaatacaatattgtattaggtgctttcctacattaccctttctgtggcattaaatgtattttcaaaagatgaattatcaagagggattattcaaattagagaagcacacacattaccaacattattgtttttaaataatttatgttcaaagagtgttgttaaaaatgtacacatttcaataccaatctgcatatgcagcatttaaccaaaaaattttagagcaaatcatactaaattgaagagtcatggataatgtgaaaattctgcaattttagattaatttactttcaagttcaaataatagaattatctgcatgattacaaactatgcacttcaaagagtagttagcatcccttgacagtgccttaaaatgcttctcccatattgaatcaatcttaacttgtccataatactagagaaaaaaagagatcttacactgataactaatattgaaagataaccttcccttcatcttattatcctaattgacctttcaataaagcttttaacaaaaagcaaaattaactggcttgggttgcagagcctatttctcctgccattatctggcaataatgaaccaagatattgatagacttaatcatactcttctacccagggtctctctctttataagatagagccaagatattctaaaagacaaagccacacgaaaaccagcagacaaggcagccaaagtatgaaaacatgattcaaatctgaaaagtagtaccaagataaaatagtgccaatgtaaacaaacaaataccaacaaaaaaagaaaaacgagacttagttcaaatataattaattacgtaagaaaatcttatttcaaatccatagaagtaatatgtgtcttatcactttcaaattcaatttaaaaatgtttcttttaaaatcaaacaaccccaaatttgcctgctcttttgaagtactaaataaactttgtccaactttgtccaagttaggttttccaacctgcaactgagcatattctttattatacatttatactgcttttgatccaatttgtttacatatgctatccctgtaattatttgctttctccctgcaatattacacatattttaatctatcttatcttttttttttagatctgaaagtatatatttattcagagtgagaaaaggcatcacaaccaattacaaagtttaaaaaactgaaaagtaccatgaataccacaaaatccagaaacatggcaatagttagttggctgttggacatgcctttcaaaatacttttctctgttttgtggctgcatactcttgaattgcctcttcatgtaacaacaattttgtaatataattttctataggaagaatagaaaattctctttcctctagcatatttgaactaaacttatttttattactaatagattagaaaaggttttttagtttgtttttttttttttttttttttttggccaggcatggggggctcacgcctgtatcccagcactttgggaggccaaggcgggaggactgcttgagcccaggagtttgagaccagcctgggcaatatagtgagacttcatctctacaaaaaaaaattaaaaattatccaagcatggtggtgcacacatgtagtcctagctacttgggaggctgaggtaggaggaccacttgaacctgagaggcagaggttgcagggagccaagatggtgccactgcattttagcctgggtgacagagtgtgctcctgtttcaaaaaacaaaaggagtcttttttcaacctcataactcattactggtaatgtgtaaatttttagggactgttggcaagttgggaataaccattttaaaaaaattctaaaggtatatatattctgaattgctctataaataatatttgttgataatcttgttatattctaattagttctagacaatctagttttttttttgcaaaaatcatcagtacctactagaaccctgccacacttagagcaaacagtctacactagaactaagaaggctgtatgagcctatactattaagattgcttaaaactagggcagaaaggaaacaaccctatactcattccctgactgggtccttgtgaagacaagcccagccattccaggtgctgagatgtagtgcctacatctaagatcaatctatgttgcttaatttgtacttacgatgaagccttgccctatataccatggtcctatctctaactcctggccagcatggctcccctagttagaagtgtatccatttccctctcctggacctgactcccctgactcttagcagtctcccctttcagagtttatggtaaatgcaagccttcagctgatccagataagcccatatgctcctgcctgactgcagtattcttagccagcccaagtttgattttgactctccagctcagcattccccatggctgttcaaaactttgcatgggaaataagtgccagatttccatttataattaacattacaatgaagtaataaattaattatttctttcagaagaatgattagataaatatttaaaagaatatgctggctgggggtggtggctcatgcctataatcccagcatcttgggaagccgaggcaggcagatcacttgagctcaggagttcaagaccagcctgagcaacatgtgtgaaaccctgtctacacccaaaatactaaaacttagccaggcatggtggcacacatctgtggtcccagctacttgggaggctgaggtaggagtatcatctgagcctgggggtggaggttgcagtgagccaagatcacgccactgcactccagcctgggcaaaagagtaaaactccatttcaaaaaaaaaacaaaaacaaaagcaaacaaacaaaaaaacgagtatatgcttctattcacggtagctaaaatgtggaaacaatccaagtgtctctaaactgatgaatggataagcaaaatgtgataaatatatagaacggaatattattcattcttaaaaaggaaatttggacatatgctacaacacagatgagccttgaagacattaagctaagtgaaataagctaatcacaaaaagacaaatactatacgatcctacttatatgagatccttagattagtcaaaagtagaatggtggtttccaggggctagagaaagagggagaacatttgtttaaagggtacaaagttttggttttacaaaacaaaaaagatttacagagatggatggtggtgatggttggacaacactgtaaatgcacttaatgccactgaactgaaacttaaaaatgcttaagatggtaaattttgtgttatatgcattttaccacaataaaaaatggaaaaaaagtacatattacatgcctctgctttactccatatcttccagtcaagcaatagttcctctaacagcttaacatcttggattatagcattagagtctacatccaacttaaactctccattctcattcatataaataatatcttcaccacagcatccttcaagaagggtctatagaaaattagcattaatataagatgcattagtaattggttaatcaggaagttcaacagaaacattaagctttcaattttagcaatcattaaattcaaaggaaagctagtaaataatttaacacttcacaaagtatctttaacttgttttgtaaaacaattcagataagtagaaaatcccaaacttacaaatatttttaagtgagtactcaggttcaaacaaggggtgaaaacaaacagcactcaatttttatgttttaaattgaattaatctgctattaggctttaaaacgttttcaaaaaagtagtaaggattcatgccacaaatgtatggatcttgcagtttaaagaagtaggggtggaggcaagggtagagcaatcgtcttttgccttagtaccagaagtctcagagagaaatatttccacaatgttaccaaatgctttcatctagaaatgtatttaaatatatgatgatagcgggatcataataaaaatgagcacgaatatctgtgacttgaaaaactaactctgtagcagcagtgcctaatggaatggtatgcctctaggtgcctagagaactgggttctctgccataagggtgggagctaaagcaaagatctcatcaatctacagaatgaagggacagcatgggagatatctatggcccacccaggtctaaaattcaatgagtttctttctttcttacttttaaaaaatgctttaaagaaaagaaaaatgtaattatttaaatgatgaaaagaactagaagagtatcttagtttgattaactatacactaataagtttcctccattttcttcaggaataactgaaatacaaaactattattggaagactttgatgacgagatgagtatcactgcatatgaaactataagaataaattttatgaagacataccttcaaaatgtaaaacccaacaatgcatttttgtttgatcaacacctgatgaatcatagaaagtccattacaattttctaattcatgtactctttgttggttgtatttaattaatgagagtataactcgcagtgctaatgcttgagtttcttcacagctactgagttcaacaacctaaaaaaaaaaatgggtggatatagttttctcccaatttgctgagagtaaaaatttaacatgtataatcttccattctgtaacatcaatccattagtttctacaaagtatttttttaatgctcatactctacctatgtaaggcttgtgaataaacaaaactgagagtaaggcataaactccatgttctatagtctcttatatatactatagtatacaatgacacacaaccttagtggccagtagcattttataactagtgatctgaagtgtcataagtttttgataagttagtcaatagacaggctctgcattatgtggtaagggagataaaaagaagtaaaatacatgatacttgttcccaatggggtctactgtcctgtcaaagagataagatgtatctataaaaaccacatgtcctgccttgtatgtcaatttacttcaaccaacactttctgacaactactatatacataagaaacacacacttattatcatgctaaaggccaaagaagaatgagacaataggtattctggagagcacagagaccattctgatccctctctgcttggtttaagggaaggctacacagagagaagatggcctaggaagagagccaaatcctggaaagcaggaataaaggggtggctaaggcagggcacagccaggggaagggtaaaggcctaaactggaagttcacagtacatctaggaagctgcaggttgcctctttggctggattgtagagaccaggttcacaaggcaggttatgcatgtaaggattttaaggacactgaattttatttttgtaggggaggaggaaggatactgaacaaggtttataagttttagacttaaaaacatactttaaaagtcttattggcaagatactaaacatataaagataaaaatgtaaacattttatctaagatccaatctctatgtaacaataacaaaattatattcaataccttgatgaaagagaagaaaacaaggatatacattttgaaactatacgatggtacaaaatatcacaaaatattggtgaggagttaaagggcttttaattttaaaacactaggagataatctatttaactagacactagattaaaaaaactatgaaaaaggaagaggtggagaagaaaagacagattacagagtatggtggatcaaatgctaacaaaatatttgtaagaaccctaacaacaacaaacgctgatatgcttcttattgcaaaattaatcaacgatgcttccattaaagaaagttagatagggagactatgaaaacttgataatgttgcaaaagttatacttagggataaaacgaagatggcattccgaggatgaaggaagatcaaagctgctttaattaaacagggatgtggatccagaggaagtagaaatgatttttactaaagtgagactgttggtgctccctaacataggtttcagcaatccctgaaatagtctataattactgactgtctactttgcatcaggacagataattaaatgactcattcgaaaatggtacttatggcctgagtcaaactttatatgtctcttttttgaaaaaactccaaacccaaacaaattaaagtttttttttttttaaagtattttttgacccttagttttttcctatgcattggaaacatttaaggaataaaaacttcataaattttatttttaaaaatatcctcctctcaatttaaaatcttgtacatttaacatttaattgtactaattacatttttggttaatagaaaacttctaaaatattcataaattagaagaaaccttaatcatctatggcagaaagcttaataacattttaatatgtaatttttttatgttaaaagtttaatatagtcgagtgtagctttttcgtgtggtccaaaagaaatcctttaatttatcaataataagtaagtcatttctctttagacaaaactataagcagtgattcttaccctggcaaagagaaaaacaaatatgccagttccaccaatttcgtgcagaatgccttgaatagttttatattcagtaggttggagattctttagatgatgaggttctaataagatgctctgaacttcttttgagctgaagggtctttgagagagttgggttttcatttgacctttaagtctaatcactggttcatagatggtatactgagcaggacagtaagttgtataaacaactgaaagactttcctgaaatacaaatattttcattcagtaatgacaacaagtttaaaatgcaagctatgaactagcaagtaagtatttcaaagtgaaaacacactcaactgatccttttctttgtttaaaaaacaacagctactacactaaacagataaacattagaagcaaggctgtttcccacaaagcaaatggtcagtgatttatttagcagtgatcaattgtatagatcacatcaaggttgagaaggattccagctttgttcggtttagaatatatattaagttatactattactactaatatcaactaagtcttaaaccacacttattacataccaggcactattctaagcacttaaaaatattgggaactctgggtcaggtcaatttatttgaaatttttgctttgcatttgctcattggctgactcttcatttaaaagcaactctaaactagatctttctactggaataaaattccagattgtcaacagtcagcacacctaactaaaataaaatagaacttcaaatatttctcccaggcaaaggatagtttccatcagtgtgtggctccctgtcaagattctctaaactattttaaaaattaaagttaattttaaatacagaatgcatgtttttcttagagacagtgtcttgctctggcacccaggctggagtgcagtggcatgaccatagctcaccgtagccttgaactcctaggctcaagggatcctcccacctcagcctcccaagcagctaggactacaggcacctgccaccacacccagttaacccagttaaatatatatatatatatatatatatttttgtagagacatggtcttgttatgttgcccaggctagtctcaaacccttgacctaaagtgatcctcctgcctgtgcctcccagagtgctgggattataggcatgaatcttggtgtctggcccataatgtactttaaggtggttttaatggtagtagatgccaaacccaggcttagggaaatcatatagattcagtgtcttctctcagaactggatgggggccttgtgcttagattattcttattatttatttatttatttatttttccgagacggagtcttgctctgttgcccaggctggagtacagtggcgtgatctcagctcactgcaacctctgcctcccgggttcaagcaattctcctgcttcggcctcctgagtagctggaattacaggtgcatgccaccacgcccagctaattttatatttttagtagagacagggtttcaccatgttggccaggctggtctcgaactggctggtcttgaacttctgacctcgtgatctgcccgcctcagcctcccaaagtgctgggattacaagcatgagccaccgtgcctggcctgtgctttatttatgacccacagcaatcagacataccacccagcgtatctgtgcaccagctaaaccaattatactgtctgttgtgtatgattatgctggaaaagcaaagtttcaaacctgcagtagtttcaatcagaaatctgacgttgcaccctgacatgagggtaccatttcttgtcttttttctttttttttttgagacagagtttgactcttgttgcccaggctggagtgcaatggcgcattctcggctctctgcaatctccgcctcctaggttcaagcgattctcctgcctcagcctcctgagtagctgggattacaggcatctgccaccatgcctggctagtttttgtatttttagtagagacagggtttcaccatgttggccaggctggtctcaaactcctgacctcaggtgatccacccgcctcggcctcccaaagtgctgggattacaggcatgagccaccgtgcctggccgagggtaccacttctccctaaccattgtttcacaagcttataactcccaaattactaaatcgggcttaaacaatttgctctctaaaaatagttttcacataaaaccctcagaattttcattcatgataatttatgttgagttttgtaacttatatgacctatataccgttcaggaaaaataaaaggattagggaaatttttctatgaaaacaaatggattaaccaaaaactattgagttaaagttattacttgaacaaacatctgtgtgagctcctcagtctccctaaggcagaggttctcaaagtgtgatcctcaaccagcatcagcatcacctaggaacttcttaaaaatgtaaattccagggtcacacttcagacctactgaatcagaagctctggcccagcaatctatattttaacaagccctctggatgattctggtgcacactcaggtttgaggaaccatttccctaaaggatgttttcttaatggtgggacatttaggataggatcattctttgttgtataatagtgttcatgtactgtagaacatttagcatcactggcccttactacccaataattattgacaaccaaatctaccctccccgcaactcaacaacaacaacaacaccacaaacaacaaaatacattccaaaacagtagtctccttcaagtaagaaatatctgtacttctcataagaagcaagagaaagaggaacccagtttcatggccagatctactagattttagtagattttctaagactatttatgaaggctcagttttctagttgctataacgaaaaatcctcaccactagctcctacattatatactggtagaacaaaatattggaataatatataaaaatcaatagagtctcatataagcagaattagcaatactttgaaagcaaaattcctaattttactgatattaaataataagttttttaggccaggcatggtggctcatgcctgtaatctcaccatttgggaggctgagacgggaagatcgcttgaggccaggagtttgagactagtctgggcaacaaagcgagattccatctctacaaaaatttaaaattagcccggtgtggtgatgcatgaccacaggcccggccacttgggaggctgaggtgggaggatcatttgagcccaggagttcaaggctgcggtgagccatgatcacaccactgcacccaagcctgggtgacagagtgaaatcctgtctcttaaaaaaaaaaataaaaaataaaaaagagtaggttttctaagacctgaatacatgtaactaaaactaacattataaatggatattatttatttataagtatggaaagaaaatataatgagcaacattttttaggagtatgtcaaactaacaagtgttattttcactgtatcataaacatttttcctgaataattagtaggtataaaataaactaaactgataaactttttatagaaatataatttcaaggaaaaggagatataaatataaagcctgaaacaaattttgaaaggagatcaaagtgtttcaatttttttcagaaaaaaacataattctaagaaaagaaaatgataaggaaccacattaaaatctttagaaatctaattcataactatacattacaataaatatacctaaatacatttactataaaattaaaatttataaaattaaaacttacaattaagagaccaatatccacatctttcttggtcataaaaagttctctgatttgttcacatcgcaaaatttctttattaatatatttggagtagtcattgactggcttgccatacttacatggcattacagatgtatggttgggtccacaagcatacagataaaaggcctcttgtgaaccaaccttagctcctgaatagcagaaaaataaagttagttatttaaaacaccctaaccagaatttttcataaaaagcaagaaaccaggaattattttttgtagccagattctttcagttgttcactatattttataaaattgataaagcctcaatttcgaaattggtgtaacgagaaaataacctatgtcaactatgatggaagatgaattaatgtatataaagttaattgtgaagcttttaattaaatcataacatttccatttgctccttagccagaaaacaggttttctgttttattttactttgttgtattttttaaataatgggagctatatcttggtaaactccatttctaactaaaatttgaatcaatatctttattccttcctatttagtcaataaacactgtctgaatgctattatgtgtgaggtttaaggacatattttttaaaaatcatatatttcatttttccctaaaatttgatatttgtataagatataataaaattataaaggagacaaccaagataagtttactagtcatgatgctacattatccagtataaaaaaacgctaagttaatatgagcttctcttttttgaggatggaagaaatacatttttatattaaatgtatatatcaattgtaagacacaactagattacaaaaacgttaaaatattttaaaagtatatcttagaatcttggaaatacagtacttattaaacacaagtaaaggaacatagatggatattttagccaggttaatttacttagtttaatatttgttaactgagaaaaaaaactggaaatgtttcaaaggaaaaaaatctcactctgtcgcccaggctgaagtgcagtggtgcaatcatagctcactcaccgttgaagagaagcaaatttcccaggtcccattttccagccaactgcaaaaactcttcttgggatgataaacaatggccaatcatgcaaaatgttttattgctatcagatgacaaacttgtttttcttggaagcataaaatccaaagtaacatcaggcttcctacattaaaaacaaaacaaagttaaagcaatgactttaggaagtctagtactaagtatttttaaagtatgaatatttaacaatggggaattctttttttttttttttggagacagagtctcgctctgttgcccaggttggcacgatctcagctcactgcaagctccgcctcctgggttcacaccattctcctgcctcagcctcccaagtagctgggattacaggtgcccgccaccaggcctggttaattttttgtattttttttttagtaaagacggggtttcactgtgttagccaggatggtctctatctcctgacctcatgatccacccgccttggcctcccaaagtgctgggattacaggtgtgagccaccacacccggcctacaatggggaattcttgaacaattttcttgggtcattatcagctggcactggggcaagagaggagggctaattgtttgtctcttggtcaaaggtgctgcagaaagaggggagccaaagagagatacctgatgatcccacggcaggccatgggaaatgtgactaaacatttgctgcaagttttctttgccatttgacttctgtatatgcaccttcctggtttacagatataaaccaaccacctccccttaattttgccaagaagtctcccatcttgacaaacaattccaaaaactggaatccatgacattccaaaaatgttatgtcatctatgaggcctttgaaaactaatcagtaaaaacataacttcttcaaaatttctgtctagccattgaaatgccaatactttctgcattttctgttttcttaatgctaagtgattatgcagcttttgattagtctcttttgcttcatggataacggtgaaggaatgcttacaaaagacagtactggaaaaggcaaaataaggctttctcacagaaagacacacaaagcagggaggacttcatcaactagtgaaaccacagagctctacccctaatttaggaatgttttaaactccattttaagataatgagagtaatctatgaaggcaaagtctaaataaaatttgtaagatgaagacaggataagctaacacgggtagctcttaatgagaaattcaactttgtgtatatttattttaaaagttttgcctaaggctctctgtttcacatataacatataaacttaactattttaatgtttttttttttaataaaggaaagatgtgggatacattcaatgacatacttctccttgaccaaataaatggctgtgactgaaactctattgccatctagtggcattatgacttaaaatagttttaaattttttattttaaaaaatagtttttcaatgagaacatacggacacagggaggggaacatcacacaccggggcctgtcggcgggtgttggggcaaggggaggaagagtatcaggacaaatacctaatgcacgtggggcttaaaacctagatgacgggttgatgggtgcagcaaaccaccatggcacatgtatacctatgtaacaaacctgcacgttctgcacatgtatcccagaactaaagtaaaataaaaatataacaatgaaataaaaataaaatagtgtttttaagggtgaaagaaaacctattgcaggatgaatgcaaaatgaattaaacaaatattaagtatctactatgtgccatatatttctgccatatttgtaagctgttaataacaactaatagaaagtattaactcattttcagtactgttaccttattttaaaaggcctcttcaaatgtattcttttagaaattctttttttttttcttttaaattgagacagggtctcgctctgtcacccaggctgaagtgcaggggtgcaatcatggctcactgtagccttgacttactgggctcaggtgatcctcctgcctcagtgtcccgaatagctgggactacagctacgcattaccatgcccagctaatttttttatttttagtggagacagggattttccatgttgcccaggttggtcttgaattcccgtgctcaagcaatccttctgcctcggcctatcaaagtgctgggattacaggcatgaagcaccatgcctggcctagaaattattctatagcttataaagtgacaaagatactagagaaccaagtttaagtcaacagaataaaatatttgtccttggtcacttgctctgttaaccaatgaaattaacttgtgccaaatggcaaacaattctctcaaaggagtatagctgtaagttggtgggtaaaaaaacagagtgatatgtgaatcaagtgaccatgcttactaatttcagactgtccacaataaaaatctaatctctcattctgaacatttctaatagtttatggttcctctacctgtcagctgacataattcagaaaaaggctgcaggggcagtaaagcatagggttttaaagcatgggccctccctagggtcagagtttaggttaaactttcagctctaccccttacttgtggcatgagtttgggaaagtcactctaggtctcagttgcctcatatgtaaaattgggataataatatacctactttatagtattgttgggaggattaaatcaggtaatctgtataaagtgcctaatacagtgcctggcacatattgagagctcaagaaattgagtggagagtgcctaggagaaaggggctctctacttacaactccagccccagctccatctgatttaactataggttctggaaacaaatttgctgattggctacagctgccatggcagctatgaagatcgagaacgtcacagacagtattttatttggaacatggaacatggaaattaggcttcaattacgtatttttacattttttaaaatgaatacaacaaaactgaactcttaattttacttccaaagcatgttcttgcttgtggcagacaccatggactgtaaagcaatccacaagctcctgctccctgtctccctctattattgaggctggacagctgtaagcaatcaattgctgcagcctcctgcagtgatgccctgtcttccacctcaaactgtcctcctcccacctgcacagggcaaattccatctcctccttcaggtctcaggtttaataccctgttcttagataggccttccctgatccacccatcgtaagtgtcaaactcgatattttctgcctcagggttttaaagcatgggcctcacagtatttttcatcatttgtaaatattcatttaattgtgtttgcttgttgtctgattcctcatcagactgtgaactccaggaaggcagggaatgtgtctatcttgtttaccattgtcccctaggcctaattaatatatcaagtgctcaaaacactgtaattcctcaataaatgtaatgaatgaacaaatgaatgaataaaaataggttaatctgtgttaagggtatatgttatttccatggtctaatctactttgagggatttttgagagaattagatgatgtatataaagcacctagcaaaaggtctgcaacatagtaagtatgcagtattatattccctttgattaaatctagacttctcagcttggcattcaaagcctgttaagtagtctcaccatgtccattcatttttatttctcattattcaacttaaactcatccaaccagcttaatcctctaccatgctacattacagtttcgaattctctatcttctttcatgctacttcattcaatacaatacttcccaatgcttacaaatcgaagataccttatagttcctacaggctaaaatttgacattaagatattccacaagatgtttcttattaacttggctcacaattctcctatgtggtaaaaatcatacagtactctccctgaatctatcacttggtatatttctagcactctatctgaatctatcaccttatacataggctagtcattctaatttcttttgaaagcctaatttaatttaggtattagccttattagccacttaatttaaataattatcacggcttcagttttataatatatgggcttgcaggatgaaattacagattctgttctttgatatatagttatacataaatgtctaaatttctgggtatctgcatgctccccaaacccaaatattaattttcaacagtcacttcgacaggaggcttattttgcatgaaaatgaccaataggaaaaaaaagtccaactctgacagatttgtaagttaaagtatagtaaatttttcagagaaatgcaaatcaaaaccacaatgagataccatctcacaccagttagaatggcaatcattaaaaagtcagcaaacaacaggtgctggagaggatgtggagaaataggaacacttttacattgttggtgggtctgtaaactagttcaaccattgtggaagacagtgtggtgattcttcaaggatctggaactagaaataccatttgacccagccatcccattactgggtatatacccaaaggattatgaatcatactgctataaagacacatgcacatgtatgtttattgcggcactattcacaatagcaaagacttggaaccaacccaaatgtccatcaatgatagactggattaagaaaatgtggcacatatacaccatggaatactatgcagccataaaaaaggatgagttcatgtcctttgtacggacacggatgaagctggaaatcatcactctcagcaaacgatcgcaaggacaaaaaaccaaacaccgcatgttctcactcataggtgggaattgaacaatgagaacacttggacacaggaagggaaacatcacacactggggcctgtcgtggggtggggggaggggggagggatagcataggagatatacctaatgtaaatgacgagttaatgggtgcagcacaccaacatggcacatgtatacatatgtaacaaacctgcacattgtgcacatgtaccctagaacttaaagtacaataataataaaaaaagaaacaacaaaaaatatagtaaattttattatagtaaaaacctagaagtttctgtattctgtttcagaagctataattgactaatgaaacataacattgtaactgagattgagatgcattttctcaaaatgcttcctacctctgtccagagacccatatggagattttcccatgaatcctccttttcccttggggctgctgtaagtaggtgagtactaaatgttgccatttgcttgggaggaaaatattctcctgtgattcaacctgtgctagtaaaacagctttcatgtcatcatttgaatccatgcacacactacagaaaaagagaaaaggcataggctgaaaacatgaaaattctgacctcagtgtttaacatacatatagtaactataattctaaataagtaagattaaaaatcagttctattttttttaaagtgcttgaaaagtcagtaggtcttcgttttataccataagttacttagttattctatcattacctcaattcatgaactaaaatagattaggctcattggctggtagtcataatttaggcaataatgttcagaattcagtttgtaaaaaaatatatattattactatttatatagccattgcccatttagaaattacaatgtattatttggttcatagaaaaattaatataaatgtctaagtattggaggtctaatctactttgtgggattactgaaagaatgaggagataatgtacataaggcacctagtaatgtttgtaacgtttacaaagtatatattcctaaataacatactggtttgtttagatttgagttttagacaaatagtatcatactattcatactcaatacaaataaaagacctgtatctatactacttaataaaggagatagtataaaaggacaagataacaaggagaacccaagcttattaggtaatcgctattaaatatataatgcacatggaaaacttatgtctgttaataacatcttaagaccattacaatctgatagaatatttccatagcataagacttcagtatttgatctaaaatcaaacagagaattaatgtattttatttactcatttattttttgtttttatttatttatttattttttgagacagagtctcactctgtcacccagactggagtgcagtggcgcgatctgggatcactacaacctctgcctcccagattcaagtgatactcctgcttcagcctcccaagtagctgggactacaggcatgcaccatcatgcctggctaatttttgtggttttttgtttttttgtttttatttttattttttgtagagattgggtttcactatgttggccaggctggtctcaaactcctgacctcaggtgatctgcctgccttggcctcccaaagtgctgggattacaggcatgagccaccacacccagccgagaattaatatattttagactttatggatttttggatagaataatacactattataaaagtggtattaatagctgttagaatgtatatatttttaaatgagactttttgttttgctataatgaacttttattagtagatttcacattaatgtctcttacacaaattatttaaatacattatctattcatgggaggctgaggataatcaataccgaaagataagagtggcattgtggggatcagcccacacttggatcatcaacgctttggatcccagtgaaattatatgaatacatccttcttctatgagtctttcaccaggatttatgtactctgcaccttctggtctgtcgctctctataagaaaaagatgttagaatgatcagtaaaatggttcgtaacaactgagtagaaaagtgaatttagaagaatacaaagcaaatttgttcatttgtagtaggttatctacccagaatgtctgagcctgacctgttctaaacaaccatattttcagagtatagatgttaactccaaaaaagcacgagggatgaaaaatggtaattcagtactttaaaagttattagatattaaaaaatgtataataactgaggacaattgtgggcgtaaccagaccgctatgtgacaacctattacaatgtgtaccaagcttcttttatcaactatgacttcactgaccctggtccagggagcacacatcattgtccatgcctcacactaccaaaactcattctagaattatcacaatatggcatgatttaaaaaaaaatatcatattacaaattttaaggaaaaactctagtgtttgaatatattcataatttatattccctggtgagtagtttttgcatataattgctaagtgattctgaaactctaatgtttctttaaggcaagctagggtaaatgcttacaggcttgggctatctggttatttatcttgactcctcttcctcatctttgaaaacccagcactgcctgaagatgtatgatgatctacttgtcattataatacatgtgactttatgtaaagctatgttatgatatatcaaaatccaaaatacatgtccaaaggctcagacttttaaagaacactactgcttattagactgcatacatattagttgctatttttcaacaggtaaaaccatgaccgatgttaaaaaaatactccctgtagcgatgacaatagttttaaaaaagaagagttaaggtcactgattattttgaggctgctgaccaagatatatgatatacagagaactcacatctgatgtgaaattttaaaaatgttccataccaaatatgaacttctgcaaataaaagagtaggacaaaaccagtgtgtacctaggaattatagagtagtaatattacaaatatttaacttaatgctcacaaccatcttataaggtaaatatatatagggtgacaaaattgaggtgctgagaggttaatttgcccaaaggcaccagttagtttagaggtaaaaggtatgatatcgcagcaaaatattctttatctctcttcaaaactttttatatatgtctactatttttaagtgtttatacaaaatcatctttctaaaatatgttttctaatatatccttaaaataaaaattaagaaaaaactttccaatatttacttttctcaggtcactatgtatatttattcattttataagagactgtttacattgagattgcctccattaaaacatgagaaagcaatctgcatagcttatagtatagtagcaatgttaaggctctggaattaaaaacaggtgggtttcaattcctttccatcacttaccagctacataacttggtcatgctacttaacttcctctaaaaatacagatagtatgagcacttactaacttgttaagattaaaaatgtatatagaaccagctgagcaaagtgacacatacacagaaagcactcaatgcacattagatagcataataaatattatcacatgtagagctatcagttcttaggtggcaaaattcaatccacaacagaaaattctagtgaaggcatagtgtcctaaaacagaggttccactggatgagaaagatttgtggaatgaagagctactgaggcctgcatctccatgtacatataaaaccctaaacatctgtctcatccagtcatttcattcattccacaggccctaagaattatcctacctacttcactttccatcaccataaattgcttttcaatgaacagttttttttctgccctagtcatatgagaaacaagatgcagtataatagcaattcttcagttaaagaaggaactggaatgaaatttattctaatgttggagaatggctgatgcatttaaacattctgtgacaggaactaggggagggccactgaggtaagacatggcatgagaaggagaacttgaaataaaagagagaaagaagtttgcgaccagcctgaccaacagggagaaaccgctgtctctactaaaaatacaaaattagccgggtgtggtggctcacacctgcagtcctagcactttgggaagctgaggtgggcagatcacctgaggtcaggagtttgagaccagcctggccaacatggtgaaacaccatcgctactaaaaatataaaattagccaggtgtgattgctggcgcctgaatcccagctattcgggaggctgaggcaggagaatcgcttgaacctgggaggcggaggttgcagtgagccgagatcgcgccattgcactctagcctgggcaacaagagtgaaactgtctcaaaaaaaaagagagagaaagaaaaggaaatggggactgtctaataggggctgggaaacaacagaaagaaaggcagctataaggttttatccttttataacatcaggagccaccctaatccagtaatgggaccaggagagaagtcacataaggaactttaggggctgatgaccccagaaaaagttgtatatgtggtgtccccttcacccctataaaaaactaaagtttccgtaatagagattcaaggctttatgacaactcatgctttgataagtcaggacctaccaccactaagtaaggcatttaaggtgaagaacatgttaagagtgttaagaacactaccacatttttacggctcaaggaaaattatagtctgaaaacaatctttgtgtacaaatcagataatcctgtcatcatacctgtaccatcaaaactgctatctggtaaaattaatgatttgtttcttttctttatcttctttcctttttctgtagtactctcagcttcatggatacactccacattaaaccacagggaaacactgaaaccttctgataggtgtggccagcagttttgccccagcaacggcaggtggactggggctatgtgccaagatgaaagcagccgatggggaaaactctctctatcagcctctttcttgctccgtgaaactcgtgctcttctcaataaacccatggccttactgtttaaaatcccaggatacttttgtgatgaaacaccgttgcttaaatttggagcgtgcagtaaagggaaggttagatactgtgaagggctcatagtagtatcactttcaataattttcagaatacccagaagaagaattttctagagaaaaagaaaaacaaatgaaactttctaatcacgtaataaagtacataataatcttgaaatttaggttataaatgaaaatacaaacatacccacacatatcagcattcctatttaaataccttcctatctcccacatctttaaaactttcattttctcgtagctgagataaaatatgaaacagatttcattcttttttttttaagacagagtctcactctgttgcccaggctggagtgcagttgcacaatctcggctcactgcaacctccgcctcccaggttcaggcgattctcctgcctcagcctctggagtagctggcattacaggcacccaccaccacccccagctaatttttgtatttttagtagagacgaggtttcatcatgttggccaggctagtcttgcactcctgacctcaggtgatccacccacctcggcctcccaaagtgctgggattacaggcgtgagtcaccatgcccagccttcattcttaaaatatgtaatcttttgtggttaatttgtttcatgtttagatttttttttttttttgagatgcagtttagctcttgttgcccaggctggagtgcaatggcatgatctcagctcactgcaacctttgcctcctgggttcaagcaattctcctgcctcagcctcctgagtagctgggattacaggtgcatgccaccaagcccagctaatttttgtatttttagtagagacggggtttcatcatattggtcaggctggtctcgaacacctgacctcaggtgatctgcccacctaggcctcacaaagtgctgggattacaggtatgagccatggcgccctgccttagatgttctctggaacatccaatcccactacaaagtagctccaaagttttctgtcttatttgcttatgcttctagtcaaggtttcattataaaaatgggtttcctagcagataatagtttaaaagacactaagccacaccaatggaaaggggaagcatagacaataattgaagagtatagtggataataaccttttgaaaaggataatccctaagatggttgtaactattcataattaagttctctttagtaattaaaattattcagcttttctgaagcacaaaaactggggatggggtgggtaaagaaaatataatctcagcgatatgtctggttaatccaaattgaagtgaaatggttaaaatatatgcaaataattgagtatttcacacataataacatgaaattgcctataccaactgtcacatcaaaagaaagagcttagtaacatttctaaataattaaaaatacattctattaaaaattgtaagtgaaagaatttatcagtgaaaaatgtaaaaattatagcatatttactgtacaaggagatttctccagaaatattctcaaaagaagggttagctcttctgaacatgttcttgaactcatcaaagataccaaaagatccaccaatactctctggcatgctaaattaaagaaagagggaaaaaattaaagctagtacacaattagaggaataaatgagcaatttcaccaaaagaggtaaaatactattgtcactttttgaatggattataaaaaatctagtataggaatcacaaaatttgctgaagaaatagcaatataactaaatgtaaatcaaccaaccaacaaaaacaacaaaaaccacttttctttttattatttttattattattattattttagacagaggctcgctctgtcacccaggctggagtgcaatggcatgatctcggctcactgcaacctccacctcccaggttcaagcaattctcctgcctcagcctcccgaggagctgggactacaggcacgtgtcaccatgcccaggtaatttttgtatttttagaagagacggggtttcaccatgttggccaggctggtctcgaactcctgacctcaggtgatccacctgcctcggcctcccaaagttcagggattacaggtgtgagctaccatgtctggccagcatgagctcacttttcttgaagattaattagctacaagtaaactaagggcattctttaaagaaacataaatcaatataatatttgttaagctaatgcttctatatcataaaatagtctgctatcttatcttgaaaatgtttaaattatatctatcactttttaagtacgaaattagatgacaagtagtggaaatattaaagatgatttaaatacttaaataccacaaactatttagtttgaacattttctttattccatcataggtttagcataaaacataaatggtgatatacaaattcatagaattctttggagcaaaataataactaatatttgtagagcaaattatagtgttcaaagtatttttacatgctttatttcagctgatcctcaccaaaaacaaaaaaccctagaaaataaatattatctccactttgacctgaaagaaataatcttgatttaaaacctgagataagttttaaaagactggtagttttggaagacctggagtttagagaatagaagccatatttaagcaacatattttgtagaagcaatgagttgacacagtagcaaaatagtacatacatctggagagactacttgcaatgagactataaaatagcatggactttatcctgtacataacatgaatccattaaaggtttttaagtaggaaaataatatgatcagtgtgtgtgcttactttttttttccagttcaaaactgagaggttccagttaaaaatggggaaatggatatatacacttgcttctgtgtactactgaaaactcatagcattaaagtacagaattataagaaggaagaaatccgtaacagcaaaaatatgtgggggcagtgggcattggggcacatctagtaagagatttaaaaatatttcttgaagatggaaaagtagatgtataagagaaagctgcaacctagaattcctttgaattacaaagaggttcagagcagtaagaagccgagctgtccatctaaggtctggagagaaagtgacagtgcggccgacaatacagggattaacgaaaggtctgtctgtgaatatccacctctctcctgtttctcagtacagagcacagatagttcagtattcacttttaggtcccaaacctgataactcttctctaaataaacgaaatggtcaggtgtatacaggcttttagcatcatggctactgagtgtaactgtacagtctgcagactgaacaaactgcctaaccaaagggaaaagtagagactaaaataaagtctgaatgctgtatgccaagccatgcatcctggttttgggctgtgatgcctggatcaagaaagggatgccttttttctcagtgcaaagacactatacgccagccaagccctatatgtgaaagatgcatttttctaaggtatgcaaactgccatgtagggtaatagtatccctaatggtcccccaaagcaaagctctcttcattagggtgtttgggaagcccctaatcatccaatggcacattcacacagagctcttccacatactacccactcaggaaagaggccaaaatagaaaacaaattcactttcacaatattagaggaaatctccaacagttttattaaatataaatggtctaaaaaggttcataaaaatattagagaattagcaacctaaatcagtaaaaataatatttaaaaaacaaaaaaacagacaaaactgaccccagaggaaaaagagataatttggggacagaagaaactttaagatgtttattactataatcaaatatatacaaggagatattatatccttatatgaaaaagaaataaccagaaaacaatcaaaaaagagctcttaaatattaaaattaccgaaataaaaaattaaataaaaggttgggattgaaaaaatgtctcaaaatgtagcacaaaaacagtgatgtagtcaatatgacaggaaagataatcttatctttgcaagatcaattgggaggctcaagataacaattagaatacaaaaaaagaggagggaatatggagaggagaaacttattttttaaaataataaatctttataatcctgtattagatctaagatatgacactaaaagcaaagcaatgaaagatagaatagacaaataggacttcataaaaatcttttaaaacatgcttcaaagtaaaccatcaagaaagttaagaaacagcataaagaatgggagaaaatatttgcaaaccacatatctgatgaggaacttgcatctagaatacataaaaaaaacctcttactattcaataatcaaaacatgaatcaccagtataaaaatggctgaaggatttggataggcatttctctgaagaaatccaaagaaaatacgcaaatagctaaaaagcacactgctatggtgtaaatatctgtcccctccaaaactcaagttgaaatttggttgccattgtggtagtgttaagagatgggatctttgggaggtgactgggtcatgaggagtctgccctcatgggtgtgattcatgcccttatgaaagggggagttcagcccccttttgcctctcttcctttctgcattttgccatgtgaggatgcagcaagaagacccttgccagatgctggcactttgatcttggactttcagtctccagaactgtgagaaaataaatttctgttcattacaaatcactcagtctgtggtattccattatatcagcacaaatgggactaaggcacacacaaaggtatacttaatacattagccttcaggggaatacaaatcaaaaccacaatgagataccacttcatatccaccaggatagatataattaaaaaggcatataataacaagtgttggcaagaatgtgaagaaattagaacccttatacactgatggtaagaatataaaatggtatagccattttggacaacagtctgtcaatttctcaaatgattaaacacagagttaccatatgacacaaaataaatgactcgagaaatgaaaacatatgttcacacaaaaaattgtacatgagtgttcacagcagcattatacatagtagcaaaaaaggagaacaacccaaatgtccatcaactgatgaatggataaatcaaatgcagtatatccacacaatggaatgttatttcagccaaaaaagaaaagaagcagggaaggggaaaagtaactttacagtggagagacctgacaaacactacttaatgcaagtgatcaaggtcaacatcaacaattataaatcatgttgacaatatgtacccttgatatgatttaatgacaatggcactttgtttctattatcttcctctcaaaagtccatacccctagcataatcatgacttttgacaaaggtgccaaaaccattcaatgggggagggacagtctcttcaacaaacgatgctgagaaaattggatattcacacgcaaaataataataataattataaagttgggtccttacctaacaccgtatacaaaatttaactcaaaatgaattcaggatctaaatgtaaaactatatatacctaagaataaaacttacggggaacattccataatattggatttgtcaatgatttcttagatatgacaccaaaggtacagcaaactaaataaaaaaatagataaattggacttcaaaatgaaaaacttttgtgcatcaaaggatactatcaacaagtaaaaacacaacctacagaatgggagaaaatattaacatatcacatatctgataagaaatcaatatccagaatatatagagaactcttaaacctcaacaacaaaaaaagaaacaacctaattcaaacataagcagagggcttgaatagatatttcttcaaacaagatatacgaatggccaataagtacatgaaaagaggttcaacatcactaatcattagggaaatacaaatcaaaatcacaagatagcacaatgagaaaaatgtcaaacaaattctgatacagggacattctgaccagtacccctcaaaactgtcaaggctaacaaaaacaaggaaagtctgagaaactgttacagtcaagaggtacctaagaagacatgacaactaactattatgtagtattatcctggataaaatccttgaacagaaaaaggacattaagtaaaaatttaagaaatctgaattatggacttcagttaataataacatatcaatataagttcattaattataatacatatatcataaaaaattagatgttaataatagggaaaactggcagggaggggtgtaatgggggaactctttataatatctgttcaatttctctgtaaatctaaagctgttctaaaaaataaagtctattaataaaaactgaaggagaattgcttaacctgggaggtggaggttgcagtgagctgagatcgcaccactgcactccagccttggcgacaagggcaaaaccctgtcataaaaaaaaaaaaaaaaaaaaaaaaaaaaaaaaaaaaaacactgaaaaaaggaatctatgcaaagtaaaaaatttaaaaaatgattagaaagagaactaaagtgctgaaacatgctacaacatgaatgaaggttgaaagcatcatgctatgtgaaagaaaccagtcacaaaagaccacatattccatttatatgaaaaatatccagaaaaggaagtagatgagtgattgccaggggcagaagaatccgtgcaggggagggttaaggtgcaataggcaataaatgctaaagggtacagggtttcttttgggggtgatgaaaatgttctaaaattaattgtggtcatggttgcacagctctgtaaataaactgcctactacaaaacactgaactatacactttaaataggtgaatgttatggtatgggaattatatcccaataaacctgtcattaaataatggcatataatttctcagagttaaaaacacatattcagatcacaagggttcactaagtgtctagcaaaataataaaaatacacccatatactaaataagtaaatgaatgagaagagaaagcttttccttacagtacaatctcagttaataaatgaaggaatgatggaaacagaaaatcactatttggcagataccacagaattaactgttccagtcaagaatcatcatactttcatatttttttcataatactaaaattagtggatgaaagaatgagaaaaagtacatttacatagtctcaagttatctccccacaagatacttattaattataaagggaaaatagtaactttacaatagagaaacttggcaaacacctccttaaccacatgatcaaagttaacatcaccagtagtaagatccagatatcataagtccttttgatatgatgcactcaaaaggacccaatatcacttctgagtattcctgacaaaaacgtataacctgaatttaatcatgagaaaacatcatacaaaccaaaattaaagtctcgtgtaggctagccttaattctccaactaaaatttagatttcttgtgattagcaatcatattatacattcattatgaatttctcaaatgtctgagaagtaccaagtacagattaatcaataccagatatggcaacaacatggcattagactgggttacagtccccactatgccacttctttgtataagaccctgaacaactcaaccccttggaatctagattttcctctctataaacatacttgcactctggctatttcattgtgtggatctgaggaacaaacgagataatgcatataaagacacttttttgaaatcacagagcactatgccaatggaagccttttttttttttttttttttttttttttttttttttttttttttttgagacagggtcttgctctgtcacccagactggagtgcagtggcatgatcatggctcactgcagccttggcctcctgggcctaagcgatcctcccacctcagcctcccaagtagctaggaccacagacatgcaccaccacacctggctaatttttatagagacaggtctctctatattgcccaggctggtattgaactcccaggctcaagtgatccgcctgccacctcagcctcccaaagtgctaagatcacaggcatgagccaccacacctggccagaagccattattatcaacttttcacataaaataatttcagagctattgtttaaaacagtttcaacttaccttgaaaatcagaatcatcctgtgttaaaatactcaagaaccctcctaaaagatttttcacagttccctgaagattaaaaaaaatacaaaattaaattacttacctcacagaagcatgaaacaactgcaatgtcataataaattctatgatagggtatctactatatatgtatatatgtatttaaaaatgactaaaaagactactatgtgtaggattatactaattttcattttctttttatactgattgatttttcaaaacagcgagcatgtattaaaattaaatgcatttttaaaaatattacccagtctcagaaatagatgaggatttactactggctagcaaaggacattaattttctatgctactttagaaaactatggaattagaagattttggaataccacttgtaggtattcacctgaggtaccagaaaagataagtaatcatctcaaataattttcagaaaagctgggttatacataaggagatgttattgggtgatgagtctgataaatattgatcacatttaactaaatgaattttttacctgttgcatgagcagaaaaacattcttttctttctgcctaataattttcaaaaaactctcaaatacatgggcaagcacatcaagtttggctttactagcagaaagcaaatttaattccagcatacaaatctcaggataaattatttccccttgagtgaggttttcgagtaagtcatttggactgcttgatgcactgaaaccttctgtttcagactttaagtctacccctgaaaagagaaaagcgaaagattacttgtattccctaaacactaaatatttcaaacttcattaatcatttagaagatctagtggcaaaaatagtaattcagaggatgcttacaaaaccttttccaatcttttcctataacacaacttttgacaatgatatggaaattttgaagattaatgagttcccttaaaagcaattttcatcttcaatagaactacaaattttacaaataagaatttttacagacatatgatagagatttaacacatcccatggacacaactttaaaaaaaaaaaacctattcaaactttctgacccccccctcaaatacctaaatcacagagcagttcaatttgcctacccaaatctttgtgaaaatagtaggcttgactagtggttggaagaatgatcaattttgccttcttcataagtgagaaacagactctgtcttattgaatattgcattttggaaaatttgacttatatgatcttttaagactgctgtgctcttaataaaatgttgatacagttaagaaatttataaatttctacctagatcagaattctttaagttgagatctacttagcaaacataaaaaaggaggaaatccaaaattataaagtcaaatctgtactatggtaagctgtactataaaaaaattaataaaccaatattttttcaaaaagcaccagtcatgggtccatcaagccctttaagtaagatatcagtgattattcccattcactagatgagagcgagaaaactgactgtgaggaagatatcctactgagaactcagtgaagactagcagtggctgggtgcggtggctcacgcctgtaatcccagcactttgggaggccgaggcgggtggatcacgaagtcaggagttcgagactagcctgggcaacatggtgaaaccccatctctactaaaaatataacaattagctgggcatggtggcgggctcctgaaatcctagctacttgggaggcagaggtagaagaatagcttgaacctgggagatggaggttgcagtgagtcgagatcacgccactgcactctagcctgggcgacagagcaagactccatttcaaaaaaaaaaaaaaaaaaaaaaaaaaactagcagtactgggacactcacaaggtcagcatataaaaagatggagtcttgccagaagtctcttggctctaatcaacccatcttttccattctactcattttaagtccaaagacaagggaggaaaggatcataggcaatatagttccatcctaaagacaaattgagctgtggtaaactaagaagaaatctatgcttggctgtcacagacaggtgtctgcattcctgtattatgtattctttataacaaactgcctgaatgctcttcctgccagtgtttgtctgcctagcttgttttcatttagtcctcaatgtaaacattgcctcttcagaaaggacttccctcaccacccagttactaatacgacatcacccagtttatcgatttctattttattatctatttctggtatttattgtctttcacactagaatatacatgaaattggggactctgtccttcactccatgttcttaaccactcagatgatgtttgtgataacaaactatatcacattgttgcatatatgaatgccagactgttgggaagatcaataaaaagattatgcaacacacttgttaaactgtaaggcaatacaaaattctaaagtggtattattatgaaccattttgctatttaatgatctggcttgcagatctaattacaagcacttcaatgatattttaccatcatcctgggtttcgccatcttcaggattgctttcactatctgcttcgtaaccttcttcttcaactaaaagtttaaaactacaacactgagaatcctcagcttcttctgaaaaatcaccaggctgggatgacaattcttctgcagattgatgactctataaatcagtgtaattcaaaggttgtaacatttgcttgtttttagtaatagaatacttattactcaaaagtcatgttaaggacagtttcaatattttcttgaagaaaaaaacttagtaaacaatatgaatcattataaattatgaaattcactcagcaaaatttcccagatcctttcagacaacttaatacctcaaaaagggggtttctaacaaagtaagttataggtcatttcagtttaataaataaatctatgtaagaaatttcattctagttatacaattggaaatgacaaaaaaccacaatgtggtaaaattttacttcatacaatttaatactaatatatattatttgtgcacatttgttaataaaaaagattttttcataaggatttttataaatgccttataagttaggtaactagagcagacaagacatttttttcaaagggattaattaaaagatctcagaatgcaactgtctacataacaagcatctcagaagtcaagagttccagtactaacttcctgtgtaagaaagaaattttccttttcttataaaaattccactaataccttcattttagaaaacattttcacttaaagaagctcagaatacttcatcattgtaacaacaataaaaggtagaataaagtaggtattttaacattttacagttagtcaattaattcagtaatatgatgaacgtattcatagctatttcagcatgtttttaagttatggcaaatagtaacataaaatgttatttcaaaaccttataaaacattatatatatggctagatcaaggagctaaaaggagaagttatataaaaaataaaggacagatggcaactaaaggtaaaataaacataaaatgagagggaaacaagccaattatgtaccacataattttaggaaagaaaattacaacagttgttttaggaaaaaatgttaaacaactaaaacactgtgactgctattttctatgtaggcactagtcatttttatgttgaatgatttaaaattaatgtgagtagagagttctggaaatattagctataccaccaaagaaccagataggataggtaaatcaccaccatccctgaattagcatttaatacactatcaggtatatgtaaaatataccaaatcaagtaatatatttctgtcttaactcgaagtaattctcagtaaatttccagattagataaggaaaagcttatcatatcactctcctgttatgtataagacagggcaatgacaaaatactgtccatcccatcacatatccatcacgaggagataagatccactgaactcatctgaccaagtcctagtccatatgctctaatgacattcatcagcgtcctagtgtcatcccacacttccgcctctgctggtcatacccaaagaacacaactatatgttgttattcataccttctcagtcatagcatcattatgttcaaaatctgctgaataattcccgagggcaactcgaagcagggcatcaaataaaggctttgctagttgtgtttcaatcacctttgactgggaaagatggtccctcatttcaaataatatactttccacagacaagttctaaggtaaaataaaagagactaagaatattaataaccattttaaaaaactaaatgatgaaaaaataaataataaatatttacttaagtataaagctaatccatttatttgcagttgatatgaaagcaaaatgactatataaatatctagctctatacaaacatcctgttaaaattaataacatttttattgataaaatacttagttcatcttatttggttttcattgcagcatggtaaagaatggcaagaaatgaagctaagcgaagaagtcaaagcaagactgaagagttttgtgtgctgtgttaaagcttgtgaatttcaattgtggaaattcagtgtggaagcatcaggattttttagagataaggcaacatggaggctggaactgaagtaggaagagcctgttggctgactgaacagttaggtgtaagttagtgaggacagaagaggtctgccatattccaggtccctagattcctttttagttgagaaatgatctcaggagaaaacttgtaagaatgtgaggtaaagcagaagaggttaggagaagaatctggacaaagatgtggttttaggagaagtctcgtcccagcctcatttcctgggaagctctggagcctgaagtgccccacaatgattgtccccacttcttagagccacatctatcagcattagctatgagcatccttcccaggcatcttccatcggtcaagggtgattcctggaagatgggtgctgatgcgcagatggtgaatgggtgatcagtttggtaaaggagttctgggcagggcagccaacagtatcacacaaaaatttagatctttcaactttgaaacacaatatccattattattcatctgacacttataaaatgtgtgtgtgtgtatgtgtatatatacataaaacataatatatacacatatataaaagtaatatattatatgttatatataacacaataatatatatattacatatattatgtaatacatattacattttttatatatatatgtgtgtgtgtatatatatgtatatatattacataagagttggactaaggacaaggtattacctgattaggtaactccaattccatcttctgttgactagttctggcaccatgaagacaaatggccagaagggcttccaaaagtcgtatactttgaagtgaggtctcactttcttgacttgtaaatagctttgcttcctcgggagcggcttcagtagctgaaacttcttccacatttatggaagaaatatgctgtaactctaatttacctaaactgtcagcactcttttttagactacctagttctgatggtatggggtcactttttatagccaaagataataaatcttccttcatagttctcttaggttgagaaattctgtttaaatcctggttttcatttacacttgtatctccctccttttttccttgctcctctttgtgacttctgaacagtttctgtattatcataaatattaacttatggcatactcggaaaccaccaagcctataaaactgtttctggaacactgaactcaacatgtagatccaacgacacatagaccaaatgtctgctgcttggtgcatatgttcaggagaaggcaagacaaggctctcgagagatatacatggcagcatatgacttaaaggctcgctggctgtgctgtcatagccagaagtatcttctgagtcattggccgactccctgtcagactctgcttctttacttacgcataaaaaagccacacagaggaataggtttattgtgttgatatgaacatcttggttaacagtcttccgtctctttggataagcttctttgaggccagcataaaatttgctgagactctgaggagaatctgaataagcttgctgatgatgaaaagaagtacccacatgtacagaggacaactccttctgttcaatgtctatcccatcaatatctggaactgaggcatctttctgttgctcccctaggctgattatcagagtttcaaatgcttttagagaatgacttcgaataccatttaagcaatttaattcgattatttgacttactccattacaactcaaaaacaaatctcttattaccctgtgaaagaaaaaaagcatgtaaaaaggtttaaataaagaaacatcatttataaataggtacatataatatttaatatatcgctattgcatgtgggatatactaaccactacctaattttattcatcaattatcaggctaaagttcttagttagatataattaggacctcaagttactttctaattactctgatatccttcttcaaacatttgtatatatggctccagcagtatctaaaaagaaaagattgcctgtcccacattaaatgaagcaattcagggaagaatatttttctccaaatggcaaattctatataaattctgaacaccacagccaccaccacacctgaggtggacaccctgagggcaggcaagcacgtgtttgttcattagtttgtccgcctgatggttcacttgggaatttttgtttactttaaatctataccttatgaagggaaagaatcacactagagctgaaaatctacggaaggctcagcatcacatgaatttcccttctaattgggctaattgaacagtcaatggtacaaatattataaaagtttttcagctctgtctcaggtgagacttgtgtctagatcattggaatcctagtaataactttaatataagccagctaggtgattctcagccctttcatcacaaagattcaggttgtccacgaatacgccaaagagttacaaaactttcaaatcagtcagttctagttaaacaatgccaaaatgtcagaaaaatttttaaatgactgtaaggcattgatttaacatcaataatagttttaaagtagttgtgctaagattgaccaaaaaatgccacacacgaagatattgataggttatttttgtataagtttctaaaatggtatatgcattaatttgaaagaccagtctacccattcgtttataaaattatttttaaatgcaccagatttggcaatcacaaagtctggaaaactcactgataggattaaaagtaattttaatattcttatttttgtttatctatattttctaatttttctacatatattgcagaggttataaatgtaaatataatattttaaaattaataatcccattagtgcctctgcctcaataatcattttatgtattattttacatgtaatacatattttacatagttgtaaataagtgaacactattttaattgtttatattttacccataagatattataatcattttctcatattccaatatgatctttgtaaacattttcaatggccaataatattctatcaaggaaatataaagtaattaaacttgccctgctcttggatatctgtgtttcatctacgtttttctcagttgtatatctaaaacttttctttttgttgagaaattaaaatcaatggctgtatcctcttctctataaacagctcagtaaaaaatgcatacatacataaacaaatggttaaaacaaatctgacatggaaggagaacattttttgttgacaaattgaaattaaatcctaggaaagaataaagagtaaatacgatcacactgctgccaaagccctggagatatcagtgttagaagtttaaatgcatacaatttatcactcacttgaaagcatccaatgaaaaagatctagacatgctcaacaacccccgcccccgccgccacccacacacatacaaacctggatttaagcaggataggcagagtttttacataaatctgaagcacgtcctgaggcaagcactggttatgatggctacatacatgactttgagctgaagtaacgcttaggtgttgacaatgatgtgctaattcaactcctctttggagcacaggattaaatatgtaattatataatttccactgaacaactatattgcctttctggattaaattgcaaatgtgatttgcaatctgtatactatgtaatctgtcttcttcaaaaacaaagttctgataagcctttaaagcatcccatttccacaacaaatcttcagatccactgctgggcaggatcccttgaaatctgtaagaaggactggataaacttgaggagagttcagcatcacataagtttccctgcagtgtctcttctaattgggctagttggtcagagtcaacagtacaaatattacaagctgcttttttaatttttggtgatatctctgctcctcctaactgatccaaaataagtttgttaaggatattcaatatatgctgctgaaaatttttcagtgctggcaatttaaaagcatggagcaaaggaatgattacagatttgggatccatacaacagcatattccaatgttatgaacacccgataggatctggacacaagtgctgctcaaggaagcctgctgtagtaagcgcaagcactgatgggcacacactgcaatgcaacagcaccgctcaggataataaacatctccatctgcagtctcttcaaatgggtttttggaaacctggtttttaaaagccgaaaccagaagacctgagagatctcggtgatgatgcataaaatgagaatattcacatcgtctgtgcctttttcttgtacacatcgaatgatgaagttgctctgatttcacttttttgacagtgctcattattttcatcacactatttattagggctttcaaatgctctgaggcctcgggaggaactccatctcttaaaaccagccattccatttgaagaactgctgtttcaaataaattaaatccatgatgctgaatgaattcttgaaccaaatccatggcttgactgaagtagaagggatttgaagctgcactttgaagacaacagatcagaatctgaagaactccttccaaaagctcaggtaaaagaagggctctatgacgatactttgaaaacacaaaatcttcctgaacctcctgcagtgttttcttttgtcttggtgcaaaagggtcaggctgcttttctaggcatattctaatttttaaagctgctctaagcaattcagttaaatttttcctaagattttctggcatcatctctgcagtactaacatctactgacagaagatgcaacactgttcgaaagagcatcctttgaatcaaagccaccggttcttcggtccaacctgcagaaactactcgactctccaagttgtcgctcagactgcagcagtccccaaagcctgctaggaattcagttagtgtgggcactacactggctgctaaaggagaattatgattcaaggtaacgtcaaacttacaaactttttctaataaagataacaaaacatgacataagtcaaatggagaattgttcatgttactgataacagacaaggcagctggctcacttaaaatgtcagtgtttgacccctgtcttggaataatctctctggaattttccaaagccatagcatctggaggagtctgttctttggttgctaagcggtcaagtttagctttggggtggtcttgtttaggaaacgatgttaaaaaatgatgcagcagatggggccttctatgcttattcattgctatgcctttttcatctgaattggcttctgaatctgaggtggagagctgtgtctttcttgcatctcttacagaatagcgatgggtaattttacgctgtcgtctgctttttcgaaaaacatttacttttgcagaaacctgactagacagggcacttccttctaaatgtaatttttcctgagtggatctttgtgaacttgagttcttttctttggtcaggattatatctgctgagagcggtaggttaaaatctaatggaatgaaaaaagaaggcttagaatacctcaatatgttttaaaactcaattttaaggtgacagccctcttatttatcttaaacccactaaaggagtttatcctcaatgtattttgctgcagggctgatttccttcatttatgtcatatctctgggttacctcctctcacacttatccttactctaaacactagctgacattagttcaaaggatacaaattgatttttaaaacaacaaaacagaggcacacctatacttactctaaacactagctgacattacttcaaaggatacaaactgatttttaaaacaacaaaagagaggctgggtgaggtggcttatgcctgtaatcccagcactttgggagactgaggcgggtgggatcacttgaggtcaagagtttgagaccagcctggccaacacggtgaaaccctgtctctagtaaaaatacaaaaattagtcagatgtggtggtgcacgcctgtaatcccagctacttgggagcctgaggcaggagaatctcttgaacctgggaggcagaggttgcagtgagatgagatcgtgccactgcactccagcccaggtgacagagtgagactctgtctcaaaacaacaacaacaaacaaaagagaacagagttaagaaagtaaatctgatttaaaactatatattatattctaacttcaacataagagatgctgtagattatctggtatttagtgctgttgttcacaccatttacaaatctcttcccatagtaccactaattaaaatgtaaggatgtattatattctcaaaaatagtattcatagacctgatataatttaactactttaagatttttctaaaattatttcaaaatcatacactatatgccaaatgttctctaaaactgaggtttaaataattctttattcaaattatttctcaaatgtttcagcactgaactaggcaccaggtatagacactattatttcatccccggtgcctagatagggcctggcgtatggtcaacactcagtaaatacttcacaggggaaatgaatgaattctccctttaactaaaaagataattagatcagtctttctctttgcagtatgtagtaagagctatataaaaaagtagctgtaatttagagtgaataaattaaaatctgtaaataaaaaaatctgtgctttactaagacagggaaagcaaaccagatgggaagaggagaaattaaaaggagtctgacaaattccacccaagcaaaagatgcagacaatgaagacaacttcccccaaagagcattaatcagatttcttaagtgattaacaatttgtgaattctgcaaactcagaaaaaaataaaagcagagagttagtgaatcaataaataagcagaaaaacagtattacaaaaccttagatacctccttaaaaaaagctccatgaaattcactaaaaatacaggaattaaaatacaataattttttttttaacctgagagatcttcaaacatctcacaaacatgtcacaagaaagggtcaagaggaaaactattaatctctccaatgaaacatttaaagtttcatgtactttatagacatatgatttcttcaaaatcataaattaaaaatatctatcgaccttacatagaataattctacccaagcttgaaacaaaatattaaatatatcctttaggctgggcacggtggctcatgcctgtaatcccagcactttgggaggctgtggtgggcagattacttgaggtcaggagtttgagaccagcctggccaacatggtgaaatcccatctgtatgtactaaaatgcaaaaattagtctggcatggtggtgcacgactgtaatcccatctactcaggaggctgaggcacaagaattgcttgaactcgggaggctgaggttgcagtgagccgagatcactccactgccctccaacctgggtgacagagtgagactctgcctaaaaaaaaaaaaaaaaaattatactttaaaggcaacactagaaaaactaagctaaaacaaatactgcaaaagtcacttatagaatactggtaatagaaagcagtctttaaaataagcaaagaaactttaatttctttattcagacttttcacttccaacttttcactatccatttttctgatgttatgctgcacacctagactcactccttctgataagtgtttctgcttctttatacattttctaatcatcagtacattcaagtacttcccccaagaagcaccatggtttttgtattattgaaggaaaaatgtgtttgcctaaataatttttcatatttagtatgaataaatcacaataacatatagtgttctgaatctgaatcagaatcaaacattcaggcagaagtaacttttctatgaaattttgataacacaagtgatatgataaagggaaaaagcatacctgttgccttttcttcttggacaggtatcttccataccagtggaaggagagacagaagaagagtcaggagttcttctctacatgtcaatgcctatgtcagtaacaaaagaatccttcatgttctaaggcgataagacacatcagttcctaatgtcttgtcttaaactgaaccaaaaaatcctttttcttgaaagtctgcatttgaaaagctaagaatcaaattaacctatcttcaatccagttaaagctgtgatacttttaagtttataagcctttctaatgatagaagaatctaagagtatttgacagtatttagcacactcctgctgatatttccaaaaatagctgttattaccaccatgcacattgcaagaattccttacctatgaagaaacagatttgctaggtgaaaatgaaaagttaagccctattaattagcaaagcaatgctacaaagttactagaaaaatgtgaagccttcatgcagttaaatgaaaaactcagagacgattttaaaagagaaattgacattattaataaataatatataaggagagaaagacttattagtgaatgtaatccaataaatatttattgactgcatactatgtccacaaaaatactgtcttaccctttctggaggatatggtccaagccctggagaaggtcccctcatttggtccataaaatacatacacataaacagttaaagaacagcagaaggcatgtagtatgagtaagtatccaggggtggtagaagcattcagtttaggagttcagaaaaaggagcagtcattatcagaagtatggaaggagaatgggagctagagagctagacctgggacacctgggacatgggtagtaaaggatttaacgacaaatcaagtttgagttctcgccttacaccaatcagtgggagagggggtcgcatgatgacacaatcagatttgctgaacagaattagttggaaggggaagcagtgttagaggcagggtaacaataatccagatgagagagatgatgactttctgaagtactccaacaacagaagggaaaaggagacatatttgagaaactgtaaggtagaactaaaataacttgcagttgattatctatggcacataagggagaaaagaaaagatctaaaaggacccacaggttactggtttcagcatctaggtagctgataatgtattcaccaagacaggaaatttacaagtggtattaggttgggataaagatgatggattcacttttcagacatatggagtctgagacgtctatgcactatcctaatgaagacagctttttagtagacagtaaatatatagatctggaacttaaaaaaatatgaagtaaataacaagatttaggagtaattggggtggaaggcaagaagatatgtgaattttcccagggtgagaatatagaatgacaatagaagaccatcaagaatgaaactccggactttaaagacttaaagatgggcaatgctaaagaaaaggctgaaaaggcttctattgaaaaatagccccaagaaagagaagtacaaccagagaaaccaaggaagagaccagttcaggaaagaaaggagtcagcagggccaaagctgttgccctttcactgtgtgacatgatggccgaaaagcatttagtaactggaatgccccttaactaacggctttaatggagtgatttgactgcaactccaattacaataggctgaggagtcaaaggaagtgagaaagtaaagacaggacattcagactactccttctggtgtcctggttgtgaaaaggctcagaattcttcaaaaaaggggtttagtaaaatctaaacccctttttaggtatagaaaacccttcacggcaatgattcctgttgagctgtccagtgtcagctccctctgccacacatgagccctccgcatacatctagctggtaaaggtttcccctgaaaactactggtctctgtgctcccaataggtcttcctcacatacactgtttctgcaattctccatccccatcctcccatctgccaaactgcaactcattctctaggtttttagttcctctgtggggagacttctctaacaccctacctgcttcccttagtaaacttagctttcatgttcctgatttgcttccattccagcaaacaccctgctgaagtgttactgtctgaatgcccattttcctcttttatccgttaaacaaatatttcttgatccccctactaaacaggccaggcactgtgtcaggtacttcaaatgctgtagtgaacacaatatccatatcctcatgaagcctacttcctagcacaggagacagaaaataatgggtaaaaataagaaaatttcagatataatgttgtgctatgaaggaaattatctaggaaagagattacagagtgacaaaaagggtaacattttagacaggctatttaggatgggctatttgagcagatacttaattgatgagaagaaggaatccatgaaaagatttggaggaaaagggctcctagcaagtatatgaagtgctgggaatgggtttggctttttcatagaaagcaagacagctcaaaagctcctagatctgataaataacttcagcaaagtcttaggctacaaaatcaatgtacagaaatcagtggcatttccatacatcgacaacacccaagctgaggggcaaaccaagaacacaatctcattcacaacagtcacagaaagaataaaatacctaggaatacagctaaccaggaaggtgaaagatttctacaatgagaattacaaaacattgctgaaagaaatcagagatgacacaaacaaatggagaaacattccacattcatgaatagaaagaaacaatattgttaaaatggggccgggcgcggtggctcacgcctgtaatcccaacactttgggaggctgaggcgggcagatcacaaggtcaagagatcgagaccatcccggccaactggtgaaaccccatctctactaaaaatacaaaaattagctgggcgtgggggtgcatgcctgtattcctagccactcaggaggttgaggcagaagaatcacttgaacccgggaggaggaagatgcagtgagccaagatcacaccactgcactccagcctggcaacaaagtgagactccatctcaaaaaaaaaaaaaaaaaaaaaaaaaaaaaaaggctgggcatggtggctcacacctgtaatcccagcactttgggaggccaaggcaggtagatcacaaggtcaggcgattgagaccatcctggcaaacatggtgaaactccaactctactaaaaatacaaaaaattagccaggcatgatgccatgtgcctgtagtcccagctactcgggagctgaggcaggagaatcacttgaacctgagaggcggaggttgcagtgagccgagatcacaccactgcactccagcctgggtgacagagaaagactccgtcaaaaaaaaaaataaataaataaaaaataaaaataaaaaaaaaaagccatactgcccaaagcaatttacagattcaatgctattccaaactaccaatgacattcttcaaagaattagaaaaagctattctaaaattcatatggaataagaaaagactctgaatagccaaagcaatcctatacaaaaagaacaaagctagaggcatcacattacttgacttcaaactactctatgaggctacagtaactaaagcagcacagtactggtacaaaaacagacacagagaccgatggaacagaataaagagcccagaaataaagctgcacacctataaccatctggaatataacctaagaaataccatcctggacataggccctggcaaaggtttcatgacgaaggatgccaaaagcaatcacaatgaaaacaaaaattgacaaatgggacttaattaaagagcttctgcacagcaaaggaaactatcaacagagtaaacagcctacagagtgggagaaaatatttgcaaaccatgtatctgacaaaggtctaatatacagaatctataatgaacttcaacaactttataagtaaaagacaaatggccctattaaaaagcggccaaaggacacgaacagacacttttcaaaagaagacatacatgcgccaacaagcatatgaaaaaatgctcaacatcactaccaattagagaaatgcaaatcaaaaccacaatgagataccatctcacaccagtcaggatggctattaaaaatgaaaaaaagaaaaaaaaaacatgctggtgaggttgtggagaaaagagaacacttatacaacgctggtgggaacgtaagttagttcagctattgtggaaagcaaattggcaatttcccaaagaacttaaaacagaactaccattcaacccagcaatcccattattgggtatatacccaaaggaatataaaccattctaccataaagacaaacgtgtgcttatgttcaccacagcactattcacaataacaaatcaacctaaatacccatcaacggtagactggataaagaaaatgtggcacatatacatcatgaaatactgtgcagccacaaaaaagaatgagatcatgtcctttgtagcaatatggatggacgctgaggtcattatcctaggtgaactaacacagaaacagaaaccaaatactgcatgttctcactttataagtgggagctaaaccttgggtacacatggacacaaagaagggaacagccactggggcctctttcaggatggagggtgggagaagggtgaggatcaaaaaactatcgattgggtaccatgcttattacctgggtgatgaaatagtctgtacaccaaaccccatgacatgcaatctacctatataacaaacctgcaaatgcacccctgaacctaaaataaaagtaaaaaaaaaaatttgttaccacaaaaatgatctattcattaagagtttgaaggaatccactggcaatagaattgtcccttaagcccttgaaggagaaaatacgtaagttttacaatattttctgtgatgattttttgagatttatacacacatgtcaattttgcaatgtacatctttccagaaatttgtcatttcatgattatttttgtcacttcatgattataattaactttaatcatttcatgattattttcatgattattttaacttaggaattatatattacaactttttttaaaaaagaaagaaggagagtggctgaaacatacataccaagagggagagggctaggagacaaggctggagggtgtaggttggacaggtaggcagtgtcagatctaatgggcccttgtggaccacataaaggagttcaggtttatctctaaatatgatgggaaactttcccaaacatacttctcagtcttctctcagggcatggactccagggctcaggccctagtcctcagcaatcacccccttttctgccacccaacacctaacatggagttgggtattcaataaccattcactgcatgaatgactttaaattttagatgcaaaataaaacatataaaagggccccatttccatgtgctttacttccaaataataaaactaaagatgtacagataacatttccatgtatagctcatactcagtatacctcaacatttttaaagatgccaataaaaatgtacatggtcttttaaaaaaaaaaaagataaaccaatttttggcatatctttccggtagagtcctcctaatctgagtctttatctttggcaggtgaactaatagcattctaatggagcttgcagaaacctcaagggtctgagaaagtgctacggacacgctgtactgataattcagcccttgctccacatactggcaaatcaccactgctgcgtaaacaggcattcctgactcctggcagagctctgcatgacacaaggtccttcccactcagatgagggcttctcacctaccttcaaggctcagacccagcaacacctcttctgtggagcttctcctcccacacgaacccaagattgctgttctccccctcaagagaaaggaagaacattcctgttgcccccatttcaccaagtgagttagttcttgcaaaccatgggccttgaaagaatgagaatgaggcaagtgcagatgtttgggttttggcccctctgctggaattgtagtcctgaagagggcatcccacaccaccctgatgcccaatatagcactgggggaaacgagtctttccttcacatttcattaccacaatttcaaacacaattcatcattggggaagttctcttcaatcctctgggtgcattacttttttattaatatctgggtatcatttattcccagatttatcctctctggtcccaaagaaaccacatttgtaattctgtccttttagaagtgataaaatcctttactcttaatttgtgggcaccctggcaaattagaacttgcagccctctatttcaaaccaagatcttatctcccaagttttatctcccaaggtcctttgtacacacaatagtcacagaatccaggggaatgaggtgttccctcatgacatccaagtgggaagttcccaatgtgccatattagacaatatatgccatgaacaggtccattccctgctatttctagaccacccaatcaagagaaatcagccaataacataccactcttatttaatacttttattttgttttgttttgagatggagtctcactctgccacccagctggagtgcagtggcgtgatctcggctcactgcaagctctgcctcccaggttcacaccattctcctgcctcagcctcccaagtagctgggattacaagtgcctgccaccacgcccagctaatcttttcgtaattttagtagagatggggtatcaccgtgttagccaggatggtctcgatctcctgacctcgtgatccgccagcctcagcctcccaaagtgctgggattacaggcgtgagccaccgcgcccagccaatacttacatctttatgtcttcctttctacagggaaaataactgtgttacacctttataaaattccccatagaaacaacaaacagtaaagtaactttcattgaggtatttttccattcaagaaacatatttcaagtaccaacaaggtgccaggcactggcccttttcataactattgtttagactgggttttaaactaattgcctaacctagccattcagaagtagaagtggtgggatgggagtaaatgggcaagtgagtcaaaggggaaagggctgagatcacaaaccggactgatgtctaggaagctgcacaggcagatgggcaccagatggctagggttcaaggacttctggatgacatgataaggaacttggactctatccagaatgtgatggaaagctaataggtatttcttttcttttctttcttttttttttttgagacagggtttcactctgttacccaagctggacttcagtggcacaatcatggctcactgcaacctccactgcccaggctcaggcgatcctcccgccccagcctcccaagtagctgggactacaggcacgtgccaccacacctggttgatttttgtatttttttgtagagatggggttttgccatgttgcctaggctggccttgaactcctgggctcaagcaatctgtctgccttggcctctcaaagtgctaggattacaggggtgaaccaccacatccagcctaataggtatttctgatattacattaaatctgtatcttgacatgctaattaaatttgattttccatgcataagcaggaatatatgtgtatggactatttaagtcctttatttcttctatcagaattttataattatttctaatatatgtgtatatacacatatatgaaagtttctacattagtactacaaataggatctttctctttccttttcttttctagctgtatagctgcagctaaaaacaaacatctttgccttatactctacaactttgttgaaaagttttctggatgagttcttggatttttctgttcacattactttaaaaaatagtatttttatttctccatctttcccacatttagctttcatattccactttaccactacatgtatttaaaacataatatcaaatggaaatagtaataaagaattatgcttgtattggtcccacgtagaacttcttattaaaaatattattggcatctgagcatggtggctcatgcctacaatcccagcactttgggaggccaaggggggtggttgcttgagctcaggagcttgaaaacagtctgggcaacacggtgaaaccccatctgtacaaaaaatacaaaaattagctgggcatagtgatacatgcctgtaatcacagctatttgggaggctgaggtgggaggattgcttgcgcctgggaggcagaggttgcagagggctgagattgtgccaatgccctccagcctgcatgacagagtctttttttctgagaccctgcctcgaaaaagaaaaaaaaaattggttcttctaatctttgtatatgaaagaaatcctctattcgaagcttaatttgtttttagaccttttatcaaatgtttttgatgagtcaggatagttatatgtactgtttttcccagtgataaacattatgctaacagtttttcttgaattagaccaggaattgcaacctttttatataaagaaccagatagtaaatattttagacttggtgagtcatatatggtctctgttgcatattcttctgtttaacaaccctttaaaaatgcaaaaactattcttagcttgtacattgtacaaaacaagtcaatggcaacaggattggcctgtaggccgtagtttgctcagcctgctcccattctgccccacctcccctgcaggcaaagagtggttattaaatggccataatactctttgttaagactccagaaagacttaggtggtgcctagtacaccctatcacctagacaaaagtactactaggaatcttcaggggattgttctgcacaaagcagagagggctgtctcaaaggctattatagatgtggcttttgaggcatagagtgaaccccactaagattcacaggaaactcacaacattttaaagaaagttggttattaaaaaatactaacagcttggcctaaaagggataggatagagacagctcaaaatgaaaaaaggcctctgggcgcccactcttcaacaggcaggaagcagggtgagaaagctgtatattatgggctaattgttatagaaaagagaagacacctcatagggtggaaccaagagtcctggagaaacatggattagggaaccactcccacagaagataattatattcccagaccctagaacaggggccatgacaacatgtgctgactggatttcaggactgctatggccgagagatggctatgttcctctcctgtccctcttcttactacaattaacttactcctatctcattattgtatatagggcatatgcggagcagataacctgtctaattcacaagtttctcaatcaagaagagctgcaacaaaattactacatgtgaaagcctcatgtgtatccagaactgatgcataccatgagatcatcaattcaaccctgaggtcatgatggaataatatacttcaagaggcgtagaggggagtgagtgtaggaggaataataataattttggtcagagaagagaccatggtagcttaaacacagccacaaattaattgcagttcctcctatcaagtgatagagtctatttccccatcccttaaatctgagctcaacttgtgactagctttgaccaatacaatgtgatcaacatgttgttatgtgacttcttgcagcttctgcaccctcttggaatgtttccactatcatgtaaagaagctgagtctagcctactgaaagatgagaagccatgtggatgagaactgaggctggccaacagccccacccaatagccctcagttaatctgctaactgactgcaaactcagatgtaagaccagctgatacctcaaggagccaaagtggctattccagctgagccatgccagaactgccaactcaacagaatcatgagcaaagaaatcattgttttatgccactaagttttggaacatggtctgttacaccacaatcaactgatatattcattgcttcaatcagtctgggtggataattgggggattaattaaaacgggaataattcaatgaattatctactctccatggatagcaccactgtcgagtggttaagatttccactgtgatcacactctcactactccaagaagtaggaatgccaacatcccctacatcctctcattcctgtcagaccaatcatgcatagatagaactaggtttgtgtgtgaacagaaactgcagaactagatatagtaaattaatgctcatttattattacctttactatatttaaaagtttgcattattctcctattgaaacaactcttgccaattttaccattaactcacttgtcaaatctgaagaataattctcattgcctattcccttgctttaaaatttccccaatgttttcagaataaaattaagacttcttaacatggtatacaaggcttgccatgtcatggcctctgcccttcaggtctccccattagccaatccccgttttaccaaaagcaaagcaaagttcagccttcgctgtaacttcactaaactacttgtagttcattgaatgtgctgtgttttctctagcccccgtgttttttcatgtgcaattcttctggtctggtgtttcctgcctctttacatcgccaattcctacttagggatgtcaatatctaagaagcagttcctgatgacccctctccactacattcaccaaatactttttacactgttttgtcatcatttatttacctatctcttcaaaagcgaagagctcctggtaaagacagtcgctgtcctttcatctccgcatctagcagaggtgctgggccatagtaggtacttaatggtctgctgagtaaagcagtgaataaactgtagccacacttctaaaggtctgatattgttctatttattttatatatcactacaggtagcccatttcagcagtactatacattgaagtgataatactacaaaaatgtaggaagaataaagtactctcctacatagaaaatagccaaagatttttaaaaacctattataatgtttgaattatattttgttcataaatgtacaaccctctttggtaaaacttcacattttactcagcaacataagtaacaactttataaaacatccacagagtgcaataggtatggaaattatgtatcactgaaattttaaaaagtagtatttataacacatgttcatgtatactagtccaattttgatatatatgttggcaatagggcatagaagaaaccagaagccattattttcaaatattacacagagacaatttttatactggaaggatcccttaagtcatccagctgaatgtccttatgttactgatgaggacactgtgctctggagcaattaagtgactaaagtcactcatctagttgatacgggtgccaagattaaaagcaaagataggctgggcatggtggtatggtagaaatattcaactttgtcatctttaaccattaaaaagaatgtttttgatatttaaaaagagtattttcccctgagaataagtagattaaaatttctgtgtataataaattatgaacaaaatggagtttattccaggaatgcaaacatttaaaaactaccgctgagcgcagtggctcacgcctgtaatcccagcactttgggtggctgaggcgggtggatcacgaggtcaggagttcaagaccagcctggccaagatggtgaaaccccgtctctactaaaactacaaaaattagccaggtgcagtggcaggtgcctataatcccagctacttgggaggctgaggcagaagaatcacttaaacctggatggcagaggttgcagtgagccaaggtcgcgccactgcactccagcctgggcgacagagttgagactctgtctcaaaaaaaagaaaacaacaacaacaacaacaacaacaaaaacgatcaagataacttacctacattacagaataaaaaagaaaaatcatatgatagtttcaacagatgcagaaaaggcatttgacaaaattcaacatcccttcagtataaaaactcaacaaattgggaatggaagaaaattccctcattctgataaaaggtgtctaagaaaaactgagagttcatatcacatttaatggtgaaatacctcatgcttctccttaggtcagacactaaaccaggaggtccactttcactacttccatctgcttttgtactagaagccagtgcaaaagtcaagaaagcaaaataaaaggcatacaaattgggaaaaaagtaaaattgtcattcacagatgacatcattatttacatacaaaatcctagggaatctacagaaaagtttcaagatctaatgaatgaatttagcaaaggcacaggacacaagatcaacatacgaaaagcaattgtatttctatgagcaacaaacaacaggaaaataaaaaaatttaaataccatttataatagcatcaaaaaggaataaaatatttagaataaatttaaccaaacaacaggcaggacctctacaatgaaaaccactcaatagtgcagagaaacaaactaaagaagacataaatagagtttgatatcatgttcatgcattggaaaactcaacattgttaagtgtcaattctctgtaaactgatttatagattcaatgccatcttaaatgaaatcctagtgtgcattttgtagaaataacaagttgattctaaaatttatatgaaaatatgaaggatctagaatggccaaactttctttaaaaacaagaacaaaattagacaacttacaacatctaatttccaaacttatttttataaaagccacagtaatctagacagggtactgataaaagactacatgaaagatcagtggaacacaatgcagtctagaaagacccataaatatagaaaaagtgctcatcatcattaattgccagaaaaatgcaaattaaacctacaatgagatactacttcatattcacttagaatgactaacactacaaagactggcaatatcaaatattagagaggatatagaactggaattctcatacactgctggtaagaatgaaacatagtacaactactttgcaaaacagttgggcagtttcttacaaaattaaacaaacattaccctttgcccacaaattgtatgcctacatatttacccaggacaaatgaaaacatatccaaggacttttataggaatgttcaaagcagctttattcataatagccaaatgcatacagctcaaaagattaaacagcaggtgaatggttaaacaaattacagtacacccatacaatgaaatactaatcagaaattaaaaagtagtgaactactgaattatgcaacaacatggatgaatttcagagacatgagagtacatactacatgattccaaagctacatttagatgctaaaagtcacaacagtggtggtcttgcagtgagtgaaggggagggactgactgaaaaaaaaggcatgacaaaactttctaaggtggcggaaatattctaaacaatgatctgggtggtgatgacacaggtgtaaatatttggattttgttttgttttttaagacagggtttcactctgtcacccaggtcagagtgcagtggcacgaccatggctcactgcagccttgatttccccaggctcaagcaatcctctcacctcagcctcctgagtagctgggactataggcacacaccaccacacctggctaatttttgtatttttttgtagagatggggttttgccatgttgcccaggctggtctcgaactccaggcctcaagtaatccatctacctcggcctcccaaaggattgggactactgatgtgaggtgtatttgtcactattcatctaactgcatacacattatctgtgcacttactgtatataaattatacctcaataaaaagtttatttacttctttatattaaatgtctattaataagctgggcgcagtggctcacacctgtaatcctagcactttgggaggccatggcgggcagatcacttggggccagaagtttgagaccagcctggccaacatggcaaaaccctgtttctactaaaaatatttttaaaaattagcccgggcgtggtggcgcacgtctgtaatcccagctactcaggtggctgagacatgacaacctctagaaccctggaggctgaggttacagtgagccatgattgtgccgctgcagtccagcctgggtgaaaaagtgagactctgtctcaaaaataaataaataaatattaataaagcaaacggactacagttggtgggaaagggcttaaatcaccccagagtactcaagaagtgctcctattcatgagaagcacagatagaaaaactaaatttcctcctaaaacatacaactatgtgtctagtgttatgatttcatcttaaatgataaaatatcattcaattaattccccttaaaaactcaaacattcattctccatttcctaattgaaagaactaaatgttgataaaggcctatgttttaaatggctatttattttcactccaaaggcacatctactgttcctactattattgctacagatattccaaaaagtgactaggtggaaagaagggattaaaaaataccaccacaggaaaaaaatatttaacttatgacctaaataattttagtcatttaatatcttaaaatatatcttatgacttaaaagagaaagtattctatttaccatatatacaaagaaaataccgtatttggaatccaatagacttggttccagaatacataaagaactgctacaactgatgataaataaataacctgaccttaaaaatggtacaaaacttttaaagagatgttcataaaagaagatatacaaatggccaataagcaaatgaaaaaatgctcaacatcattagttgttagaggaatgtgaactaaaactacaataagatactacttcatattcttttagaatggctaacactacagactagcaaaatattcccaaaagaaaaattattgctgctgttatgacatgaattatttcagtcatttagtaatacattaaaagacatttcatgacataaaagagaaagcataaaatctggagagatagaaagtagattagtgtttgcttaggggtaggggaatggaagggataggggaacgatagctaaagggtatggagtttcttttggaggtgatgaaaatattccaaaattaactgtggtgacagatgcacttacctgtgactacactaaaagccactgaattgtacacataaaatgggtgaattttaagatatgtgaattatatctcaataatgttatttttaataatgctgttattaagattttgattgggattaaattgggatctatagatttggagaaaacatgtatgtttataatattgattctttcaatacatgaacattatataatgctccaattatttgggtcttctttagtttctctcaataatgttttatagaattccatgcagaagtactgtacatattttattagagtcattcctcgatatttactattactgatgctatttatatggtatattttaaagaagacaaagcattgaatttttttattgtggggaagaacagagcatggtgtacatattaaataatcaaaatttcaaaataaatcactatacatggtctaacatgattttttctgattttaaattttatttacagaaaagtcatacaaatatataaaaattatatttaatcactcatttaacaaatcacattcatgaaaaagaataaaaatacataaacttggctgggtgcagtggctcacacctgtaatcccagcactttgggaggccaacgggggtagactgcttgaggtcaggagtttaagatcagctggtcaacacggtgaaaccccatctctactgaaaatacaaaaattcactgggtgtggtgatgcacacttgtagtcccggctacttaggtggctgagacacaagaatcacttgaacccggaggtggaggttgcagtcagccgagattgcaccactgcactccagcctgggcgacagagcgagactctgtgtctcaaaaaaaaccataaacctacaaatgtcctgaaaattccatgacaagtaaatgcttcctaatttgtatttgctatgttccttagcttacagtgaaaacagaagtactgttttagtctccatatttcctcaatatatgtatctattagcaaaatgctttcacagcaaagaaattttatttaatgatggccaattttacatctaaagctggtaacattcaaagtgttaaaaaaaatccatcatattggtgttacaaacacttcattattttttcaactaactatattaattagttccctgaaagcagattgtagagttttacgatcacaaaataattattcattttctactaaaatgaaataaagatataaatcacatttggccttaaaattaatttatgtgagtacttaatgtttctggatctgttttctcatctgtaaaagaaggttagatgaaaacatctagtctcaactagttttaaaactctgttaattttataataagaaaacagcaaaaccatatggtcataccatactttaagccaaaaacgtttgataaattagatgtatacaagctaaaggactcagtaattattagttcacataagaggtctctgctttcactccagaattagcagcctccaaaaatttttcaaaaacatacttgatatttattgaaaatgaaaattcatcatgtttctgacataagatacagggatataagattatgtcttatatttctactaagaaccatagttatctcactgatattacgataaaaagcatagtatatatgaaaccatttagttcttaggcaattcataattctaagatatttcagacgttttgaaagtattcaaataaacaatatggttataaataggtccactttttttttagtggaataatgtgaaagactggactttatctcaaggaggcttcagaaactatgtaatccaaaaccatgtagctacagttaactatcatatattgatgaaagtaagtatttgatataaaaatgttacctgatcaattatagaatttagcttggtaagtaatagaaatcctcgaccatggacaaggtactgtccaagggttgccatgtgcgtctcctcctcttcttcctccctggcctccaccctctggaccactgcattgcaaagccggttgacatcggtcagaaattcacgtgccagtgagttactgtcggtgctcatgaccgagctataaaataagtattacaaaaaaaaaagattaggaaaacaaatacaaatttacttttaaaactatgtgtttttgttgtttgtttctaactgaagattggcttaaaattactggaaattggtacttaaccctataatattttcaggcatagttctgacctagtcaggtgcttcttaaataattccttccatggcgaaatgagtcccaggcttgaaatacctgagcatagctgagaataggtaagtaacagcacctggatggaaaacattttctctttttaagagagaagactttctttcttaaatacaataaaaataaacccattacttataaaatgttcttgctttatatattttataataaattggtattttaaaaatataacccatttttcacttgatagagcccacaatcactgacccatcctccccaaacaccaaagttcagttaataaaaaggatttccaatcaggtgaataaaaactgaaaaattctaatagctaaagttacgccacttcacttcttatgacatatttaaatcaaataaagggtaatgtgacattttaagattaagggaaataagctacagcaaacagaataggggaacataaatacagaggaaaatgtacaaatttccagaagggaaaaaccatgaacaacgaaatccccaaggagtttcaaaatagtttcatctctgggctaaaagtaattttgaggtatccagtaacctttaaaagatatttaacatagagatgttaagttaaataagacatgtattgcctcacctcccttcacccgcttcagggggaagccctccccacagtccctgctgagagggcagtgcacatatgactatgcctcttgccaagaggcacagtcaagctctgggccccagttcagctacaatccatgctcatcacaagatgtgactcgtatagtgtgggttgcaaagaggaactggactaatcaggttttctttctctctcgggaatttaaactaaagggatatagttgatgtcctgaaaggtcacgcagagatggggctgtggtagtcattatgaggtagctgagggtcagaagaagccaaccaggtaaaaatgaaccaacgggatacaaagagaagtagataaaaatgaaagggaagtaccagagaaattcctaatactaccttagttcctgttcatcctgggacctcacagtttaattctttgattcccatcaaaattctaggtattacagtaactctcttttagtataacaaacatcaatatttttaatatttttgaatattagaaaggagaaaaatataaagtgcatctctcattctaaaatacggcaataacctctattatatattaatattggttctttatatgctttcagaaagtaaaagtattaaataaatccaataacctaatttatattcagttcatatttatccaactttaatatatttcattgaatctgttcataattttaggatacataattacttagtacaccactaaaaaagaattaaactatgacacaatgcttcttatcacataaaatttccccacaatatcaccttctgggccatcaagaccattcatgccacagcacttaagagtactgcagtatcgtttctgggattttccttcaaagctactaacgtcattctataaatttatatgctggtgctttcttgatcttaccagatggtatcagcagaaagtttcagaaaacaaccaggaaaacatttaaaaactcaacaggtatagtaccagcaatgcacagaagtctgctgaagcactgacaatgtgaaagtctatgatcaagtgcactcatgtgcaggccaggtcaactacttcacaagtgcttataagacactatccattgcaagatacactgcaactttagaaacattaaaaatgtgaaaaactgaaaaattatgggaataattaagtctatcttctagaaattaagaaaatggaaatcaatataaatttttagatataaaagttaatgccatatcagtaaaaggcattataatctcaacagaaatgtatgttttttcctgatttaaaaatgtacctaaaatatatacatgtttatatgaataggttagtgtatatacatgattacttgcttttatttaatttagatatattgaaaaacatttcacatgagctctcactctttaatagctgtatggcatactgctacatgtaaatattacatatatagcattatattatagtttactatgtagccaatctcttatttttgaatagattgtttctagctttttattatcataaacaaagctacaattaacacccttatactacttgcccctttatcttattacttccttgaagtagaaattgccgttatttcataaggtaggttttacatatttcttgttaggtttactccaaggcgctttatatttttgccattattatgaatgggattttgttttccgtaacatattctaggatttaaaactggtatatagtaggcacataggaagtggatttcttttgatataataatcatatatctaaacttctgagcttttttattattttgttttgaatttcccagatataatactctataatctacaaataacaaaaattctgaattatcttatccaatattcatacaatttccattattctatctaattgtatcagtttgcactaacagaacaacatcagttgtggtgatggggacacttttgctttgtatattaggaagtattcacctcttcctaacagaaatattgaatttaattgaatgactttcagtcatttttaatgtcaactgaagagatgattgcacggtattttctttaaattttttctaatatttaaagtacccagaaacaaagaatatataacatgaggttatagccaacaaccagatataaatagtatactgtatatatccttttgtaactttgctttttcctcttaatgttatgttcattccattaaaccatcatgcaatataccattgtatgaataaaccacaaactatacatccatctctactaagaaaagtttagctgttttaactttggggtttaacgaatgtcagataattatgtagtttcaagccttcaaaatcatgttgatggttaatatttattacattatatacttaccagtctttcaccactgctgtgacatttacagtctatatcatttggactcataaactagatgaaacaaatattcttagaacaaagcttcacctacaaaaaaaaagacatattaatcacaatagtaaaccacaaataattttaacaaagttgtgacataatcagtggccagtcttcatacatgatgtatgaaaccaccaatgaaatttttagatcttaggagcacactaaaaaaatgcctacttcaagaattcctcttgagagggaatcttggaacatagtgatctgaaaaagcaactcaataatagctctctacttttcctcttccagttcttaacttaaaacctccaggtaaatcacaagttaactgcaaaggagaattagaccagtcttcttaacactagaatctaggaggcagcggaatatctaaatactatcacgacaaaaaggttttcaactcagagttcctaggtacagccattactttcctgttaggatgaaaggtatttgaggatacataagaacttagacaataccaaagccaaacattaatttattaatcaccatcaaatttcatatctttattgaagtttttaaatgaattaatcttttgagtagaatataatgaaggttatttctagaagactaaaggataaatttctatttctgggatagcaacaggatatttctctttagttacctgctctccccttctctacagtgcttaccaggaagaagcatgaagaatgtttccttatcatagttatgcggcaaacatgaagatattttgaattataagttttaaaatcagattgatttttaaaattatttttatttaaaaaaaaatgagatggggtcttgctgtgttgcccaggctagtcttggactcctgagctcaagtgatctgcccacctcggcctcccaaagtactgggattacaggcgtgagccactgtacctggcccaggagtgatctttaattacttcaaaatgctcaaatctggaaaactgtcttaagtttctttcagcttgccaaccagttcttgtaccacacattattctaggcacttgaagataaaccaggcagaaaacagctgtgttagacaatgcagggctttgtgtgaattaggaaaaaacatcccttcctgatgggtgcagctccacacagcagggcacacagctatcaaagcacagggtatatttcagtctcaccccctcattcctctggcagagcaccagaaagcagtatatcaacggctcaaccaagtggaacagccctggaatagagtcctaacacaccttccatacctgttcctgctgcctcctgagctaatcaatatcatgcaaattttttttttttgagaggagtttcaccctttcgcccaggcttgagtgcagtggcgcgatctcgggtcactgcaacaacctctgccgcctgggttcaagtgattttcctgcctcagcctcccgagtagccgggattacaggcgcccaccattatgcctggctaatttttgtatttttaatgggggggggtttcgccacattggccaggctggtctcaaactcctgacttcaggtgatccacccgcctcggcctcccaaagtgctaggattacaaatgtgagccaccgtgcccagcccatagagatatttttaactttaaaattatggaaggggaaaaaataaaataaaattatggaagggaaattatggatcaaactgtaagcctaaagatggtattatattagctgctctgactactaccaccctccagcttggactaccacaaggtagagccatctatcttgcaatgctaagatgattccagctaactcagcgtggccgtaagaagtgaaagctggcagctggtcagctagatccgtctgtttctcttatcgagggacattttctaggccaagctgagggatttctctaatgctcttaaactggcatggcttctttatctctgtagtttacaaagcctcacttgaatatctatgcagtttcattttatccaagatcataattctaaccaccagcacagtcacatgtgtcctccttgagtctgccagcactctttatacacacctgtattctaatttttatcatcctgtatcattctaggtgtccagaacatctggaagtatagatacatttttaataatgatgcccttagcccattatatatttgcctctgtttccaaactacatagacacaccctgtagttacttatctatgactgtttcaccctctaggtcacaagttacttaaggccagggaccctgtcttattactttttacctttcatagctataatgcccaattttaaatctaactttatcactataatttcaatttctaatacaacaattgttataatgtcataacaaagaaaacttgccccaacgatattcgtagaatttttatatccttagcatttaccgtaaatgaaaaacatagtaacaaatgcctataatcatataaatgacctcctcagaaaaataatgtttcactttttcctcatatagtgactggtaaaatgtaaaatatgaacaagcaaaaacaaaacatacatacacaaacactgatttaatgtattagctacctctcattttatgtcatcagaagtttcatcaatatgccatttaattcaacaaatgttattgaacatttactgtatgtgagctactaatttatgcactgagtttagagcagaatcaaaatccttaccatcatgtattatagtgaggtggagacagatgaaaagcaaacatacactataatgtcaggtcatgttaattcgatgaaaaagtaaaacaaagtaagggtatagagtgacaggaatgctgtttcagataggatggacaaggaaggtctgaagcagtaatatttgagcaaaaacttgaatggaataagtaaatggaccatgtgggtatctgggaaacgtgcgttccaagccactgagataaatgtatgctggatgtacgggatattgagtgcaagaggacaagaggtaaaaaataattgcaaagaaaaagtgagaaaagtcaacccattcttccttctcaggaactaaagtaagcatggaaagaggaaatagaagtgttcccctgaaaccatttctccccaagaatgcaagtccctcccaatgcccacccaaaaaagactataaggttttttagcctgtgtgaagaatagtactgtttactgataggtaagactgacataagaacagttgtgagggaaaataacgttcagttttagctatgttaggtgtgataggtttcttagaaattaagtaatcaagtaggcagctgaagatcaaaacaggcagggaagctggaactagtgaatcaatttgggaatcatcaggatatcatcaataaatttttaaagccatggaactagacagatgaaataacccagaacagtgctgttcaccggagctttctgagacgatgagcctgttctataatttctgccacacaatatagcagacaaaagccacatgtggctaggggctactataatgaacagcgaggacctagagaatgagtgtaagggagcagagaagaggttttacaactgagccctgggcttagcatggctgagtcaatggagagggtaagtatccaacacaggagactgagaaggaacagcaagtgaggcaggagaaaaatcaggtgagtggtatctcccagaaaccaggtgaagaaagcttgaaacagaaaagagtaaccaatgctatcaaaaattctgagagaaagctggcgggtgcagtggctcaagcctgtaatcagagcactttgggaaggtgaggtaggctaatcacttgaggccaggagttcaagaccagcctgggcaacatggcgaaatcccatctctactaaaaatacaaaaattagccggcatggtggtgcacacctgtaatcctagctacttgggaggatgaggtatgagaactgcttgaacctgaaagggggaggttgcagtgagctgagattgagccaccgcataccagcctgggtaagagtgagaccctgtttcaaaaaaaaaaaaaaaagaattctgagaagttaagttaagtaagatgaagactgggaattgactgctggatttagcaacatggaagttactgacaatcttttcaaagaatggtcttggtggggtggaaaagagtggtgaggaaatgaaggcaagcaatttaaacagctcttttgagaagttctgccacaaagcatgcaagggaacgggtgatggcttgaggaggacatgagataagtgaggttaaaaaaaaacctgattaatattatagcttgtttctaagctgaaacatagtatgtttctctaacagagaaaggaaaatagatgaaaaactagaatgagaagagagaattctaggaacaatgagtaggcaaaacgaagaagaccaacatacaagtggaaggaacagtggcagttcatctaattgaataagaagaatgtcagagaatacgagtatagatgtaggaagattagtatatttggcaataggaggaccaagaatttttttcaggtgcttctattttcttggtgcaataaacagcaagactgccagctgagagtgagaagtgggaaggaggtgttaaactgatgagtgtaacagggtcaaaaaacagcagcccataagagacttcctgccaggctgccaatgagtaactaaatcaagattgagttccattgttcaataactatacccatactataatccaactctccttcatgttcccaagtatagaatggtggactgtcaaatactccatgggaatctagatatattacagctgcagcattctcctaatctgtaaatgtagactctataggtagaaactgggttatctggaatgaattcttagaaagcctacatagcctttattgctcatcttttctttaagtataatatttgaaaatctttaaaaatgatctctagagtcttttgtggaagtaacatcaagtttacaaaaatctatggaagctacatttttttaaattttagaacattattcctccacaggcttctacaagttttcacatttcactataattactcaaagattattagttgagcaatgacattaacaaatgttctcagaatctgaccgtgagatgtgaattcattttagagcatccagagttctgatacaatctcctccccaatcttgggcttcaattttctcctcttatttttctcacttgtacccttcttagtctgtgtgtagatcattctccatgtcagagaagagaagaaagctaagaaatttcatttgttctctgtatctgattattgggtccatttgttggtaagaatctattatttatttgtcatactcattctctctctctccccctactgccctatcccccacccctgcgccctttctttctttttgtagagacagggtctcaccatgttgtccaggctggtctcgaacttctgggctcaagtgaacctcccgccttgacttcccaaagtgttgggattacaggcgtgagccactgcacctggcctcattttcgttctctacatataaaatgtaaaaggtcagcccaactttttcaaaatcttagctcattattctaccaggactgtgttcctattctataggttttatatgtgtgggtgtatgtgtgcatatatatatatacagttttttttttgagacagaatctcgctctgtcgcccaggatggagtgcagtggcatgatctcagctcactgcaacctccacctcccaggttcaagttggccaggctgatctcaaactcctgacctcaggtaatccgcccacctccacccttccaaagtgctgggattacaggcgtgatccactgcacacgaccatttggtttcatatccttctttctttcttgtgcacattatttaaaaatcagttcatgctgggcatggtggctcatgcatgtaatctcagcactttgggaggccaaggtgggtggatcacctgagattgggagttcgagaccagcctggccaacacggagaaccccccccaccacgccccatctctactaaaaatacaaaaattagccatgtgcggtggcaccgcctatagtcccagtaactcaggaggctaaggcaggagaattgcttgaacctgggagagaaggttgcagtgaactgagatcgcgccactacacaccagcctgggcgacagagcgagactctgtctcaaaaaataaaataaaatgaaataaaataaaataaaataaaataataaataaataaataaaataaatcatcagttcatgtggccatgttccctctccctttccttcacatattatttccaattgttcagtagagatactgcctattatcaccttgtaaccactttcccttcaagagactatctctggcatcttacctaccttttcttcgaattttaggaactctgtactccaattctctatattccggctttgttccatattcctcttcctgcttattagtctgccagctatcatttacaaaacaaccactttgtatcagacactaagaacataaagtaattccagtctctgccctcaagaagattacattacggtggcaaaggcaaatcaatatatagggtactatgtactgctaaggggcacttaacccaatttgagtggccagggaagcttcatgaagaataaattgaagttgtacaggtaaagggagaaaagaagggaagaaaagcattagagatggaaacagcagctcaagttgtcactgaagaaattacagtaagtttggtatcacaactacaaaatgagaaacaggaaaagtgaggatggagggagtggctggcaaagaccagatggtgaaaggcttttgtacactatgctaagaaccttgggctttaatctattggctagtgagtcttatcagaatcacctatagagtttgtctaggccccatgatcagagaacctaatctgctaaacccacagcaagacctaaacatcggtatttttaacaagcttcataggtgattctaatgaacagtcagggctgagactcactgctacaggtgacaggaagcccatgaattattttgaacatgtgagtggcatggtcaatcttgaacacataggtcattctagtggcaatgtggaagacacattttatggagaaaactctagctgcatgaaaaccaatttggagactggcgtcatactccaagcaaatggtaaggatatttttttctaaagcaacagtagaataatataattttattaaatatccaagaattaaaatgagcacaattttggtgattaattggatggagaagtgagtggtaagggagggatcaggacaactctctgaatactggcttggttaactggataaatggtactgtcacctgcgaagaacacacaagaagaactgaggcacgtgtgcagagtctgctgtcagggcaaaaccactccacaccaggtgagctgagtcctctgtctattaggccagtgactaacttctttacagtgactactgagactaaatccaccatgcctttcattccaatttcagcaatgctcaaaatgtataccttctcaacaactatccttaactccatctcatggtttccaataccagaccgaataaggaaatagcaagtatagactctcctgagaaggcaggattagaaaagaaaaacagaaaatagagaggagctggagaaggaggcataggttaaggaattttttttttcaagtatttgtattttttaaagaattggaagaaccgtatttttaggctataagaaataagaggtggtgcggcgtggccagccatctcctatcagctctgattgtgtgtacttcttcccagcatcactggcaccatgttggtagcttaaaatcatcatggtgagagtatttccatcatggaaatgggcaaatgctacacattagggtcttttttgtttctttctccaggagagccactttactagcataccactgcagccagcacaagggaagatactgaagacaggggcaagagaacgaatgaatgaaggacaaaattcatggagaaaataagtgtggattggatcaagggtataggtgaagaggttaggctggggcggggaagcaggaggggacacatcatcctctgaggctgagggaaaggaggtaaggagaattgcagatatagaaaacaggtggaaggccagaaactgagggagctcaagaatgactggctcaattttttcattcaagtaataggcaaagttgtctgcttaaagaagagagtctagagattgggggctaaaggctaagtaatttagaataattattggaagaatagtcaaatgggggaaagtagtgatgacagacaaaataatttactggttggctactagcttagcagaggtggaaaaccatgaatttctggtggtatggattttttcagctatttcagattcaccagcaggattcagctgcttgggtctaataatagacagtgcagactgttatcactgatctggaaatgggagttttggtgggtggaggcagcagaagcataagtgaaggggacccaagggtatgggtggaagaacagtccttatggccaaaaatgagacacagactgggtaggaaaaagaaagaggccaggaaaataaatgttgatagacaagcagaaaatccaggcaatcaaggaagtgtggatctctaccagactgaagagtacacaatgtgggaatgaagatgttagaatttttagatttctgaaacaagcggtcccagatgacaacatccacagtgtggccctgcaagcagatgtctaaagtgaagtgaaagttaaggtccttgcagttaagtaaccatgaagctagtatttttggacaacagatcattgtaagttcttaaaatgaaagccctataatgacagagattttgtctgttgtattcactgctaaatctctagcatctagaacagaacacagctaacagcaggcattcgattctactcatttgccgaatgaatggcgtggcctctctctcaggattttcattaggttaacttgtctaattaagcccctcgtagtcaagttaggtcaaagatagactcaagagtactggttccctggattatttcctttaccttctggaaatgaaatggtcactaaagtcagtcaacagtggctctgctttcattgaatgagacttcctgcagacatctggatagttaactttgatatcttagctctgttccagttctgtgattaatttccacaacttattatccacctaaaagattacagaattaagctatcaccctcagtcttgtggattttcatgcatttatcttcttgacacagagaactactacacccgcccctcacagcaagtcatgaccacatatattcttcacttttagggcagctcctcatataatggcatttttagatgccttgtcatgtctgtgttctagacaatgctaccaaggacattacatgtaccactgaaaataaaatctcaagctcaacaacagggcaagaaatggtccctaggtggctgagtttccttttcaataaatatcaaatagccagtggccacagtgataagaagggaaaggggtccattgtgctacagttccctttttcataaattcattaattccaatatttatttattaagtaaatattttaatagatatttattaatatgctccagctcattctattttcactatttatgaatctgttctgaatagtgggatatacatacagtaggcatcatgacagtagtgaaataggacccagaagccgcagatcaggaatctagcaattactagctagtcacacagagctgtgtgaagtttggctgcctcttccataaactaccccacagagttgctatgtggagcctaagaaattatataacctcagtaaacattgttgacaaattttatagctctatgtaaatgctcagtactagctgcacaccttatgacagacagtgccatctgaaggaagaaaaagatcactgcaagctttcctcagatcagtgtgaggaaaatgatgttctgtttcataacgctatttccagggaagcactgaaaaaaaaaataggaagtccctgtattttctgctttttccttgtcttgtggcttccacaagaaaaaaaagaagtaaaaggaaaaaacaacaaaaaaggttataataatgatatttattcttataggttgattagaaagcatactttttcctcatcaaacagtaacacccaaaagacttgttagtctttcaccaaatgccaaaaaatcctggaaaattcccttttaaagtaacactacgtgcttgcctaattttctcaattcaatagtattagagaagttgccattggaaagactttttttcaaaaatgttatgtgccaaagaggagactgtgataaatcagggttattttaagaattaggcaaaataatgtacagaataataagtgcccaataaattctgttaaatcaaaatctgccatgatttgaagcagccttcttgaaaataaaggttagtttatatggatttaactattctaaatcccagctctccagagtttaatatatattgatagattgattagcaactttctcaaagatctcatatagtctttacaacacatcagtaaaaataaaaaatctttatgagaaaaaaagataacaccatttatatcatttcataaatgacatgaataaaggaataaacatgaataacttagaatcttatgttgtcataatggcagaaattttagatatcatattctctaaccccacattctacagttgagaaaaactgaggcctacaggtccaaggtcacagaaatgattagtcactggactctactatcccagttgtcttggagttacatatgttttggggggtaattaactaaaactgaaataagcaagtttagaagatacatagcctttcttcttctgtcgattagaaattagacaacaggcaaaggcgtttccctaacactaaatactacctctaaatggtatccagaacctttactcaagtccactggattgtaatacatacacctggaaacaagatttttaaacctctctctacaaactttttagactacaacacagaactatatgtctgaaatgcaggacactggtggggggaaggggaccaaagagggggagggggaaactgcacttgttcagattaatataattctctttaaagaataagccagttaaaacatatcagttgaactgtacaatatttaagcaagaaaatatctgttaatctaagctttactgtgtaactttttagtcaatactagatgtgttaagcaataaccatcagaatgattcctaactaaagagaggagctcctgggatcatggcgaagggaggcaggactagattgcagctctggacagagcagcatgtggtggcttgcattgtgaatttgagctccagatccactgcaagaacaaaccagcaatcccgagaggacccacagaccctctgaaggaagcggattgctcctgcaggccccaggagacccccaaatactgtgagtgccccaactgtgcaagtgggaaagggagaccctcctctcctgaacacacacccccactggagaagctgaaggtctgtttgctggagaagtttctgaccttacctgagctgaatcaagttagagagccaagcctagtgaattacaggggtagagaatgcagcagaaaggccctgggagctccctgggtccttaagtagcccattcctgcctggcaccacaaggatccattgggagggtggctagaggagcagggggtaaaaccccacagggaaaggaattctctagcctaactttctaacaatttgaacgcggtgagaagcctgctggccagaactccggggagggtgcaaatccagctcgcagacttcacaggtggaaggaagaactaaagcccttttctttcgtagctgagaggtggatagcctcggggaagttttcaagcccatctagccctcagcctggaaacagactcccggcagttaggggggacacggtgggagtgagagtggcccttctgtttgcgtgggagctgggtgagggctccgactgctggctttcccccacttccctgacaaccttcatgactcagcagaggcagccataatcctcctaagtacacaactccagtaaactgggaatctcacccccaattccccacagcagccccagcacgacccaaccaaggagctgctgagctcatacacacctagccccacccccacctgatggtccttccctatccaccctggtagcaaaagacaaagggcatttaatcttgggagttctagggccctgcccaccgcatatctttctctgtactactacagctgatgctttctggaaagcgccacctcctggcaggaggccaaccagcacaaaaatagagcattaaaacatggccaaccagtacaaaaatagagcattaaaccaccaaagctaaggaccctcacggagtccactgcaccctccaccacctgcaccagaaaaggcgctggtatccatggctgagagacccatagatggttcacatcacaggactctgtgtagacaacccccagtaccggcctggagccagggagactcgctgggtggctagacccagaagagagacaacaatcactgcagttcggctcacaggaagccacatccataggaaaaggaggagtatactacatcaagggaacaccccgtgggacaaaagaatctgaacaacagtcttcagccctagaccttccctctgacagagcctacccaaatgagaaggaaccagaaaaccaaccctggtaatatgacaaaacaaggctcttcaacacccccccaaaatttctctagttcaccagcaatagatccaaaccaagaagaaatccctgatttacctgacaaagaattcaggaggttagatattaagctaatcagggagggaccagagaaaggtgaagcccagtgcaaggaaatccaaaaaatgatataagaagtgaagggagaaatattcaaagaaatagatagcataaagaaaaaaaacaataaaaaattcaggaaactttggacacacttttagaaatgcaaaatgctctggaaagtctcagcgatagaactaaacaagtagaagaaagaaattcagagctcgaagacaaggtcttcgaattaacccaatccaacaaagacaaagaaaaaagaatacgaaaatatgaacaaagcctccaagaagtctgggattatgttaaatgaccacacctaagaataatcagtgttcctgaggaagaagagaattctaaaagcttggaaaacatatctgggtggataattgaggaaaacttccctggccttgctagagacgtagacatccaaatacagaagcataaagatcacctgggaaattcatctcaaaaagatcttcgcgtaggcacattgtcatgaggttatccaaagttaagatgaaggaaagaattttaagagctgtgaaacagtagtaccaggtagcctataaaagaaaacctatcagattaacagcagatttctcagcagaaaccctataagctagaagggattggggccctaacttcagactcctcaaacaaaacaattatcagccaagaattttgtatccagcaaaattaagcatcatatatgaaggaaagatacagtctttttcagacaaacacatgctgagagaattcgccatcaccaagccaccactagaagaactgctaaaaggagctccaagtcttgaaacaaatcctggaaacacatcaaaacagaacctcttcaaagcataaatcacacagggcctatagaacaaaaatgcaagttaaaaagcaaaaacaaaacaacaacaaacaaaagtacagaggcaacaaggagcatgatgaatggaaccataccgcacatttcaatgctaaaattgaatgtaaatggcctaaatgctccacttaaaagatacagaaccacagaatggataagaattcaccaatcaactatctattgccttcaggatactcacctaacacataagcactcacatacggtaaaggggtgggaaaaggcatttcatgcaaatggacaccaaaagccagcaaggtattcttacatcagacaaaacaaactttaaagcaacagcagttaaaagagacaaagagggacattatataatggtaaaaggccttgtccaacaggaagatatcacaatcctaaacatatatgcacttaacactggagctcccaaatttataaaacaattactaatagacctaagaaatgagacagcaacacaataatagtgggggacttcaatactccaatgaccagacaggtcatcaacacagaaggtcaacaaagaaacaatgaatttaaactataccttggaacaaatggacttgacagatatatacagacatttcatccaacaactgcagaatatacattctattcaacagcacatggaactttctccaagatagatcatatgacaggcaacaaaacgagtctcaatagatttaagaaaactgaaattatatcaagcactctctcagaccacagcggcataaaactggaaatcaactccaaagggaagcttcaaaaccatgcaaatacatggaaattaaataacctgctcctgaatgagcattgggtcaaaaacgaaatcaagatagaaattaaaaaattcttcgaactgaatgacaataatgacacaacctatcaaaacctctgcgatggagcaagggtggtgctaagaggaaagttcacagtcctaaatgcctacatcaaaaagtctgaaagagcacaatctaaggtcacacctcaaggaactagagaaactagaacaaagcaaacccaaacccagcagaagaaaggaaataaccaagatcagagcaaaactaaatgaaattgaaacaaacaaaaaaaatacaaaagataaatgaaacaaaaagctggttctttgaaaagataaataaaattgatatatcattagcaagattaaccaagaaaagaagagagaaaatccaaatgacctcattaagaaatgaaatgggagatactacaactgacaccactgaaatacaaaagatcattcaaggctactacgaatacatttacagacataaactagaaagtctagaagagatggatacattcctggaaaaatacaaccctcctagcttaaatcaggaagaatgagataccctgaacagacccagcgagattgaaatggtaatttaataattaccactaaaaaaaaagtccaggaccagacagattcacggcagaattctaccagacatttaaagaattggtaccaatccttttgacactattccacaagaaagagaaagagggaaccctacctaattcattatatgaagccagcatcacactaatatcaaaaccaggaaaggacataaccaaaaagagaaaactacagaacgatatccttgatgaacacagatgctaaaatccttaacaaaatactagctaaccaaatccaagaacatgtcaaaaagataatccaccatgatcaagtgggtttcataccagggatgcagggatggtttaacatacgtaagtcaataaatgtgatacaccacataaacaggattaaaaacaaaaatcacatgatcatctcaatagatgcagaaaaagcattcaacaaaatccagcatcctttatgattaaaattctcagcaaaatcggcatacaagggtcataccttaatgtaataaaagccctctatgacaaacccacagccaacataatactgaatggggaaaagttgaaagcattccctctgagaattaaaacaagacaaggatgcccactctcaccactccccttcaacatagtactggaagtcctagccagagcaatcagacaagaggaagaaataaagggcatccaagtcagtaaagaggaagtcaaactttcactgtttgctgatgatatgattgtttaccttgaaaaccctaaggactcctctagaaagctcacggaactgataaaagaattcaacaaagtttctggatacaagattaatgtacacgaatcagtagctcttctatacaccaacagcgaccaagtggagaatcaaataaaagaactcaaccccttttacaatagctccaaaaaaaaaaaaaaaaaaaaaaacttaggaagacacctaacaaaggaattgaaagatctctacaaggaaaactacaaaacactgctcaaagaaatcacagatgacacaaacaaatggaaacatatcccatgctcatggatgggtagaatcaatattgtgaaaatgactatactgccaaaagcaatctacaaattcaatgcaatccccatcaaaataccactatcattcttcacagaattagaaaaaaaaatctaaaattcatatggaaccaaaaaagagcctgcatagccaaagcaagactaagtgaaaagaacaaatctggaggcatcacattacctgatttcaaactatactataaggccatagtcaccaaaatagtgtggtactggtataaaaataggcacatagaccaatggaacacaatagagaacccagaaataaacccaaatacctacagccaactgatctttgacaaagcaaacaaaaacataaagtggggaaaggacattcttttcaacaaatcatgctggaataatcagctagccgcatgtaggagaatgaaactggatcctcatctctcaccttatacaaaaaatcaactacacatgtactaaggacttaaacttaagacctgaaactataaaaattctagaagataacattggaaaaacctttctagacattggcttaggcaaggatttcatgacagagaacccaaaagtaaatgcaataacaacaaagataaatagctgggacctaattaaactaaagagcttttgcatggcaaaagtaacagtcagcagagtaaacaaacaacccacagaattgggagaaaatcttcacaatctatacatctgacaaaggactaatatccagaatctacaacaaactcaaacaaatcagtaggaaaaaaacaatcccatcaaaaagtgggctaaggacatgaatagacagttctcaaaagaagatatataaatggccaacaaacatatgaaaaaatgctcaacatcactaatgatcaggggaatgcaaatcaaaaccacaatgtgataccatctcactcctgcaagaatggccataatcaaaaaatcaaaaaacagtagatgttggcatggacgtggtgaacagggaacacttctgcactgctggtaggaatgtaaactagtacagcctctatggaaaacaatgtggagattccttaaagaactaaaagtagaactaacattggatctagcaatcccactactgggtatctactcagagaaaaagaagtcattatttgaaaaagatacttacacacgtttatagcagcaaaattcacaattgcaaaattgtggaaccaacccaaatgcccatcaatcaacaagtgaataaagaaactgtggtatgtaagtatgtatgtatatgtgtgtgtatatatatatatatgatgaaatacaatgcagccataaaaaggaatgaattaacagcatctgcagtgacctggatgagactggagactattattctaagtgaagtaacttgggaatggaaaacaaaacatcatatgttctcactgatatgtgggagctaagctatgaggatgcaaaggcatagaatgatacaatggactctgaggacttggggggaagagtgggaggggggcgagggattaaaagactacaaatatggtacagtgtatactgcttgggtgataggtacaccaaaatctcacaaatcaccactaaataacttattcatgtaaccaaataccacctgtaccccaataactgatggaaaaattaaaaataataaaaataaaaaggtttattggcaaaaaaagaatgattcctaactaaagacaaaacaaagttcattaggaatattatttttatatatttacttttattaatataaaaacctttataatctattttatagtggataataaatacactctcgagaatactgaagcaaaatctggtactcactaaataggggaaattaaaatatttaatgggctttgtgtgatcaaattcctcttggaatttaaaatgcagatcagggaaagatatgacacttaaagttctaaattaaataactgaataagaaaattcatgaaaaccaatttaacaataatataaatggtttcacaaactgaaatcttccataagacaaatcatgatcccatatttattgactactcaccatacttcgtggtatgttcaactttcattgaatctattaactttaaaagaaatgatagcagttgtttagcgcccaggcccttcttgacaaatactgaacttgcttctctgaagagtgcattaaggagcatctgactagaagtcaagatgtcatgtattcttaggaaataaagattgtggtctccagttccgtagatactaacattgggacagcttcaggaaggaaatgctgttaaggcttttaactacagaccctacagaatcttagtaacaactcatgcctcaatgggaaaatgaattcagagttccaacttgaattgctagcaatatgttttgccccattctcccccagccccctgcctgtcagggagggagaagagattcctgtacctcaaagccatttgtggtagctccaacaatctggggaaagggccccaaaagtaggatagtaccacgtaaggcaaacagtaagccagttagacatgttgaggtaatctcagcactttgccggacctttttcccggggaagtctcacaatgcaacactcaagtatactgtagtttattttgtctgtaagggcaaatcttatgcattctaaacattctcaacaaccatcttagaaatgagcctctggaacacagtcatatgtaagacgtaactgccatactcaaaagacattttttcaactaatactgaggtaagtgacaagttgattgacaataaaggaaaactgccagagttcgcatttaataaattattttaaaatgagaatccattctacaatcaactttcagagagttaaacgatctctgggttaatgaccatatcacctccctcaaaattttacagataaactaaggcagacagcagttaagagatttcccaaaagtcagaggacttaacagctaggtctgcagagtcctatccaatgtttttcctaatactgcatacaatttttgacagactactcacaaccaaactatatctttcagaattctacctttcagagcattttagcgattaggtctggcacaacttacaactgtaactagacggttttctgtgtggacaggacagaaaactgactaattacagctgtacttagtgccaactcccaggcacgcctccaagcaccacaaacttcttgcccccccacaaacttctcaagatgttttacagctttgttatctttttccatgtttccacattgtacatttataccaaaaagtaaatgacttggaagaaaaatgttgctcctcttgaaaagaagtatgtacattttaacaagaagtaacaccttcagctctaaagagcatcagaaatttcagcatcggagggttaagaattggctctgaactagatgttctatatttaaaatgtgggaatataataatccttaactagtgaatatggaaataaatggttgtgctgttcctatatttattctgtattatgcatttaagctaagttaaagtagaaaaatgtgtttaatgaaatatttccaatttatgtagaattgtgtaaagaaaactaaaaaaaaaaacatgtataacagcagtaaggcagtagttctgggggaagaatggaaatctaagacagcaatggcccagaaaggtgtacatattattttttcatatttcagggtgtcaataaacaacattgcctatttcgctacccctctccccaagcccatgaaatcttggttaacatgccattccggctgccttgaaacctggggcgctgacctagggaggagaggttactctggctccttgcagaacaaagctggccaggaaataaaggaaactcaggcatagggcagccaggcaaaattttaatagaaattcagaggaagtcacactaaaacgcaccaaacttaagcctttcaacaggtagttcatttttcctaaaaacaaacaaattcggcaaccagatatctcaggaagaacctgtgtttggccctgagcaccgcaaaagggtagaaattctgagatattgtagctatagagagagagacggcatttaaaggaactatgaaggttcatccaggtaaatcatctccccggctttctatccctgttagaaggaatgtgctagatgttttacactgactactacatccctcctcaaaagagacctttggatttttatagcatgatgatgatgatgataatctggctaacacctacagtgattaattactacacatcaggcactattgtaagcactctaggtaagtagagtagttagtttaatcctcctaacaatctcctaagtaacattattatccctagttgacacatattggaaactgaagcacagtaaggttaggtcattgctcaaagtcacagagttactaagtgtcagggccaggattcagactcatgcaatccctttgtattctatatacaaatttctattctccaaagcagacattgacttctctctccaataagccagctcttccttcttcattcctctttcagtaaatggcctctacccagtgactgaggtgagaaaccagaatagcacttcatctagtgcctagtcaattctccctcttgaccacttactggttcacctctgcatctgctgctctatgaccttgggtactcgacttcctctttctaagcctcagtttctcatctatacaactgagttcataagagtagctgtagttgttgcgaatatcaacattaaacgagataattcatgtaaaatgcatagcacagtgcctggcagattgcaggaaaatcaattattattagatattatcatcatcaccttgaatctggtccttccccctaatcttacacctaagcatccttagaccttcaactcctctcttacttgcaatactaacaacctcctacttgatcacactgtctggtctattttctgtttaatctaaatatgctaccactaaaaatgttactcatatcccttggaatgacaaatgtcactccaattcatagggaagaagatcccaactgcttattatcaaagtatgcaatacctgctacaatttagcttttccaaactcccaacacataacacgttgtaccaccctgcaattccttcaaagggtatacactttctcaactaattttttatcatgttgctatggaaattcccattaattcccaattaattacttttccatatgcctctatcttatcactcaccacactgtactgtattgtttcttttaaaactagattatacttttcttaagaaaggaaaccagatcttatttgatcagaaaaatatgagcatctaacacagtaccacagatacaagagttcaataaataaacaccagttcatttaatactaactttgatagaaaacattttaatattcaaatacctttaggaaatgttcccccaggtaaggctctgagaaacagacacatttacaaaagccactctctattccacaattagcatttaaggcactaccgaaacaccttaaaaaccttaccaaacatttttcatattaaaaccaaaaaccttcagcaataaaattttggatgcttattcatactgttaaagataatccaaagcatacagtttaaaagttcttgaaaatcaattataagcatgatagttttccatacctcctgaggaatgctaaaaacagcttggagccttatcctaaatgtgaaatgaaaataataaaaataatttatgtagctgtactataataataaacttttttcatatatattttgcataaggttaaagattctgcaaaataagttttagaagattctgcaaaataagttttagacatactgaacacagatatttataagctttaaatacaccttgcacgtatagatagcacgtttcctcttatttcataattcttaagaaacaaaaaaattagcttcccttcaaaagaaagaaaaaacaataattgaggcagtcaattacagaaaaatgtgtttactgttataaaacatttcacaccaagaaagataaccacaagttcaaactcagatctggtggctgaatctactgttctataaccatgtgtgaagatggatagttaggggagcagagcacagaacagaaataagaaagaaatatatataaatattttctgagcacaggcatttcaaattccacccacataatttttttccctaccacactgggtagtttctatcatactcggtagtttctatcactgtggtctaaatgtagacttgtataaagaaaaagggttaaagttaaaggggtaaaataaggaaattacatattgaaaaccaaacactatgggtttctatgatgcacagacatcttttggttatgagatcactttcttaaaatacattaaaattttcaaatggttggtagtataacagaaagaatagtagactaaaagtcaagagattctcagttttctgttttgccttgttctctttaggatctcaggcaaggtgcttaacctttctgatgcccattattcttacagatatttaaaaaacaaaaactagatgatctctaaatgcctctttgggttgtgaacttttatgagagtacaacattcagaaaatgtagtaagtatcaacattaatttaagattaaaattatacatcttcaatgtttccttaaactgtgcataatcaggttttatcaaaactgccttactgggttctgttttttaaaaaataaggtgaagagaaaataaatatatttcagtaatgtggagcaaatgactttagaaacattctccaaaatgtttaaataaggctaatagagaaatatttcaagactaattatcagtattactgtctttggaagcatcactaagcagaaattcaggaaatggcaaaagattttaatcttgaacaaactctaagtcataatgcagtaaaggtacaatgaagtctagacacttaaatatgaaaagtaggataagagtgagctgatggatataagcagctcttacaagttacacaggatatactgattttttttttttttttttttttgagatgaaatctcactcttgtcgcccaggctggaatgcagtggtgcgatctcggctcactgcagcctccacctcctaggttcaagcgattctcatgcctcagcctcctcagtagctgggattacaggtgtgcgtcaccacacctagctaattttttgtatttttagtagagatggggtttcaccatgttggccaggttggtcttgaacaataggcataaaccagagccatcttaggcaaatcaagatgtttggtcataccagtgataagtaaccagagaagctatcaccttagaaatggttgtggatgttgaaaataagtgaattgagccctcaactagatgggcatgagtggagattactagcctaagatgactttctctagtcacatgatattgccctgaaatatcatgggctatttcttctgggtacatcttcctatataaggatgttgggatttgaagaaagttctagattcatctctagatgaacattcagaagtcattaacatataggtggtatatgaaagcttagaaatagatgagatcatcaaaggaaagcacaaagaaagagaaatgaggaggaggagagaatccagaggctcaccaacatgaaggagctggcaaagaagaatccagccaatgagactgaagaggagtggttagaggggtacgaggaaaaccaaaaaagaggggggtgtgtctgtgggtgtgtgtgcgcgtgtgcacacaggtgtatatatatacacacacacacgtatatatacacaaacatatgtaaatacacacacacacacacacacacacacacacacacacacacacatatatatataaaatttcacaagccaagagagaagagagggttaagaaatgaatggttaatattttcatatgcatcactttgggggccaggaagacaagtcagtattctcctagtttcccaagatgacttgtaagtcattgttattcgattttatccacttttaagattacattatagctatatttatagttgtcacctactgacctttgagtcagccatctccatttactgagaattttgtcgtatgactatcttcctttccacacagaagctatatattctggggacttcattatccataagaacaattgattccaacacacaagacttaatgctctttgccttcttcttcaatgacccctactttgcagaaggctagcatggtttagtagtcaggcataagtgcttcaatgctagaaggactcagaaagactcaggtacttcgtagctgtgagtcttgggaaaagttactcaatctcactgagctccagtttcctcatctgtaaaatgttgatactaatatgtgaaacataagcatgataacctatggaaaatatttactatagtgactactacacagtgttcaatgaatagtagtttttattaatattaatattgttataattagcactattaatcttggctatccacccatcattggtcattctttggcccttatcatcacctgaaactgctaactccagaatcttaaattgagaattctcacatctatgtgccaatttttccatctctagtactcttttatttccattaatcctgcacttgactcatttagattcttcatcctcttcattatccacatttaccagccttgtcttggcttggctttgttccttaataagcaggattcctatggctcaacccttcaattagcagcctcattaccactctctattccttgacttcccactaccccctactcaagttttccatcacatcttcccttccaatctcaatccaggttcagtctacttgttttctgcattgttatgggggtggggaaggggagtggtccaagttcagtctatttgttttctgcattgttatggggggcagggaaggggagtgggagcaggcaggctgctggagaacactgcttaaccatcctgctggcctctgtacatttgtgatttcaagcctggaagggtattcatcatgattcagcaaagaagtcacatgcccctagttaagtcccttttacaatctcaatagtaacttttattttcccctcaagcatactccaacccatgttcttccttctcaatctcagcagataatcttgcttcacagagaaaaagagatgtcatcctggatactaacttatatctatatctaccccatttccttttcgtttttaaacaggaagatacatcattcctcttcttcagggtaactctttcatttgtcctcctggacctgactcttccatttcctctcgttacatttgatcaattatcttctacctcttgtgacttcaattttcttcctcttcaatggtccctttccctcaatccactgaagtgtccttggcttctccatccttaaaacagacaaaccttcccaatgatcacatctacttcctcaagcttctacccactaacctcccttcattaccaaaagtatttgaaagaatatatttactgaacaaatgaaaattgttttattgggtttaggcttctctcctgagcaccaggcctttttttttttttaaatgtatctatatctgactcagtttcaacaaaggaaataaaacagctaattccaccaaactgaagaaaactgatggatttcacatctccaaatccactcctccacccgtattttttaaattacgagtaattatctgcatccccattcaccctcagacaatctagaatccttaaagcctgctttgattcctccctctcctttatccataactacacaaggcctttctaaaatctctcacatctgtcccctttgcgccttcctgggattattactgttgaggtctttctcatcttacacgaattgaaagggatgttgtcagggttaaataaaataataaatgggaatgtactctgtaagttataaagtagtactatacaaagagtatcatacaaatactattacatctttggcaaagtaagcatgaagttagcttaatatgacttgttcttaaacaaattctgggtcttagtaatcagtgctttcttttctaattacaaatcactaagcacttggcaagctggtctatagtttttctaggaatcagtcagtgtcaagattttcaatatatagtttctggactttaccttcctctccccccatttttaaatgtaaaatatgcaattcttcaggtttctggcagaaatcttctatcctcttttttaaaaaaagactttattttttagaagagttttaggttcacaacaaaacagagaggcaattacagagtttccatgtacaccctgctctctcacacatgtacagcctccccaactatggacagcccccctaaactggtacatttgttataatcaatgaacctacactgacaggtcattatcacccaaagtccacagtttacattaggattcactcttgatgtggtatattctatgggtatcgacaaatgtataataacatgtagctaccactgtagtatcttcagaatagtttcaccgccctaaaaatcttctgtgctctgcgtattcatccctccttctctccaccactaatctttttactgtctccatagttttgcctttcccagaatgccatacacttgtaatcataaagtatgcagacttttcagtttgccttttttcacttagtgatatgcactaaagatttcttcatgtcttttcatggtcaagccacttttaaacacaactttacaggtataactgacatgtaacaaaccacatatttaaagtgcataatttgatatgttccaacatatgtgtacacccatgaaaccatcatcaaatcaagatagtaaacatatctagtatcccctgaagtttcctagtatgccactgttctccctctttcctgccccttccctctgtaacttatctccaggccagcattgatctttcttccattatagattaataggcattttctagaattttacagatggaacaatgcagtatgtactttttttttctttttggtctggctttttttcgtgctgtgtaattattttgagatttatccatgttgttgtgtgatctaaagttcattccttgttattgctaagtagtaatctgttatataaacattgctttttaaagatgagtggcagtagttttataaacatttctaatatgtgtagtactctaccctattgttcatttatttcttccattcagttaaaatagtgaaaagctctcttatgtcctcatccattttatgttttaatttcaaagaatcatatttgaatggaacaatgactagccttttgaaaattatttgattcctttcttgattaagataatcaattttaagcattaatctttcatgttattaggtaagatttttgtttttcagcagttagacctggaaagccttcaacatttccaaacgtattggacctctctcattactgtaaacaaagttgggggattaagagttacaaagccaaacactggtgacacacagcagcaaaataaaataatatcaaagacaatacagtgccctcaaagactccaagatcagtttataattagttattaatctgacagatttttatacatttttaagatatatttaggttgaaaatccattttaaaaaattagcttatttcctggttcttaaagtgtagaccttaaattccagaagactgatatatacatatatatgttttgtttgtttgttctgtttagagatgacgtgttgctgtgttgcccaggctggactcgaaccaggctcaagcgatcctcccacctcagtcttccaagtaactgggactataggcacaagccatggctcctggcttcggagactgatagactttttatccaagttttacagggcaaattctattgctacaaatactatataatttgatttagaagatcttcatttaacatgtgatggcccatttatttcaagccatctttactgaaacaaaacaattaggctaatccctgcatattactaacttaccagtgttaaatgaaatttataggaggtcactggtttagactgagttcctcctgcactagggacaacagatcaaatcaaaatggagtcactcatgctgaagttccacttcaccaagccaaaactaagttgtttatctgaccttccaagcaatcaggagagacagagttagtagtcaaatcccaaacaggccagttgatatgatatgatatgactgacataaggaagtcccatctgctttaaccctaataagaaaagtaactttaaatgaccaatttgctttttcttttctgtttctgttttcctcaccccttttcagtgtatacggtagtatccctttatccgcagattcattttccaaggtttcagttacctgaggtcaactgtggtctgaaaatattaaatggaaaattccagaaataattcataatttcaaattgcaccctgttctgagtagcatgatgaaatctcatcctgccctatagtgtatataggattcagtactatccaccatttcaggcttccactggggatcttagaacatatctccccaaggccgggtgcggtggctcatgcctgtaatcccagcactttgggaggccaagatgggcagatcacttgaggtcagcagttcgagaccagcctgggcaacacggtgaaaccccatgtctactaaaattacaaaaattagccgggcatggtggcaggcatctgtagtcccagctactcaggaggctgaggcaggagaatcgcttgaacctaggagccggagtttgcagtaagctgagatcaccccactgcactctggcctgggcaacacagcaagtctccatctcaaaacaaacaaacacacacacacacacacacacacacacacacacacacacaccccttcaagataaagtgagactaccataaaaccaaccacttctgctcggctcatgagaacacttgttctattttataaaatgaggtgttgcctgattctacaatggcaaaggtgaagtaagatctttaagctaaatttgttgtaattttgtcttttgacattacaaagtattaaaaatgagtcatttcctttgtaattttgcaaatggccaagtaaagccacacttgataacattttagggcttaaaaaaaatcttgaacttggcccagcacggtggctcacgcctgtaatccaggcacagttgggggccgaggagggcagatgatgaggtcaggagattgagatcatccaggctaacacagtgaaaccccatctctgctaaaaacacaaaaaatcagccgggtgtggtggcacacacctgtagtcccagctactctggaggctgaggcaggagaattggctgaacctgggaggtggaggttgcagtgaaccaagatctcgcctctacactccagcctgggtgacagagcgagactctgtctccacggaaatctttagtaaaaggcgaaagatttatacaatttgaagagaaaccagagaatgactctgtctaaaaaaaaaaaaaatgttgaacttaagccggcaaccagataattcaggaaaagattaatcagatgaaggtgttcaagttaaatacagcaacagaccaaaaaggtactctgaaattccagactatatggctctctctacaaccgaagctaacaaacacactatgtgagtgcaatcaaacaaaaataaaactacaattgggaaaagaatgactaggttggtccaaaagaattaagaagaaaataatcatgaaatcaaagctggcagtttatgggtgaaatttttaaccccctggtatagtcaaggtaacgtaaaaagtgtcttcaaaacaaagtcacttgtgtttactactaataatctcagctttgacaaaaattctttgcttggccaaacttactcaggcttttgaattttctgtgaggcccatctgtgcacttccttgtaaaatccagtattagcaaagaaccctgctaagtctgtttagcataacatcctggatatctaatcatcctaaatatctgatcaggttcctcatcctccaccattccccaggtaatgtctgatcgccctggcctgtcttcagcaagaatcccgttaggtcggcttagccagaatcccccttatccctgatgtttccttttagcaattttccatccacgatccccacactgctgcttggctataaattcccattttctcatgctgtattcggagttgagcccagtctccctcccctactgcagggccccactgcagaggtctctatacctattgagatggttctgaataaagccttacttaccattcttaaacaagtatcattgaatatttttttctttaaaaacgtgaatgtctaattttattgtcttctaaccaactcccacccttctccccaccaaacctactcctctcgtaaacctaatctcagtaaacaagtaccccatctttctacttgttcggaactaaattttggtgtcttttacatctctaccctcaatttatcctgaaatcaatgacctctcaccacctccaccaattccactctggtccaagctacattatctctggcctggattagggcaacagttccggattggtatcccagcttctgctcctgctcaacccttcccctacaacaaagtctattctccatccagcgcccagaatgatcatttttaaaaggcaagcctggggccgagcgcagtggctcacgcctacaatcgcagaatgttgacacgccaaggtggatggatcgcttgagcccaggagtttgagaccagcctgggcaacaatggcgaaaccccatctttacaaaaaattagccaagcatggtgggtgatgtgtgcctgaagtcccaattacttcagaggctgaggtgagaggatcacctgagcctgggaagtcgaggctgcagtaggttgtgatcatgccactgcactccagcctgggagacaaagtgagatcctgactcaaaactaaaaataaaaggtaaggttctttactcaaagagtggactcccctttccactgagagtagaaactcaagtccttaaaagggcctacaaggccttatacagtctaatctcccaccacactcacctctttgactttatttctactcctctttgctttttccaccacagccaaatcagcctctctgctgtcctcaaacaagcccagcacacagggcttctgcaagcccttctgccttcctctctgctagcacatccttccctcagagaggtacatggattacccctcacttacttctggtcttggctcaaatgatatcttttctaggaagctttccctggctgcctctagttaaaattgcaaacctctcccggttccctgccctccctcttccctgccctccctcttccgtgctttttctctgtagtacttaacaccatctgacacagcacatattttatttgtttattatctgaggtccccactagaatataagctccatgaaggagcagatatttatgttttcttagaaaagtatctgacacgcagtaggtgctcaataaatatttactaaatacatatatataattatatagtttgtgaagtatttttatgcaaattacagcaattcatttttccttatgccctctcttcttcaaattctccaatctttgtagtaacaatatggatgacagcaaagagctatcagaaaaagagttgttggccacttaacaaagctctttaaaacagataccccatattaatcaactacatctataaattgaaagcttaaagtcaacatctttattagcatagatgaatctaggcgtggaattttaaaataatagcgcagaagagccaagaatcatcaggaagaaaagtctaattcagtttgtcctatcaatctgttaaacaaacaataggaaaatgcaacctgcatttgatcttcaaggaaacactggcccaaattcaacacgaacgcattcaacacaagattcgactcccttaaaattttctatctgcttaaaacaaaccccattaactatcaagtgccgtcgctgggtgtgtatggtctgccgagcggatcggggatgttttgctatgttttgtttaaccagataagaattagcgttaaggaaacgtttcttaaagcctctgtatcccctggaccattaaacaaccccttcgttgggctttacactgtggtaccggggtcttctcgggtaatttcccagcttatttaactcatcagaagcgaaggggcatctcagtcaggctccagtgataccggagacagacggcagatgtctcaggggatcccctggaaagagaggctctcgcccagtcaaagggtgtcacggacaggaggaaagagcggaccgaggcgcacggtgtaggtgacaggtgggcgagcgccgcagggcaacagcgcggggagtgaccggctgggtggtggcgcggaaaccgtcaactcccatcgtcaacctgacagcttgggcccagctgggctgagtagtgcagcggcacaggatcaaaaaataaaataaaggtagcaacacaccgccgtcagcctgctcgacctcgccccccgcgcgctgcgaaataaagttagtgcccagtggccgctgcaatggcccagaggggcccagccgagctcccgcccgcggcccggcggctgtcaaaggcggcccggcgccgcgagaagtcccagagcccagaagccagagaggacgccccgagctggcgcgtcaggccgagtgccctcgcgccctcgcgccctcagcccggcggtcccggccctcaacccaggctgacagccaccagccccaaaccgcctcccctccaggccacgcagaggggccgggacccggaaccttctgccggcagcgtcggcgcccggcggccgcctttacctggtttgtggcagctgcggccgccgcgcactccccctctcccggagaaccccgagccgacgccgctgccgccgccgc

SEQ ID NO: 1852 - DNA, 5805 bp, Homo sapiens
  source 1..5805: mol_type = genomic DNA
ctgggggtcagagagaagggagaggcctccttctgaggggcggcttgataccggtggaggtaagctggccgaggctctgtgaggagtcaaggtgaggtgctgagggaagactgaggatgtccccaccccagatagaggacccgaaagaaccaagtgccgtctctgctcccagccctggaccacccgggggccgatctggggctgacttgtgaggctgggccgaccccctccctccgccgctcaagctgctgggcactctggagtgagagcttggtgtgaccagggcagggctggttaggagagggcagggcccaggctctgccgggcatcaaggccaggaccctgagggaggctgggcccccccaacccaaccatgacctacagccccaggttccccagccccatcctcagctccactctacaccccaccccaccccaccccaccccaccccaccccaaactccaccccacccccccaactctcccgcggcagaatctggttccgcccctgttgtcaacccagggaagccccaggtgcccggatgtacggccagtgactcccacactgggggtcagagagtagcgggggcctcgctgtgaggggcgggtcgatatcggtggagggaagcgggcccaggctctgtgaggaggcaaggtgagaccctgagggaggactcaagaccccccgccccagatagaggaccccaaataatacagcgccgcccctgtgccagccctggaccaccccgcggggtcgggcgtatcaggctgggcccaggctctgactggcatcaaggtcagaaccctgagggagggctgaacgcctccacacccctaacccagccaccaccaccatgacctacagcctcaggttccccacctccatcctcaccccccccccactccaccccacccccaagtctcccgtggcagaatccggttcggctcctgctgtcaacccagggaagctccgggtgcccggatgtaaggcctctgacttgcgcactgggggtcagagagtagcaagggcttggttctgagtggtggctgaagatcggcagagggaagcgggcccaggctctgtgaggaggcaagatgagacgctgagggaggactgaggacgcccccaccccagatagagggccccaaataatccagcagcacccctgctgccagccctgaaccaccccgggggcggacttctcaggctgtgggccacccttcgccaccccaccacttaagccccaggggactctgggtcagagcttggtgtgaccagggcaggactggttaagagagggcaggggccaggctctgccaggcatcagggccaggaccctgagggagggctgaggccccatagagggagtcactgcccctgcagtggaccctgggaagttccgggcatggcggtcaggcaagcggatcgtgatatctgcatcctgggctgaccgagggaaggggcttggtatcgttagcgtggccgcgggagaacagagggagggcccaggtcctgctgggagacaagggaggcctgaggggacccagtaccccaggacaaggggcccaccccgcccctatctgagaccgaggcccctcctcattcagcctcgggaatccgacagatagagactcaggtccacagaggggtggggcccagccctctaggagaccagggaaggaacaagacggaggacagaggggaccccggagtccagctcagtggggatcttggcctgggcgatcccgggcacggtggccgcatgtggtgcattgtggctggtgggatcgggtgtcaatgggaacagggctgtggtatgaggagtggggcctcaggtgagcagaaggaggagtcccagaggcctgaggaaggattcaccagacctctcatcccagacctaggaaacctgcccctgccgtcagtcttggaaggccccaggcaggacggtgaggaagggaagtgccccctccacccccaacacacactttctcaaagagggtctaagggagaaattggccttggtctgcaagactcacctctggttcagcaaaatggaaggggccagattctgtcagaagcaaatatgaatacctagaggacacccagaccgacgaggccccctggaacctgctcctttggtcagccttgggtatctcatgcatgagtgaccatgaggtggcccctcacttctgcctcccgggtctccgggaggtgggggccttggtccgaggggtttcctcagctcagcagagggagccacacctggtcagcacagggtggaatccagggtcttccaggagtgacggggaggaagtttggtgaggactgaaggtaagaaggtacctccacgctctcaaaaaagaaaggacctcacagacactggtgtcacctgttctcagccccaggtggccccaggcaggaatggcatgaggcatgctctcatttctcccacgtgactgggggtgagaggtctcagggaggtgagtaccttgatcccagggggcactgagagatccaacagagggctccacacctggtcagtagaaggaggactcccaggatcagcaggacccaaggtgtgcccccttcatgaggaatggaggtacccccaacgcagaaagaagccaccccacagagtctaggtgaactctgttcttagatctgggggcgggggggggcctgatcaaggatggtgctaagtggcaagctcatttgtaccacggcaggaagttgaggaaccctcagggggatgaggcgttggtgtaaagggagatgtctgctcatctcaagggtttgagggtcgaggaagtagaagccccagcaggagtaaagatgaataacccgcaggaggactttggaacacccacctcatacctgaagggttcagctggtggggtcagccccggacaccccacgcaggggtgacatatgtggggcctcctcacctctgtttctggatctcagggaggtgaggactttgttctcagagggtgtgtgtggacaaaacagggaggccctgtgttcgacagacacagtggtcccaggattggagagcagtccaggtgaggaacctaagggaggatcgagggtacctccaggccagagaaactctcagatcaagagagtttgccctgcccctactgtcaccccagagagcccgggcagggctgtctgctgaggtccctcctttatcctgggatcactggtgtcggggagggctggccttggtctgagggggctgcactcacgtcagcagagggagggtcccaggccctgccaggagtccaggtgcagactgaggggaccccactcaccaaacacagaggacctagccccaccctgccccttgtgtcagctgagggaagccgctgggtggatggactcccctcacttcctcttcaggtgtctcctggagatagggcctcaggtcaacagagggagggttccagaccctgcaggcatcaagatgaggaccaggcagtatcctcaccccaggacacatggaccccattgaatttagacatctcttactgtacttccgaggaaaccctgggcaggtgtgggcagatgttggttggggcatgtccttctgttctatatcagggatgtgagctcctgatctgagagactctcaggcaagtagaggagtagagtccagtccctgccaggagaaaggtcagggccctgagtgagcgcagaggggaccatccaccccaaaagtgtgtagaactcaagagtgtccagcccgccctcttgacagcactgagggaccggggctctgcctgcagtctgcagcctaagggcccctcgattcctcttccaggagctccaggaagcaggcaggccttggtctgagacagtgtcctcaggtcgcagagcagaggagacccaggcagtgtcagcagtgaaggtgaagtgttcaccctgaatgtgcaccaagggccccacctgccccagcacacatgggaccccatagcacctggccccattccccctactgtcactcatagagccttgatctctgcaggctagctgcacgctgagtagccctctcacttcctccctcaggttctcgggacaggctaaccaggaggacaggagccccaagaggccccagagcagcactgacgaagacctgtaagtcagcctttgttagaacctccaaggttcggttctcagctgaagtctctcacacactccctctctccccaggcctgtgggtctccatcgcccagctcctgcccacgctcctgactgctgccctgaccagagtcatcatgtctctcgagcagaggagtccgcactgcaagcctgatgaagaccttgaagcccaaggagaggacttgggcctgatgggtgcacaggaacccacaggcgaggaggaggagactacctcctcctctgacagcaaggaggaggaggtgtctgctgctgggtcatcaagtcctccccagagtcctcagggaggcgcttcctcctccatttccgtctactacactttatggagccaattcgatgagggctccagcagtcaagaagaggaagagccaagctcctcggtcgacccagctcagctggagttcatgttccaagaagcactgaaattgaaggtggctgagttggttcatttcctgctccacaaatatcgagtcaaggagccggtcacaaaggcagaaatgctggagagcgtcatcaaaaattacaagcgctactttcctgtgatcttcggcaaagcctccgagttcatgcaggtgatctttggcactgatgtgaaggaggtggaccccgccggccactcctacatccttgtcactgctcttggcctctcgtgcgatagcatgctgggtgatggtcatagcatgcccaaggccgccctcctgatcattgtcctgggtgtgatcctaaccaaagacaactgcgcccctgaagaggttatctgggaagcgttgagtgtgatgggggtgtatgttgggaaggagcacatgttctacggggagcccaggaagctgctcacccaagattgggtgcaggaaaactacctggagtaccggcaggtgcccggcagtgatcctgcgcactacgagttcctgtggggttccaaggcccacgctgaaaccagctatgagaaggtcataaattatttggtcatgctcaatgcaagagagcccatctgctacccatccctttatgaagaggttttgggagaggagcaagagggagtctgagcaccagccgcagccggggccaaagtttgtggggtcagggccccatccagcagctgccctgccccatgtgacatgaggcccattcttcgctctgtgtttgaagagagcaatcagtgttctcagtggcagtgggtggaagtgagcacactgtatgtcatctctgggttccttgtctattgggtgatttggagatttatccttgctcccttttggaattgttcaaatgttcttttaatggtcagtttaatgaacttcaccatcgaagttaatgaatgacagtagtcacacatattgctgtttatgttatttaggagtaagattcttgcttttgagtcacatggggaaatccctgttattttgtgaattgggacaagataacatagcagaggaattaataatttttttgaaacttgaacttagcagcaaaatagagctcataaagaaatagtgaaatgaaaatgtagttaattcttgccttatacctctttctctctcctgtaaaattaaaacatatacatgtatacctggatttgcttggcttctttgagcatgtaagagaaataaaaattgaaagaataa

SEQ ID NO: 1853 - DNA, 5807 bp, Homo sapiens
  source 1..5807: mol_type = genomic DNA
ttattctttcaatttttatttctcttacatgctcaaagaagccaagcaaatccaggtatacatgtatatattttaattttacaggagagagaaagaggtataaggcaagaattaactacattttcatttcactatttctttatgagctctattttgctgctaagttcaagtttcaaaaaaattattaattcctctgctatgttatcttgtcccaattcacaaaataacagggatttccccatgtgactcaaaagcaagaatcttactcctaaataacataaacagcaatatgtgtgactactgtcattcattaacttcgatggtgaagttcattaaactgaccattaaaagaacatttgaacaattccaaaagggagcaaggataaatctccaaatcacccaatagacaaggaacccagagatgacatacagtgtgctcacttccacccactgccactgagaacactgattgctctcttcaaacacagagccaagaatgggcctcatgtcacatggggcagggcagctgctggatggggccctgaccccacaaactttggccccggctgcggctggtgctcagactccctcttgctcctctcccaaaacctcttcataaagggatgggtagcagatgggctctcttgcattgagcatgaccaaataatttatgaccttctcatagctggtttcagcgtgggccttggaaccccacaggaactcgtagtgcgcaggatcactgccgggcacctgccggtactccaggtagttttcctgcacccaatcttgggtgagcagcttcctgggctccccgtagaacatgtgctccttcccaacatacacccccatcacactcaacgcttcccagataacctcttcaggggcgcagttgtctttggttaggatcacacccaggacaatgatcaggagggcggccttgggcatgctatgaccatcacccagcatgctatcgcacgagaggccaagagcagtgacaaggatgtaggagtggccggcggggtccacctccttcacatcagtgccaaagatcacctgcatgaactcggaggctttgccgaagatcacaggaaagtagcgcttgtaatttttgatgacgctctccagcatttctgcctttgtgaccggctccttgactcgatatttgtggagcaggaaatgaaccaactcagccaccttcaatttcagtgcttcttggaacatgaactccagctgagctgggtcgaccgaggagcttggctcttcctcttcttgactgctggagccctcatcgaattggctccataaagtgtagtagacggaaatggaggaggaagcgcctccctgaggactctggggaggacttgatgacccagcagcagacacctcctcctccttgctgtcagaggaggaggtagtctcctcctcctcgcctgtgggttcctgtgcacccatcaggcccaagtcctctccttgggcttcaaggtcttcatcaggcttgcagtgcggactcctctgctcgagagacatgatgactctggtcagggcagcagtcaggagcgtgggcaggagctgggcgatggagacccacaggcctggggagagagggagtgtgtgagagacttcagctgagaaccgaaccttggaggttctaacaaaggctgacttacaggtcttcgtcagtgctgctctggggcctcttggggctcctgtcctcctggttagcctgtcccgagaacctgagggaggaagtgagagggctactcagcgtgcagctagcctgcagagatcaaggctctatgagtgacagtagggggaatggggccaggtgctatggggtcccatgtgtgctggggcaggtggggcccttggtgcacattcagggtgaacacttcaccttcactgctgacactgcctgggtctcctctgctctgcgacctgaggacactgtctcagaccaaggcctgcctgcttcctggagctcctggaagaggaatcgaggggcccttaggctgcagactgcaggcagagccccggtccctcagtgctgtcaagagggcgggctggacactcttgagttctacacacttttggggtggatggtcccctctgcgctcactcagggccctgacctttctcctggcagggactggactctactcctctacttgcctgagagtctctcagatcaggagctcacatccctgatatggaacagaaggacatgccccaaccaacatctgcccacacctgcccagggtttcctcggaagtacagtaagagatgtctaaattcaatggggtccatgtgtcctggggtgaggatactgcctggtcctcatcttgatgcctgcagggtctggaaccctccctctgttgacctgaggccctatctccaggagacacctgaagaggaagtgaggggagtccatccacccagcggcttccctcagctgacacaaggggcagggtggggctaggtcctctgtgtttggtgagtggggtcccctcagtctgcacctggactcctggcagggcctgggaccctccctctgctgacgtgagtgcagccccctcagaccaaggccagccctccccgacaccagtgatcccaggataaaggagggacctcagcagacagccctgcccgggctctctggggtgacagtaggggcagggcaaactctcttgatctgagagtttctctggcctggaggtaccctcgatcctcccttaggttcctcacctggactgctctccaatcctgggaccactgtgtctgtcgaacacagggcctccctgttttgtccacacacaccctctgagaacaaagtcctcacctccctgagatccagaaacagaggtgaggaggccccacatatgtcacccctgcgtggggtgtccggggctgaccccaccagctgaacccttcaggtatgaggtgggtgttccaaagtcctcctgcgggttattcatctttactcctgctggggcttctacttcctcgaccctcaaacccttgagatgagcagacatctccctttacaccaacgcctcatccccctgagggttcctcaacttcctgccgtggtacaaatgagcttgccacttagcaccatccttgatcaggcccccccccgcccccagatctaagaacagagttcacctagactctgtggggtggcttctttctgcgttgggggtacctccattcctcatgaagggggcacaccttgggtcctgctgatcctgggagtcctccttctactgaccaggtgtggagccctctgttggatctctcagtgccccctgggatcaaggtactcacctccctgagacctctcacccccagtcacgtgggagaaatgagagcatgcctcatgccattcctgcctggggccacctggggctgagaacaggtgacaccagtgtctgtgaggtcctttcttttttgagagcgtggaggtaccttcttaccttcagtcctcaccaaacttcctccccgtcactcctggaagaccctggattccaccctgtgctgaccaggtgtggctccctctgctgagctgaggaaacccctcggaccaaggcccccacctcccggagacccgggaggcagaagtgaggggccacctcatggtcactcatgcatgagatacccaaggctgaccaaaggagcaggttccagggggcctcgtcggtctgggtgtcctctaggtattcatatttgcttctgacagaatctggccccttccattttgctgaaccagaggtgagtcttgcagaccaaggccaatttctcccttagaccctctttgagaaagtgtgtgttgggggtggagggggcacttcccttcctcaccgtcctgcctggggccttccaagactgacggcaggggcaggtttcctaggtctgggatgagaggtctggtgaatccttcctcaggcctctgggactcctccttctgctcacctgaggccccactcctcataccacagccctgttcccattgacacccgatcccaccagccacaatgcaccacatgcggccaccgtgcccgggatcgcccaggccaagatccccactgagctggactccggggtcccctctgtcctccgtcttgttccttccctggtctcctagagggctgggccccacccctctgtggacctgagtctctatctgtcggattcccgaggctgaatgaggaggggcctcggtctcagataggggcggggtgggccccttgtcctggggtactgggtcccctcaggcctcccttgtctcccagcaggacctgggccctccctctgttctcccgcggccacgctaacgataccaagccccttccctcggtcagcccaggatgcagatatcacgatccgcttgcctgaccgccatgcccggaacttcccagggtccactgcaggggcagtgactccctctatggggcctcagccctccctcagggtcctggccctgatgcctggcagagcctggcccctgccctctcttaaccagtcctgccctggtcacaccaagctctgacccagagtcccctggggcttaagtggtggggtggcgaagggtggcccacagcctgagaagtccgcccccggggtggttcagggctggcagcaggggtgctgctggattatttggggccctctatctggggtgggggcgtcctcagtcctccctcagcgtctcatcttgcctcctcacagagcctgggcccgcttccctctgccgatcttcagccaccactcagaaccaagcccttgctactctctgacccccagtgcgcaagtcagaggccttacatccgggcacccggagcttccctgggttgacagcaggagccgaaccggattctgccacgggagacttgggggtggggtggagtggggggggggtgaggatggaggtggggaacctgaggctgtaggtcatggtggtggtggctgggttaggggtgtggaggcgttcagccctccctcagggttctgaccttgatgccagtcagagcctgggcccagcctgatacgcccgaccccgcggggtggtccagggctggcacaggggcggcgctgtattatttggggtcctctatctggggcggggggtcttgagtcctccctcagggtctcaccttgcctcctcacagagcctgggcccgcttccctccaccgatatcgacccgcccctcacagcgaggcccccgctactctctgacccccagtgtgggagtcactggccgtacatccgggcacctggggcttccctgggttgacaacaggggcggaaccagattctgccgcgggagagttgggggggtggggtggagtttggggtggggtggggtggggtggggtggggtgtagagtggagctgaggatggggctggggaacctggggctgtaggtcatggttgggttgggggggcccagcctccctcagggtcctggccttgatgcccggcagagcctgggccctgccctctcctaaccagccctgccctggtcacaccaagctctcactccagagtgcccagcagcttgagcggcggagggagggggtcggcccagcctcacaagtcagccccagatcggcccccgggtggtccagggctgggagcagagacggcacttggttctttcgggtcctctatctggggtggggacatcctcagtcttccctcagcacctcaccttgactcctcacagagcctcggccagcttacctccaccggtatcaagccgcccctcagaaggaggcctctcccttctctctgacccccagtgcgcac

SEQ ID NO: 1854 - DNA, 69204 bp, Homo sapiens
  source 1..69204: mol_type = genomic DNA
ttagattgtaaaagtttattgatatggtcaaaaagcaaacagccagacatttggttatctttgccactacaatgtgtcattctgaactgtatcttaaaaatgcataacaaatgatatttaaaccattaccagaaaagtaaatgaagagtctacttaaggcacttcatatgaaagctaattcaaaattttcacaaaagtcacactattttataagtgtagtaaattaccttctacacattttagccagaatgctgcctttctccttacagaagaatgtgctcttaaagggagaaaaagcaaatacaaaaaattgtcattctgtcaatgttcatgacaaattatctggaactatacagattacatggcagtagtattcccgtggtcaatctgtacaaatcagggcatcttcatacaagtctcataagaaccacagcatagatttggcctgagacaagtacaagaatagcaggtaaggaattcagaatctcacaatttacaagtgagtaattaacaaaaactggctgctccattaaaaagtaaaaggtcaaccatatcccctcatccatgaaatctagtaacgaaaaacaaaaaacccacataaaatatttcttctgaggctactatatccatctctttctgcaaaccacatggcagggttattagaaggtaaatggcaggtggcagtcatagtatctttttaatgtaatacttgtaagatttccttaaaattattttttcacaattacaattatcctatttccacaatagtggcatttcaggttactcttcataactatgggggaggttatagttagatataatgataaccatgaaaacattcttcacagaaatttggttagcacatatggttatttctactgacagaaaccaaaagacaaaataaaaaaaatcccttcaaattggtactttgtttctccacctaaaggaagagaataaagactaaaataacagcaaaacatagaacagctttcgagaaacgcttaatttctatatacaggcatcagctcaatattttatgatttttctttcccattctaagggagtccttttctttcttacttttttttttttttttgagatggagtctcgctctgttgccaggctggagtgcagtggtgtgatcttggctcactgaaacctccatctcctgagttcaagtgattctcgtgcctcagcctcctgtgtagctgggattacaggctcctgccaccacacccagctaatttttatatttttagtagagacggggtttcaccatgttggccaggatggtctcgaactcctgacctcgtgatctgcctgccttggcctcccaaagtgctgagattacaggcgtaagtcactgcgcctggccagggagtccttttctaactgagcctatttttctcttaggtacaaatggaataagtgacaaactctaatttgtagaaacattttaggccatgtataagttacactgattttagcactaagctatatttttatcacagatgggtcaccttaaaagaaaactaaggagatggaatgaatctgaaatctttctaaatacaaggtagttaacaccatactcaagcagaaattataatcctgtatttagagatacttttttttgagacagagtctcactctatcactcaggctggagcgcagtagcgtgatctcggctcactgcaatctccgcctcccaggtattaagcaagtctcgtgcctcagcctcccaagtagctaggattataggcatgagccaccaagcccagctaattttcatatttttagtagagacggggttttgccttgttggccaggctggtctctaactcctggcctcaagcaatccacctgcctcggactcccaatagatgtcttttcatgttcacagctatcgagaagcatagacattgctggtgtggtagctcacacatgtcatcctcgcactttgggagactgaggcgggcggatcacttgagcccaggagttcaagaccagcctggacaacttggcgaaaccctgtctctactaaaaacacaaaaattagcctggcatggcggtgcacacctgtaaatcccagctacttgggaagctgtgacaggagaatcgcttaaacctgggaggcagagtttgcagtcagccgagctcacgccactgcactccagcctgtgtgacacagcgagaccgtctcaaaaaaacaacaaaacaaaaacaatcatagacagcactgtatttcagtaggaaatatgcaaggaggaggagaaacaactgtcttgctgagggctagacgtgtgctctgaagaatggtgttccattttcagaagaccacatgacacacataatttctctactcaaaaggaaagatgcgtaaagtatacacatccacacaaagatgaagaagctaagaatgaattcctaatgtagttatctgtaacaggcatatgtgggaacacctggtcaggacttactttccccatctttggataaggcaatataaaatcagatgaccaagttaactaaagtagttttgagctttgttctaactaaaacaaagtagtagttttacaatttttataatatacttaattgtactaaattaaatgttccataaagttcactgggaagagaaggttaagaggataattattttcaaatacctcagattttgacagaggattgcttgttaaggcactacacatcttctttggttaaatgattaactatttaaatcacttgaaaaaaagaggtaatacaaaatatacaagttgcattcttcttttcaaacacacacgattttcgtttttcaatttccagtactccagtgtctatatatctctgggacctttttaactcatcagaaagctgaaacaaaaatatattccaatctattagtctctgaaagaaaagtaggatttacttttaatcaataagcagtatgttggttttaacagataaaagagcattttggtacgtacatgataatctttgggtatcaataacaaaaagtgagaaacactgagagacccgttagtcttatgacaaaaggaaatagaataacctcaagttaaaatatctcctgaatagagacactaattaataattttattttttcatttttttagagatggggtctcactgtgttgcccagtctggtctgggactcccacgctcaagtgatcattctgtcttagccttctgagtagctgggactacaggcacatgacactgctattgaatcaactctgctgatcaaataattaacagaagtcccagcaaaattaccttcacatctcaattagtattctgtagaggataaattattataattattatttttgagatggggtctcactctattactcagactggagtgcagtggcactctatttcttaaaaaaaagtagaggcgagaagaagtttttaacattaaaaaaaatcatttcttcttcaaaaggaagtataatatgcagacaaggagctatgtgaatagataatggcataaaatgttctaatcattatgtatttctagaatacatatgagatttctagaataaattaggtatggcaaaataaatctaaaagatgttcctgagaaatcacatactaatattgtccattatactataattaatttttatatgggaacatatctgaattacagctgtttgggcatggtggctggctaatgcctataatcccagccctctgggaggctgagcaggagactcgcttgatgccagaagttcaagaccagcctgggtaacatagcaagaccctgtctttacaaaaaataaaaatattagctgggtgtggtcatgtgcagctgtagtcctagcctcttgggaagctgaggtgaaatgatggcttgagctcaggagttcaaggttacaatgagctatgaacacgccattacacttcagcctgagtgacagagtgagaccctgtctctgaaaataaatgaataggccgggctcagtggctcatgcctataatcccagcactttgggaggatgaggcgggtggatcacttgaggtcaggagtccaagacctgatcaacatggtgaaaccccgtttctactaaaaatacaaaattagccgggcatgctggcacacgcctgtaatcgcaactacttgggaggctgaggcaggagaatcgcttgaacccgggaggcagaggttgcagtgagccgagattgcgccattgcactccagtctgggcaacaagagcaaaactccatctcaaaaataaataaataaataaataaataataaataaatagatgaataaataaaaataaagcctatatctttcctttataagctaaaatagtttggaagcaaagcaaaaagaaggatattataaagcaatatcaactctaatcattccaggtattggtaatcactgtataaacaaaaaataagaatcatacctgtatgggtagccatgatatttagatctaaaaatagagagcatccaactgaagaataatacaacaagtccaataccagccacacacattactgcagaaaaataaaaggagagtaaaatgagcaggttgagtataataaataaccatggcagtctatactttctttttttattttattttattttattttattttattttattttattttattttattttattttatttttgagacggagtctcgctctttcgcccaggccggagtgcagcggcgcgatctcggctcactgcaagctccgcctcctgggttcatgccattctcctacctcagcctccagggtagctgggactacaggcgcccgccactgcgcccagctaattttttgtatttttagtagagacggggtttcaccttgttggccaggatggtctcgatctcctgacctcatgatccgcctgcctcagcctcccaaagtgctgggattacaggcttgagccaccatgcccggcctggcagtctatactttcagagagtgaaaaggaaggggtatacattattgataaatctcaacttttcaacaattttcatccctatttcttaatcttcaggaatctgccttcccctttaatttgctccattacaatgtaatagagtaactcctttacataattatgcaattcaaatgtatgaaataatgaattcctttaaagtcatcacactgaaaggtttactgttagaaacactgttacaatcgacaagaaaatcacccatttggttttttggttttcttttttttttttttttgagtcagggtcttgctctgttgcccaggctgaagtgcagtggcacaatcacagctcactgcagtctcaacctcctgggctcaagcaatcctcccactacagcctcttgagtagctgggactacagatgtgtgccaccatgcctggctaattttttaatttttttgagaagacggtgtctcactacattgcccaggctggtgttgatctcctgggctcaagtgatcttccgcttcagcctcccaaagagctgggattacaggcatgagccacggtgcccggcttacttatttattgaactttaaaacccctaaaagtggccttgtagtattgataaacattaacttagacatctgatgacttcattgtgatagcctcacttgaaagtactttattcatgcacagataactacacagccttatatatgtaactcaataaacatggatttcttatttgaatgagaaaaaaaatctgatccctagccctagattcatagctctctccactaatcccacatgtcatgtcctacattagcacagcagttattaaagtgaactacaaatactaatccccaaatgcgcaagtatggattgtcatgatgtgaagctctttcaatccccggactaaaaatggctaagaactatagagatagggatgtagggaagcatgtgtccaacagcaaaggaagctctagggcaggggtgtccaatcttttggcttcccagggccgtactggaagaagagctgtcctgggccacaaataaaatacactaacactaatgatagctgataagctgaaaaaaaaaaaaattgcagaaaaaaaccctcatgatgttttaaggaagttgacaagtttgtgttgggccgcatgtggcccacagactggacaagtttgttctagggtaacatacttagtgactgataagaaaatcaattttcggccgggcgctgtggctcatgcctgtaaccccagcactctgggaggccaaggcgggtggatcacgaggtcaggagttcaagaccagcctggccaagatgatgaagccccatctctactaaaaactacaaaaaaaattagccaggcgtggcggcaggcacctgtaatcccagctactcgggaggctgaggcaggataatcgcttggcaaagcttgcagtgaaccaagatcgcgccactgcactccagcctaggcgaaaaagcaagcctctgtctcaaaaaaaaaaaaaaaaaaaaaaaaaaagaaaagaaaagaaaatcaactttcagttttgttttacttatggaacaattcttttgccttttctaattgttacacaatatgactagggcttaatgtgtaaatgttaaacaatatttctctttaattcttttctaatttacaaaaaagaagtgcagcttgctgccaatgctcatttaattttatataatcacgctgtttgaggctgaagtaaatctgactgattttcaatgtgaaaataaaacaaaaactgttgttggagttattactaaacagaactaacatcagaatcgtctgaatcatcacaatagtctatttcagaaaaattgaattcatcaaatgaatctttggccaacaactgttcgagaatggtgtaaacattacacgtggaatgctacattttctaggatttgacattttcagtgatcaagaattactatattttgtaaatggaaataccactataatggaaataaaaatggactgatgtctagtatattagtatattattctatttacagcactctgttttcagtagtggtaatggatcacttgaacccagtgatatctaacatatcaattttgtttccaaagttgatatactagagtggatgtgaaaacaataattaaagcacgatattttgtggcagagttatctcagcgtaaacactgcagccacaagcactgccagtgagtattctcagggcaaatgggaaaagggttaacttaaccaaagaagtgaaagaactctatgatgaaaactataaaacactgctgaaagaaactgaagaggacatcgaaaaatggaaagatgttccacgttcatggattggaagaatggatgttgttaaaatgtccatactatctaaagcaatctatagattcaatgcaatccttattaaaataccaatgacaacttcacagaaatagaaaaaacaaaatttatatgaaatcacaaaagaccaatgatagtcaaagctatcctaagcaaaaagaacaaaactggaggaatcatattacttgacttcaaattatactatagagttatagtaaccaaaacagcatagtactggtgtaaaaacagacatacagaccagtgggacagaagacagaactcagaaacaaacccatacacctacagtgaactcattttcaacaaaggtgccaagaacatccactggagaaaacacagtctcttcaataaaaggtgccaggagaactggatatccataggcagaacaaaactagacccctatctcttgccatataggaaaatcaagtcaaagtggattaaagacttaaatctaagactgtacaccatatatatatatatgcatatatgtatatatatgcatatatatacatgtgtgtatatatatgcatatatgtatatatatgcatatatatacatgtgtgtatatatgcatatatgtatatatatgcatatatatatatacatgtgtgtatatatatgcatatatatatacacacacacacataaataaaagacaagagtcttgctctgttgctcaggctggagtgcagtggcatgatcttggctcactgcaacctccacttcctgggccaagcaatcctcctgcctcagcctcccaagtagctgggactacaggcacacaccaccacacctggctaatttttgtatttttagtagagacagggtttcaccatgttggccaggctggtctcgaactcctggcctcaagtgatctgcccttcttggcctcccaaagcattgggattacaggtgtgagtcactgtgcctggcctaagactgcaaactattaatatgaaacaactataagaaaacaatggggaaactctccaggacattagtctgggcaaaaatttcttgagtaataccccagaagcacaggcaaccaaagcaaaaatagacaaatgagatcacatcaagtttaaaagcttctgcagagcaaaggatacaatcaacaaagtgaggagtcaatccacagaatgggagaaaatatttgcacagtacccatgtgacaaggggttaataaccagaatataaaaggagctcaaacaactctacaggaaaaaaactaatgatctgatcgaaaaaacataaaatcttttttttttttttttgagacggagtcttgctctgtcgcccaggctggagtgcagtggtgtgatctcagctcactgcaagctccacctcccgggttcacgccattctcctgcctcagcctcccaagtagctgggactacaggtgcctgccaccatgcccagctaatttttttgtattttttttcagtagagatggggtttcactgtgttagccaggatggtctcgatctcctgacctcatgatccacctgcctcggcctcccaaagtgctgggattacaggcgtgagccaccgcaaaaaaagaaaatatttcaatagacgtttctcaaaagaagacatacaaatggcaagtaggcataaaaaaactactcaacatcaatgatcatcagagaaatgcaaataaaaattgcaatgagatatctatcatctcaccccagctaaaatggcttatatccaaaagacaagcaataataaatgctggcgaggatgtggaaaaaagggaacccttgtacactgttgtacactgttggggggaatgtaagttagtataaccactaagaagaacagtttggaggttcctcaaaaaactaaaaattgaaccaccatatgatccagcaatcccactgcttgggtatacacccacagaaaaataaatcagtataccgaagagatatctgtactcccatgtttgttgtagcactgttcccaatagccaacatttggaagcaacctaaatgtccatcaacagatgaatggataaagaaaacgtggtacatatatacaatggagtactattcagtcattaaaaaaataagatcctgtcacttgcaacaacatggaactggaaatcattattattattgttgagatggagtctcgctctgtcacccaggctggagtgcagtggcgccagcttggctcacttcaacctctgccttccaggttcaaacaattctcctgcctcagcctcctgagtagctgggattacaggtgtgcaccactacgcccagctaatttttgtattttagtagatacggggttttaccacgttggccagggtagtctagaactttctgacctcaaataatctgccccacttggtctcccaaagtgctgggattacaggagtgagccaccatgcccagccttggaagtcattaagtgaaacaattcaggtacagaaaaaaaaatcatatgttctcacttatttgtgggatcaaaaaatgaaaacaattgaactcatggacacagagagtagaaggatggttaccagaggctgggaacggtagttggggaatgccgggggaagtacggatggctaatgggtaccaaaaaaaatagaataaataagacctactatttgatagcacaacaggataactatagtcaataataatttaattgtacattttaaaataactaaaaaagtataattggattgtttatgacacaaagggtaaatacttgaaggatggatactgcagtctccgtgatgtgactattacacattgcatgcctatatatcaaaacatctcatgtatcccataaatatatacacctactatgtacccacaaaaattaaaaataaaatacttttcctgagtattaacacatgctgagtgtagacaagttagccttttattctctaagaaaatgtactcatagactgcgtgtgatggctcacgcctgtaaatcacagcatttggggaggccaaggcagaaggattgcttgagcccaggagttcaagaccagcctggacaatgtagcgaggccccatctctacaaaaaattacccaggtgtggcagtgcatgcctgtagtcccacctactaggaaggctgaggtgggaggatcacctgagccagggaggtcaaggctgcagtgagttatgatctctccacagcactccagcctgggcgacagagtgagaccctgtctcagatttaaaaaaaagaaaaagaaaatgtgcacatacgtatatacagcatcactctgtatatatttgtatcctcctcttttcatacatctaaaagtgcttagagcagttcccagaacatgctaaagaaacgtctattaatttgtgatcattttgttaggtaagaaacttaggagatcaaattgtgactatttcagtatatgttgccaaaatgtttaacaatttaagttcatgtcagtaatgtactttgatggccttttcccaagaataaacactgaaataggcaatttttaaacagtcaggcaaagtctacagccatagcaccctgaacgcgcctgatctcgtaaaaagtcaggcagtgaaaggacatatactgactggattaaaaactataaaatgcttactttggcagcatatatactaaaactggaatcatacagagaagattagcatggcccctgtgcaaggatgacatgcaaattcgtgaagtgttccatatttttttaaaaaaattttaaaaactgatacattaattatttttctaacacgtaaaaattcatttttttagagattgagtctcgctctgctgcccagactgaagtgcagtggtgtgatcatagctcactgcagcctctaactcctggcctcaagccatcctcctgtcccagcctcacaagtagctgggactacaagtgcgttgtaccacatccagctaaaaaaaatctattttaattgagcaaaacaagtatttctcaaattttaagttcagtatcttcatcttttttctagaagttaaagtaaatattagactttatttaggtagggtaatttttatgacatttaacttttttatttatttatttattttgagatgaagtctcactccgtcgcccaggctggagtgcagtagcgcgatctcggctcactgcaacttccgcctcctgggttcaagtgattctcatgcctcaaactcccaagtagctgggattacaggcacgtgacaccatgcctggctaatttttgcttttttagagacggggtttcgccatgttggccaggctagtctcgaactcctgacctcaggtgatccacctgccttggcttcccaagtgttgggatttacaggtgtgagtcaccacgcctggttgacatttaactttttaatcataaaaggaaaatcttgacttatttcatgaaagtaaaaccaaattacattgttagattctctctgcaacagataacaatgtgtgaatattctaatatataaaaagttcatgcaggctgggcatggtggctcacgcctgtaatcttagcactttgggaggccacagtgggaaaggttgcttgagcacaggagatacagaccaacctcggcaataaagtgagaccccatctctacaaaaaataaaattaaattaactgggagtggtggcatgagcctgtggtcatagctacctgggaagctgaggcagtaggactgctggagcccaggagttcgaggctacagtgagtcattattgtggcactgcactccagcctgggcaacagagtaaggcctggccttaaaaaaaaaaaaaaaatgtccagctgagcacggtggctcacgcctataatcccagaactttaggaggctgaggcaggcacatcatgaggtcaggagttcgagaccagcctggccaacatggtgaaatcccgtctctactaaaaatacaaaaattagctgggcgtggtgacgtgcacctgtaatcccagctacatgggaggctgaggcaggagaattgcttaaacccaggaggcggaggttgcagtaagccaagatcacaccactgcactccagtctgggagacagagcaagactccgtctcgaaaaaaaaaaaaaaaaattccttgcaaaccaaataaaagggctaagactctaacagataaatggcaaaagacaaaaggacaatttatagaaggaaaaacataaacacaaatgactagtaaacatttaggaaaatatttgaccttataaaaataaaaggagtacaaaataatacatttccaccttatctgattggcaaatatatatgtatctataaaacagatacatattaatgagattaatgctgataaaattacaatgaaatggctgggcacagtggttcatgtctgtaaccccagcactttgggaggccgaggcgggcggatcacgacgtcaggagatcaagaccatcctggctaacacagtgaaacctcatctctactaaaaatacaaaaaaattagccaggcatggtggcgggtgcctgtagtcctagctactcgggagactgaggcaggagaatggggtgaacctgggaggcagagcttgcagtgagctgagatcgcgccaccgcactccagcctgggcgacagagcaagactctgtcttaacaacaacaacaacaacaaaaccaatgaaacaaacattctttttttttttttctttaagatgaagtttcactcttgttgcccaggctggaatgcaatggcacgatctcggctcactgcaacctctgcctcccaggttcaagcgattctcctgcctcagcctctcaactagctgggataacaggcatgcgccacaacgcctggctaatttttttttttttttgagatggagtctcgctttgtcacccaggctggagtgcagtggcgtgatctcggctcgctgcaacctctacctcctgggttcaagcaattctcctgcctcagctgcctaagtagctgagattacacacgcacgccaccatgcccagctaatttttgtatttttagtagagacgggggtttcaccacgttggccaggctggtctcaaactcctgaccttgtgatccacctgccttggcctcccaaagtgctgggattacaggcgtgagccaccgcgtctggccaaatttttgtacttttagtagagacagggtttcatcatgttcatcaggcttgatggcctcgaactcctgacctcaagtgatccacccgcctcggtctcccaaagtgccaggattactggcataagccactgcgcccggccaaaacaaacattcttaaataccagtagtagaaatctaaattattttaacttgccaaaataatctgtaatgattaaaacatcaagagaattgaaaatactcagacagaggaccacacagttattcttcttctaggaatctaccttaaggaaacaatattaaataagaatgatggctgggcgtggtggctcatgcctgtaatcctagcacttcaggaggctgaggcaagtggatcacctgaggtcaggagttcaagaccagcctggccaacatggtgaaaccccgtctctactaaaaatacaaaaaaaaaaaagaaaaaaaaaaccccaaaaaacaaaaaaactagccgggcgtggtggtgggcgcctgtaatcccagctactcaggaggctgaggcaggagaatcacttgaacctgggaggcagaggatgcagtgagccgagattgcaccactgcactccagcctgggtagtaagagcaaaactctgtctcaaaaaaaaaaaatgatgcttaatgtatcatgatagttactgaagaataattatagttaaaattaggaaaaaactaaacattgaaaaaaatcggaatagttaaattataatatagagtataagtcagccaggcacggcagctcacgcctgtaatcccaacactttgggaggctgaggtgggaagatcacttgagtccaggggtttgaggccagcctgggcaaagtgacaaaaccccatctctacaaaaagtacaaaatataagctgggcatggtggcacatgcctgtagtcccagctactagggaagttgaggtgtgaggacagcttgagcctaggggcggaggttgcagtgagctatgattatgctactgcactccagcctgagtgacagagtgagaccctatcttaaagaaaacaaacaataacagagtataagtttaaaattatgtatatagaaaaagttattagttatttaactccagtttaaaaagggggtgtgaagtgtcaaaattttatatatacagtttttaaggtttttataagtggaaagaaatatattacaatttaaaaataattagtttttcagtggtggaatgtttcatgctcctgtttttttacattttctataatgagcatatattaattttaaaatagtaaaggagtttaataacagatatgacatttaaagaaaaaaatagtaaaggggtaaaataacctacttatcctataagtaagaggaaaagtgattaagagatcactctttttccatagtacaggcagcactgttacattttgagtaaggtgacttactctttcgctttccaatatccatgtcagaggtagcagcttcacataaaagcaccattcctaaggtaactccaccatctaagaaaaattgtttaaggagaaattcgcacagacaaaaaagacataccattttactatttccagtttctcatgaagaaaattaaaatgaatatataaaccttcaactcttcattataaaaaaccaaaataaggaatcttgtatctatacggcatgacaattatttactatgaagatacaaaaaattaaaattggaagattacttcatttgtgcaaagaaaaattgatattttaaacaaatgtcccaccataacttacagatgaaatatgagttttcccgaaattgtactttgaaataacctgtctggacattcagttattgccctgacctcaaacacatttaaaaatattaaatggcttttttttttttttgagacagggtctggctctgtcacccaggctggagtgcagtgacgcaatctcagctcactacaacctccacctcccaggctcaagccaccctcccacctcagcctcctgagtagctgcaactacaggtgctcaccaccacgcccagttaaattctgtaatttttttttttttttttttgtagagatggggttttgccacgttgcacacgctggtcttgaactcttgacctcaagcaatccacctgcctcggcctcccaaagtgctgggattataggtgtgaatgaccacgcccagccctaaatagccattttgaatatttcaccccacctccctaaagaacacatttgaaatatatatcatttagggagaacagtaactactttttatttgaaaattaatttctgaaaaatctctcctggcctagtttagcggttcacacctgtaatcctaacagtttgggaggccgaggcgggccgattgcttaagtctgggagttcaaaaccagcctgggcaacatggtgagaccctgtttctaccaaaaaatacaaaaaattggccaggctggtggcacatacctgtagtcctagctacttgggaggctgaagtaggaggatcacttgagcctggaaggttgaggctgcagttagccgtgatcataccactgcactctagcctgcatgatagaactagactgtgtcaaaaaaaaaattctccatattttcaataatactttattttttaaatttttcccatgccaagatgccaaaagtacatcaataattagcctttaaagcacaaattactactaacctatctaattttatcctattctaataaaaaagaaaaatcctggccgtgcgtggtggctcacgcctgtactcccagcactttgagaggcagaggtaggcggatcaccttaagtcaggagttcaagaccagcctggccaacatggcaaaaacccgtttctactaaaaatacaaaaattagccgggcgtggtggcaggcgcctgtaatcgcagctacttgggaggctgaggcaggataatcacttgaacccgggaggcagaggttgcagtgagccgagatggcactactgcactccagcctgggtgacagaacaagactccatctcaaaaaaaaaagaaaaagaaaaagaaaaatcccacatgtgccatgaccacacttttattcagcttaataggagctgcataaatacaaaatacaacaacccatacaaataggtaacagatggcatggttgaatattaaaataagcaagttcaaattttaaagcaaatagaatgtgttctagtagaaaagagagacagattcaccctgcagtttagtgaatactaacagcagtaaaacactcccaaatcaattatacatatgtacatacatgttgtatgctaccgcatgtgggtatcattaagcggaaagggaaaaatatgtgccctttagatgaggcctgaatttataattggctctaaaatttgacttgtcatcccttcattaccatcttgcattcttttttaaattttttaatttaatttatttatttgagacagggtctcactctgtcacccagggtggagtgcaatggcataatcacaactcactgcaacctccacctcccaggctcaagagatcctcctgcctcagcctcctgagtatctaggactacaggtgcataccacgccacgttcgttttgttgatttttttgtagaaacggggtctcactatgttgcccaggctggtctcaaactcctggactcaagcaattctccagcctgggcctcccaaagtgctggaattacaggcgtgaaccaatgtgcctgtgccccatcttgcattctttcttcaatagcctcttgttagggatgatgcccattcatcatgttttcagttgttcagccaagtctcttctccagcaattttttctgagttctttatctgcaggtttgtgcaaagattgatcatttcgttttttaaaatttttatttattatactttaagttttagggtacatgtgcacatcatgcaggtttgttacacatgtatacatgtcccatgttgctgtgctgcacccattaactcgtcatttaacattaggtatatctcctaatgctatccctcccccagtatttttttgccagtattttattgaggatttttgcatcaatgttcatcaggaatatttggtctaaaattctctttttttgttgtgtgtctgccaggctttggtatcaggatgatgctggcctcataaaatgagtcaaggaggattccctctttttctattgattggaatagtttcagaaggaatggtaccagctcctccttgtacctctggtagaatttggctgtgaatccatctggtcctggacttttttttggttggtaagctattaattattgcctcaatttcagagcctgttattggtctattcagagattcaacttcttcctggtttagacatgagagggtgtatgtgtccaggaatttatcaatttcttctagattttctagtttatttgtgtagaggtgtttatagtgttctctgatggtagtttgtatttctgtgggatcggtgatgatatcccctttatcattttttattgcatctatttgattcttctctcttttcttctttattagtcttgctagcggtctatcaattttgttgatcttttcaaaaaccagctccaggattcactgatttttttgaagggttttttgtgtctatttccttcagttctgatctgatcttagttatttcttgccttctgctagcttttgaatgtgtttgctcttgcttctctatttcttttaattgtgatgttagggtgtcaattttagatctttcctgctttctcttgtgggcatttagtgctataaatttccctctacacactggtttaaatgtgtcccagagattctggtatgttgtgtctttgttctcggtttcaaagaacatctttatttctgccttcattttgttatgtacccagtagtcattcaggagcaggctgttcagtttccatgtagttgagtggttctgagtgagtttcttaatcctgagttctagtttgattgcaccgtggtctgagagacagtttgttataatttctgttcttttacttttgctgaggagtgctttacttccaactatgtggtcaattttggaataggtgttgtgtggtgctgcaaagaatgtatattctgttgatttggggtggagagttctgtagatgtctattaggtccgcttggtgcagagctgagttcaattcctggatatccttgttaaccttctgtctcgtggatctgtctaatgttgacagtggggtgttaaagtctcccattattattgtgtgggagtctaagtctctttgtatgtctctaaggactcgctttatgaatctgggtgctcctgtattgggtgcatatatatttaggatagttagctcttcttgttgaattgatccctttaccattatataatggccttctttgtctcttttgatcttttttggtttaaagtctgttttatcagagactaggattgcaacccctgcctttgttttccatttgcttggtagatcttcctccatccctttattttgagcctatgtgtgtctctgcacgtgagatgggtctcctgaatacagcacactgatgggtcttgattctttatccaatttgccagtctgtgtcttttaattggagcatttagcccacttacatttaaggttaatattgttatgtgtgaatttgatcctgtcattatgttagctggttattttgctcgttagttgatgcagtttcttcctagcatcaatggtctttacaatttggcatgtttttgcagtggctggtgccggttgttcctttccatgtttagcgcttccttcaggagctcttgtcgggcaggcctggtggtgacaaaatctctcagcatttgcttgtctgtaaaggattttatttctccttaacttatgaagcttagtttggctggatatgaaattctgggttgaaaattcttttctttaagaatgttgaatttggcccccactctcttctggcttgtagagtttctgctgagagatcagctgttagtctgatgggcttccctttgtgggtaacccggcctttctctctggctgcccttaacattttttccttcatttcaactttggtgaatctgacaattatgtcttggagttgctcttctcgaggaatatctttgtggcgttctctgtatctcctgaatttgaatgttcgcctgccttgctagattggggaagttctcctggataatatcctgcagtgttttccaacttggttccattctctttgtcactttcaggtacaccaatcagacgtagatttggtcttttcacatagtcccatatttcttggaggctttgttcgtttctttttattcttttttctctaaacttctcttcttgcttcatttcattcatttgatcttccatcactgataccctttcttccagctgatcgaatcggctactgaggcttctgcattcatcacgtagctctcgtgccgtggttttcagctccatcaggtcctttaaggacttctttgcattggttattctagttagccattcgtctaaccttttttcaaggtttttaacttctttgccatgggttcgaacttcctcctttagctcggagaagtttgatcatctgaagccttcttctctcaattcatcaaagtcattctctgtccaggtttgtttctttgctggtgaggagctgcattcctttggaggaggagaggcactctgatttttagaattttcagtttttctcttctgttttttccccatctttgtggttttatctacctttggtctttgatgatggtgacatacagatgaggttttggtatggatgtcctttctgtttgttagttttccttctaacagtcagcaccctcagctgcaggtctgttggagtttgctggaggttccctccagaccctgttggcctgggtatcaacagtggaggttgcagaacagcagatattggtgaacagcaaatgttgctgcctgattgttcctctggaagttttgtttcagaggagtacccggctgtgtgaggtgtcagtctgtccctactgggggatgcctcccagttaggctacttgggggtcagggacccacttaaggaggcagtctgtccgttctcagatctcaagctgcatgctgggagaaccactactctcttcaaagctgtcagacagggacatttaagtctgcagaggtttctgctgccttttgtttggctatgccctgctcccagacctggagtctacagaggcaagcaggcctccttgagctgcggtgggctccacccagttcgagcttcccggccactttgcttacctactcaagcctcggcaatggtgggtgcccctcccccagcctcgctgccgccctgcagtttgatctcagactgctgtgctagcaatgagcgaggctccgtgggcgtaggaccctccaagccaggtgtgggatataatctcctggtgtgctgtttgctaagaccatcagaaaagcacagtattagggtgggagtgacccgattttccaggtgccatctgtcacccctttccttggctaggaaagggaattccctgaccccttgcgcttcccgggtggggcgatgcctcgccctgcttcggttcacgctcagtgcgctgcatccactgtcctgcacccactgtctgacaatccccagtgagatgaacccagtacctcagttggaaatgcagaaatcacccgtcttctgtgttgctcacgctgggagctgtagactggagctgttcctattaggccatcttggctgcacaaaggtcttttgttaatgtgatcatttctttctttttttttttttttttttgagatggagttttgctctgccactcaggctggagtgcagtggagccatcttgactcactgcaacctctgcctcccgggttcaagaaattctcctgcctccgtctcctgagtaagctgggattacaggcacatgccaccacgcctggctaatttttgtattttgagtagagacggggtttacccatgttggctaggctggtctcgaactcctgatctcaggtgattcactcacctcagcctctcaaagtgctggggttacaggcatgagccaccatgcccggccaaagattgatcatttctacaggctttgatttctgggtactctctgattaatgattgagacttgctctggggaaagcttgtctttttatcatggtttatgtgcttttgctttgaatgagctttccttcttgctaaatacctcaaggtcttttgtgtactcttcttagctgtcaagagctatgatgcagttctatgtatactgttttatttcatttactgatctttaaatttttactaacactgcctactatatggcaggcactataaactgttggaaataaaaagttgaacaaaataaagatcctaccatgaagaagattacactctagtgaggaatacaaacaatgaaatacataaattacacagtcctgattaaatgttactccaggagaactgagcagaaatagaggagacattattccataacatacaacaactaggctattaaaagctagtagaaggccaggcgtggtggctcacgcttgtggccaagacgggtggatcacctaaggtcaggagttcgagaccagcctgggcaacatggatatgatatatccattatataaacattaaaaatattgactacttttctttttcttcgtattttcagatttctttgtaatttttatgtatttttataaatataaaggccatacaacatagaaaatgcttataatatattaagatagcaaactccatacacaacatgtctacaagtataaaaaatgaacacccttaccatgaaacattcatatagaaatgaatgcaagataatatgcaaaagtaaatgtagtttatactattagggtttcaggttataggtgaacattttccagactgctactttattttaaaaattcaggaggccaaggtacgaggattgtttgagcccaggagattgagaccagcctggacgacagggcgagactccatctctagaaaaaaatacaaaaattagctgggtgtggtagtgctcacctatagtcccagctactcaggaggctgacgtgggaggactgcttgattctgggaggtcgaggttacagtgagctatggtgaccccactgtactcaagcctgggcaacacaagatttcatctctaaaaaaataaacataaaaaaaatccatatatatttattctgggattccatttattgtgttttctttttttttttttttattttgagacaaagtctggctctatcagccaggctggagcacagtggtgtgatctcagctcactgcaacctctacctcctgggctcaagccaccctcctgcctcagcctcccaagtagctgggaccacaggcacgcagcaccacacccagttaatttatgtactttttttagtagagaaagggttttgtcatgttggccaggctggtctcgaactcctggcctcaggtgatctgcctgcctcagcctcccaaagtgctggtattataggcatgagccaccgcacccagccctgtaggattccatttatgtaagttaaaaaaaaataggtaaaataaacccatagtgttagcagtcaggatagcagttatttctgggtgggaaggtggcaatcaggaggaatgatgatggaaaatgctctgagatgtgggtaaaattttatttattgatgtgagttctggttacataagtgtgttaattctgtgaaaattcatcaaactggactgggcaccgtggatcacgcctgtaatccttacactttgggaggccgaggcaggcggatcagttgagctcaggagttcgaaaccagcctcgccaacatgatgaaaccccatctctactaaaaatatcaaaaaaacttagccaggcatggtggcaggtgcctgtaattccagctactccagaggctgaagcaagagaatcgcctgaacctgggaggtggaggttgtaatgagctgggatcacaccattgaactctagcctgggcaacagagcaagactccatctcaaaaacaaaaaacaaaaaaccaaaaaaaaaaaaaaaaaaggaaattcatcaaactgtaaacttttgtaaacttttctgcataactgcaacacttaaaatgtaattttaaaggttgcttagatcaggcaactgattatatagtctgctttattaatcatgcaataaactgtacattaaactaataataaatatgtgaatattttccaaaatcataactactacttagaggtggcctcagtctattaattattatcaacctggaagctgtaaacaatgttaccggtcttgaggtttcatatttactttaaaagaaagtgggggccgggtgaggtggctcacgcctgaaatcctagcactttgggaggctgagatgggtggatcacctgaggtcaggagttcaagaccagcctggccaacctggtgaaaccctgtctctactaaaaataaagaaattagccaggtgaggtggtgcacacttgtaattccagctactcaggaggctgaggcaggaggatcgcttgaacccaggaggtggaggttgcagtgaaccaagatggtgccactgcactccagtctgggtgacagagcgagactccactcaaaaaaaaaagggggggggggtggggagtggttaggccttttctaatattccttacctctgacaaaattattcattttctcactatttctggtacacagcacttaagtcactgtcttataatctgtatacatgtctgactctgaaaaaagttcactttttgcatcctaataaccaaacacaagacattctatatcccaacaggattgtaatccgttccaaatgtatactaaaccttaggctgatgctcagtcttaaagcagaggtaaaatgacaattttctaatttcttaaacttcttatatatttaaaagtttaagacaaagctaaaagaccaacaaaccccaaatcaactaattaatactttacaattttaattgctcttttgctccattattcaatttcaaagtactagtgagaagaactgattcaagatactgaaaattttctaaggtataataatttgttaatccatcaaaccatacttttcttttctgttctttttttttttttttctttgagacagagtctcgctctgttgcccaggctggagtgcagtggcagtctcggcttactgcaacctccacctcctgggttcaagcaattctcatgcctcagcctcctgagtagttggaattataggtgcacactaccgtttctggctaatttttgtatttcttgttgagatgaggtttcgctatgttggccaggctgaatccatcaaaccataaatgaacattgtctttctttttttttcttttgagacaagagtctcaccctgtcatccaggctggagtgcagtggcaccatcttggctcactgcaacctctacctcctgggttcaagcgattctcctgcctcagcctccagagtagctgggattacaggcgcccgtcaccatgcctggctgttttttttttgagacagagtctcactctgttgcccaggatggagtccagtggtaccatctcggctcactgcaacctctgcctcccaggttcaagcaattctccggcctcagcctccccagtagctgggattacaggcgtgcaccaccatgcctggctaatttttgtatttttagtagagacagggtttcaccatattggccgggctggtctcgaactcctgatctcaggtgatccgcctgcctcagcctcccaaagtgctgggattacaggtgtgaggcagcacgcctggccgtctggctaagttttgtatttttggtagagacagactttccccatgttggccaggctggccgcgaactcctgacctcaaatgatccacctgcctctgcctcccagagtgctgggattacaggtgtgagccaccacacccagcccataaacgaacattttcaactaaaattttaggattaaaaaaaataaagtttgagtaatatttttctttcagtcttcccccgccccgccgcccgccccctgagatggagttttgctctaattgcccacgctggagagtaatcacacgatctctgctcactgcaacccctgcctcctgggttcaagagattctcctgcctcagcctcctgagtagcagggattacaggcacccgccaccacgctcagctaatttttttttgtatttttagtagagatggggtttcaccatgttggccaggctggtctcgaactcctgatctcaggtgatctacccgccttggcctcccaaagtgctgggattacaggcatgagccaccacgcctggcctcagtcttctttcttctcatatggactaggtgtatattgttaatctttcagcccaccatttcatggttgaatagattaattctcccaggtttgggctggatgtgaagcagtaagtatattttccatagtgcataagaacattttcccaaatatccttcaattaaaatcagttaaaatcaaaagcttaatatttttttagaatgctttccttaaaatctctctaatcatcaacatagtataataaaactgggaaagacatacacaaacatttactaaagatagaattttcagtggttttgaatttttttctttatacttatttgtattctaaattttctttaatttatattccttttgcaatcagaaaaaaatatatttaagtttcgttttttttcccttttttattagagacagggtctcactgtgtcgtccaggctggagtgcagtggtgtgatatcagctcactgttgccttgacctcctgggctcaattgatcctcccacctcagcctccctggtagctgggaccacaggcatgcatcaccatacttggctaattttttgtgtgtatttttttgtagagatggggttttgccatgttgcccaggctggtctcaaactcctgggctcaagcaatctacccatcacagcctccaaaagtgctaggattacaggtgtgagccaccatgcccagctgattcttgtatatcaatgtcaggacaccctggctgagaagcacaattccaggaacattacatttgttcaccttgttgatttgttccagagtcagtgcttatgtactcaggtgggtaaactatgtttagtcatattatgaaatttagattcttacttatctgacatcgcttttacctgtctttgcagcttacagaggcatccacttttagatataagaaaataaaaattagcttgggccaagaaagtaaaaatattccttgtcattcaagagaatggaacaacacaaacataaagcagctgcaaagtccacaggaagtatttttccctagcacacacttcagctgtaaaatgtcaaaatatccccatctttgagtaattactgttttcttactgaggaatattggtctttaaatagacttcttgcaattatatgagtaaaaatgaaatattcttgcttggcagatctaagtcactcaatttacacgtataatttctaagtagcctcaatttacaaccaaggtatagagcttcaaagaagaagtttttgaagacaaaaatcccacatttatgttaactttgtagtttccaagcaaacagaaccctgggtctgattgacagttcagacctgatgttgacccctttacacagccttacactgcttttagcctatcaaaacaatgctttgtttaaatttcacataaactccactattctcccaaatcctattacaactctatcttttctttgttaagatgttccatggttcttctaatgtacagtattcctcatattaatgagccaataaacctggccctatcagactacagatttgtccctagtagtctttggtttattgggctggagaggatgatacagtaatgattttcaaaggatattgtgacttgcattaagagaacagccccagccaaatgctgtagagagaatactagactgtgagaaaacagacaaaatacagcaagaaagacttattgtaaaaggatactaaacagaagaacaatgtgtgtttcagctacaaactgggcttgactgcttccatggatataattctaggagggaaaaaagacaaaatggaatctttaagtatacattaaatgttggtatgctaaccctaaaacggggtattttaaactatgaaattattaattcacctgataaaccatgtgacatactccgggtctgtggcattcatcagtaagtctggttactataaggctatttttgtattatctattctcgatttgtcttttcattgtactaatactatgtttatttttgagacagggtcttgctctgttgcccaggctggagtgcagcggcatgatcatagctcattgcaatcccaaagtcctggctccggtgatcttcctgcctcagcatcccaagtagatgggactacaagtatgcaccaccatgcctgctcagctaatttttaaattttcattagaaatgacatattgctatgttggccaggctggtctcaaactcctgggctcaagcaatcctcccacctcagcctcccaaatgcttgaatactgtacttatattttcaacaacagaatatgtcagaaaactagttgttgttgttgttttttcttttcttttttgtttttcatagagatgacgtctcactatgctgcccaagttggtcttgaactcctggcctcaagtggtcctcctgcctcagcctcccaaagtgccaggattacaggtattagtcaccacacctggccccattttttttttaaggagatggatcttgctatgttgtccaggctgggctagaactcctggattcaagtcatcctcctgcctcagcctcccaagtagctgggactacaaatgcaaaacactgcacctgggtgagaaaactagtatttaagtgtacaagaccatgaggtacaataatgtaggctccatgaagacagggatcatgtttttcttatcactatatttaataataattagcacagtgcttagaaacagtggatgctcaggtacttgatcaatttttctatttagttgaaggctgtctttcattcttagctagcttggttagaaggattcaccaaatgggaaaaggaacttcccacttttaagagcactgcggccgggtgcggtggctcatgcctgcaggcctgtattcccagcactttgggaggctgaggcaggcgcatcacctgaggtagggagtttgagaccagcctgaccaacatggagaaaccctgtctctactaaaaatacaaaattagctgggcgtggtggcgcatgcctgtaatcccagctactcaggaggctgaggcaggagaatcacttgaaccagggaggtggaggttgcagtgagccgagatcacgccattgcactccagcctgggcaacaagagcaaatctccgtttcgaaaaaaagaagaaaaaaaaaaagagcactgcatggtcttatcagtgatggaagcttgttaacacaagagagattgaaaagtgaagactaaatccagctccttcatatgctggcactgttctcacagggtaataatcattgagttaactttggtctacaaaggaaagaaatcccagacttcccttaccacatgtcccgtgtggggattcttatgggcatatggtggtcctcttatatggttccacatttgaccagatgtcatagcaagcacaaaacactaggaaacaaaaaaataataaaatattcatggtcaaactgttcttgtcttgattagataacaggaatatgaaaatgtgcatctgtttagttaagacatagaattttttgcagataaatgatttattaaggcttatatttcatcccaaggatcacaattcgataatacttcaaaaggaaaacactattttttttttttgacatggagtctcgctcttttgcccagactagagtgtagtggcgcgatctcggctcactgcaacctccgcctcccaggtttaagcaattctcctgcctcagcttcctgagtagctgggactatagaagcatggaaccacgcccagctaattttgtatttttagtagagacagggtttcaccatattggccaggttgatcttggtctcttgacctcgtcatctgcccacctcggcctcccaaagatatgggattataggtgtgagccactgcgcctggccaggaaaacactatttaaaaattataactatgcagacacaagtttcaaaattgaatactgaaaaggctttttagaataaaattttcaggctgggcatggtggctcatacctgtaaccccagcactttgggaggctgaggtgggcgggtcacctgaggtcaggagttcaagaccagcctggccaacatggtgaaaccccgtctctcctaaaaatacaaaaaaattagctgggcgtggtggcacacgcctgtaatcccagctactcgagaggctgaggcaggagaatcatttgagcccaggaagcagaggttgcagtgagccaagatggtgccactgcactccagtctgggtgacagaccaagactccgcctcaaagaaaaaaaaaaaagaataatattttcagaacaactagagattttcatagagatgacagtctgtcatttaggttgaataaaaggcaggtacaatcagttccttgaagttctggccatccttatgagataatgaatgaaacaaactgattttaagacagaaaattaaaatatataaaactattttcctcaggtaagaaataaaatgctacttctcacataaataaaagcttacctaaaaatacactattaggaattttattcaaataattttttgtcttctgaaattcactcaccaaagctgcaaaagcccatccagttttattaaagagaaattccatattacttcttcgaagatacacaagtccaccaataacagccaaaagcaatcccaacataaggggaccagcataatttgggggtctaatcactctaatctaatggaaaggagagaaaaacatgttaaagtataaaatttttttactaattatatgggtcaaaataaaatctgaaatgaaagcaatcaaaattattgtggttactttcggaaaaatgatcctttttatgttatcccaatcaaactagtctataatataacctaaaataggatagaataggtacaatattctatttaaccacaacataacatcttttagattaagaaggatttgccaagtacaactagataatccatggacttaaggtcgaaagagtggtttccatgctgaattcaatagggtaatagagagtgttctgtaatttcactcattcatcaagatgattctgtttaatgctacttatgaagtgactgccaaactagtaccacctcagtgatatggggacaagactaattagggcctcccagtaagattcaaaggggataatggccaagaaacagtctacatagttgggaaacttacattgacatcagttctgtcggcgatccaccgggcaatctgctcagctgaaaaaccccgcacctgtaactcatatgtatcaccccgtttgggtttcccttttgcaggaaagttgatgaaagttggagctgaattcatgtttagctgaataaaaacgagccatgaaaatatacattatcaggaaaataatcttaattgcagttaacatcttgaaatttaggcattttacaaagatgaggaggcctgggtttaggtaggttaagtgatttggtttgcccaaggaaagtggtaagtggtggagcaggctttaaaagcaaagctgcctgtgaccttaagtattacatactactcaccaaatacacattcctcgctaagaaacctgtattttactccactagaatggaaactttgccataccacagatattttaatctgttcagagattatgcaaaatgaatacatttatgagcactaaaataatcttatgtagctgagtaagctccaaatagagtatattctcaatttggaggaaccaagataataaaataatgctctaaaacagcagtgaaaagcaatacaaaatggtggctatatgcagaaatagtctattctaagaaggtccataaatgtttactgatgagcaccacatttctctattctccatcatgacatcatgatatatttgagaagacaacaccggaaatactaaggtaaagaaaccataaccatctcatctgcattatatctttttttatttttttgagatggagtctcgctctgtcacccagactggtgacaatcttatagagattggcttgcacaaatcaatttttatttatttatttgtttatttttgagatggagtctcactctgttgcctaggctgaagcacagtggcaggatctcggttcactgcaacctccgcctcccaggttcaagtgattctcctgcctcagcctcccaaggagctgggattacaggtatgtgccaccacacccagctaatttttgtatttttagtagagacaggggttcaccatgttggccaggctggtcttgaactcctgactgcaaatgatccccccgcctcagcctcccaaagtgctgggtttacaggcgtgagccaccgtgcctggccttacaattataattttaaaacctcagccaataaaataatccaactcccatgctttgattctttagttaaaatccttctaacagtaagttttcaagctttcccataaggtgagagcatgtactgactgttgcttatcattattttggtctctttggctgtataatgtggtaaattaatgaattaatagattactcctttggttaccaatgtccatagatttatatgccttggtcagtaggcacaaaatccctagaggtagataaattctggctatcctgttaaaattcaatttctgtgattgcaaagctaggaaccaaatcttatacaatgttcagtctaccaaatgctgcccaaattttaggccaaactctttattcaatatttgtttagttacaccacctctacatttttgaaaatgtgtataaaaaataaaaactggccgggtgcggtggctcacacttgtaatcccagcactttgggaggccgaggtgggcagataatgaggtcaggagttcaagaccagcctggccaacacagtgaaaccctgtctctactaaaaatacaaaaattagctgggcgtgacggtgggcacctgtaatcccagctactcaggaggctgaggcaggagaatcgcttgaacccgggaggcggaggttgcagtgagccgagattgtgccactgtactccagcctgggtgacagagctagactccgtctctaaataaataaataaaaaataaaaaataagtaacatataaatacacttctcttgtaaaaaatatttttaaaaacattacatggttataaggaccaattctagtacattctggcagccacagttaccatttacagatatttttgaatttattcatatatatgtttataccaccagaaaacatataatattgctgttttaacataaatggtatcatattaatggtattttcctggttgtcttcctttttagcaactaaaaataatgttgcagtgaacatccttgcacatatctccctgtacccatgtgaaagtgattctctagaaatgggattgttaggtcatgggatagaaatattttttaattaaaatggatatagtgcccaggcacggtggctcacgcctgtaatcccagcactttggaaagccgaggcaggtggatcacttgaggtcaggagctcgagaccagcttggccaacatggtaaaaccccatctctactaaaaatacaaaaattagctgggtgtggtggtgggtgcctgtaatcccagttactcaggaggctgaggcacaagaattacttgaacctgggaggcggaggttgcagtgagctgagattgcaccactgcatttcagcctgggtgacacagtgagactctgtctttaaaaaaaaaaaaatggatatagccaaattgtcttccaaagtggctgtgccaaaatatacttctacttaacaatgcagtaatgtatccatttccctacatccttgccaaaagttgatgtgatgggtgaagactgtactttatcattatcatactattaatttgtgtttccctgtttactaataaaacatctttaaaacaaattagttatctgaaaacatctttgtttttttttcttgagaaggagtctcactctgttgtccaggctggagtgcgttggcgcaatcttggcccacacaatctccgcttcctgggttcaagcgatcctcctgtcttaccctctcaagtagctgggataacagggatgcgccatgacatccagctactttgtttttgtattttcagtagagacaaggtttcgccatgttggccaaggtggtctcgaactcatgacctcaagtgatccgcctgcctcagcctcccaaagtgctggcattacaggcgtgagtcaccatgcccggcctgaaaacatcttgtagcccaacgatacaatcaacagagtagaaagaaaacctgtgaaatgggaggaattatctgtaaatcatttatctaataaggagttaatattcagaatagtctgggcatggtggcttatgcctgtaatcccagcactttgggaggccaagacaggtgtatcacttgaggccaggagtttgagaccactctggccaacatggcgaaaccctgtctctactaaaaatacaaaaattagccaggtgtggtggcgcatgcctataatcccagctatttgggtggctgagacacgagaattgcttgaacctgggaggcagaggttgcagtgatccaggactgcgccactgcgctccagcctgggcgacagagtgagactctgtctcaagaaacaaacaaacaaaaacaaaataaaaacaacaacaaaaatttggaatatataaagacctcctacaactcaacaacaacaaaaaacttgatttaaaaaatgggcaacacaggtgggtgcagtggctcatgcctgtaatcctagcacgttgggaggccaaggcaggtggatcacctgaggtcgggagtccgcaaccagcctgaccaacatggagaaaccccgcccctactaaaaatatgaaaaaaattagctgggcctggtgacgcatgcctgtaatcccagctactcgggaggctgaggcaggagaatcgcttgaacccgggaaacggaggttgtggtgagccgagatcgtgccattgtactccagtctgggcaacaagagtgaaactctatctcaaaaaaaaaaaaggcaacacacacacacaatgggcaaagaacttgacatttctccaaagaagatatacaaatggccaacaaaacacatgaaaaaatgttcaatattactatcattatggaaataaaaaacaaaaccacaatgagataccacctcacactcataaagatggctattatccaaaacaaacaaacaaacaaacaaaaaaccccagaaaacaagaagtggttgcgagcatgtggagaaactggaaaccctgtgcaccattggtgggaagtaaaatggtgaatctgctatggaaaacagcatggaggttcccccaaaagattaaaaatagaattaccatatgatctagcaattctacttctaagtatataaccaaaagaactgaaagcagggtcttgaagagattatttgaacactcgtgttcatagcagtattattcacaatagccaaaagctggaagcaacctaagtatccactgacagatgtatgggtaaacaaaataaggtgtatacatacaatgcaatattattcagctttgaaaaggaaggaagttctgacacatgctataacatggatgaacattgaggacatgatgctaagtgaaataagccagtcacaagaacacaaatactatataattccacttatattaggtacctagagtagtcaaattcatagagacagaaagtagaatggtggttgtcaggaactgggggagtggggaactgaagttgtttaatggctataaagtttcagttttggaagatgaaagaattctggagattggttgtacaacaatgtgaatgtatctagcactactgacctgtacatttaaaaaatggtaaacataataaattttatattatatatatttacaaaacaaccccaccaaaaccccttgtagactctgaaattccttggaggttaatgaaccaaaataagatacactattttttggtaggtatcagttttcacatacgcttagcttttgcatactgtggcatatgacactgttacttagagaaagatttgaatctcttccacagatggacacactaccatccttatacctttggctctaaaatctagctctaaaatagagtaatggaaattaatattaaaaactattcaaggtacgaaagtgtacgtaacaaaaacaaaaatagacaaatgggactatattaagctaaaaagcttctgcaaagcaaaggaaacaacaaagtgaagagacaatctgttgaatgggagaaaatatttacaaactattcattcaacaaggaactaatgtccagaatatacaaaaaattcaaacaactctaaaaagaaaataaaacaaaaacaaaaacaaaaaaaattcaaatcactcaacagtaaaaaagcaaataatcccattaaaaagtggacaaaggacatgaatagacatttctcaaaagaagacacacatggccaacaggtgtatgaaaaaatactcaacatcactcatcatcagggaaacgcaaatcaaatctacagtgagatatcatcttctcccagttagaatggccattattattattattagaaaagctccttttctgctcatctgtctgttgcctccttgcaatacattttcctactttctctaataaatctgcctttctttaccttaaacgaacaaacaaacaaaaacagatgcaaggatatggagaaaagggaactcacggccaggcacggtggctcattcctataatcccaacactttgggaggccgaggcgggtggatcacctgaggtcaggagttcgagatcagcctggccaacatggtgaaaccctgtctctactaaaaatacaaaaattagctgggtgtggtgatgtgcgcctgtaatcccagctgctcaggatactgaggcaggagaatcgcttgaacccaggaagcggaggttgcagtgagccgaaatctgcactccagcctgggcaacagagtgagactccatctcaaaaaaaaagggaactcatacactgttggtgggaaattaaattagtatagccactatgaaaaacagtataaggccaggtgtggtggctcacgcctgtaatcccagtactttgggaggccgaggtgggcggatcacgaggtcaggagatcgagaccatcatggctaacacggtgaagccccatctctactaaaaaatacaacaaaaattagccgggcgtggtggtgtgcacctgtagtcccagctactcgggaggctgaggcaggagaatggcgtgaacccgggaggcggagcttgtagtgagccgagatcacaccactgcactccagcactccagagggagactccgtctcaaaaaaaaaaaaaaagaaaaacagtataaagatttcccaagaaactaaaaatagaactagcatttgatccagcaatgccactactgggtatgtatccataggaaaggaaatcagtatatcaaagggatacctgcacccccatgtttactgcagcacaatagcaaagttatggaatcaacctaagcatccatcaacagacgaacagatcaagaaaatgtggtattaggccaggcgcagtggcttgcgcctgtaatcctaccactttgggaggctgcggcaggtggatcagttgagctcaggagttggagggagaccagcctggccaacatggtgaaaccccatctctactaaaaatacaaaaaaattagccaggcgtggtggcgcacacctgtaatcccagctactcgagacgctgaggcaggagaatggcttgaacctgggaggttgcagtaagccaagattgtgccactgcactctagcctgggcgacagagaaagactccatctcaaagaaaaaaaaaatgtggtgtgtatacacaatggaatactactccaccataaaaaagaatgaaatcatgttacttgcagcaatatggatggaactggaagttattatgtgaaataagccaggcacagaaagacaaatatggcatgttctcatatgtgggagctaaaaaaattgaactcagggaggtacagagtagaatggcagataccagaggctgggaagagtgtatgtgtgtgtgttgtggtgggcggggtgggggggaggggtgcgggagcgggcaatgaagagaggtcagttaatgggtacactcatacagttagaaggagtaagatctaatgttccatagcagagtagcgtgactataattaacaaaaatgtattacatatttcaaaacagctagaagagaggacttgaaatgttcccaacatatagaaatgataaatactcaaggtgatggatactccaactatcctgacttgatcattctatgaatctaacaaaatatcacatgtaccccataaatatgtacaaatattatgttatcagtaaaaaaactaaggtagaaaaaaatgggttttctatttttacaaatcactaacagaagttatgtgttaccttgttaaaataaatggaattaaaaattgtaatttccaaaaataactgcagcctaaatagtagagaattaaaaagcaatttttttttttgagacaaagtctagctctgtcacccaggctggagtgcagcggctcactacaacctcctggctcactacaacctccacctcctgggttcaagcgattctcctgtctcagcctcccaagtagctgggattacaggtgcccgacaccacacctggctaatttttgtatttttagtagagatgggatttcaccatgttggccaggctggtgtcgaactcctgacctgaagtgatccccacgccttggcctcccaaagtgctgggattacaggtgtgagccaccatgcctggcctcaatttcttaaactccagaaattgtttcctttagtctaataaatcctaaatgcactaaccttttaggttacaacatttttataaatgcactgattttgatttgtggagatggctaagtgagactggaatatgaatagcacaatgaatgatatactgtaaaatggaaacattaagccatttttttcaacatttaccgaatacccgttatgtgcttagcactgatagctacaggatatggctctgccattaactaagtagtaactatattcttttatttatttatttatttatttttgagatggagtctcgctctgtcgcccaggctggagtgcagtggcgcgatctcagatcactacaagctccgcctcccgggttcaagccattctcctgcctcagcctcccgagtagctgggactacaggcgcacaccaccatgcccgtctaatttttgttgttttttttttgtagagacagggtttcaccgtgttagccaggatggtctcgatatcctgacctcgtgatctgcctgcctcggcctcccaaagtgctgggattacaggcgtgagccaaccgcacctggctgtaactatattctaagggagactgtcaaacaactacagagctaactctactgtaagacaaaatgtggataaatgtataacagaaatttaaggcaagtgatataacaatacaagaaaaggagtgactcactttttatctggaaaagttgagaaagcttacagggagtatctgaaacaaggcttaaaatgtaagcagaattttgagagtggagagaaagcagacagggaagaaaattgttgtaacccaacaatcaacagtgctgacatacgagagtgcatcaggccaggcgtggtgtctcacgcctgtaatcccagcactttgggaggccaaggcgggcagatcacccgaggtcaggggtttgagaccagcctggccaacatggcgaaacccctgtctctactaaaaattaaaaaaaattagccaggtgtggtggcgcgtgcctgtaatcccagatactctggaggctgaggcacgagaatcgcttgagcagaggttggcagtgagccgagatcacgccaccgcactccagcctgggtgacagcaagactccacctcaattaaaaaaaaaaaaagagtgcatcaaagaatatgattatgggaaaggtgtgactggagtaaagagcacatgaaattaggactaaggaattctggcttcagtctatacactactcctttcaaaagtgtgttctatggaatctagccaaatgctccattaagtggtccaataatatgagaaattctgtgtattagagcccccattggaaagtataacacatatcagcatcagcatgttaacatctctgatctctcaaaagctgtgttgggagacaattcttcatgagtttctcatgtttctgcacatcttgtggacaagggccctaactgcctttgttctggacaatcttctcaaggatatttgtatatctttggaagatagttgaaatggccttcgcaaaattatgactgagacagtgaaagagatctaacttaactgactccgacttggttctaacctccaagctgtccttgttcattcctggccataggctgaactaactttaggagaaacttagtttatagtttaaacaaagactgtaacagccctttcccaaagcagacctccttcttgcctgagaactagattgcctttgtaggactaatattagccacaagatgaaaaattatggtttaggagtcatgtagctagaggctacaagattctgaccctccctaaactgctcctaatatcatcgcttgagatattttgcagactctgcacttgatggatcagctgacaccacccagatcaataaactggctcatctgatcttgtggccccctcccaggaactgactcagcacatgaagacacctttaactccctatgatttaatctctgagcaatcagcactcctggctcactggcttccccccacccacgaagctatccttaaaaactctgcaccccgaatgctcggggagactgacttgagtaataataaaactccagtctcccacaaagctggctgtgcatgaaatactttctctattgcaattcctctgtcttgatgaattggatctgtttaggcagcagcaaagtgaaccccttgggcggttacacagtctccctccacagcaaaggggaggcacacttactatccattacagaaaatgtgggttcccagagcttggtgttcctctcccataatgcagcccattggccctctttgttattgttgttttcttaagagttggggtctggctctgctgctcaggctagagtgcagaggcacgatcacagctcactgcagcctcaaactgatctcaagcaatcctcctgatccagccttccgagtagctgaccactggccctctttggattgccctatgggaaatggggtttggggaacctatgacattttggctacttgttgtgagtagtaaagtcctttaacttgagccaggcatggtggcacaagcctgtaatcccagctactcagaaggttaaggtgcaaggattacttgagcccaggagttcaagactagccagggcaacatagcaagacccaatctcaaaaacaaacagcaaaaagtcctttgctggactctgactcaggagtgtcatattttctgccagcatccatgaaactgtggcaggttaacttgttagcttgcaagtagggtaagaacttagatccttcccagcttttgaaccctgaagtaaaaagaaaacttaattttgtttaaaccagggtttcccaagtttatttttttccaagaatacttattaataccatgtagaaaaaactctgggaaatgttatagcaggcaatatggacagagcgctaaatggaaggtaagtggaccagttaaaaggttactgcattagcttgaatgagagatgaatgtgagccttggaatgtaaagggggtatggctatgacacacgttgtacaagaagatgaagatgacaaagaagtgtcattaatgatacagaacataagatgaggcttgggtgaaagtggaagagaaaacagtttaatttgggatataataaatttttagattgggaagtcattcatatgaagatgtatagcaaggcattatatccagctttttccttttatgtttgatacaattgagtaaaatatgttcaaatatatgaattagacacatttataaacaaagacaaaattgaatctatgtccttaagtatttatatgcaaggggaaagaactagtagagatgctgaagctaaaaatggaccaggtgtggtggctcacgcctgtaatcccagcactttgggaggctgaggtgggtggatcatctgaggtcaggagtttgagaccagcctggccaatacggtgaaaccccatctgtactcaaaatacaaaaagtagccaggcgtggtggtgggcacctgtaattccagctattcaggaggctgaggcagaagaatcacttgaatccaggaggcagaggttgcagtgagccgagatcaagccactgcactctagtctgggcaacagagcgagactccatctcaaaaaacctgaaactaaaaagaaaaattaaaaaattaaccaggcgtggtggcaagtgcctgtaatcccagctacttgggaggctgaggcaggaaaattgcttgaacccaaaaggcagaggctgccagtgagccaagattgtgccattgcactccagcctgggcaacagagcgggactcttgtctcaaaaacaaaaaatagttgtgagaggtcatgattgacagagcaggtgggtatgtgatccagggcccaggaaaaaggttcagtttcaaacaacaaaagatctacttttctactaagactagaggtaaggggacaaaagaaatcaactcaagatggaccagaaacttaaatctaagacctgaaaccataaaaattctagaagataacattgtaaaaactctttttttgagactgagtctcactctatcacccaggctggcaatctcggctcactggaacctccgcttcctgggttcaagtgattctcatgcctcagcatcccgagtagttgggattacgggcgcccgccaccacacccggataatttttgtattttagtagagatggagtttcaccatgttggccaggctggtattaaactcttgacctcgagtgatctgaccaccttggcctcccaaagtgctgggattacaggcatgatccaccatgcccagctgaaaaactcttccagacattggcttaggcaaagaattcatggctaagaccccaaaagcaaatgcaacaagaacaaaaataaataaatgggacctaatttaactaaaaagcttctgcacagcaaaaggaataatctgcagagtaaaccaacaacccacagagtgggagaaaatatttgcaaactgtgcatctgacaaaggactaatatccagaatctacaaagtactcaaacaaatcagcaagaggaaaacaaacaatcccatcaaaaaatgggtaaaggacaagaatagacatttctcaaaagaagatatacaaatggccaacatcactaattatcagggaaatcaaaaccacaatgaaatactactttacacccgcaagaatggtcataattaaagcaaaaaaaaaaacacaaaaaacaaaacaaaaaaaaacaaagatgtggtgtggatgtagtgaaaagggaacacttttaacactgctggtgggaatgtaaactagtacaaccactatggaaaacagtatggaaattccttaaagaactcaaagtagaactactatttgacccagcaatcccactactgggtatctacccaaaggaaaagaagtcattatatgaaaaagacacatacacatgcatatttatagcagcacaattcacaattgcaaagatatggaaccaacctaagtgtccatcagccaatgagtggataaagaaaatgtggtacatataaatcatggaatactactcagtcataagaaggaatgaaataatgtattttgcagcaatttggatggagcgggaggtcattattctaagtgaagtaacttaggaacggaaaaccaaatatcgttatgttctcacttatgagtaggagttaaactatgaggatgcaaaggcataagattgatataatggacgttgggaactttgggggaaaaagggtcagagggggatgaaggattaaagactacgtatttgggtacagtgtacgctgctcaggggatgggtgtaccaaaatccagaaatcaccactaaagaacttatccatgtaaccaaaaaccacctgttgccccaaaactattgaaataaaaataaaaattttaaaaaagaggtaaggggataaagatatctatagtatagatagctatactaaagacttcaatattacataatggtgggactcgtgctgtgatttaaaaaattccttaataaattatatacttaaaatggttaaaatgataaagtttgttttatatattttactacaataaaaatgtatgttatttaaatactactcaatttccatattctagtaggttagcattgataactacattttatggttagctcaagtttaacttttagtttgctactctagatcttacataagagcaatcccatttaatgtcttatagccactgaaaaaaatatattccactttcactatattttacctatttttatatagcagaataaaccaaagatcttaccatctgaaatacatcagagccttcatcaaaatccaccatggcaaaaaatatcctgttggtgaatgcactggagtatcgccaggagtttgccaggatctggaattcttcatcagcttgcctggatgcaatgagattcgtaaagataacatataaaacaatttttgaaagcaatctcgtttatcatcagtaaaacaggtccaagcaagcaatagcaggttttccaatgggagaaataataaaaaacactgacaagtaggtcagactctgctgacagggttaagacaaatcttgttttggcataagagaagccttatcccaagttagggatttcatgagaagtagtaattacctgactccgcttcatactttgtgcctgtttcttatcccaaaactctttcaacaatcattggaaatatatagctaatcgcctctacaataactttccataccctaaattacttctaagagttcaaagacaagacagaagtgtattccctaaagaaagcagaaatacaatattaattcatttttaaaaatctaaagtgcaaaagctacttggtaaataacacaatcagataaattattaggatgaaagataagaagagtctaggaattgaaattaattgaggccagctcatacctgtaatcccagcactttgggaggctgaggtgggtggatcacctgaggtcaggagctcaagacaagcctggccaacatggcaaaaccctgtctctattaaaaatacaaaaattaggccaggtgcagtggctcatgcctgtaatcccagcacgttgggaggctgaggcaggcggatcacaaggtcaggagttcgagaccagcctggccaatatggtgaaaccctatctctaccaaaaatacaaaaattaaccgggcatggtggcaggcacctgtagtctcagctactcgggaggctgaggcaagagaatggcttgaatccgggaggcggagattgcagtgagccgagatcacaccactgcactccagcctgggcgacacagcaagactccatctcaaaaaaaaattattgaaacctcaagtcatctttgaatttttccatatctcccatatgctttcagttctcatgatctgtcaattctcatttgcgataaaagtttcactccatatcctcctatttttattgctatcatctaaggtcagatttttgttatctaatagtaggatatttaaaaatactgactctggtttctcctccttcaatccttctttttttttgagacagtctcgctctgtggcccaggctggagtgcagtggctccatcttggctcactgcaacctctgcctcccagtctcaagcaattctcctgcctcagcctcctaagtagctgggattacaggtgcccaccatcatgcccagctaatttttgtatttttagtagagacagggtttcaccatgttggccaggctggtcttgaaatcctgtcctcaggtgatccgcctgcctcagcctcccaaagtgctgggattacaggtgtgagccaccgtgcccggccctcctccaatccttacactgcaatatacatccatcttcctaaattactactttcctgaaacacttctcagaaatcactgttgctttcttattaccttcagaatacattctctaatctctttcactagttattgaaggttctttatcacatagcttcaaataatacatctagtttttatctagtcttactactaatcaatctcaaacagtaacctttagtcccaatattttatttactcctatccctgtacccttgtgtacatcatgcttctaaccagaatatcctgcctgtatcaacatcttatccatttgtctagccctagcacaagtcttatttcctccatcaggccaatccaaatcactcctattaaccttctttcctgaaattttacagtatttattatatgtacagttgatctggtacttaatcacaaattgccttatattgccatctaaattttcatatgtgtaactcatttccttaaccagatgataagggtaggttatctattttacaattctcatcccaacagcaccacaactacagtataattcatgttgctgttgtttaatttttatttgttgaatgagtgtagaaaaatttgagttaatattaaatttggtctcatagaaaataagatgccagtaaaaacttaggttagtaagaattccattaatttgcatttaatagagaattatgaaggagtttgtgtttgttccctgctatttttgtatactcttgattgctactgagtgaactgacggaattagaagtaattctagatttcaagtttattcatagttattacttacgattcctttttcttcttttatttatttttaatttatattcagcacatactccacaaaataagcactatggaaccaaataccttgactataccctagctccagggagaaaatcgttaaagaaaagttatcaaggcttggggtggcagaacacaccattctgaaacaagctgtctattcctttgcatggctatcaggctgtcagaatctggagaacctccaagtttttactaaactaattcttcatacagtagctttgtcattttatttaaagttaattaccagatcagatacactgatctaaaaatataaataaaaagacactaaaaagcaaaagctattttattttttagtatccaccattttgaattgttcatggtgtttttatttaacagaatagcaatctttgctcctaagatcattaagaaacaataaaataaaatcaagaaaccattgtttgatgaaaacttaagcaagattagtctccatctccaaggtttacaatcactataaaacaactgggaaattagaaacatcgctaaatcatggatctttgggattaaaaaaataataattaatatacccatcaccttacctatttattattttttggtggtgagaatatttaaaatgtttttagcaatttcaaaatctacaatacattaactatggtcaccatgctgtgcaatagatcaccagaacttacccccctcatctaactaaaactttgtacactttcaccacatcctctcctaagactctgaaaaccaccattctactctgcttctaggagttcaacttttttagatttcacatgagatcccatgcatcttttttttttgtttgtttttgagacagggtcttggtctgttgctcaggctggagtgcagtgggatgattatagccttctgcagtttcgacctcccaggatcaagtgatcctcccacctcagcctctggagtagctgggactacaggcacatcaccacacccagctaattttgtttatttttatagatacaaagtttcactatgttgcccaggctggtctccaatgcctgggcccaagtgatcctcccatctcagcctcccaaagtgctgagatcacagacatgagctaccacacccagctgcatcttttttttaaaaaaaaaaaaacattaccagctgggtgtggtggctcacgcctgtaatcccagcactttgggaggcttaagtgggttgatcacgatgtcaaaagatcgagtccatcctggccaacatggtgaaactccgtctctactaaaaatacaaaaattagctgggcgtggtggtgtgcacttgtagtatcagctactcgggaggctgaggcagaagaatcacttgaacccaggaggtggaggctgcagtgagtcaagatcacgccactgcactccagcctgggtgacagagcgagactttgtttcaaaaaaaaaaaaaaaagaaaattaccagttttcttgaattccaaacttggatgaagccaccattattgcattagtaaacatcttaagcattgggtagaccagttaaaattgtggagcctgtttcttccaaaaatagtaggatatttgctttacctaccttttgggattttgacaatacaagagtatgaagctgaaagcacttacaaataataaaaaaatactacatcaatgctactggcatacagttacataagttgatactgatttttttttttttttgagacagtctcgctctgtcgcccaggctggagtgcagtggcgcaagcttggctcactgcaacctctgcctcccgggttcaaatgattattctgcctcagcctcccaaatatctgggactgcaggcatgcaccacaatgcctagctaatttttgtatttttttttttttagtagagatggggtttcaccatgttggctgggctggtcttgaactcctgacctcagatgatccacctgcctcgacctcccaaagtgctgggattacaggcatgagcccccatgccccgccaagttgatactaatttataagatgactgtttgatctttaagttacttttatgatggctaccacaattatttatccatgcttcccccactgatacggataatcaagaattgactataaaagagcagtagtattgctaccatagacatcctgagtaaggtatacacattatttaagtacctactgcactaacttggcccttctgggattgagaaatggttaacgttatatgagttatttaattttaaagcgtagttggagttcatacttgcaaacgacacactgtctatgcagttggagagcagtgaacatgacgataacggagtaatttctcggtggggctttcacaaggcgacggaacttgtctccattcattcttattacaggtcttttgttagtccattccatcagctgactaaccttttcagataacaccatctaaaaaagacaaagtgagcatgctattaatatactcaacttggcatttaaagttcttttaatgaggcagcttacttaaaaccaatactaacaagcagaggtatacagaaaatgtgagacctaaagccaaaatttggtagttgggctggatgataattattcttaaaatacattatttcataatattttgtcagacattacacttttgatgtaattaattatgaatgaatgaatgaatgaataaacgaatgaatgacactgtctcgctctgtcatccagactgcagtgcagtggcacaatgagggctcactgtagccttgacctcctggcctcaagggatcctcccacctcagcctcccaagtgcttggaatacacacgtgttccaccatgctcagctgatttttgtattttttgtagagatggggcttctccatgttgcccaggcaggtcttgaactcctgggcttaagcaatctgcccgcctcagctaccgacagtgctgggattacaggcatgagccaccacacctggcctttatatatatatatatatatatatatatatatattttttttttttttttttttttgtagagacgggggttttactatgttgcccaggctagtcttgaactcctgggctcacatgatcctcccaactcagcctcccaagtgttggcattacagtcatgagccattgcacccagacagaattatttattatttactaataagataaaaataacaaaacctttcatttgccaaaaattccaaagaatgttgagttaaaccaatggccagttttatatacaattttacttctctcaaaaaacatacagtgaaaatcttgaaaataaagagtaaagtgggaggaatcactctattcaattttaaggtttactatgtagccacaataattaagacagtgtggtacagatgaagggatagtatcacagaacaacagaacaaaaaaacaacccagaagtagacccatacaagtgtagtcaaatgattttgcacaaaggtgcaaaaacaactcagtggaggaagaatagccttttcaacaaatggtgcagaagcaattggtcatccatagccaaaaatatgaacttcacaccttatataaaaactaactcagccgggcatggtgactcacgcctgtaatcccagcactttggaggctgaggcgggtggataacctgaggttgggagttcgaaaccagcctaaccaagatggagaaaccccgtctgtaccaaaaatacaaaattagccaggggtggtggcacatgcctgtaatcccagctacttgggagactgaggcaggagaatcgcttgaacctgggaggcagaagttgcagtgagccgagatcgtgccattgcactccagcctgggcaacaggagtggaactccatctcaaaaaaaaaaaaaaaaaaaaaaaagaaactaatacaaaatagatcatatacttaactgtaaaactataaaacttttatgaaaataaataggagaaaatattcagaagctaagggtaggcaaaggtttcttaggcctgacaacaaaagcaggatccataaaaaaaaaaaattgatatactggacctcatcaaaattcagccggatgtggtggctcatgcctctactcccagcactttgggaggccaaggtgggcagatcacttgaggctaggagtttgagaccagcctggccaaaatggcgaaacccagtctctactaaaaatacaaaattagctgagtatggtggcacatgcctaaaatcccagctgctcagaaggctgaggcatgagaattgcttgagactgggaggcagacattgcagtgagccaagatcataccactgcactccagcttgggtgacacagcgagacactgtctcaaaaaaaaaaataaaataaaataaaaaattttactctctgggccgggtgcggtggctcacacctgtaatcccagcactttgggaggccaaggtgggtggatcacttgaggtaaggagttcgagaacagcctggccaacatggtgaaaccctgtctctaataaaaatacaaaaattagccaggcatggtggtgggtgcctgtaatcccagctactcgggaggctgaggcaggagaatcgcttgaacctgggaggcggaggttgcggtgagccgagatcacgccactgcgctccaacgtgggcgacagagtgagactctgtctcaaaataaaataaaataaaataaaataaaataaaataaaataaaataaaataaaataaaatatactgacaatatcaaatgctggtgaggatgtggagaaactagatctctcatacatcactggtgggaatgtagtatggtgcagccactttggaaaacagtttggcagtcttaaaagatcaagcaactgggtgggtgcagtggctcacacctgtaatcccagcaatttgggaggccgaggcgggtggatcgcttgaggtcaggagttcaagaccagcctggctagcatgttgaaaccacatctctactaaaaaaaaaaaatacaaaaattagctgggcatggtggcacatgcctgtaatcccaggtactcaggaggctgaggcatgacaatcgcttgaacccgggagacggaggttgcagtgagccaagatcacatcattgcactccagtctgggcgacaagagcaaaactctgatgcaaaaaaaaaaaaaaaaaaaaaaagaaaaaaaaatttagccgggcatggtggtgcacgcctgtaatcccaggtacttgggaggctgaggcaggagaaatacttgaactcaggaggtagaggttgcagtgagctgagatcacgccactgcattccagcctgggtgacagagtaagactctgtctccaaaaaaaaaaaagaaaaaaagaaaaaaaaaaaagccaggcgcagtggctcatgctgtaatcccagcactttaggaggccgagatgggtagatcacctgaggtcaggagtttgagatcagcctggccaacatgataaaatcccgtctctactaaaaatacaaaaaaattagctgggtgtgttggcgggtgcctgtaatcccagctactcaggaggctgaggcaggagaatctcttgaatctgggaaggcggtggctgcagtgagccgagatcgtgccactgcactccagcctgggcaacaagagtgaaactctatctcaaaaaaaaaaaaaagaaaaaaaaaaagaaaaaaaaatctggcaactaaagatacatttaccatacaacccatcaaccacattatttggcatttgtcctatagaaatgaaaatttatgtctacacacaaaaaagagctagagtttgttcctttttggctaatcatcatgaggcagtggaagagaagcatggttagtcgacaggatttaagtttgaaattaaatgccatcatatttatcattcccctcatcttcactctcaatgttttctttttcttttttctctcgagatggagtcttgctctgtcacccagactagagtgcagtggtgcgatctcacctcactgcaacctccccctgctgggttcatgcaattctcctgcctcagcctcccaagtagctgggattacaggcacacgccaccacgcctggctaatttttgaattcttagtagagacggggtttcaccatgttggccaggctggtctggaactcttgacctcatgatctgctcgcctcggcctcccaaagtgctgggattacaggcgtgaatcactgtgtccagccccaccctcaatgtttaatccttgccatgagtagtaagaaggcaggaagggataacaaagaaaacaaaaatctcaatgtagagttaatgctaatttatgattttgctcatctttatagagatatgtatagaaaaagctgggaaatcatgcagtggttcatcattcagaaccatttgaccagttatatttcccgttacctatattctagcacttaccattttaagacactttgacgtttgattccttttctagactattagctacaagagaacagagacccacaattctttaccatacagtaggcactcagtaaatgtgtactaaatttataatcagtgaaatttaactgggaattgactgacttgcttacattaacatgtaagaaagaaatgattaactgcacacgtaaacacttacatagaaacaaaactttttttttcactttagaaagtaacatggattctaaaaatgcatgatttgccttttttttttttttttttttagacagagtctcactctgtcatgcccaggctgaagtgcgatggcatgatctgggctcactgcaacctctgactcccaggttcaagtgattctcgtgcctcagcctccaaagtagctgggattacaggaacgcactaccacccccggctaatttttgtgtttttagtagggacggggtttgaccatgttggccaggctggtcttgaactcctggcctcaaatgatccacccgcctcagcctcccaaagtgctgggattacaggcatgagccaccatgcccagcctggtctgcctttaagcatacctgaattcatctaatactgaccacaattttatgtcacaagtacatctctatgaatgatggaaaaaagctgcataaaaattagttttgtaggccaggcgcggtggctcacgcctgtaatctcagcactttgggaggccaaggcgggcagatcacgaggtcaggagttcaagaccagcctggccaacagggtgaaaccccgtctctactaaaaatacaaaaaataagctgggcgtgatggcgggtgcctgtaatcccagctactcgggaggctgaggcaggagaattgcttgaacccgggaggtggagttgcagtgagccgagaccgcaccactgcactccagcctgggtgacagagcgacactcagtctcaaaacaaaacaaaaaaaacattagttttgtagcaaatacgaaaaaattctggtaagggccacaaaaagaatatgccacacacgaaaaaccgaacacactctaaacccacagaaaaagatatacactcttgaaagattggttgttaacaggccaggtgcagtggctcacgcctgtaatcccaacactttgggaggctgaagtgggtggatcacttgaggtcaggacttcgagaccagcctggctaacatggcaaaacctcatctctactaaaaatataaaagttagctgggcgtggtggcacatgtctgtagtcccagctaccggggaggctgaggcactagaatcgcttgaacccaggaggccgaggttgcagtgagccaagatggcaccactgtactccagcctgggcaacaaagtgagaatctgtctcaaaaaaaaaaaaaaaaaaaaaaaagaaggaaagattggttataacaaataattaacaagactgcggaacaatgaaacaagtagttggtaaaggctgtgggagagaatgaaccaggaggaagatagagaatatttgatttaaattgagactgcacagatcaaatttattgtttttccaacaaaatgaattgctattatttgataccgttttaatgattctcagagcacagaaaatatgggttcacattttaaaatatgcaatctatattttgaagcaatcattaatttttgccatattttgttttttttatatatagatatttattatactttaagttctagggtacttgtgcacaatgtgcaggtttgttacatatgtatacatgtgccatgtggtgtgctgcacccattaactagtcttttacattaggtatatcacctaatgctatccctccccctccccccaccccacaacaggccccggtgtgtgatgttccccttcctgggtccaggtgttctcactgttcaattcccacctatgagtgagaacatgcggtgttaggttttttgtccttgcgatagtttgctgagaatgatggtttccagcttcatccatgtccctacaaaggacatgaactcatcattttttatggctgcatagtattccatggtgtatatgtgccacattttcttaatccaggctatcattgttagacatttgggttggttccaagtctttgctattgtgagtagtgccaaaataaacatacgtgtgcatgtgtctttatagcagcatgatttatattcctttgggtatatacccagtaatgggatggctgggtcaaatggtatttctagttctagatccctgaggaattgccacactgtcttccacaattttagaccaatatctctgatgaacatcaatgcaaaaatcctcaataaaatactggcaaaccaaatccagcagcacatcaaaaagcttatccaccatgatcaagtgggcttcttccctgggattcaaggctgcttcaacatacgcaaatcaataaatgtaatccagcatataaacagaaccaaagacaaaaaccacatgattatctcaatagatgcagaaaaggcctttgacaaaattcaacagcacttcatgctaaaaactctcaataaattaggtatagatgggacgtatctaaaaataataagagctatttatgacaaacccacagccaatatcatattgaatgtacaaaaactggaagcattccctttgaaaactggcacaagacagggatgccctcactcaccactcctattcaacatagtgttggaagttctggccagggcaatcaggcaggagaaagaaagaaagggtattcaattaggaaaagaggaagtcaaattgtccctgtttgcagatgacatgattgtatatctaattttgccatattttcaagttaaatttgacagttaccagcaaatacaaatatgatttgactattttattcagggtgactacatattctgtatggggctgagaaaaacaagtgtgaagcagtaacaggtatttacacagttttacatcctcctatctctattcaaccatatagatatataatcatgccaacaaaagaaatataagtgctttgaattagttatcaatatgtggagttttcctacacaaaaattcttgaataaacgttttcaagcaggtctacataaaaaatttatggccaggcatggtggttcaagcctgtaatccctgcactttgggaggctgaggagtgaggactgcttgagccctggagttcgagaccagcctggtcaacatagtgggacccagttactacaaaatattataaaattggtcggatgtggtggcatgtgcctgtagtcccagatactcaggaggctgaggcaggaggatcacttgagcccaggagttagaggctgcagtgagctacgatcacacatcactgaactctagcggggacaacagagcaataccctgtctctaataaatatatatttatatatataatttatatatatttatatatataaattatatatttgttatttatatataatttatattatattaatataataatataatataattataatatgtattatattaatataataacataattatattataatatatattattattaatccaggctatcattgttagacatttgggttggttccaagtctttgctattgtgagtagtgccgcagtaaacatacgtgtgcatgtgtctttatagcagcatgatttatattcctttgggtgtatatccagtaatgggatggctgggtcatcccatctgccggcagatcacgaggtcaggagatcgagaccatgtataataattattgtaatatatattataatatatgttattcctcttcctgtttattaacagactagaaagaccagacttctggctattctttctcgaaataatttatcaagtagaagaaactagttcaaaggaattatcttttttcaggctcttataaaacaaaatcacttcaaaaggctgcttaatgcagaggcaattagattacttcctgaattcattttcttttttttttttttttttttttggtgacagggtctcactctgttgcctaggctggagtgcagtggtgtgaacttggctaactgcagcctcaacctcccaggctctagtgattctcccacctcggcttcctgaatagctgggactacagatgtgcaccaccgtgccccactaatttttgtagagacggggttttgccatgttgcccaggctggtctcaaactcctgagctcaaatgatccttgccctcccaaagtgctgggattacaggcatgaaccaccttgccccgactgggttcattttctttaaaatgaattgaaaacagatcacaacaaatgaactagttttaaacttttacaggctgggagtggtggctcatacctgtcatctcagtgctttgggaggtcaagtcggatggatcacttgatgtcaggagtttgagaacagcctggccaacatcgtgaaaccccgtctctactaaaaatacaaaaattagttgggtgtggtggcacacgcctgtagtcccagctactcaggaggctgaggcacgagaatcacttgaacctgggaggtggaggttgcagtgagctgagactgcaccactgcactccagcctgggtgactgagtgagactctgtctaaaaaacaaacaaacaaaaacttttacaataaaattacatgaacatagcctggaacattataattagatgctataatccttattcacaatgacgtaatattttaagatattctaaagcaagcctctcttggatttatggagaaaataatagctactatttggaatgtctagcgggtgtcaggcagttacttcttgctttatagaatatataattaagttcaatcctcaaaacgacactataaggtaagtactctttttacatttgcttatctgttgagaaaacaggattggagaggttaaacaacttgcccaaaatgccacagttagtaagatactgaggtagaaactcaaacaggccatgatcattctaaaccagggtttctcaaaagcaacactaccgacgtcttaggccagatcattgttgtgaggagtgatcctgtcagtgcactgtaggatgttgaatagcaaccctggcttctactcactacatgccagtagcaccctcctctcccagctgcaacaaccaaaaatatctccacacactgccaaatatctcctggggagcaaaatcacccccaatcccacaatattgttcttaaaaaaaaaaaaaaggccgggcgcagtggctcaggcctgtaatcccagcactctaggaggccgaggcgggtggatcacgaggtgaggagatcgagaccatggtgaaaccccgtctctactaaaattagccgggcgcggtggcgggtgcctgtagtcccagctactcgggaggctgaggcaggagaatggcgtgaacccgggagtcggagcttgcagagagccgagatcatgccactgcacttcagcctgggtgacacagcgagactccatctcaaaaaaaaaaaaaaaaagagagagacagggtgtcactttgtcacccagactggagtgcagtggtgtgatcatagctcactgcagcctcaaaatcctgggcttaagtgatcctcccatctcagcctcccaaataactgggactacaagtatgcgccaccatgcctagctaatttttaaaagttgttgggcacagtggctcatgcctgtaatcccagcactttgggatgccgaggtgggcggatcatgaggtcaggagttcaagaccagcctgaccaacatggtgaaaccctgtctctactaacaacacaaaaattagctaggcgtggtggcgcgcgcctgtaatcccagcttcttgggaggctgaggcaggataatggcgtgaacccgggagtcagagcttgcagtgagctgagatcacgccactgcactccagcctgggcgacagagcgagactctgtctcaaaaaaaaaaaagagagacagggtgtcactttgtcacccagattggagtgcagtgacgtgatcatagctcactgcagcctcaaaatcctgggcttaagtgatcctcccatctcagcctcccaaataactgggactacaagtatgcgccaccatgcctagctaatttttaaaaactcttgttgggcgcagtagctcatgcctgtaatcccagcactttgggatgccgaggtgggcggatcatgaggtcaggagttcaagaccagcctgaccaacatggtgaaaccctgtctctactaacattacaaaaattagctaggtgtggtagcacgtgcctgtaatcccagcttcttgggaggctgaggcaggagaatcgcttgaacccgggaggcagaggttgcagtgagccgagattgagcccctgcactgaaacttgggtgacagagcgagactccgtctctaaaataaaataaaaaaatctcttttagagatagggttttgctatgttgctcaggctggtctcaaactcctggccccaatagacactcctccctcatcctcctgagtggctgggattacaggctcaaaccactatgcctagctcaagaacaactgttttgaactgaaaagaatgtacaattttacaatcttatttttatgtattcaaaaatctttaaaaatcattactgatcaaaatacaacataaaagaaagatttagtgataaagtaacccaaaacttcctagagcaagcctttatcataatggataataaactttttaaacctgtgtttctcaaagtgtggttggtataaaggagcttgttaaaaatgcagactttggccgggcacagtggctcatgcctgtaaccccagcactttgggaggccgcttgagcccaggagttcaagaccggcctgggcaacatagtgagactctgtctgtattttataaaattaaaaaaaaaatgcagacttctggccaggcatagtggtatgggcctgtagttgcggctactcaggaggctgaggtagaaggatcatttgagcccagaaatttgaggctgtagtgcactatgattgcacctggtgatagccactacacttcagcctgagcaacatagttagattccatctctaaaaaaaaaacaaaaatcaaaatccatatttctagatttcatcccccagtacatttgattcagtaagtccagggcagattccaagaatattgaattttaacatgttacacatgtgattctttatatacactgaagtttgagaatcacagctctacattctgattcttatgggttaggactacatgttatataaatttctatggacagcaaagggaaattaaataaacattaagtgaaccaaatgatgaataacaggaaaaagcatgccatttctaataataaaccaacccgtgatcctcctggaacggttgaagaatgtgatattctacttaactcaaatataatgccttaatacttcctagacacttccttcactggtcctcttttttgtcttctttagttaatagatttataagggaatttcttgttttctctctctctcttttgtttcaatttagagacagggtctcattctgttacccaggttagagttcagtggcatgattgttagctcactgcagcctcgaactcctgggctcaaatgatcctcctgcctcagcctcctgagtagctaggaccacaggtgcatgctaccatgcttggttattttcttttatttgtttgcagagatggggtcttgctatgttgcgcaggctggtcttaaactcctaggctcaagcaatccttccactttggccttcccaaagtgttgggattacaagtgggagccactatgtgtggccaggaatttcttcaaatttgaattgaaagctttcttgatcagggtaaatctctattcctaaagaagctttttcctaagggtgcctctggttctttgtcaagagcccattatttgggtatggaaaggcatggttgagaaataaaaattttgttcctctattgccactacactaaatcccactattcattttccagattcttctttatcttccaaagtcacaaccttcaaatggaaaagttaaaaatttcacctgtgcacttcagatcattctaataatacttgaaaattattaggaagaaacatatcttccaaagactataacatgtaaagataagaggtttatcaagtgaactgctcagcaactccaaaaaagcaattaattcgcaaacaactcctaatgcaaatacttttcccgctaatagtttttttgagacagagtcttgctctgccacccaggctggagtgcagtggcacgatcttggctcactgcaacttctgcttcccgggttcaagtgattctcgtgcctcagcctcctgggtagctgggactactacaggcgtgcaccaccacgcccagctaattttgtacttttagtagagacagggtttcaccatgttggccaggctggtctcaaactcttgacctcaggtgatccatccaactcggcctcccaaagtgctgtgattacaggcatgatcgactgtgcccggcctccactaatagttgttaaacattcaagaaaatatactgatctaaagctttcaatttgtattggatatattttttataaaacaaattacaggcttactatgaaaaaacacattgaatttacaagatattcacaatcaatttatttccctccttctccttggcgtacattagtctattttctaccattcaaataaaacaaaaatagcaataatactcccaattgaaatacttaccaacaaagtaaagtaagtttaaagtctttctcttctcttgaaacattttaactagtatgtccaaaaaaaatcacctcactactagaaggcaatgtctctaatcctatttgtaataatcaagtgttatagaaatctataactataagagattaagaggaccaagaaagggcagtgagacatcagtttaatttcatcttacctgcttgcataatatttaacttgattagctctaccaaagtagcttaagctttaataaccagaaattgtcctattgtcactatcactcatcaaaaatggaatataggatctattaattacgatttaaagctaaaatctgatcctgccattcaaatttcttttgaatttcagaagcaagaaagctaagtattaccagtctgaattcctctaaaatgcaactttccccaaaagcatgtttcttaaaaaaaattctgtgggtacacagtaggtatatatatttatggggtacatgagatactttgatataggcatgcattgcataataatcacatcatggtgaatgaggtgtccatgccctcaagaatttatcctttgtgttacaaaccatccaattatacttttaattattttaaaatacacaactacattatattattattattattattattttgggacagggtctggctctgtcacccaggctggagtgcaatggtacatcttggctcactgcagcctgtacctcccaggctcaggtgatcctcccatctcagcctccctagtagctgggactacaggcacacaccaccatgctctgctattttttttttttttttttttgctaggaacacggttttgccatgttgcccaggctgatctcaaactcctaggctcaagcaatctgcccactttggcctcccaaagtgctgggcttacaggtgtgagccaccacgcctggcctcattcttttttaaatttaaatttaaatttttgtgggtacatagtaggtgtgtgtgtatgtatgtgtacatatatatgtacatatatatatatatatttttttttttgacatggaatgactctgtcgcccaggctggctggagtgcagtggggcgatctcggctcactgcaagctctgcctcccgggttcacgccattctcctgccttagcctcctgagtagctgggactacaggcgcccgccaccacgcccggctaattttttgtatttttagtagagacggggtttcaccgtgttagccaggatggtctcgatctcctgaactcgtgatccgcctgcctcggcctcccaaagtgccaggattataggtgtgagccactgtgcccggccttaggtgtatatatttatgaagtacatgagatgttttgatacaggcatgcaatgtgcactcatcacatcatgtaaaacgagatatccatctcctcaagcatttatcctttgtgttacaaacaatcctattatactcttaattttttaaatctacaattaaattattattgactatagtcactccgttgtgctatcaaacagtaggtcttattcattatgttttttgttttttgtttgtactcataaagaatccccacctcccaccaccacccccagcttctggtagctatcattctactatctccatgagttcaagtgttttgatttttagctcccacacgtaagtgaggatatgcaatgtttgtctttctgtgctcggcttatttcacttaacataacgacttccagttccatccatgttgttgcaaatgataggatctcattcttttttatggctgaatagtactcccaaaacttattcgtgtctttgttctaaccatcagggtttattcataaaaattcttcatattttcacctttcctaatcatctaccagtcttcagatgttagtatgaagtagaacaaaacaaattcttagttaaggtatacatttccaactccctccttaaattaagagatctggaacagatctggaaatataacgggcagataattactgaagaagacagtgaacagagaagtgagcatttttaatccttaaatgccatctgctccattatcagttcacgtacttcctggatagagctaaaatctatccttgtcccctttccttagtttttaattttttggtggtgtctccatttaattgttctgcaactgctactaagcctgtttctctaatcagatattttctagagaactgcagggttttttgcacatgtgatactttcatgagtcatttctcaaagcaaagtttttccaatgatagcctgccttgttaaacatcccaaaaagatcaactgcaaaacatttaccacccagaggaatataatctcactttattttctaacatttacttaacatcttctatatgccaggtactgcattaggtacttcacatccctcatctcatttaattttcacaatagccaaagaaatcagcattttttccattctactgatgaggaaaatgagactcagagtaacttgttaaacatcattgggggtggattaaagcatatcctctttaaaactacagacttttttggaaaactggggagggagatctatctgccatcctagcattatgatgaccatttttattatgcttcagtatgcattgcgtgttcatcactttccacatttcatattattattattattatagattcccagaagtaaagaaatatgaataattttatcaaagaccatgcttcttcatttttatcatgctgcctctctaagataacaccagatgcgaggatgaacaacttcccttccacaacagggggaaaggattcaccataaaataaaaccagtcgctgcaaaaacaagcctttgttgcctagcacaaaacataggctttggaactagacagaccagtgtgggatcccagctcagtttcttagagctgtgcttctatgagcaagcccccaaccaccctcttgcttactgtcagttccctcatctatctatctatctatctatctatctatctatctatctatctggggtgggtagagatgagtctggctatgttgttcaggctgggctcaaactcttggcctcaagggatcctcccatcacctcaagggatcctcccacctcagcctcccaaagttctgggattataggcatgagccaccatgcctggccagtcccctcatctttaaagtccccttatctttcgaaggggttaatacttactctgcaatgttaatgtgtgtattatagataatgagtgtaaactatagtgcctggcatgtagaatgcattcgataaatatcagagaataaatggctgggctcagtggctcacgcctgtaattctgtcactttaggaggtcaaagcaggaggattgctggaggccaggagtttgaaaccagcctggtcaacatagtgagacccggtctccacaaaacatttttaaaaatttaaaaagaaaaataagtccacgttccaatgaaaacattgttaaaggtataaataataagcagggtagcattccatttagcaatagacaactatgaggaacttgagtgatttttaatcatatttatttaggggaggtatcttttaaaaagaatatacatatatgcacactttttttttttttgagacagagtctcgctctcttgttcaagcgattctcatgcctcagactcctgagtagctgggactacaggcatgtgccaccctggctggctaattttttttgtatttttagtagagacggggtttccccaagttggccagcctggtcttgaactcctgacctcaagtgatccacccgcctcggcctcccaaagtgctgggattacaggcgtgagccactgcacccagcaaaaaatagattttaagatcagacattaccctattatttaaagtcaaatttattatagtagatagacctggaatttttttaaataatgttttcaaaaattgacaaaaaaatgttctgcaacagaacacccatattttgaaactgtgtctaaggagtatcatagtagtctttttaaagacagcctaaaccattctcagagagggaaggaggaaaaactaaatcatctttagcagcctatataaattccatgcttactgatgagaaaatccaattttatgttgtgaaatctaagaaaacctacaactgaaagaacagattcccggctgaacacagtggctcatgcctgtaatcccagcactttgggaggccaaggtgggtagatcacttgagtccaggagttcaaggccagcctggacaacacagcaaaaccccatttctacaaaaaatataaaaattaactaggcatggtggcacatgcctgtagtcccagctgggaagtcttaggtgggaggatcacctgagcccagtgaggtcataaggctgtactgagctatgatcatgccactacactccagccttggcaacagagtgagaccctgtctgaaaaaaaatttttttaaatatatatatacatttataaaaagaaagaacagattcctgattttatataagtacacagttaatctgatgtttgttgaggacattttgacagaaaatgctggatgtgaggtaaagaaaaattaagaagtttttgcattcaagatgcttacagtgttagggcaaagactggcatataaacaaggacaatacaggtcaggcatggaggctcgctcctgtaatctcagcactttgggaggccaaggtgggaggatcacttgaccccaggaagtagaggctgcagtgagtcatgatagtgccattgcacagcatgcagcctgtgtaagaggccctgtctccaaataaatacatacatacctacaatgactatatgctgtgctgaattcatctcagttcacctggaggcaccaagaaaactttagccgaggaagaaagaagatactgtttgagctaagacttgaagagtaggaatcttcaggtgaatgaaagggtggggtaagagaaaaggaagatattctcgcataagtcttgtacatgcatgaaaagggtgaatgtacttccaagagagtacagaaagatcaaggaaggcatgtaatttattgccttaacataaaattcaccatattgaccattttaaagtatacaattcagtgctgattcctttaaaaaaaaaacaaaacctattttcagctaggctgttgtgcttccagttcagtgagagagtcaatgaataaatataatttcactggtagaaatgctaagttttaaaaagccttcactttttaattaaaaagaataagtggactaggcacagtggctcacacctgtaatcccaacactttgggaggccaaggcggaagcaacacttgagcccaggagtttgagactagcctgtcaacacagagagactccgtttctacaaaaagataaaaaagtagccagggatattgtggcacatgccggtagtcctagatattcgggaggtggaggtggaggtgagaggatcactagagcccaggaagtcgaggctgcagtgagccatgatcccaccactgaactccagcctgggcaacagagcgagacccggtctcaaaaaaaaaaaaaagtggtcatcgtggaaattcaggtaataccagcaataccagcatgtaaagtaaaacgtgaaaacgttcccctcatcgataatcccaactgcctagagatagccactgttaaggtattgtcatgtatccttacagagatttctctatacatacacatatacttatatataggggatgctgttgtttttaacataaaaaatttctaagacataaaattatgcattgctctgcatcttcttttccacataaccatagcttaggatcctcccaaagaaggacatcaatttctagtttcagtgtctgagcctgctcacttcacgatacttttgacaattgtatatttttattgtactctttgccaatctaataagcaactcattaagtttaacttcctagcttagtttttcttcttatggaatagttcaaatacttagaaacatagagaagatagctttctttcttaattcagctcaagtagacaagtatctgaagtgcttaactggtatttttagagtatgtgcacagtttttctctattagaggaagcacagaatgtacaggaaatagagttagaatgactgacgtagggtttgagtcctcgttcattttctaaatttaagactctttttctcatctataaaattagagggtataagtaattgctagtagtcttaaagtcctaagagtataggactccaaatcacaaacgtttgaaaacgcattgttaaaattcctctacctggattgcttaatggtgagaatactgtatctcctccacttcctaaagcctatgagttccacaagatcttagttttgttcatttatgtatatcaagtgcctagaacattgcctagcatgcttacatttgtggaatgattgaaaatggttaggagctttcaatctggtaaattgccttgaaacaattatttggacaaagtaataaatctggcataatttcactctttggtctaactctcacactcctgaaatgaaaatgctagaaaatagagaactcttacacatcattcagggagttacatcggccagcagtatagagtctcagatatcctactcctgggatctaaagtcgaactccccacccccaacacctgacggggcccacactcaaaagtgtcaaaactcatagctatgcacattcacaagactgtagaagtcgggctgtcacctacgctactccactctcagattctacatccccagaagacaaagagttacagttccttctctcacgaattccacaactccgaaaaccgcgtaattgaagccaccaaaggcatagaagcggcagggaaagggggctgggaagaggcgaacagaccctcttaagccccagtcattgggaaaagcccatgctgctggaaaccgcgttctcacctccttctttctttgggcagaggctgagggaacgtcgcaaacgatgagcagcgccaccaccatggtcacagagacacaccaaaaccgccaacgcgctgccatgttcgctcctctcccttctataagtgaaactttgctccggctaggtctgagggtggggcgtgagaacaggcaaatcggccccttgcctttcctcattggtccagctcagccctgccgggagacccctcacattacgtcacagcgcgctggcgctacac

SEQ ID NO: 1855 - DNA, 78753 bp, Homo sapiens
  source 1..78753: mol_type = genomic DNA
cgaggctccgtgccccgccccccgggtgccccgcccctttgcgcggctggcgcggccagcaggccaggctcccctcggcaaacctgtctaattggggcggggagcggagcttcctcctctgagggccgtgccgcgctgccagatttgttcttccgcccctgcctccgcggctcggaggcgagcggaaggtgccccggggccgaggcccgtgacggggcgggcgggagccccggcagtccggggtcgccggcgagggccatgtcgctgttgggggacccgctacaggccctgccgccctcggccgcccccacggggccgctgctcgcccctccggccggcgcgaccctcaaccgcctgcgggagccgctgctgcggaggctcagcgagctcctggatcaggcgcccgagggccggggctggaggagactggcggagctggcggggagtcgcgggcgcctccgcctcaggtgagctcagggccgcggcaggccgggcgcgcgggtcgagcggggtgggctgcggtggggaggtgggggcgctgtcggtggggctgagcgcggcgggggccgccggcgtgagtgagcggaggtggggaggacttcggtcattgaggcggagcggaactcagcagctccccggaacgcctggggtttgagagcggggcccagggctctggagggtggaggcaaaagtggcccagcggctgcctcgctccctgttcccacccccgcccctggtgaaagggagaagtcgaggttgaccccggaggatagtgagagaaggaaagctgtcaggggacccctaggatggggcagtcatccagaggacttaaaatgcaaaagaaagggatgtggacactgctctgggagacctaaggaaggctgggaagaagcgcaggcgaggtgatgaatgcagagggtggggtgcaggaattcatgaacattttgcaaggtattgggaaagactgacgccgaactcatcatctccctccatcaaaccaggttaccacgttctcttcttgacttcaccatgaacatgaaactcgaagtaaaactattttccttgttaggtttggaatggctgtattagggttcctgaagttttggtctcgagactcctttaccctcttaagaattattgaggaccccagagagctcttatgtgggttagagataatacatacatgtaatacatactgatatttaccacctttgaaattaaagctaagacatttaaaaaatattaatttatttaaaaagaataacccattatatggtaacagaaataatactttcgtggaaaaacaaattttccaaaacaaaaaagtctattagagaagtggcattggttttcattttgaagatctctttaatgtcttggcttaatcacagagctggattcgtttatgtgcttctgcattcagtctgtcgcactattacaggtcacagaacgctggaaactgcagtgtccactcctgaaagaatgaatgaaaaagctaaataaagtcttaatattgttatgaaaaatctttatgaccttgtggaccccgcgaaagggtctcaggaactgcactaggggttcccagaccccacttagaaccattactttataccattgttgtaactttggcctgcctttgaaccccttagcagttttttgaacttctcaaatgacaaagatttgtcttacagtataattatttgtacacatctttataaatgccttaagaacaaaaactgtctcttaatattctgttatgtatagaggttagtaaatacttgatgagaggaaagtcattcattcaaaatggtatttattaagtgcttattatttgctagaaattttagaagataaaaaactaacaaatattcaattcctaatcataagggtttatccaggaatggactattatttggggacctttacaataacatattaaatgctgtgttgggtatgaatgataatggatttttatcttttattgaggacatggtatgtaccacaaaatatactaaatgtttacatgctgctgctgctgcttcattcttctttattcttcttatttttgcattatcttttttttttccgagatggagtcttgctctttcgcccaggctggagtgcagtggtgtgatcgtggctcactacaacctccgcctcccaggttcaagcaattctcctgcctcagcctcctgagtagctgggattacaggcgtgcgccactacagcccgctaatttttttgtatttttagtaaagacggggttttgctgtgttagccaggctggtcttgacctaaggtgatccagccgcctcagtcttccaaagtactgggattacaggcatgagctaccctgcctggccacattattttcttaaaccctcctgacaactcttgtttcagagtttgggattgaggcaaaggataatagtgacttgggattattgcttgtgcaaaggagtaatgatgtgaggagggaataactagcaaggcctagcagagaagtggcataatttttttctgttctaggaaaaacacgttgggcttttggatatgcaaaaaaaacaaatacaaaatattgttatgctaggtacataaaattttgaatttctggacttaccataatgtaaaaaattgtctttgggggcagatctccagagtattacggtgctaacgagtactctggttagggaaggttctgggcttcctgaagaaagccaggtatggaggactcctacatggccatgaaggagagagaagaaagtcagcaaggccctgccagggaagaagcgtggctgctggaatccaaaagcagcggatacttgatgttgggtgttgtgttttcctcgcctgccttcagtcagtttttgttaaaggctacaaaatggtcttagctttgtttgggggaactaaaggaaatatttgaggccacttttctgtggagtcacacagagagaaggggacagttgcctaacaagaggtggcaagcacaaagggcatgcagttgtggaatctgagaatttggggtgggaagtctgatgagaggcagatgagtttcacctgtctttcaagatggtaaagattagttttgaggaggttggctggggtgagaagggttggagaatttgggaacgttaagctcatccctatggagatcagaagaattaaacggactttttttcaaaaaacagcactgggagcttgggggctggacagtgaagcaaggtcagctggggatgcttactctatttaagacaaaaaagttattgtaaagtgatttcatgctgttgggagaagatctgtgatactagaaggtcctaaaggtattttttctctggtgccaaagacaggaattatagtgtgagtgtctagtccgtgtgggtgacaagtcccacgaggctgtgaagtgctttcttcagtcactggatctgcagccctagaatctcgaaatgttgcccattctgtttctttttcttctcttcacttttttttctgacactttacatctttcctcaaactgggtgaaaatttaataatacaaataagtaaaccacaagaaaagagcccgttcaaactgtctacaagagattagaaataattgtaaatgttttcattgctgatgactcagagtaaatccttgttgatagcttagttccccacaaccatgtacatttgggaatgtgctatagtcagacccggccctgattccattcaagactgacctggacaccctttgctgttagtgtagatagacacagactctgagggtcttgcccaagctatgtaaattctttggtggcatggaacatctgagccctaaggatggcagaccttccaggaggttctaaatgctgcctaaaattctgttaagtagggagcttagaaatggggctgtggaacctggaccatggaaaaacagtcattgcatacctgctgagtagaaggtgcacttttagctgcagaaatcctgctttcatgcagtttattataggaatgagaacgtgtaaaaggctctaacagaaggtttcctcccagcctgggaaacatactgagaccctgtttctacaaaaaaacaaaaaattagccaggcatagtggcacaggcctgtagtcccagctactctgcaggctgaggtgggattgcttgagcccaggagttcgaggctgcagtgagcctcaacaattattattgaaattcattcagtaatcattcatttatgaataattaatatggacaagacagaattttattgatttaggtattgtcaacctccagcatggtcgacagagaagaccttgtctctaaaacaaataaactaaaaaaggtttccttctcgccctcttggtcttatccttcagtcccatgactttacatttatttgggttgattactcctaatttctatttccagcccatttctctgctttgaactcctagattcacgtatgtaaacacttgtttgccatcttctcttgaatgactaagacacgtcttaaatataacatgtccaaaatttaacacgtcttcccttataaacctctttctttcagtttctgcaccctctggttgttcagtccaaaaacttcgaattcattcctgactccacttttacacacaaatcgtttttgtcagcccatccttcctgctgtaccttcactatatatatgtagaatccaatgtccactgctggcacgctgggccaagccacgttgtctctcaactagattattccagtagccacttaacttctccctgttttgctttgctcccaccccagtctgttaccaatatagcagtaagaattattcttttaaaacatcacatcaggtcttattcctcctctgctcaaaactctcctattgtggccaggcgtggtagcctcacacctgtaatcccagcactttgggaggccagggtgggaggattacttatgcctaggacttcaaaaccagcctgagcaacatagatagaccccattaaaaaaaaatgccaactctcctattgtttttccatctcagagtaaaaacaccattagctaccagttcactcttcaacctgatatcttcttgtctccatccctctctactctggtcacatgtgctttcttgccttcctttggacacagtagtctttgtacttgctgcctactcaggctgagatggtctccacaggtaaccacatgacttgttcacctcactgagctcttctctgatcataatatttaaaattaccctctacatctgctcagtgttacctgtctacttgcgttacctccacaacacttaagaccattggttagttggatacatacacaaaaagatatctctgtgtttatttaaatttatgtctgtacttctctagaatgaaagatccaggaagatacagaattttgttttgtttgctgctgtatcctcaacacctagaaaaaacagtggcctattttaggtgatggagaaatagatcaaattaatgaataaagattccaaatagtaaatgtaccaagaggagaagcagaagaacctaaaaacagcattatggtttgtcccctaaagggtgtataatacattctatttgattatatatttttttaaagataaaaatagagatatttttaaaaagtaaagtacatttgtttcagtcataaagcagtttttaaattaaatcaaaaattctaaattaggactttcagaaactacttcaaagcacactcttacaggaatgtaacttaaaaaggaaagaaagaaaagttaggtatgtataagcatcatcttagctgaaagccagtgcccatacggaaaatcagtaaaaacaaaaagagatacagagtcttctttttctcctgtgcctcttgtaatggaagagaaatcatctgtacttcaatttgatctttgttcttttgggggggaaggaaagccaagtgtttttaattttctctatatcaatatagacattaattaaagcatcacttggttgcatttgatgagatggcttcttaatttcatttatcagatcctggtaaacttctgaatcataaaaattatatttagcatacagcatccctatttttacaaatctcattctaattatttacaaaattagtaatccttgtattgtttctaatacaggttctttcacttgggtatttcagaaactagtaaaataaaatttcacaaaataagagcactaacaggcagcttcacctttttatgttttctgtcatcatagtcaccattgtttcttaaaagaaagaacactttaacacctaaaaatggaaaagacaattttagaataaaagacagctttattgtccttatttttatcattttaccttggactgcagattgtgctgccactggtctacagtccagaatttgagactggttgacttgtgatatgatgattcacatttaacaagaatggcatattgaatataataaaattgaactaggatgcttagaaaagaatacctagtaaatatagtgatcacaggaggccttagaggacattttcaggttaccaaaataatagttactcaaaaaaatgtttaaggaaaagctaaaattgtttcagaaataagcatagttaagaagttagctttaatattcttttaatatccccatattcttattgcataataagagctaacctttattgaatgtctgttacttgccaagcactgtgttaagcacttcttacatggattagctatttaattctaacaaccctatgaggtagataatattactaatgaaattaatttgatcgtatacattttttccatatgaaataatcaacattatcactgaattttaaatcttgggtaacagtataaatgctatgacagcatcttcataagactactcaaaatgaatgaggattaatatttcaagcaataaaatagtttgctaaccttgattctgtcacaccctggcactattatgtttcacctcttgcatctgttcaggctttcagccttgacaattatgattgaaattcattcagtaatcattcattaatgcataattaatatggacaagacagaattttaggtattgagggattttatgtctgcgtgtgtgtgtgtatacacacacatatatgtttaatatgatggggtttctgttttcaaggagtttactataatctagttggataaggcagcttttcttcatgctcatgaagaaaagctcaccgttctaaggtgaaattatgtgagataaaacatgaaacaagtctgcacatgactgcttaaggcccaaatccaggctgctacccgtttcatatagcccatgatctaagactggtttttgtattttacgaattgtaaaacaaaaaacaacaaagaagaatgtgtgatagagactctatggcccagaatatctaaaatatatccttgctggccacttagaaaaacagttgtctataaaataagtgcagttaggagactgtgtctataaagtgtgtttggtggactggtgtggtctaggaggaccttgtagagaagctagagttaatatgggactgtaattcaaattggcaggaaaaggagcaggatctgcaaagatggatgaggtgtgaattctacagtatatcatgcagattatctaaacactttggttggctgttgttggttatgtttctttgggaaagtttttctgtcgttgattgctcggttttttcttgattcttttgtctccccttgaatgtttaatacttgtactttccccttctataaaatgattacaattcatatcattgttccattcttcatggccttctatgatctgatcttaacctgtctttctaatctggtataccactactgcacacaataacatggaaaaggaaattgtatatgtatgttaaatactggtatttttaaaagaatagttttaataaaaggacaataagacattctttaaaggaagggttagcaaactatttccatagagggcccaatggtaaatatttttggctttgcagccaggtattcagctctgcagttgtatcaggagagctgccatagacatttgtgaatatgtgaatgaatgagtgtagctgtgctccagtgaaactttatttacagaaatcaggtagctgaacacatttggcccacaggccatggtccctgcaataggatatttctaggtacttagaagtactttggtttttttctttcttttttttaagaccgagtctcgatctgtcgcccaagctggagtgcagtggcatgatctcagctcactgcaatctccgcctcctgggttcaagcgattcttgtgcctcctgagtagctgggactacaggcgtgcaccaccacacaccggctaacttttgtatttttagtagagatggggcttcaccatgttggccaggctggtctcaaactcctggcttgatgagatccgcgtgccttggcctcccacagtgctgggattacgggtgtgagccaccgtgcccagcctaagtactttgaatgtcaatagtactggttctctttctaaatatactttttaaaaattatcaaaagagccaggagtggtggctccagctctttgggaggcagaggcaggattattgcttgagcccaggagtttgaaaccagcctgggcaacatagcaagacagcatctctattaaaaaaaaattatcaaaaaataaatgcacataaaaaaatcaacagtacaaaaggggttatagtgaaaagtagatcatccagccatgagctctactgtcttaccctctgtgaggcaactatggctacgagtttcttagataccttttcagagtttactctccatgtataagaacacacacaaatgatcttggtaataacaaacgctgttctgtatcttccttttttcatatgaatacacacatagacatactaccttgttaatacaaatagtagtgtattatacacagttttttatgttaattccttcatttctcagtatgtcttaaagacctatgcctttacctcaggctcagtttttttaatgaattaacagtatttcatttgatatacatgccataatttatttaaactagtaattaaggatatttttagtatttttcaattgctaaccttgtaacactgattgttctatccgcttcatttggggtcattttgtatttcatcatctttgaagaaggagtaaggaaatttttctggccttcctattccccattcctaaattaaaggcaaaaaaacctttgtcagtatcaaggctcaatttctctcacatcctgtttctgggtttctcattctcctgatttaataatcatgggacacttggggaggccgaggcaggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaaaaaaaaataatcatgggagctgagtgggagaagggaataaagaggaattccccgtgatgaaagaggaggaaaggatactcgcattcattatgtgaatagtttgtcaccacccacccactcacttgtgatttattccatacagcaccaccgtggtccagatatatagcaggtgtatcatgtggaagaaagctgttgacttgaattctttctgttgctttcagttgcctagacctggagcagtgttctcttaaggtactggagcctgaaggaagccccagcctgtgtctgctgaagttaatgggtgaaaaaggttgcacagtcacagaattgagtgatttcctgcaggctatggaacacactgaagttcttcagcttctcagccccccaggtaggttttgttcttaggattattctccaggagttcatggagccaaacttagaagaaattatctcttttgaccaggtgaactgtgttaagtatttttggaaaatgtaaatgtgtagtgccttgtttgctttcccaggttgaagcaaatgcaatgcatgaatattggttggattgtggttgaagaaaccagctacatgagacatttttgagatagttggaaaaatttgaatgtaactacatatttgatatattaagtaattatcatatgataatgatactataggagaatgtcctttttttaaaaggagatgcattttaaagtatttagggagaagattcctatgacatacattggaatagtgcagccaaaaaaatgaacatatatttattcctatgtatttatatagatgaagtaaagcaagtatgacaaatgtttaagtttttttttgccgcagtgaggcttttgaatgttgattaactcaaccttgtactcttatgagtttttcctgaattaccgatattggatgaggctttgtacttcccacatcaggcgaggcttaggaaacagtccctcttctccattcagctgctctcctctcagctgcagatagagttggtctacagcagtggtggagggcaggagggacatgccattgaagttgcctggttgtggcagcactgcagacctccttctttacctggggatccagtgggccattatttgtcccacaggaagcaaagaggctggttgagcttggaaaggcaggttgagcttggaaagacaaaggacctgatgcactctattttacgtggttttgatgtataccatttcaatatataaccagcttggttatgatatatttttaagttaacatgaggaacttaaaaccataaatgagatgttattttttattgttagttgtgggatagggaattaggaacacatggtatagtggtatgctgtcagttacatgtaccagaaaccccaacccaaataggcataataaagagaatacatttctccttctaattgaaaagcttagagcaggtttggcttcaagagaatcaaggaacaatcctgttctcaacgcattggttggtttttgtctttgctcttcctttcttggcattggcttccttccatgactgactctccacatagcgcaagacgtctgctggctttttctgggctccttcattcttgccccagcaaaacccagagggttcatctagttaactagcttcggtcaaatgcctagctcttaacctgtcactgtgccaaggagatggaatgtgctgactcgcctggcttgaagccaggagtggagttgggttgagtctgctttcctggaaccacatggatcaccaaacaaaattgaaactattagaaggaaaaaggaagtagcagatactggggaggtaaccaaaaagtttactacaaatggaaagggccctggattataaataaggagacttggactcccaatcatcccctgctttacaaggccctctgtagatggtaaaataggcctctgataaatgccctatgaatttgatacacactgtattggatgcttgctttctatttcccagcgcctcttcctaccaacagggctggggtgggaataactagctgctaatgccaccctcccaaatgcaactgttgtttggcaccaaacagtaaactttcttttttaaacctggcccattactgatagaaacagtagagttcctaaagtggtatttattaatttttatattgctggtgcttgaagtagcacccaagagttgtgacatttgaaatctactagtctaggtttcatactgttaaagtccaagttctcatacctagtaaagtctcatacctagtaaagtctacttttgcttactttactaagttctcatactttattgaataccagggcctctgaaagcttaggaaacctttctgggaagtaaatataacatgtatttcattctctttttcaataattatgcttaattactctaaccgttatttgccaagtctataatatgaacataagtattctctacctcacagagttataggagctgcatgagataatgttgtgttgaatttcatctatacaatgacaggggcctcatatctcttttgatttgtgttgtgatcactggcctgagagctagggtttcggaatttttaagtttcccatatgtgaaaccgggcttgactgaaattgagtcatatatttacttaggtgtaacaatttgcctgaattttaaaaataacacaatattttatatttttatttttgacaggccagcaactaataaagtgccaccctaataaacattagtaatcttcctttgaaaaatccatttttgctctttgtgtttttctccaaataggattagcacttttctatcagtgttccccagtgaagattatcctgatgatatttggcttacagactttctcaagattatctcatagggcttttttgcatttgaggagagaataggaaaggaaagcagtttatttttttctttttgtttttaattttctcttcagtacatttgtgagctgtagggaaatattatttgttttattttgttttttaaattttttgtgataaagggtcttgctctgtctcccaggctggaatgcagtgatatgatctcggctcactgcaacttctgcctccggagcctcaagcaatcctcccgcctcagcctcctgagtagctgggactacaagcacgcaccaccatacccagctaatttttgtatttttggtagatacggggttttgccatgttgcccaggctggtcttgaactcctgggctctaagcagtccacctgccctggcctcccaaagtgctgggattacaggcgggagccaccgccctgtttctgtgttaccacttgtgcactgtttctgtgaagttttatgtcatgttagccgtataatatccttaggaattggttgttgcttgaatgttagttattgatttaacagcaaacattttgagatctaataaagctcagtaattttaggaagaagtaattaatttgttagcttactatctgcatctaatatgcataatctaagatttactcttttttttttttttttttttttttgagatggagttttgctcttcttgcccaggctggagtgcaatgtcatgattttggctcaccgcaacctctgcctcccaggttcaagcgattctcctgcctcagcctcccgagtatctgggattacaggcatgtgccaccacgcccagctaattttgtatttttagtagagatggggtttctccatgttgatcaggctggttttgaacttccgacctcaggtcatccacccacctcggcctcccaaagtgctgggattacaggcgtgagccactgcgcccagccaacttactctatttatagatagtagaataaagaaatataagaattacagagaagaattttaatattttaataaagatattgagaataaaaactattttaattatattaagaagataagctctgatagaatcaacttaattggtggtttgcctcgtgtattcaataaagtttactgtattgcaatgcccttgctgtgctaggcattatgctaggtactgtgagtttagagatgaataaaacaatcgtttccacctgctgataggtcatagtttagtaggggagacaaacatataaaagatcatatccaagacagttgtaaaaaatatatatatatagtaagtttatctgatctccagttttctctctttgctatattcttgagtcttagtgaaaatacaaaatagaaatattctaatgttttctctcttttttgcattggtactatttcataggaggacattacttcttattccacaggaagtctgatgattttcctctgtccttacagagagaagcctggtttgggttatgctgtgaactggcctttgaggtctaaatgcagggagatggggaaactttagatttattttgattaaacgagaaactatagtcttacgttgccatattctgttccaagtgacggtggaacaacagtcagaggtagctctgaaaggtaactgtaactgtcatgtggagtttctctgtcttttgagaaactgaccaagtttcttttctggatttgttttggtgcccagaaatagctagagcagtatccatgcatctctaactagagcagtttctgtgatgaggacccagcttcagcagtcactcagcatgtagtctgagtgtaaactcactctggaattataattttatatattttgtgaaggagcctcagaggatcgaggtttttactctctgttgctttctttcttgtcgagcatttccactgcacatgggttggccaacttgcccctcagtgtggtcttacttgaattatatgatagagaaatcgcttctagtttttatttgtggatggtgttcatcccattttccagcgctagtaaattgtttccctacttttattcctttgctcatctcagtgggaattgtagaagggggttaaatggatgtgttgaaagggttttgaaccaaaggtctgtaatgatttttttttttagatcttatttaagtttcaaagactgattccaaagcaaccaatattgacatctgtatagatagacttagatgtgtagttcaaggtgcttttgtttcttttgttgttgttgttgtttgtttgctttttgagtctcactctgtcacccaggctggagtgcagtggcgcgatcttggctcactgcaacctcatctcccaggttcaagcgattcttctgcctcagtctcctgagtagctgggattacaggcacgcgccaccacacccagctaatttttatatttttagtagcgacgaggtttcaccatgttggccaggctggtctgaaactcctgacctcaggtaatccgtccgcctcggcctcccaaagtactgggattgcaggcatgagccaccacacacagcctatttgtttcttttgttttaagtgaaaacattgtgagtgtagaattataggcttcatcagtcctagttacatacatcacgaaatggttgcctggagaagtgatgcccttaacctggaatgggcagagcagaggctgaacgatgggagctgtttagagagaactagcattgttgatgtggatctcattaagatgaatcccaagttgcttttcagctccagtgctgcaatattgccattttatttcactcttcatatgaaaggtgcctcactgagggtacctatgagatgtctgtggcagggtcatgtgccatcttttcagtggcaccttttccatttgcctctactccttttttatttcatacctttttttctcagatccgttgtaacatacgcattgttatgttttggctatttttattactttatctctaaaataagtgcaaaggttgtttaatgttattctttagtttctaaaatacctttacttcacattttatcttcacaattctgtgaagcgacagaacagtgctattgtgaacatttaaattttaaccaacaaacatttacatggaaaatgagatttccaaaagtgatcatttggccaaagtcacaattattgacaaaggtaggattaaaaaccaggtctgctgaccctgacctgaactcaataccatttccataatgctaggaaatttctgaattaagaaacttagttctgtattattacctcagttgcctctttgacccatggacttcaatttttttcttcttgccaacttaaaaagtgctcaaagactggatcttatttgtaagggacttttcttatttcatgaatatgaggaaattggcaattattcctaaaagaaaaatatcaagaagtgaaaagagaaaaagatggtatggatgtgcatgaggataaggaataagtagagggagagaaagggctggtgagcaaggcctgaaggaatgtctttctggatgtggagtgtggaggggagtctcaggcaatgtaacagaataagggatgtgatgtgggaaactagatttagctataatctatacagatttcaattgacatgtaagagaaacatatgtggacatactttgtgtaatgccgtaggagggacacacatggacctactttggttatatactgggggaaattgttagaggaagaggaatgatatttatttgggcacactgtagggcatgtgggtactcttctgtgatagcatagaagattgcagagtaactttgaggacaagttttagatggaagttgataaaaatctttttttgtttcatggcctctgaaagtagatggacttcagtgtatggaatagatctgtttttggaaaaagtatttattgataaactacatcaacatttaaatgcgtcgtgagagagaataacttcaagggaagctatgtgtccttttgtcaaaaattatcctaatttatctttcttataatttcagcagggttttaaatttttgttttattgcttaatagcatgtacttgtttatcggcatatgtgtgtgtagttgaaagcacgatccttggttccatcgtacctagtcacattctcccaggcttacaggaaatcaagtaacttctctgacttctttgtagatgttatctgaaaaatatgcttgtttaccaggaagctgtgtgttcaccgtttaaaatagaactttcatttgtatgccttcgtacagcctacgtagcactataccatattctttttttacctttgttcagcaccttctcactagtgggtgctgcattggggtggctaagggttgaccatgggtccctgtcgcacaaggctttgtgggaggaaggaaatttgtgtggttaaaacatgggaggtattgcaactcattttcttgactattcaccaggggtggtttccaaatcacattttgcctttcaattctcagtctttgaagcaataaattgtatatatatgttacacacacacacacacacacacacacacgcttattaataaagttgttggtgcaggacaggcttataaactgttaatttagatgtacattaaaagctactttgtcttggccaggcacagtggctcacacgtgtaatcccaacactttgggaggctaatgtaggaggatctcttgaggccagcagttccaggcaacatatgaggccaacctgggcaacataatgaggccctgtttctacaaaaaaaaaaaaaaaaaaaaaaaaaaatactaattttaaaaatcacttagtcttgtgtcccatacaaaggaaggataacttttagaacctggccatatgatccctttccagtagtcacctgcttctttgtaagatactctagaggaaaaaccctttccatccttcttgtctcttatctccttgtataatggcagagaatatttgccatggtatattcatgagccgtgtcctggtgtgggattgctctttgtgtgatacactttctcagtaaggtaggctcactgtggcagaaagcgggattaccgtgggagatatattgagaatcaccaagaggccggtcatggtggctcactcctataatcccagtgctttgggaagctgaggtgaggtggattgcttgagcccaggagctcaagaccagcctgggcaacatggcaaaaccctgcctctacaaaaaatgcaaaaattagccgggtatggtgatgcacacccgtagacccagctattgggggtgctgaggtgggaggatggcttcagcccaggaggttgacactgcagtgagccctgatcatgccactgcactccagcctgggtgacagagtgagaccctgtctcaaaaaaacaaaaagacagaatcactgagaaagcaaaacataaggtttaaaacctttaaaaggcaagaaaacctaggtttgcatcctggttctgccattttacaatgtaaaaaaaaaaaaaaagtctcagagagtttaatttaccccaggtaatttgggtgaccttctgcaaattacgtacctttttttcattgtaacatagatgtaattagtatctaccttgtgtggttatttcaaaggttagtgataaaaatgcctggtgcatgtaaagcagtcagtaacttgctgctgtagtaatttctgttattattatatatattcaacaaacacgtgttgaacacccactaacacccactgcagtgccatatgtgggcacaattctaggtgctgaatgaactggtgactaagaccatcaaggtccttggccttgccctcatggagcttctattttaatacctaagacggacagtaagaaacagggattttagagagtgaaggacactgaactgggtgaatgtaatagataactggggggtgggagggtacctaatttagagacatttcccagagaagctggtgatattttagtaagaaacctggatgatgaggaaagagcctgccatgaaacagtagaatagtggaagccagtggggtggcggttgcgggggatggcaaagcggagcttgtggggagaacccagcagaggactggtaagtggaaaggcagaaaagagcttggcttatagaaggaaggaggcccagtatggctggagcttggtgagcctggagaagagcggaggggccaaaggagcagttcgtggaggactttgtagccatggtaaggaatctggattttttattctaagtacaggcacactttgttttattatgcttcactttattgcactttgcagatacttcactttctgcaagttgaaagcttgcggcacccatgtgtctagcaagtctgtcagtgccatttttccaatagcatgtgcctacttcatatctctgtgtcacaccttggtaactcttacaatatttcgaactttttcattatatctgtcgtggtgatctgtgatcggtgatctttggtgttactactgtgattgttggtgcctggtaagatggtggcatccaggtggcggtcttaagaccagatcagtatggtgttggtggtcttaagaccagatcagtatggtgttggcagatcagtatggtgccgctaggcaggcactgactagctccaggcagctcaaccttgggagcttcggggccccgagaggtggagcctgtgagtggggcatgcactccatgtggaagccagagcctcctcccctggatggagtgtacgagatccctggaccggagcccatcccctctgtgagagagatgtacttcacgcccgggctgccaccgctgatcttcctgccctgggaccctgggtagaaacacccaaaattctgttcaccccgttcacgaccctgggaccctggctcgaagcacccaaagttctgctgctcaagctccattcacgagcagccaccatacaaagaccaggcctgctatgtctttcaccagcgttgccgccttctcaggggtgtcaagcaggccctctggcttaccgaggccaagttaataaaatgccttcctgagaaagtacttggccttgttgatgatacaaggaaccacatagagaaccaagatgagcgtcttctgaatttgatctctcatgcctgtctctggcactgtactgagtacggccccaggagagaggcctgctgtctggtcattgtggacagtctgataaagttgtgtaagtctcagattctcaggcatccttctctggccaggcagatttgtgcccaaaactccacgttatccaccacctggaattgtgtctgttcttcagggtcatggttctagtggagccggctgagtgccaaggatcctctgcccccgccatctcctccagagaagaggttgaagctactaaaaatcatgttctcgaggccttctgtcccctctccccactactgatcttcaggaatgcaatgtttctgatgtgaaagatgacacaggattctgggagggctatccttacccctatctccatatcctgcacttcctggagaaagccgatttgcaaccacatagccttcaaccagatcagctgtgggccaagatgatcctgtttgcttttggcattgccctggctcaggcccagctcctctgtggcaatgacaccaagatctcggagcagcccgtggttgtgcagagtacatgcacagacggacgtgcattccatttcctggtgttacagtagaacaccacagacctggcctcttaacaagtgtggcaagagtttggtctgggtggaatcatgccagctactctctcagcatttttggtgtctcccagtgataaaaaagaaggtgggaccgggcccagtggctcgcacctgtaatcccaacactgggagtctgaggtgggtggatcacgaggtcaggagatcgagaccatcctggctaacgtggtgaaaccccgtctttactaaaaatacaaaaaattagctgggcgtagtggcgggcgcctgtagtcccagctactctactcaggaggctgaggcaggagaatggcatgaacccgggaggcggagcttgccgtgagccgagattgcgccactgcactccagcctgggtgacagagcgagactccgtctcaaaaaaaaaaaacaacaaaaaattagccaggcatggtggcacgtgcctgtaatcccagctactcaggagatggaggcaggagaattgcttgaacctgggagatagaggttgcagtgagccaagatcgcgccactgcactccagtctgggcgacggagcgagactccgtctcaaaaaaaaaaaaaaaaaaaaaaaaagagggtggttgtggaatgcgttgggctgactggtttccagtgggagacatccaggaagtttttagctctgtatttacatggtgctacgtgagccaaggaccattctgaggcccgaaacccacctttgccttctcccactgaagagggcctggggtccccctggagcctcagtgctcatctagcctggtggtctcactgacaataaagagcccttgcattgcaaaggaaaaaaaaactattataattgttttggggtgccacaaattatgccactataagaagttgagcttaattgataaatgtcatgtgtattccaactgctccaccgactggccattcctctctctctctctctctctctctctctcactctctccctccctccctccctccctccctgtccctcttcctctcccacctccccactccctctttgggcctccctattccctgagacacaacaatattgaaattaagctgattaataaccctacaatcgtctctaagtgttcaagtgaaagaacagtgacacacaacaatattgaaattaggctgattaataaccctacagtgatctctaagtgttcaggtgaaaggaagagtcacatgtctctcactttaaatcaaaagctagaattgattttacttaatgaggaaggcatatcaaaagctgagataggctgaaaagctaggcctcttgtgccagttaaccaagttgcgaatgcagaagaaaagttcttgaaggtaattaaaaatgctacttcagtgaacacacgaatgataagaaagcaaaacagccttattgctgagatggagaaagttatagtagtctggatagatcaaaccagccacagcatgcccctaagccaaagcctaatccagagtgaggccctaactcgcctcatttctgtgaagacagagaggtgaggaagctgcggaagaaaagttggttcatgaggtttaaggaaataagctgtctctgtaacataaaagtgcaaagtgaagcagcaagtactagtggagaagctgcagcaagtcatccagaagatctagctaatgccaggcatggtggctcgtaattgatcatggtgtctataatcccaccactctgggaggccagggcaggaggattgcttgagcttaggagtttgataccagcctgggcaacatggtgaaaccccgtctttgcaaaaaatacaaaaaattagccaggcacagtggcacctgcctgtagtcccagccactcgggaggctgaggtgggagaattgcttacacctggaaggcggaggttgcagtgagcgagatcatgacactgcactccagcctaggtaacagagacagaccttgtctcaaaacaaaaaagcaataaaagatctagctaagataattaaagaaaatggctataataaacagatttttcagtgtagatgaaacagccttctattggaagaagatgtcatctagaactttgatagctagagagaagtcagtgcctggctgactcttgttaggggccaatgcagctgacaactttacgttgaagccagtgcccatttaccattctgaaaatcctagggcccttaagaatgatgctaagaaactgcaaagtttttgtcctgagtaaccagatggatggtggtaggcagtaagactggtttaccatctttgagatggggaaactgtggggactggcagaggagtagattttgtgtcagaagggatttgggacatataaaattggtggtggctataggacattcaaatttaaagccaggatagccaaaactcctatattttttagatttattacttgttctcttttgtcattgttgcaactttttcctgtcacatcgaaacttgggaaatcagaatctttgtattttaaagttgtgatgtaaaactctcctggcagatgaatggtaaatgtggggacattaaaatacagtgttatgaatttgctggcttcagcaagagtgcttatcccattttccacctttcctaccaacatgtatcacagatttcagaaaaattctgaacttcatccgtcctgtactaacttggcctcgacataaaggattaatgaatatgaatgtcctcccttggcaagagtttaaaattctgagaggctctactatatttactaaagattttctagggcttctcgaggccctcaaatgtgctaggtatacaataaatatttactcatttttaattttgcttttatttagtatctttgtgctgtgactttcatgaacattattttttttcctagaaagtttagtacctttgatgtattaagattactgttatttacactgtttcctttttacttgtaatcttgttttgtttctttgcattggtgggtggtagaagaaaaagacactgttatgaggtcacattcagtatagacaaggaaagaaaataaaagtaggtgcaggaaattaagttttataagttttaattatctttttctttacttcctaaaagccagctaacccagttttattaattacaacttttgcaaatgtaagcttttctagctttggtttcttttatgtcagttatctattgctgcattaataaattacccccaagtcagaagtgaaaaacaacaactgtttattatctcacacagtttctgaggctagtagtccagaagtggcttagctgggtagtcctggctgagggtctctcgtgaggcagcagtcagactgtcagccaggtctgcagtcatctgaaggtttccccagggttggaggatcttctcagatggctctctcacaggtgttgtcaagagacctcatttcctcactggctgtggcgggagatctgtttctttctgtagagatatggtttggctgtattcccacccaaatcttatcttgaattcccatgtgttgtgggagggacctggtgggaggtaattgaatcatgggggcaggtctttctctgctgttcttgtgatagtgaataagtcttatgagatctgatggttttataaaggggaggttccctgcccgcaccttcttctcgtttgtctgccgccatgtgagacatgcctttcaccttccaccatgattgtgagtcctccctagccacgtagaactgtaagtctattaaacctctttcttttgtaaattgcccagtcgtgggtatgcctttatcaggagtgtgaaacagactaatactcttaccacttgagcctctctgcagggctacctgaatggcctcctgccacagtcatgtgcttccctggggcgagtgagtgagagagaggcaagagaaggagttgggggtgttccattattgactaggattttcttccaaattcctgtcaaaagtcttccaagcttagatgttggcagttattcctcaaatgaggaatgtttgtgtcacaggtatatcaaatatatatctcactgctctgtttctgtgtctttctcttccaaaatcattttcatttcaatactaaataataatgcagtcatttgaagacgttttcaatggtgttgtctttgtccattgcatgcttccataatacagtaccacagactgggtaatttttaaagaacagacatttatttctcacagttttggagcctgggaagtccgtgatcaaagaaccagcttctgatgaaggttttcttgctgtgtcctcacatggcaaaagagagagaacctacctgcaaaccccgttattacagcggcattaattcattcgtgagggtagagcctcccgctaggccctacctcccaacattgttacattggggattcagtttccagcacatgaatttgggggcacatattcagacaatagcagacattgcaacttaacacgtctgttactaacagtgcacgtaacttgactgaagtggcagccatatgagcatttatgaccaaacatttccatgagctaacactgagaactaccctgtggctgtgcctgacaggcatctgttataaggtgcatcctgatttcagaagtgttagaatatgggggaaaaaagcttctagaaattgaagaaatatggtaaataattttctcccccacccaatcatggggaagtacaatagatcaaagtcttctgcaagtaagtttctttcctctgattttacaaaagctgcaactcacaaagtgtaaattgattgagaaggagatgtgaatgagtgatttatgacaaagataaatatgcaagttatttctaaaatgtttcaatttttggtttcagatgtataaacaaggaaaatccctcttgtgactttaattttttttttttttttttttttttttaggaataaagattactgtaaacccagagtcaaaggcagtcttggctggacagtttgtgaaactgtgttgccgggcaactggacatccttttgttcaatatcagtggttcaaaatgaataaagaggtaattttttaaatatatcttttaattcttccaaggagagagaatgatagagaattaattaacattatcgtcctaaatgtagttttaacagtttggtaaaagagtctgatagacattgctaggttattactgaagtagtcaatagtcattattttggtaagacagttccagaattgtctcatgaaaacattgtaaacaataatgaaattagttctccactctaaaaattgtggaaaatagggattacttagggcagcagtgttagcgagtataaaacatcaccagtacattcttgtgtatacaaactcttcacaacagattatgttccaaccaaaatctttaaaagattttcaaggctatatggaaagttaatgtgctattctttttaagaattccacatcactgttttatctgtatcagaagatttaggaccttgtggtagattctgaagtaaaattcagatgggcagaatgggccatttattccttttgtgaaatgattggatccctgcagcacccaacaaataatttaaattcacattttagaattctcttttcttcagagttccttgagccatcttgcactggggatttctcagtgggctggctgcctgcattgtgtcccacttctgtgggcttttatcttcgatccccccatccctctctatcctcctcccacttccacagtaccttgaaagtccatattcttttcactctgttagtcccagtaattcagctttcttccaaacttgatgtcacgtctccctttgcaaatctgaaactaaataaaagctgttctgagaatgacttttcctttaattggattgcctcatactgtaggtgaattctgtggttttatacgattttgtttccgtctgttacacagaggtaagacagagcaactgtggaatgtagtaaaaagattgcatgtagctttggcactagataggtctgtgttggaactctgactgccattattagccatgtgaattcctatcatcagaggttgtgagaattaagtagacaggatgttttacgtgcctaggctcttgaaagattgcacctaaaggtatttttttatcatattttctcaattgcaaagttactttcattttattaaatgccctttgaggagaaatagtggaaaaaccctactacattaagtatatcatttgtaagctatgtcctgattggaaaaaggtagaaatgtaggggatggaaaatgcatcttagagttgaagagttgtaatggattttaaaactcttaagttttgtaaaaccacatgatcataggagtattgtaggagatgtttacttaacaagtgcttgttgagcacctgttttgtgccgggccatgttctaggtgtgatgatacagcactgaccagaaggtctctgccctcaaagagcttacacgccagtggggacagagcaagtactgttaattcctgtgagttaagagctatgaggaaaatcaacagggtggcaacataatatgagaagctactaaggttttaagcaagggaagtaacatggtaggattcgtggggttttttgttgttgttgttgttgttttgttttgtttttttgttttttttttgagatggagtctcgctctgtcgccaggctggagtgcagtggcgcgatcttggctcactgcaacctccacctccccggttcaaacgattaccctgcctcagccttctgagtagctgggattacaggcgcgcatcaccacgcccagctcattttttgtgttttaggagagacggggtttcaccatgttggccagggtggtttcaatctcctgatctcgtgatccgcctgcctcagcctcccaaagtgctgggattacaggcgtgagctgtcgcacccgactaggattcatgtttttaaaacataaacttgcggcttgaaggaagcagagaacagcaaggtgagcagttgtcttaatacctgtgcttgactggaagtagcagtagcgtggagaagagaaggtggatcacagtgcataattcagtgtatattttagagagagtcaactaagctgacagattagatgtagagcatggggagaaggaagagaaatcaaggatgaccccttaggctttccacctgagcatctgagatgtgttatatactgaggtgttgaagattggaaaattaattgacagaagacagattaacggagaaaaagcttatttgtgtgcatgcaagagctttcagaaggagtagcttgctaactggttaagttatgtagctaatttagtagggaaaggcaggggccctgtgagcataatggatgggtttcttcaggaaagacaaaggggagaagaacaagggaagatagcaaagtttgtggtaatgttgttcatgcaggcaccagtggtatctcctcttcattgtgaccgtaaagtccccaaagagagatttatggtacttttactcttggtctgttgcctgggggtaaaagctgccccacgagggaatttatggcagcctcatttcccagaactttctgttttgggtcagataaaggaagactgagaagacttctttctgtatctgttgagtcccagatgtcttcagtttaatataatcttcataccaactcaggggttctgagtgggtctccacagatcttcagcccaagtagcctttgttaagaggatacatcttccattttaacaggagggaacagagcagttataaataagtacagacatggataggtttgtgatttgttggcagaaaaaggaggtaatttctgtctgaagtcagtgcctaagagaactaggattacaggaagtttgaggaaagagtatacatcaatagtctagaaggaaaacacacttaggacgatatagtaggattgtcaggcagttgtaagtgcagcctgtcatcccagttgtcacatcctgagcaaaatactcttgctttggtgtaggtactgaaaggggagagagtagagttcagtaacttggggtttggagagggaggaggtgagcttgttaaagtacaggttgaatatcccttgtctgaaatgcttgagaccagaagtatttcagattttggattttttttaggtgctgaaatatttgcattgtatacttaaaagttcagcatcccaaatctgaaatgttccagtgagcatgatggaggtgctcaaagagttttgaatttgggagtatttcagattttaaatcatcagattaacctgttctttgcaagggagttattgtaatgaggcacttgagtaagccccttggcaatgtgccaaagttgggtgtagctgatcaattgctgggagcagaaaaagcattaataaaagaaaccttactattggaggtggggactgtggatggccatcccgtcttactgtctcattgatatgctttccatagctcttctctgtctagaccttgaaggagattggatattgtttggttaaggagtttatcctcttacagaattttgcagatcagaaggtccggggtctcaaggtgaaataacttgcccacgtcttcccagctaatgtggtcagagctgaaagcaatagccaagcccaattctctgtgttttctctatgccgctgtggtgtttgtatgttgtatggctgctaaactcataaatgttgcagttgtagattctttcaatactcagtgattgatctcttaaatgccagagcaaatagttttctgttagtgagcctttggaagatgtttgggggccagcttaactctctggtttatggatttgtaaaagactggatttttaatacttcagtcctaaataactcaaagcgttactgtttttaactcagaaatgttttagaacttgggggaaaaatgttgcactttcaaagcttcatactgaaatcatagattttgtacagcatattttataaggtgtgtttttgatgagtcatccacttctcttattgattctttcacagattccaaatggaaatacatcagagcttatttttaatgcagtgcatgtaaaagatgcaggcttttatgtctgtcgagttaataacaatttcacctttgaattcagccagtggtcacagctggatgtttgcgacatcccagagagcttccagagtaagtaacgaaagaagctgaatgttgggatggggattccccatattttattttattttaaatgtttacttttaaacaatttcaaagtatcaaaaaacatagcaaaatttcacataggtacttcatccattataatgtcaaccattgttaagatttgatccatgtgttttgtctttcttttttttttaatttagtttttggttttgttgttttttaagacaaagtctttttgttgcccaggctggagtgcagtggtgccatctgatctcagctcactgcaacttccgcctcccaggttcaagtgattcctcttgccttatcctcctgagtagctgggattacaggcacatgctatcacacctgggtaatttttgtatttttagtagaagtggggtttcaccatgttggccaggctggtcttgaactcccgacctcaggtgacccacccgcctcagcctcctgaagtgctgggattacaggtgtgagccagcatgcccggcctgctttaattgtccttctgtgtgtgtgcgcgcacgttcacacatgcacacacacatatatgtgtgtgtgcagatactttaggatgacatagacaggcctcagtctggtcgctgccactgacctcttcaagtttgccttccttcatgttccattactctgccctcacacacggcacctatattcaacttcgtttctccctgctgcttccatggtctcgaaatgtcttgcatattcacactccacatctttgcgtcacttcttccttccatcttgaataccttttctgtctgtcatacttttatgactctttcaagcctcagctccctctgctgccttggcattctgattttacctctattatagaactcgttgcattgattttgaaattatttgtttgctagctgtctgagcagtgtagggataaggagttcccttttctctttctagttcttagaacaaagcctggcaggtagtagtcgcttaccagttatgcaattcattgaccaccctcatgaggcacagccttgggcttcgatgttacagctattttaaactaagcatgagagagagcccctgaccccaaactacttacacaactatcaggaaagattatctgctacaacagaaagcaggaagactttcttgctaccacctctttctcccaaaagttaatcttttgaacgtatttctatattttggttgtttgtgttgtcaggcttgtctccctatctaactgaactcctgaagggaaagtctcggtcttaataatctttcgtaaaaacaaacactcaataaccaatagcactcagtagatgtttgttgacagaatgaagaaccagggtgaattctgtttaacaaagtagagacggaaatatttccatcaaaaacatttaatattcttacatttaaagcacaaattcaaagctacctaaaaatctctgaaggattcttgatatctagaacacttccttatttaagaaacagattgtggatctggcatggtagctcacacctgtaatcccagtactttgggaagctggggtgctggggcgggtgaatcacttgaggccaggggttcaagaccatgctgggcaacatggcaaaaccctatctctacaaaaaaaatgcaaaaaaaaaaaaaaaaaatggggcctgatggtgcacacctgtagtcgcagcaactcaggaggctgaggtgtgaggatcactcaagcccgggaggcggaggttgcagtgagctgggatcacaccagtgcactccagcctaggtgacatagcaagaccctatctcaaaaaataagaaaaagaaacattgtgaaactaacatcatggaaaaatgctatttcctgaagttactcttactcatgaatactaaatatgatcattataaaaagtagatcagtagataagcacatagcatttgagacctgatagtcttgagttctataattaggatatgaatcaagaagaggtcagtttgttatgaatttgaatgttgtggtcttcagttttgtaggagaaaaaactctcatatagtagtcttgctgctcacttttcaattcttttccataatgcgtatttttctcccaaactattgtattgctcctaaaaaatgatcttgtggaaaaaaactctagcgttgatgtcagcactaaaggccatgtagtgagtgtatcattcactgcaaggaaacattcatcagactgctttgctactcactctgctccatctttttagtgcaataactagcattgatcaagacaaaaaaccagtctcctctaaagagtagttgtcagatattattttgtttatttggtgcacagtcaagaaccatgttctttgttgtatttgctggacaaaaagaaggatagggaggaaaacactttttgttaaaagagttaaaatgctgctgtctcattcttttctctcactttagtcttccgtaaactcaaatgacgttaaggttgttgagaaataaaatatcggtcaggcgcaatggctcacaccagtactcccagcactttgggaggccgaggcaggcagatcacgaggtcgggagtttgagaccagcctgaccaacatggtgaaaccctgtctctactaaaaatacaaaaattagctgggtgtggtggcccgtgactgtaatcccagctactcaggaggctgaggcagtagaatcgcttgaacccagggggcggaggttgcagtgagccaagattgcaccatggcactccagcctgggtgacagagtgagactccatctcaaaaaaaaagaaaatatcaccattttctttaaataaaaaatacctcatgcacctctgcattagcccattctcacactgctatagaggtactatctgagactgggtaatttataaacagaagagttttaattgactcacagttctgcatggctggggaggcctcaggaaacttacaatcatggtggaaggtgaaaggaaagcaaggcatgtcttacatggtggcaggagggagagagagcaaacaggggaaatgccagacatgtaaataaccagatctgtgagaactcactgtcacgagaacagcatgggggaaactgcccccatgatccaatcgcttcccaccaggtccctccctcaacatgtggggattacagttcgagatgaaatttgggtggggacacagccaactcatatcaacctttctcaattttatttaacttttttatcccattttttattaaggggtaatttatatacagtacaatgtacagatacgtgtacagtccagtgagttttaacatatatataacatgggtatatgtacccatttaacatatatatagtcattgaccagtctagatattttatattcagcttcttccactcagcataatgtttttaaaatttactcatgttgttcagtgtatcattaggcagtcccatctttttgctgagtaacattccattgtatggattgactagtttgtttattcattctcctgttgatagacatttagtttgtgtccagttttggaatattatgaataaagctacgatgaatattctcatacaagaccttttctggacatatgttttatttcttctggatagttacatagaagtggaattgctgaatcctagagtagatatatgtttaatttttcttaactgccaaagtttccaaaatagtttaccattttgcattaccaccaacagcgtataagatttcaggttactcgccccatatcttggccaacattggttgttagctcttattgatgaattaagcttttggtcattatgaaatgctcctttatctctggtaatcctctttgtcttgaagtttactttgtgtgatactaatatagccatggaagctttcttttttgttttgttttgagaaggggtctcactctgtcaccgaggttggagtgcagtggcacgatcatggctcactgcaacctctgcctcccaggctcaaatcatcctcctacctcagcctcctgagtaactgggaccacacacatgcaccactgcacctggctaattttttgtatttttggtagagatgggatttcatcatgttgcccaggctggtctcaagcgatccgcccacctcggcctcccaaagtgctgggattactggcatgagccaccgcgcctggccagaaccatggcatttctttcataagcttttttgtatagtatatgtttttcattcttttagtttggaatgtctttgtttaaagtttcattttagatgacagaatacaggtaagtgttgctttttgctctagtctagaaaaaagtctctttcaaggtgtttagtccatttacatataatgtgattatgtttaagtctgacatcttgatgttcgttttcagttagtctcatctgttctcttttgatcctcctttcctgacctcttttggactgggattacaggtgtgagccaccgcgcccggccaaaaaagcattttttaatattccattttatctcctttattgactttagctgtgtcttagtgttattttttagtggctgttttagagattacagtatgcctctaacttattgtagtaaaccttctacatattctaccttaaaatataagaaccttatatagtatactttcattgtgccccccattgtatatttgttgtcatatattttacttcgacatttacttttgagcaatcttgtaaaagtacgtgtgtgtgtgtgtgtgtgtgtgtgtgtgtgtgtatttatttttattattatactttaagttttagggtacatgtgcacattgcgcaggttagttacatatgtatacatgtgccatgctggtgcactgcacccactatctcgtcatctagcattaggtatatctcccaatgctatccctcccccctccccccaccccacaacagtccccagagtgtgatattccccttcctgtgtccatgtgatctcattgttcaattcccacctatgagtgagaatatgcggtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgttatcatgaataatgccgcagtaaacatacgtgtgcatgtgtcttcatagcagcatgatttatagtcctttgggtatatacccagtaatgggatggctgggtcaaatggtatttccagttctagatcactgaggaatcgccacactgacttccacaatggttgaactagtttacagtcccaccaacagtgtaaaagtgttcctatttctccacatcctctccagcacctgttgtttcctgactttttgagatggagtctctctctgtcgcccaggctggagtgcagtggcacgatctcggctcactgcaagctctgcctcctgagttcacgccattctcctgcctcaggctcccgagtaggtgggactacaggcgcccgccaccacgcctggctaattttttgtattttttagtagagacggggtgagtcactcttatcacccacgctggagtgcagtggcgtgatctcggctcactgaaacctctgccgcccagattcaactgattctcctgcctcagcctcctgagtagctgggataacaggctcttaccactgtgcccgggtaatttttgtatttttagtagagatggcttttcaccatcttggccaggctggtcttgaactcctgacctaatgatccacctgcctcggcctcccaaacttctgggattacaggcgtgagccaccgcgcccagcccacgtgtgtataatttttaaagattttgtttaaaatattcactgacatagttacctgttgtggcactcttgagtctttccttctgacccaggttgctatcaagtaaaatttcccttctggctgaagaattcctcttaatacttcttatggttacagtctgctgtttttctgtaataatttgtaaaaattatttgtgtaataatttgtagacaaattatctcagcatttgaattctgttaatctgttgtcttcatttttgaaggatattttcgtcgtgtatagaattttagaggtgtgttggtttgttttcaccactttaaagatgccattccattgtcttttggcctccattgtttatcatggaaatttatttattccttttataattgctcccttgaatttttcctgcttggaattctctgattcttggacctgtaagttatctttcatcgattttgaatcatttttagccataatctccaaatatttttcttctactttctttctgggactcttaattatatgtatgttagactatttgatattgtcccacagatcttgtaagctctttttttttctttccttcactttatctcttttgtttccagttagatttcttctaacctgttttcaagattactgattttttggtgtgaccagtttgctggtaagcccatcgaatgcactgatgagtggaaatcttgatattttaaatttctgttatttccatttggctcttttttttttcttcaatttctcactgctgaaattgtaagttggccaccatcttctgtgcaagttgattaactgcctttttctccagatcctttaagatgtttatcttcgaattaatgtgagtctctatctgataattccagaatgtaggtcagctctgcttttctttttctttttttttttttaacaagtaaacatggtttattttagaaatgtgaggctatttcaacattagaaaatttttttttaattatactctaagttttgggatacgtgtacagaacgtgcaggtttgttacataggtatacacatgccatggtggtttgctgcacccgttaacctgtcatctacattaggtatttctcctaatgctgtccctaccctaactccccagcccctgacagggttacattttctttcttcttcgtaagtctcataattatttattcaatgctgaacattgagtataaaagaaaaatagcattaacatatgagattaacatattacacattaacatatagagattgaaattaatatttttatgctcaggaactagacacacccctcgtaatggctactagaataggggtatgagtccatccagtttgtagttgttaggtctgtgctttagatgtattcagtttactactgacggaattgagggtagaatgaggatttccctttggcaggactgaaattgacatatcgagaagactagaaatctctgttttacagctctagtgccaaactgcaagagatctctctccactttacatccagagtctcagcttattggaccactgaagcatttttgttcaccaaccccacccttgtctcttctatgtctcagggggtctgagacccccctgcctagctgccttgcccccagccagccttggaaagcaaaggcactgcattcactgagggcctcgtgggcctccaagggtttccctcaggcctctgttgtgccgtcagccttcaacaggccctgtggacctgcacttcacaggtgatcttttagctctcctctcctccttcgccttctgcaagagcacttgagaagggccgaagacagggagttggtgagtgaggcagaatcttttgcagctggggttccttgaggatctaattggtcatgcccactaggggtgaccagccatctggttttcccaggactttcctagtcttagcacttttaagtgctgcattctgggaaacctttctgtcctaggcaaactgagaccactggttaccctaatgccagctcacagtctgcctttaaaattttgtaaaacattcagctggcttacccttccttgtcaactcagttctaaaggcattaggtggcaccaaacatggtagacatttgtgtggggtgggaggcagtgggaagggactgggatgacccagagcaggatatcaaagccccggtaaggtgtccatgtgggagtggagcagtctccagaaataatcctgatgaattaagagagcaatgcatatctttctagactatttttgtgcatgtaataatatatctataagtggaatcatattcattcaatgaatattactgatcacctgtaatgtgttagacactgagtttcataatggagacttgttgcataaaattgacaagctctttgccttcaggaaacttaaagagtattaaatgagtgttaagtaaatgatgtctaatatctgcctggggtagaaatgttagtgataactcaccaatatttattcagtgcgggttacaaaacttatttcagtatgtcaaagaacggaacttagagctttccatgttaaatgccaatatcgttcaagatgttaataagttgtttgcctcgatcaaaaagattctgcagccaaacacatttagaagacacttgaactatattcctctccttaattgacaattcatactaacacttttaaagctttgagaagtcctgcaatcgagaaatgtgtttaacccagaattttctaagtttatttgtccacagcattcttttggccacagaatatctcgtaatatttctatgagtgctatagtttttttaaacagtttgggaaatgttattaaaaattgtaacaaatgaagggggaacttgacacatctctttaattatagggaaattttatttttatttttaacctagagattttattttttcttttaatttaaggaagtgttgatggcgtctctgaatccaagttgcaaatctgtgttgaaccaacttcccaaaagctgatgccaggcagcacattggttttacagtgtgttgctgttggaagccctattcctcactaccagtggttcaaaaatgaattaccattaacacatgagaccaaaaagctatacatggtaggaagttgattttggggtcttttgggggagttaacatgtaaaacaaatggtacaattgaaatataaggtgaacattaaaactcatatcctttcagatgttttaatgttttcagtatttttatttaaagtcccttatgatttcatattaactagctcttatatttgctaaagtgctagaattcaactcaggcttatatgtaaaatgtcaaatagtattgcatgaaactcagcactgttggaatcattacaacatttacttgctggtatttaacctgatgaatggagctaatgtaacaaatgtctaaagccttctaagatgttatgttttggagcgtatttttaaaacacaaaatgattttttctccaagccattaaaatagaagaggaagcatttacatgttctaatattgatataggtgccttatgtggatttggaacaccaaggaacctactggtgtcatgtatataatgatcgagacagtcaagatagcaagaaggtagaaatcatcataggtaagaagtatttccccagtgttctgacaagtggactataatataagctatataaactgcaacgtttaattaagcaaaggaaattatactttttaccccatactatttaatgatgtgttaagcattagaagttatattgtttatattgaaatttgaaagaatgcatactaaaatcataatctaggttcacagaaagcaaaaagaatcaggaaaaaaagccattttgtttaaattattttagttacagtttattttcaacacttatgataaaatatgtattctttaaagctttagctacaaaaaacttgattcagtgggaaaagatttttggccaggtgcagtggctcacacctgtaatcccatcacttttggaggccaaaggttggtggttcagttgagcccaggagtttgagaccagcccgggcaacatagtgagattccatctctaatacaaataaataaataaattagctaggcatggtggcatgcacttggtcccagctacttgggaggctaaggtgggaggattgcttcaggctgggaggttgaattaaaaataataataataaaagaaaaagatttttaataaaacatttttaaaaacaaacattatacacatataaaggaaagaaaggttattaacaatcccattcttaactgcgtaatttgggaatttgttatatttcagcttaatatatttatagttatattgttcatagttggaggtattgatgcatgtgttggtttgccaacattatctctatgatattgatctctatttgcttgacggctgcccttcttaagatcatgaattacaatatattcaaatttgttttttctgaaacaaggaagaacagatgaggcagtggagtgcactgaaggtagtgtaagtctttggtttgaaaccaaatctcctgcatgctagttactcttgggattggtggagtgcttttagcctactgagtgcagtgatggaaaaaatactagctgtaagaaatgattttgattgaagaatattgtattttaatctttgaagttttataaatggacagacatgattaaattgacacagtattacaataactaatcttcagttgactttcttttaatattacatataagaacaaagttcctgcattgtatcttttgagtagtgaacatttgcaattaattcttaatgttaatttttatctacataaaatttgtaagaaagataggtggctacgtgatcatggatatttgttttagattattttgtctgtcctttagccatgattagatgctctcaaatgaaatttagtttttataaaagtttcaggagaggagatttattgtttaacatatgttctatgaaatattaaatattctgtattaatataaaattgatcaggattttttgaagctacaggactctagataatctaccatgtcacctttaccataatatgtaaagggaactgaaaatctatttcaacataaacttctaatttgttttaattagccaaagcattgtacttaaattgtaatgagtaaatattaaaatttggatcatctttccttagtgtgatgtcacattgttttgcaaaattagatttgtggatggcaaagtatttttttcaatttctgcctctattacataagcttaggctctacttgggtaaagtaaggaaataatgttaaattttatattttctgattttcctgtccttcatgtctctatagtatcactctgaaatactataattactgttttcatcctaatatgtagttgcaaacaagaattctctcttgtaagagagttctaatcccatgatctgttaaccctgtttgagggaagccatgtgaagaaatcctaatcgaactcctcttcctctcctaatcctttttgcctaattgcatggtttttaagtcttcctaatgttggaaacctcttaagaataaatataagctagccccgctgtttggctccaaggtgatgcatgtgaattatcaccttgctgtgctgcttctgtacctgcagtattctctataatttttgcagtagcaagcacactattaaataataattttcaaataactctatttagaacatatagagatgaaaatccagttacgaagtttctccagaagtctcagatgaaaaaattagatccaaatttttttcaatgaaagtccacaaaattgagaattgcatatgaacagtgtcctttattatatatatatttttacctatttagcatggtgtcctctatttcattttgtgtattttattcaagagacttgatcagactattcagccataaaaaaggaatgaaatgatgtcacttgcagccacatggatggaacagtcattatgttaagtgaaataagccaggcacagaaagacaaatatcatatgttcttacttatctatgggagctaaaaaagttgatctcatggaggtagagagtagattgagactggcaagaggcttgggggtggatgaagagaggttggttgataagtacagacctgcagttagaaggaatcagttctagtgtttgatagcacagtagggtgacaataggtaacagctatttaccatgtctctcaaaatagctagaagtgaaatgttccccacacaaagaaataagtgtctgagatgatggatatcctaaataccctgatttgatcattatatatcatatgcatgtgtcaaaatatcatatgtatcccataaatatgtacgattattatgtatgaatgaaaaaaagatacttgatcaggatgaggggtgcgggttgaataggtggatttttttagggcagtggaactattctgtatgattaatgatgaatacatgtatacaaattttaatcatttaggaggtcagaggagggggattccaagatggaatacagactataagaaaagaacctaactgtattgcaaatgtatggtacagcctcactgaagaggggtgaaagagtacagtgctactgacctaaataactaagtaactgggaatgagttgagcctaatactgaaggcaaaaaaaattgcacataacacatgtgctgactcagaccttcttcaattgattttatgtaacatataagaataaagtttctacattaaaaaagtatgaatagtatataacatttgtaatttattgttaatgttaatttttatcttcataaaacttgaaaaaatagatagctataatgtcattacttattttacctatccattggccatgataagatgtcccatggggtacaggttaattctgaaaccactatttctcccaaaaacaccttacaccttgagaaactatgaatctaaccatgagaaaaacatcaaatctcagttgagtgacattctgcaaaatacctgacagttactcctcaaaaccgtcagtgtcatcacagacaaggaacacctgagcaggtgtcagaaccaagaagatacaagcctgaggagacacaagcagttgtaatgtgagatcctgaatggagtccctgagcaaaaaagaccattaatggttcattagttgtgacaaatatactattctagcataagacgtgacaaatacactaggctaacataagatgttaataatagagaaattaggtatggggtatataggaactctctctgcactaccttcacagtagttctgtaaaccttaaaatgttctaaaattaaaagttgacttaaaaagatcatttgagattactgtttttaattagccagaatatctaaaactatgaataaattatgaaagagcctagtttttgtcacttaatgaaaacagtgatggcttagaagtcctaaatgataagcacagcaatattcactattctttgctattcagtatttgcatggcttcttcatttaatttgaaaagttgtaaactgataaaacactataacatgattcactggctcaaaactacttggattagtcttactatttgtgctaaattggtgtttagattacttaatctattttctcttactttgttttagatgaattaaataatcttggtcatcctggtgagtaatacaaacataaaactttagttttagatttttaagttgttgaatgcagcaaagttaccgtaggtactcttttgctacagtaatactagtaacttttttctctttattgaaataatataatttaaggttgaaattaactacatgaagtacaattttatacaagtgatacattaaaaatattttaggttataaaactgtaagggtagaaaagaagtgtttgaggtaacataaaacctcaaggtattatcattgtgtattactccttatatcataacaaggaagttaatgggggaagtacgtgacctttaatctgaaagcaggaagcagtgtttgacagagtgacaggggtaacatttctgaactgatcagacccctgggacctttttcttggtgcctcagtcatacagcatatctgaactagttgggtgggtgcctatatctggagtaagaagtgtgtttgtggggatcattggcatcgtacaggtcggttggtcagtgaccatttcttaatgagtgacagttgtcaagagtatgtagaactctgtaggctaattttaattagaacagatttctaataagttaagccttcacctgagataaaaggcatatcaacagtgagaactacatgaagacacaggatatcaacctcgtgtaggctttctgaaagacaatgatggaacctgtggatagatctgaaaataaaacctttcaggaatagtttaagaaggtggttatgtcatttaatatttgtagaaaaccctattacttctccacttatttctcattattttagcatcattactagtttgcttagtgtcatactcatattgcattagcaaacatctattattgtgaatgccattgggctgtgctgactgtatataagcaaactagacacagcagaaagtccccattacctgtgcgtcattctccttgctgtagtgtcctcaaattcacataaagcctcaatgagacctgcctcaagtaggtcttgaactgtcaaaaaccatcctagtaattgtttctcttactgggggagaatagggggtctggatagaatcccctttcctaaattagtctgttaattcttgcttttctttaatgaacattatgaaaagttatttcagaaaaacttttgtaaatagccaccactaagattctaaaattttcctggccctttgagtttttcctcatttcccacaattcagggagtaccaaaaatttaggtttaaaagaagaatgttgtatagggaaagcttttaataggcttcagtggcatgtatttgaccagtagtacaaagttatctcccgacagtagtggacacacaactgatgaactacatctttccctacatggtgcttcaggtgcggggcgggattttattttatgtatactagagggtgaaagcatagaatccagaaggagactccctaagttagtatccagatttgctacttactagcttcataactttgggcaagtgactttaatctctctctgccttaatttccttatctatataatggggttaataatagtaggcacctcatagggtagagtgaggtttcattagatctgttatatataaagcatatagaacggtgccagctgaggcatcaggaaatggtaactactgctacttcctattgtgaacaccaccatcgtttttttccattcaagagtgtttttattaaaaatctgaagagtagaaactatattctgtaagtgatgctgctgatgttatatacttttcatgtatctttaactctggaaatataccatggatcttacatgttttgcttttttatctttgtatagataataaagagcaaacaactgaccagcctttgggtgagtagaactttaaaatgcattatcaaagtataattattgtgtataactccagaaggaatttaagacattttaatttggttttttaaagaaatgtgaataacattgggaccaaatgttttatttttttgtatctgtaaaagaaggtttagaagaggaggcttaaaaatgattacaaattcagtttctagggtcaagtcaacttctgtggagtgatttgtgtgtttctcacgatatgcaaacagacatgcgtacaaaaagaaacatgtacatgctgcatagttagcatagaggaggaagtggttagtgctgtctcttggtgagggatagaaatcacaaaggctgcagtagctttagcgtttgctcccctgtcttctccaatggaaagagaaaagaatttaggataaaatgtaaacgaacagttgcatttgaagaatgcctgggacaagaaaatgtaagggagaaaactttagcagataaaagtttagcagattaacatttaaagatggtaaaaatagctaacagcttgatgctggcagaagccagataaaatatgtctaaaatttgtccattggattcagctactgaagatgtgattggtggctttgagtggaatgttgaaagtgcctaatatgtgtcagttactgagttatgctgggaatttaaacatggatacaatgtataaaatagtggaaaaagaaagattcagaagtgaacaaatgaagacagtacatattaatttgttggaaagaaagagtggtttgaaattaactagatagggcatatattcaaagtgttttggtaggaggggaaaatgtgaggatatttacatttggaaaggaagtatctgttgagactgtgtagattagagtgatccatcaaagagaggacaatttatagagcaagttcctagaagagatgatagggatttgggccaaggtgaaaacaagagaaattggctttaatcagaatgttgaaacctcttttgagattaaaaagaaggagagattggtgaacagatagatttattgggaagctgaggacatttttagtttatgttttttgtttctaagtaattaggcgtagtaatatgcttaaaagattgaggaaaaggctgggcatggtggctcacacctgtagtcccagcactttgtgaggccgaggcaggcaggatcacctggggtcagaagattgagatcagcctaaccaacatggagaaaccccgtctctactaaaaatacaaaaattagctgggcattgtggtgcatgcctgtaatcccagctacgtaggaggctgaggcagaagaatctcttgaacccgagaggtggaggttgtggtgagctgagatcgtgccattgcacttcagctgggcaacgagagtgaaactctgtctcaaaaaaaaaaaaaaagattgagggaaaaagagtaaagtaaggctgaatatagatcttattctatggcagaggcttagaggctaaagaaaatggaagcaaggtcttacaagtctgatctacaagtgaatgtgtattgagagtccaactaagacttttaaagagtaagaatttataatggttcagatcagttgtgtgctttttctgtagcagatctcagctttaaaatagagaagataggctgggtgtggtggtacacgcctgtaatcccagctactcgggaagctgaggcacgagaatcacttgaacccaggaggcggaggttgcagtgagtggagattgtgccactgcactccagcctgggcgacagagtaagactcttgtctcaaaaaaaaaaaaaaaaaaaaagaaacctgctatgtttcattcatagtggtaagttttcatgtattccagctccatgatcttttctttagatcctccagacagacctcactgattaagaaatacctattaaaatagtgttctgaacaaaggcatagccatcatattctgtagagaggagcatacatatgtcttaggtacacaaaatgacaagatccaaatgtaactgggttagttgctgaagatggtttaatcacaaatatgcatttaatagtaatgctaataaactaagtgttttcacctagtgaaatgtttaatttaaccctgagatgtaggtatttttcctcatttttagtagatgaaaatttaaaactgtaagtgtttaataaaacttgctcaggattatacaatgtagtagttgagacaggattgaaacccatctatctctcattccatagcctccgttagctccattatgccaggtattctttctcaaacatgtcccaattgaaagaataacaagataaatggaatatcaggtcaacttctatcattgaagttcactaaacatttatctaatgtttcatctgtgctttatgacaggcatcccccacccccaggctgtggaccagaactggtctgtggcctgttaggaactgagacacacagcaggaggcgagtgagcgagcattaccacctgagctctgcctcctgtcagatcagcagcggcatttgattctcataggagtgtgaaccctattgtgcactccttaggagaatctaactaatgcctgatgatctgagatggaacaatttcatctcaaaaccacccctcccctgacaccgtccatggaaaaattgtcttccacaaaactggtccctggtgccagaaaggttggggaccgctgcttaatgaaacaagagaacaagccttggtttgtgaattcaaggctttggatactaataggaggcagacattaaatgaataatatagtacatgctacatgcctagtagaaatatgtaaagaatctagaaattgttcatagaagatggtgatcagattagtcgaggagagttagagagggctttacctaagaggcaaagccaaggtgaggattttcaaggacgaattgggagctctcaaggggataaaatgaaaatatatgggatgagagttcattcagaaatgaaggagagggaaaaaagggtgaagacatggtaagaatggaggcatgaaatagatggtgtgggtgaggaacaaagttcagtattgctagaaggtagaaaactagggaaggagtggctggaggctatactggtaatgtagttatttattgctgaataacactgcaaaatttactagcttaagaacagcatcagttttattatctctcattgttctgtgggttggactgggtttagcaggtggttctgctggtctttcttggggtctctcatgcaactgcagtcagatgaggctgggactgccacattcaagatggctttgcttacatacctggcaccttagtgggggttggtgaaagactgtgaagactgaaaaaatctccctccctctctctctctctttctcttcctcttactctgtctctctgtctctccctctccttgtctgtctctctctgtcctcccctcctcttcccgcccccaacttctttctcttcgtttccctctccctctttcctttggttccttctccctccctgagtggtctctccatgtagctgttttctttatgtcgggctggatctccaaagtggaaactgtcagagcttttaagggcttagaccctgaactggcagaggggtcacacatattatgttgctcaaagaaagtcgtgatacagcccagattcacaggtgggggtgactgtactacacaagggcaaggatactgtggtttgctgggggctacctgctaccacatctggaaagataggcatggactagaatgcaaatggccttgaatgccaaactacatcaccagtctaacccccagccactccttccctagtcctctaccttccagcaatactgagctgcctgttcctcacccacaccatcaaactgggactttattttgtaggacatggagagtcattaaaagatttaatacatgtgatttttaaataaatacttaatagcatttactatatgccagctccttttctaggtgcttctgaatattaactctatttagaaaagtaacataataatcagaattattagacatgggattaatgatataacaccagtttttgaagaatatattacattaaactttggaagacgtttaggatcatgagttaaaatgtctttctgaagtggcttcattattcttttgctgaatccactggcatttttgtttcacttttccaataaattgtttgtgttcaagaagttgtgggtagctcttacagtaaatatttttctacagaaaaactctttcatttatgttatcacttgaaaaccattataaattgctttatatttgccgtcttgaagttttctttattcctcactcttacctcctcaaattcaagttttattgttcgtttctctgtcgtgtcctttttcctctccctttctactacttctcgatcttccatccaccccagttcacctgtcacccaggaactgttttacaagtagattggacaggtaagatttacttacccaccatctttttcaccagtaaagtcaaggaaatgctgtaagacatcttaggaactagctattaaaaattatcattggaggaaaattttagaagtgttatagacaattatcgatacatatgttttaagacctgtagttctcacactgttgaacccgtgcattctgtaaactgtaccaagtattctttcccaaatagagaacaaaaccagtgaataatgatttgatatcagcaaaaacatcccatgatgcttagtttgacagttaattttatttccccaaagacccagtgatttttttattatatacttataattgttttctaccaataaaaatctatgatgtgtataattaaatgatggtattccatggaaaaatggaattatttacaagcattttactaccccagtaactttttaacctcttgctgtaaacctatgatttggactataatgatgtaaagcagagacaatgcattctcacatttcccctcaccttagaagaagactgatttgagtctgtcactctgttgaggttggatccttattctaatagcattgatggactcaaaaaaatgtgctgtggatcagccagctaagagtcttgctgtagcaggtactttagtgtaagaatactagtttattttaaaagaaattttaaaaaggccaggcgtggtggctcacacctgtaatcccagcactttggaaggccgaggtgggcagatcacctgaggtcaggagttcgagaccaccccgacctaagtggagaaaccccatctctactaaaaatacaaaattagctgggcgtggtggcgcatgcctgtaatcccagctactcgggaggctgaggtgggagaatcgcttgaacccgggaggcagaaggttgcagtgagctgagatcatgccattgcactccagcctgggcaacaagagcgaaactccgtctcaaaaaaaaggaaatacaagtgatgttaagttttatgctgcctcctattgaaatccatgctgagtattctccgctttttcattgaattaataatgcggcttaagtatcatttcactgttatgtatattcataacactgggcagttggctagaaatctctgaacatgtacatatagaatagagatgacatgatataaaattactgaggcttttcacaaagtagagttttttttatcctttgagagagtcacagtcttttaaattgatgctagttttaacactaggtttaagtgttccatggaaagaaaagcaatttcaccagagagatttttggtgaaataatcatctcaattatttgaaacatctgaaattacatattgtagacgtcgagtcagcaatgtgattattcatgcctgtttcaacttcataagagtagtattcataataacttacaaataaactacttagcagcactttgtggcaggggttggttaccaagtcctggcctgcgtcagagggggtggcctgcagttctacccaggcggctcttcagccagttggctggggctgcaggtgctcttgtcaccctgtctctctgctccctggcatttctgtcactgctgctactattacgggtgctgcacacgccccactgtcagccctcaagaagaaagccgtcagaggctattattgtcacgggatggtcttgaggttttggtgtgttctttatttttttttttttatttttttcttccctttgataccagtgggtcttgagtttttaaccattgaccccattccaggctatcaaagaaaggtaccgtgttgaagacctcataagcactaagctaggtctggctttccacactgttttagatgggctgcacacctggttaagctagctgctactttttaaggcatagatacagatctttttttctcttatgaacaaaaaaactgtttctatcagaatacattatctttgagcaaagtctcagtgcactaagttcaaaaaatgaacttttaaggtactcatacacaaaatcttcacatacccctgaaatagcctcatctgagtcaaatgggggagtatttttaaaagatgctaagaggagacggtagtacatccacatggctactgcagaaaccaagaatacagtacccgtgaagttctctctctctttgatatttcccctcattcactctgatgggattcttcctgtcccttttttagttatcttgtttttagcctcttccattctcagcaaaacagaacctaatttgatgggaacccaatttcaaatattccttgtttaaattttctccaaaagtctagttgaatattatatcccttttgttataatttaataaaagtaaactttaatattaattactgttatgtttcatatacagctaataaatatcctttgcctggctctcaaaagtgtgaatatgcttaatttcagtttgatgattttagcatctgtgttcctcagagaatattgatctgcttacataaatagttctaaaatgaaattaaataatgaaatcttatttgaaatgaaataatgcaatcttaaagcatactttttattataataccatctccataggttttgttttaatctttatatcttctttaaacaccccctttctttttttttcaaagcgaaggacaaggttgcccttttgataggaaatatgaattaccgggagcaccccaagctcaaagctcctttggtggatgtgtacgaattgactaacttactgagacagctggacttcaaagtggtttcactgttggatcttactgaatatgagatgcgtaatgctgtggatgagtttttactccttttagacaagggagtatatggtaagatatttataatgtttgtttttacaattatccattattcttttcattatacaagttaggttaagaattgaaaatcagataaagataaggtaaacatgttgttgaatggaagagttttatttttcttattaagatgatacatttgatcttcattccatctgaataactaattagcttcatgtctttacttttatgtttcctgttttgtcaaaacatatttttcttactagaattcttacctgtcttttgtgatttttttttaattgatagagccacagtataataaaacttgataaccacacagcaaaatttacattcatatgcgtaaaatattacagtatgtggggttttctttgaggggggtagcataaaaggttctagtagaatgtatattttgtatgtttccttttcctaactattgcatggtcttttctagtcttttagtgagaactagattttaacaaggaaatgttggtggatggggcatataatagtaatttgtaaattaaagttctatacagatatgcttagaaatgtacctctacaaaaattcttacagtaaatatttaatgttttttccccattctttcacctaaatatattaacactgcatatatggtaaagaatttcaaaggagacagaatgtgctgtcactagctaatcatttatttggtgatttatttctttcaatatgggaaggccagctgttgagctcatctgaaccgtgttttgcaggattgtgcttccatgacattgtgcaataacatcagattgccagggaagtgacatttccaggcctgttgttaggcatgcaatgataaacaaaaagtaccggtttggctcctgtatctttccagttattttattttaataatttctgaatttactcttgttatttataattagattgatatgataaggcaagtttggtcagaatttttaatggtgctcaaagtagaatttttaatggaacaaaagctttttttttccccccaagatttaccacactgttgtgtaagggatggggaaaagtctcaaaatcttacttaaatgagtttccctctctaaatagtgaggatttagagaaagacaaatgaagttaacaaggtaaacacctcaaatgtgagatttcagctattatgctgatgtgttaataaaactttatttataactcttatggactgatgactaatgggtgaatccatccatttttttcttatgaaaatatgaaagaatatacaatgcaaatatgccaccttggtaattggcttatacaggttgagcattcctaatctgaaaatccaaagtctaaaacttcgtgagtgccaacatgatgccacaagtggaaaattttacaccttacgtcatgaggggtcgcagttaaaactttgtatcatgcacaaaattatttaaaatattgtataaaattaccttcaggctatgtgtataatatgtatatgaaacataaatgaggctgggcatggtggctcatgcctgtaatctcagcactttgggaggccgaggtgggtggatcacttgagcccaggagtttgagaccagcctgggcaacatggcgaaaccccatctctactaaaaatacaaaaattgggccggacgcagtggcttacgtctgtaatcccagcactttgggaggccaaggcaggcagatcacctgaggtcaggagttcgagaccctcctgtccaacatggtgaaatcccatctctactaaaaatgtatggtggcagtcatctgtaatcccagctactcaagaggctgaggcaggagaatggtttaaacccgggaggtgaaggttgcagtaagccgagatcacaccactgcacttcagcctgggtgacagagcaagactccgtctcaaaaaaaaaaaaaatagaataaaataaaataaaaacacgaaaattagctgggcgtggtggtgcatgcctgtaatcccagctactcaagaggctgagacacaagaatcgcttgaacccaggaggcagaggttgcagtgaaccaagatcacaccactgtactgcagcctaggcgacagaatgagacttggaatcttggtctcaaaaaagaaaagaaaaacataaatgagtttcatgtttagacttgggtggcatccccaagataacctcattatgtatacgtaaatattccaaaatctggaaaaaaaaaatctgaaacacttctggtcccaagtctttcggataaaggatactcaacctgtattttcaatctggcatcaggggtgttgtttgtttttatattatacaattgatctcagcttttaaggtgcctacgtgacataaaaaggaaaaggcttccaaaacttcactagaagtgatgaggtgtaaggaaaaaatattgatcagtttaggtttctgtattggtgaagtatttaaagattgagggaatcatatgaagaattactaccttggttgtttattctcatttcttattgatattttcaccttggcttttaagccctttgtttgacttttaaaaccaaatcctgtggccagggcatggcggctcacacctgtaatcccagcactttgggaggccaaggcgggcagatcacctaaggtcaggagttcgagaccagcctggccaacatggtgaaaccccgtctctactaaaagtacaaaaattagcccagcgtgatggtgggcacctgtaatcccagctacttgggaagctgaggcaggagaatcacttgaacttgggagggggaggttgcagtgagccaagatcatgccactgcactccagcctgggcaacaaagcgagactccatctcaaaataacaaaaacagatcctttagttgcccctgtgaagtagagaaccagaaatattaaaaattgtgacaagactgcagtttaggctgaagctttgccccaatataaaaacgtcatcttggagtacaaaataaagaggcatgttaaagcaaaatgtcagcttaagaaagctagaaaacttttaaatcctactgattcgtgtcttaacagggtggctgcattatattttgaagtattgtgaatattccaaacatcagacacatctacactaaatgtaagtgtggtagaggcttgagggtttagggcatatcataaagaaacctttagtttttcttttggactatgcctttaccgctagttgatattaccaggggactcagtgcttgagggctgtgggggaagatggaaggcagagtcacaggaatttcagcatgaacagctagatacggagaacagaggaactcgagttcatgcccttttatattatattgcacgcaggtttgtagaagaaataaaagttgcaacagaacagacaataattcagttttaaacatatgtaaacataaaaaacagaaaccaaaaccagaaataactgtccttaaaaatacaaaaatacatgtccttaaagataaataaggagaaagatttctagttatgttgtatagatggccaggataaaaagtaaccctttggcctgagatctatccctgcatagcctttctgtgttcatcgcttgctgcagcttagttgtgctttcgtgtagaagaacggtaaaggagtcttgtcggaatatggcaaaagtgttattcggcctgcagcggagcagctgttcagttcacatagctcagtggttaagcagtgggccttagcatagctagcctgggttcaaagctttggctttctgctgacttagctgtgtgactgtggttctttaacttttctaagccaaaaggaatctacaaaatggatagaactaaattaatgaggtttacaggataagataaaataattatccctgtgcctggcacactaaaaatgctcaaaatattgtacctattattgttgtcgtttcctgtcaatttattaaagacattcaagcactttttcatctttagattggggatttggactaggtagcattctatttcaggcctcaatgagagaaacccagctttaatcagtttctgtgtattaagggtctacctaaggttttttgggttttttttttggttttgggtttttgtttgttttgttttttgatacggatggagtcttgctctgtcgcccaggctggagtgcggtggcgcaatctcggctcacggcaacctctgcctcctgggttcaagcagttctcctgcctgagcccccagagtagctgggattacaggcacatgccaccaacgcctggctaattttttgtatttttagtagagacaggcttcactgtgttagccaggatggtctcgctctatctcctgaccttgtgatccacccaccttggcctcccaaaaggccaggcgtgagccactgcacccagcctgccaaaggttttttgtgtttttttttttgttttttttttttttgaggaaaaaaagtcagggggtttaaagctgtagtgtagtaaaacagtgaaaagccagtgcactgacattttacgttgtctgagagtcgagttacctaaaaagccagcagtagattatagagacagtatcatatagcacagtagcgaggctggcctgcatctgtattttggttctgtcacttactaggcatttcagtttgggtgagcttttaaacctcttcatgtctcagttttcccatctgtaaaagagggatgttaatattacctactttgttgtgaggattgtgtgaggcaatgtaactagtgacctttcttggaaccgtgcctggcacatagtaagtgccgtgtaagcctgctggggtggcgggtgttgtgctcatcagccactcactgtgctaagtggagtgcatattcagttgagtggaaaagtttttcatttaaatgattattttctctgtagacaaaaataaatatctgtgactatattcttgaatcatcctcccaagaaataaaactccctaaagatctaatttgcagaattgtatttctaagtacagtaagttctttgacatttgtttaaaaaatacctattttcttctctatccttgagtaatgggatggttaactaaataaataagcagtactagagatggaatttaaaaacaacaacaacaacgatttgggccacacacggtggctcacacctataatcctaacagtgggaagctaaggtgggagggttgcttgagcccaggagtttgagaccagccttggacaatatagtgagacctcatctctacaaaaaatttaaaaattagccaggcatggtggcacatgcctgtggtcccagctacttgggaggctaaggtgggaggatagcttgagcctgtgaggtcgaagctgcagtgagctgtgatcacactgctgcactccagtatgggcaacagagcaagaccctgtctcaaataaataaataaataaattttttaaaaaaatgatttggactagttcattttacacaaaagtacttaattcccctcaatataatttggttgcagactttgatacagaatagttacacttttcgtaagacattttgggaaagagaaaaaatattttggtgttaagtgccttaattccattcagcagttgcagggctgggcatgtggcattaatgtaacagaacaacattcagcttttccctggatgaatggaagctaagccttccctcagagttgtatcttcaccccaatcaagtcttgctggagccagacgtattacctgacatgagggaggcagcacccaggcctgctgtcagtcgtctctgagtaataccagttgttgaaatggtaccatttctactaaaagtcagacccttgaaaagagacctccagatctgaccctgtcttgattggtttgcattgttaatttaatgcaattcagtaagtatttactgagttatttttgttacatctatagtccagatgaaggagtatgctatgtgctgagagaaataatagtgaataaagatcatgatctgtcctcctaagaaaattacagtcctgggccgggcacggtggctcaacgcctgtaatcccagcactttgggaggccgaggcaggcagatcacctgaggtctggagtttgagaccagcctgaccaacatggagaaaccctgtctctactaaaaatacaaaattggctgggcatggtggcgtatgcctgtaatcccagctacccgggaggctgaggcaggagaatcacttgaacccgggaggcggaggttgcagtgagctgagatcacaccattgcactccagcctgggcaacaagagtgaaactccgtctcaaaaaaaaaaaaaaaagaaaaaaaaaattatagtcctttaatacaaggagaaaaaaacactatggagtcaaaacatcaactctgtgattttaagcaaatcatttaatctttgtaatttaattttctcatctataaaataagggcagaaatcacttaaagttgttatatggattaaaattagattgtgtatatgaaagtcctttgaaaaccaagaaaatgttatacaggttgaatatctctaatctgaaaatcccaaatccaaaacactcctggtcccaaacatttcagataagagctactcagagtgtgtaaatgtaaaagattagtgtcattatgatttcttatcagaaaaactaagtagacataggactatagaatgtcaggaaaagccagtatgtgattgtcagaaagtgctgctacagcatttcaaagtagggagaatttgaagtgtgttagaaagccacaaaccagttaccaggtagtagttaccaggtgagtaacttgctaaggattctgaactttggaaataacccttgaggactggttatggtttgggtagatagaacggagatagagtaacttgagcaaagttgtggacgttaaaaataagtttatcttgctcttgaagcagtaaagagactgatggaaaataaagttatattttgaatacttgatggaggtgtataagttgtaccctttttaaagtgtataatttggtgatttcagtatcttcacaaagtgggcatcagtcaccactacctaacttcagaacatttccatcaccccaaaaagaaaccccatatccattaacagtcactcccattcctccttaccccagcccctggcaaccaccaatctattttctgtttctgtggatttgcctattctggacatttcatataaatggaatcacccaatatgtggccttttatgtctgccttctttcacttcacatgttttcaaagttcattcatattgtagcatgtactagaacttcattattttagggctagataatattctattatatgattatattttgtttatccatttatcatctcatggacatttttggacatgattaataatactgctgtgagcatttgtgtacacattcttgtgtggacgtagtttccatttctcttcggtatgtacctggaagtgaaattcctgggtcatatggtaatctatatttaactttttgaggaactgcaaaactctttccaaagttcttacaccattttacatttgtgccaccagaaatgaatgagggttccaatttctctgcatccttgccaacacttgttcttgtctgtcttttttattgtagccatcctggtgagtttaaaatgacttggaactagtggctaatgatgttgagcatcttttcatgtgcatatttgccactcatatatcctctttggagaagcatcagatcctttgcctatttttaaatcaagtcattagtcttttttttttgagatggagtcttgccctgttgcccaggctggagtgctagtggcacgatctcagcttactgcaacctctgcctcccaggttcaagcgattctcctgccttagcctcccaagtagctgggattacaggctcccaccaccacacttagctggatttttgtatttttagtagaaacggggtttcaccatgttggccaggctggtcttgaactcctgacctcaggtgatccacccaccttggcctcccaaagtgctgggattacaggcttgagcctccgcgcctggccgtcattagtctttttattgatgagtggaagagttctttattctggatacaagctgtccttatcagataaatgatttgcaaatattttctcccattgtgtgggttgtcttttcactttacctgatcttcgtggtttattgaattaaatccattcttttggtcattatttttaaaaccctatctgtgcactcctttttaaaattccctgtgtgtgcagtcttattttcattcacaacagtaatttagttttttgctaggctagtctcttttctgttagctttcattccaggtccaatccgtgtttatttctgttctcctgcccataatctacctcgctctctctctgcctttgcaaatttctagccattccctctcttaagaccatcccctgttgtttcacttcatactgatattcctctctactttactcatttcatacgtacatggtggttgtcccactaacatgatttatggcatttaattatgtgatgactttcattgttgcttgataacataaacgtgtgaatcgtgtgaattcatgtatggagatacatgaatctcctgatctcctgcttagaggtcaggaactttgtccttcttttttgtttctctcagtgcctacatgataacttccagtgcacacatgagctgtaatataaacccacacttgaaaatgggtatatccattttctcattttagctgaaacgtatttgaaagaaccatttttctcattttaatcgaaattcagaaaaagcagacgacctggattttgtcctgtaggaccacatgaagcaaattgtctttaattctcaaagccgcattctctgctaggagtcggggccataattacaatggattagctacttttggttccctgtctaaatggcttttactatttgctttaaaataccctgtaaagaaatcattaaatccagaatattgagagagcaaaatcagtgggctccagatattgcaagcagaggggaggatatcttcaaaagtgttttgtccagtacttttatgaagaagttcagactgatatttttgttgttttttacagccaaaacaaatttcaagaaaacattgagttgtttgggttagtttttatagtatcacttctcagtaaggaaatatgattcatctgttgagtcctaaaactatcccaaattttagattattgagtcaaaagactctagatggaagattgatatttatatctcatagcaaaaagaaaaaatagcaatctgcgaagtcagatttcccatctctgattataaaactatatattttaataacccttaactgtttatggtaatacctgcagtttcttgacttcatattgcagttgctattcatctgaattgtgtttgttcatccgttaaatacttactaagctcctgctctctatgccaggaacacacaaataaataaatgtaagactatctctgccctaacagaactcctagcttcatggaggagacaaatgagtcaggagagaaatcctagctgcattcttttttatatatcataacataaaattgtattttatattatactattggttacaaatatattttataaattaggatatacttcagacagcattttgatattgtcttgaaatgcaaattttaagtgcagactgttggtaatttatttatttatttatttattttgagacagagttttgctctgtcgcccagggtggagtacagtggcatgatctcagcttacagcaatctccacctccaaggttcaagtgattctcctgcctcagtctcccaagtagctgggattacaggtgcccaccaccacgcccagccaatttttgtatttttaggagagatggggtttcaccacgttggccaggctggtttcgaacccctgacctcaagtgatctgcctgcctcggcctcccaaagtgctgggattataggtgtgagccgtcatgcctggcctgttgccaataattttaaatgcaaaataacattgtctatatttataattgggtatttcttacatatgctcacatcaacctgaagaaaattaaagtcaaggtttttctacaaaaagttatgcagtctgtatgttcagagtgcatttagaattgacatctatctctctcttatttttcctcttttcagggttattatattatgcaggacatggttatgaaaattttgggaacagcttcatggtccccgttgatgctccaaatccatataggtctgaaaattgtctgtgtgtacaaaatatactgaaattgatgcaagaaaaagaaactggacttaatgtgttcttattggatatgtgtaggaaaaggtaagttttctaatctttattaaagaattgttggagttaaatatcgaccatgacaaactagagaaacctgtgaaatgctaaaagccatttgcgtttgtgaattttagtttatacattgaaactggaagaacaaaactagaggaaaatacatttactccatgtatatctaattattttaactcttcatatttgctatagaacacaaatgaagaactaaagggcatgggcatttactcacactacaggggattcaactctccagaatgcctttagatgactttaataatcactatagttattccctcaggaattaacaaaaccaacacccatggagttgggatctctgctcactagtcagtcctggtcttccagacatggaatgagtagccgaagcagatgtttggaggtttggatcccatttgtctgccattgcctttctaaggagtagaaccaatgactgttcctctagatttactatttttttgcttgctcagcatttaccaatcaaaatccaatgccagagttcaaatgcaactctagttttaaagctaacaaggagttagtgggttattttgggtagatatgtagctacctagatgaaaaattttgaatctataattttaaattatgtattctaaaaaactgttgtattttctcattatttatacccttttaagaatgctctttaacttttcatatttctatctgccctcctccgcctcccttaaatagaaatgactacgatgataccattccaatcttggatgcactaaaagtcaccgccaatattgtgtttggatatgccacgtaagaacatttgatgtttacgttgaagtttcctttattgtttgatgtctttttgtttttgctttttaggagcaggggtcttaactctgtcacccaggctggagtgcagaggcgccatcatagctcactgctcctgggctcaagcgatcctcctgcctcagccttctgagtcgctgggattacaggcatgtgccactgtgcctggcccctgagggttttttgattatagattagaggcctagaaaatacctatagacatgtaggcataaatttacctccttgatattctgcgtagaaaattttaaatgatcgactttagcattccatatcatggtatcttaattattaagcccaaattgggcatgtaattcctgcttaaagattaactctttaattatcaatgtcatgtgagaggcagaagagaaaatgaagcttattggtgtatacagaagtcccatgtggcaagtgtttgcttttctaacattttctttttaaaaaattatttttattggatattgacaagttataattgtatgtatttatgggatacaaagatatgctatgatgtacgtattcaatgtggaatgattgaatcaagataattcacatatcacctcaaatacttatcttttttcctaactgaaacattgtaccctgtgactaacagtccccacgctgtccccacccccccccagcctctggtaaccaccattctgctgggtgcttctctgagttcatttttattagcatccacatataagtgagaacatacagtatttgcctttctgtgcctggcttaacttctttttctatttttaaggtgtcaaggagcagaagcttttgaaatccagcattctggattggcaaatggaatctttatgaaatttttaaaagacagattattagaagataagaaaatcactgtgttactggatgaagttgcagaaggtaaaataaaaaataaagagaaaagtactcagaaaaaggagagcaggggagacacacctattcagggttccctctctggtgattgttttattcttattatgtgggtttggaattagtacctactttataaaacaatttttatattaatataacgttcagcaacacttctgctatttaatgtcatctttccttcccttttgacctagctctccaccatctgtgcagcattactcagactacaaggctaagcctcggcacagtcattaataaagttgaattctcagagctctactttgcttctatgcccagtgccttggtactggcaaatctccctatttgagggtgggtgggtggcatggaggggtggtggggaattgtccagtgagcagtctctcccaggatgggagagagaaaactttacagaaatttttagacactgctgggaaaagctgagttcatttttttccctgatgaacttagtagtttttaaatcctgatttaaggatgtgatcctagggggtctaatgccacatcttccatttctatctgttctccctgcctgctggtataatgctgtgcatatgtcagatgctgaacaagtacctattatttcagtagattgcactgtgttttttgaaaaaacattttataagccatagcaaaaagaaggtaacttggccaggtatggtggctcaagcctgtaatcccagcactttgggaagctgaggcaggaggatcacttaaggccaagagttcaagaccagcctaggcaacatagcgagaccctgtcttcaaaataaaaaataaaaataaaaaagaagaaattattttacaaactagcaccactagaaaatggagtttcatggatgttccagtgatggcagtttgggtataaggtgtttgaccaactgtcagccatatttattttcatgtttttatctgtgtagctattttagatcacttgacttagccacttttccatttaacataaccagccagggctttggacttcctgccaccctcccgcttcatccagagaagttccacttttatttgttttctacattaggcttcttctgaagcttacatttgaaggaaaggctctgctgctttaaaaaaaaaaaaagaaagaaagaaaacctttggattatgtcagttatattcaaactgagatccagtaaggtgctccagaaactctacagtgttttatttcaatttcgtttttaagtccattttaactattttaaaacttaataaaaagcaccatgctcactcacatatgatatttaccaaattgtcatagcaatgaatggcatcccgatatgtgctgtgaggatatttgaacttcttataaacatcttagacagttttgcttttcgctgatctttttcagtcctaccatgtctgcttaaccagaattgcccaggcaggaagaccctgtagtgtacatggagcacactcagctcagtgccgtgcacattgtgcccttcgtgggtaacggcccactcattgtacaaaataagtaaaggcctaatagtatcatgataaataatacagttaaatctagcccttattttgagttttggatgctttgtgtctgacccctgtcttagtagtaaagagcaaaagtagttgtatgaaatttttcacaagtcatccaattttgaaacaaaactttgctgtttctccctttggatcttccagattacttaattgaaactcattccatggctgggcatggtggctcacacctgtaatcccagcactttgggaggctgaggtaggaggattgcttgagcccaggaattcaagaccagtctgggcaacacagcaagaccccatctcaatttaaaaaaaaaattatttggggccaggtacagtggctcatgcctgtaatcccagcatttggggaggctgaggcaggagaatcacttgaacacagaagtttgagaccaacctaggcaacattgtcagaccccccatctctataaaaatttaaaaaattagccaggcattatggtgtgcacctgcagtgccagctactcgcgagacttaggtgggaggattgctcgagcctggcagtttgagactgtagtaagtatgaccacaccactgctctccagcatgtgtgacagagcaagccccatctcaaaaaaaaaaaaaaagaaaattccagagggagaaaagtattcacagattataagccaagcagttgaaggggaaaataaacatgttaccaatttctttttttaattttttggtttctttgtgtgagactacagagtctctgtcgcgcaggctagagtgcagtggcatgatcttggcttactgcaacgtccacctcccaggttcaagtgatcctcttgccgcagcctcccaagtagctgggactaaaggcacacaccaccacgtccggctaatttttgtatttttggtagagatagggtttcgccatgttggccaggcctgtctcgaactcctggcctcaagtgatccaccggcctcagcctcccaaagttctgggattacagacgtgagccaccacgcccggcccaccttaccaatttcaactgtgtgcaaggaaaacaaaatatgaggtaaattggttgttataatgctacagccatcaatctgtaacgtgacttttatttttgtactattcaggacagcattattattagaagtgttgaacatactactgaaggttttcattgtgagtagatgttcgatatgaatataggaccttgaagtaacctacatctaattataggacccctcttctcccttcccccactccatgataactaccattctaaacttattcctttttcgttttacatagttttattgagtttatatatacccaaaaaagtatgcgtagttttgtttttaacttcataaaaaggtattatgctctatgtagtcttttgggactagatttttttggttaatattatgttgctaagattgatccctattgttgcatgactgtagtttttaactgctacgtaatattctgttatgcaaacatactacagtttttttcaactactctcctgtgttggtgagcatttgagttagttgtaggtttttgctatgttaacagtgctatcattaacagtcttgtgtatgtctcctggaatatgtatgcatgaatttctttgcagtataattctacaacttggaattgctgggtcatagggtgtgacagtattccattttgagagagaatgccagacagttttgtaaagtggttgccgagtctacacttaaccctactccccacggccagcaagggataatgtgaatctgtactctctccatcacttgatagtcagacttttttatttttgccaaatgttaaatagtatctcatgtgatattgaacattgttcatatttttaatagctatatgtatatcttatgtgaaacatctttttatgtcatttgtgcattcttctgtgtgtgtgtgtgtgtgtgtgttttggcttattgatttagaggaatgttgtatgtgttcttgatataatactagcgaggaccgctaagacacaattgaataggtagttgtgggcatccttgtcttgtttctgactttaaaggaaatactgctaatgtcttcacatttagaataatattgtaagtttttttattaacactttatcaggttaaggaagttctcttaatttttttgaaaatttttattatgaataaatgaacaagattaaatggtttttctgcagctatgaagaagaaaataggatgtttcttttctttcaatttcttaatatggtgagttaaatttatagatagtctaacattaatccaacttgagataaatcactttcattgggatgtatatttttaatacactactagatttaatttgccatcattctgtttagaattttcatatctatattcatatgggaaatgggcctgtaattttactttcttatagtatttggtttaattttatgagaaaataaaattagtatttagtggtatcagtgttatcagtatcagtggcatacagagtatcagtgttatctgatagaatgtagcgtaggccttgtggaatgagatggaggacaaccaagatggttgattttatgtcaacttttgccaggcctcagtgccaagatatttagtccagcattattcaagatgtttctaggtgatggatccaacattattctggataagattaaagtttaaattgatggactttcagtaaagtagattgctctccataatgtgaatgggcctcattcagttagctgaaggccttaatggagcaaagactgacctcccacaagcatggagtttgctagcagcccgcctctggggctcaaactacaactctcctctgcatccccagcctgcctgcctgcaggtttcagacttgcaccgccacaattcataaaccaataccttaagtcagtcccttcttctcactgtccctctatgtacacacatacacacacacacacacacacacgtgtacgtgtacacatgcgcccatcttgttggtactgcttctctggagaactctaatacagaagaagtacaccctgttgtttactgggaacttttgtataaattatgatctgttccctaatgtttatggtagaacttgcctataaaccaacctgggattggtatttttttggtagaagatttttaaccactggttcagtatcttgaatatttcttgtaccatataggcttttcatttcttgagtcaattttgataagttatattttcctaggaatttgggcagttttcaaattcgttgtcatttagttgctcatatttctaatagtattctttaatctctgccttatccatagttatatatccgttttcatcagtattacttgtacttactttccttttttatttattgccagcttttgccaattgtgctatttcattttgaagaaccaatctttgactctgttgatttcttctactttttcattgttttctacatcattaacttctgctgtttatttatgtcttgccttgcatttattatttctttttctaacatcatcgtagttattcacttttagcctattttttccaatttaagtttctaaggctttacatttctcttaaaacatcactttcatcacacatcctataagtttagggattttttttagttgactttttttttctttgacctttaagttatataatattatctttaattttcaaatatggcaggaattttcatttcactttttgctttttatttctaccttaattgctttgtgatcgaataatagtctgtctaattgctatgctttgaaatttgtggaggttttcattatggccaagtaaaagatgaaattttgtaaattttgcatgtgtacttgagaaaaatggatatttttgtagtaactggttgcagaactctatgtatgcccattaggtttggcgtattaatttttattgttttgttcagttctatatttctgctgattgtctctttgatcaataattgagatgttgaaatctctcaatttaccaaattttcttgtagttctagcactttttacttcatatatagtgactattttcgtgttttaaatgtttatattttcttattgaacctttatcattatgtagtgatgcctccatttcaaatgcttcttctctttttgtatcatactaacagagccacaccaacttcctttttgttgacctaatatgctattttttacacttttactttcctactcttaacccctaggctagcctgcttctctacacttttactttcaaacatttcatgtcattctgctttgctgtagcttttggaggcaccatataacagattgtttaaaatccaatctgataatcttggtcttttaatgagaaaatttagttaatttacatttgttattttttgtacctgttttaaccatctaattttttgatttggctcattttcttatcttttttaaaaaaattgtatttatatcttttcttctctaacaaataataattttaatgtactcctacaatacttggtatctccttttaactcccaacatgttgatttaacttagacttagttctggatcactatataattttgtctctttttttaaaaaaaagaaccttactattgttaatttataacatagtagacagaagtaggataaactataacttaaataatatacttctaaatttaaattgatgtgtatccatatacattagtctatctaaaacatgttgaatgaaaatggtacattacaaagacatacatagaacatttttgttgaattcaaaaacctaaaacattggcatatactatttatgaacacttacacacatgagtaaaaattaaaacatgcctgatatgtctggcacataataggtgctcaggaaatatttgttgagtgaataaatgatactgagaatataacctgataatgtaggatagttcttagcctaaatatttaaaacataagaattggtggtcttaaaaataatatttattttcatatcttttagatatgggtaagtgtcaccttaccaaaggcaaacaggctctagagattcgaagtagtttatctgagaagagagcacttactgatccaatacagggaacagaatattctgctgaatctcttgtgcggaatctacagtgggccaaggctcatggtacggtaaagcccattttttgttagatctacaatatacttaacgttaaatcataaagtttcttctgaataaataactttcctcccagttttacagtgaaaatattttggcctactaggcaaatctcaaaccaaacaaatatttcaattatggatattacactggcttatttgatttagaaatatcaaattatttagcccattattgtcactattggtaaaatttaaatgaccatttaaaaatttttctatttttaaaataggttaagtttccatttgtctaatacacaatcctttagattctcctatattgtgacctgtcgaaaatcatggattgggttctgatccagtctctaccactctatgaacatgttatctataacatgtaaataagaaatggtacctgcttcaggctgggtgtggtcgctcacgcctgtaatcctagcactttgggaggccaaggcaggtggatcacctgaggtcaggagttagacaccagcctggacaacatggcaaaacctcgtctctactaaaaatacaaaaagttagcggggtgtggtggcacgtgcctgtaatcccaactactagggtggctgaggcaagagaatctcttgaacctgagaggtggaggttgcagtgcagtgagcagagattgtcccactgcactccagtctgggcgacagagcgagactctgtctcgaaaagaaaaagaaatagtacctgcctcataggttattgggattgaatgagtgcataggtagaaatgagcatggcactcgacaagtcctctgtacttttgattattcgtataactgagcatcctctcttggacacttgatcagtaagttgagtgatcagcagagaagatgacgtgaaaatcaatctgtagcttaattaccttttggtaattgtgtatggtttaatgaaaaaataagtttaaattaccaattgaaataattttggattttctgagtccaagtatctagtctgtgagtctcttatagataattgaaaaataattgtatttaatgaacttctataaaatatctttattttcataaataataatttttgttcttggccaggtgtggtggctcacacctgtaatcccagcactttgggaggccaaggtgggtagatcacctgaggtcaggggttcaagaccagcctggccaacatggtgaaactccatctctactaaaaatacaaaaaattagctggtcatggtggcaggtgcctgtaatcccagctactctggaggctgagccaggagaatcacttgaacctgggagtcggagtttgcagtaagctgaggtcacgccattgcactccagcctgggcaacaagagcaaaactcagtctcaaaaaaagaatttattctctaatacatatttttagtaaattaacatattaaagcacattaaaatgtaaaatgctataaatatctcaccattccagataactggataagtaattgaatgtcttttctctaaaaaagatctaaacaacaaatagcaaaattacggtggtaaagatcaacaataaacgaaacttcataaaacaaaatgaaaaggtcatatagaaaatatttgtaacaaataagagaaaaaaaattaagaccctcctcagtaaacaagcaaatgatacaaattcaacaatccacactgctggaagtatagagaaaaattttttaaatggctaatgtaagtaattaaggaataattaaaactgatggtatctttctgctttttaataccatcaagtagacaaatgttttaaaaattaatactctgttttggacatgttatgctgaaactttatattccatgcaaattgaaaataatttgtcccatatgtaaaggaacaatcacatagctttatctatcttaaagcattacgtatatataaatattaactatgatagaaaaacaataaaacccagaggtattataaatattcaagagttaacagaatggttaaaggtaacaaactataatgtggctgttcagtgacattgtgctttattaaaaattctggtcatataaattgaggcaacagtgaaaatttatctacaattgtatgcatatttttgattgccacaataaaaattatatatacagttggataagaactataaacaaatggtaaatgaaagactttgtttggccagcagaatagtgagcattattttttaaattgtatgtgtttaaacaatgtaaatcatgtttttaagcaaaagaaatgctaactatattctcctccataaatatttgcctcttatcatcagaaaacctaccaaagttgttcttattgttctttttcagaacttccagaaagtatgtgtcttaagtttgactgtggtgttcagattcaattaggatttgcagctgagttttccaatgtcatgatcatctatacaagtatagtttacaaaccaccggagataataatgtgtgatgcctacgttactgattttccacttgtgagtctcttcttttatttaaaatacagtgatatattctcacttattaaagactaaattttttaaaacttaaagttgatggtaaatataaaggaaatatatatatttatatatgtgtatatatttatagtttagtaacactgatcataatatttactaattgccaaaataccttaagtttatgagatttagaaatgtctaaagttcactcaggaaggatgcctctaatttcttatatcctaaacacgagagccaatgtgaaggaataaaatgtgctataaatatgtcaagaataatttccttttaaacagttataacttatattggaaacagtagtttttaagtcttgttaaggtatggtcatatgctggaataatagaaatctagttctgctcttttcaaacatttaggtttgatagttattttacgttggtctaaagaagccagtaaatagtacccctctttcctacatgagtgtgacaaactgagaagcaagcaaggagtaagacaagcagaaacccaaaatatcactttgattactgatagaggctttgtggaggatattgcttcatgtcagagtaaatggtctagcaccaaaccccagaattgagtggccaccccacacctccagtctcagcagtacggagcccagataggcttcctgaggtactgagcaagctgggggcctgtgggcttctcactggagcagcagaacccttactcttggccattgggttggctctaaaagaagaaaaaggaaaaggctgtttatttatccttcttaaatattctaatcatataaatttccctgcaccttcccaaaagtgatgattaagaggagagaatccaggagtcaaacactaatggggctctctctgcttaagaggaaacttgagtagctcaagaagcatttctaggaatcatttgaaaggaagctctttcagagctcactttactttttagatggcttagtacagaattgagaattcctattataaccatagattgttgttttcattgtttagtcctggataattttgggattaccaaaattcacgagaggccagaattcacgagaggatagtatcagttaagatgtcttatgtactagattatattgtggctttcattgatttcattattaacagtccctaatttttttttttacaggatctagatattgatccaaaagatgcaaataaaggcacacctgaagaaactggcagctacttggtatcaaaggatcttcccaagcattgcctctataccagactcagttcactgcaaaaattaaaggttactaccttttctgtttatagctactaatggaaaactttatgaaactggaaacttattttggcatagaccatagatatgctgccttattattaaagtagagataaccagtctacagaaggtcctatcagtgaccctttttatattctgtttccgatggtgaccagaggactttatgtgtgcttaccctccagaatgctaaaaaattagtaacattagagtatattcttttttctttttttagagacagagtcttaactctgtcacccaggctggagtgcagtggcatgaacatgacctactataacctcaaactcctcagtgcatatgatcctgccacctcagcttcccaagtatctgagtctacaggcacatgccactacacccagctaattttttaaaactttttgtggagaagggatctcactatattgcccaggccaatctcaaactcctggcctcaagaatcctcccttcttggtctcccaaagcactcggagtacaggtgtgagcttccactcccagctccatattctacttttaaatatgttcagattttcaagtaatcatttcctagttctatgactagacatatagcaaattagaattttttttccatttttttatttctagttgacttacaaatgagaagctagttctgcacattgagtgttctaatgaaagcttttaatttgttcacaactacatgaccatagaatgtatcagctaaaactcagggaatggaatgggcatgattgagaattacacacataaacctgttgtcatcctgttcggagctcatctacttaaaatcctttcttctcttaaaaagttagcccattatctgattcagttatattttccacctacgattatggattactataatattttaaaaacagcttaagctttttttataaaactggtataaaaccaggtttttttttttgttttgagatggtgtctctctctgtcgcctaggttggaatgcagtggcgcgatctcagctcactgcaacctccacctcccagactcaagtgattcttgtgcctcagcctcccgagtagccaggactacaggcgcacaccaccatgcccagttaattttttgtatttttagtagagacaggtttcaccacgttggccagactggtcttgaactcctaacttcaagtgatccatctgcgtcatcctcccaaagtgctgggattataggcgtgagccaccacgccgggcccagatcattttttaattaaaagttaataccccatctctaataatagggaagggtaagtttcctaagctgcactgcttggaaaatgttttccctgttcatctagagtgtaagaaagatctctttgactttgactactaacagtagtaagaactagaaattctaaatgggttgtaagtattgcatgaaggaaaaggaagataatgatagctggcgtttctcagtttcagggagatataaaggatgccttgaggatttggaacctgggaaaggagagtgagtggatttttgggggtgggggtgtgtatgtgtgaatattttcagattgatatatattcactgttgatgccaataataaaccagatttttttccttttcaggaacatctagtcttcacagtatgtttatcatatcagtactcaggattggaagatactgtagaggacaagcaggaagtgaatgttgggaaacctctcattgctaaattagacatgcatcgaggtttgggaaggaagacttgctttcaaacttgtcttatgtctaatggtccttaccagagttctgcagccacctcaggaggagcagggcattatcactcattgcaagacccattccatggtgtttaccattcacatcctggtaatccaagtaatgttacaccagcagatagctgtcattgcagccggactccagatgcatttatttcaagtttcgctcaccatgcttcatgtcattttagtagaagtaatgtgccagtagagacaactgatgaaataccatttagtttctctgacaggctcagaatttctgaaaaatgacctccttgtttttgaaagttagcataattttagatgcctgtgaaatagtactgcacttacataaagtgagacattgtgaaaaggcaaatttgtatatgtagagaaagaatagtagtaactgtttcatagcaaacttcaggactttgagatgttgaaattacattatttaattacagacttcctctttctaagattttgtgaattggttgaatagttctatacaaatgaagtatggaggtgtgtatgtttatatgtatataacaaaatattttcattgtgaccactctgaagtaagagcaatgggaatggcattattgtagaataagtcattgtatttttaacaccagaaagaaccttgccgatcaccaggcataacctaattttatccatggaagaaacacagaaaggcatctaagttagagctggcaccagaactgagacctccagaaatctattccagtattttttccactacacaactgccttcctgacaggttctgagataagtgttatgtttgtagatagagtgaaatatatttatatatatataaatatatacagatacatatctgtgtattatctcaaggaatgtacaaactttagtttttgattataaggacttcactgcaagttttagttaagaggtttgtatataaatctgttatagaacaggctgaaatttcttgttcataagattatgaaaccacatgagaagtgataaaatgtttgttaaagctagatagaggttaagaatcaagatataatggataattttcatagctgcctatcagaatttcccaaatatttagcatcttccttgataatatgtattttcttcttgaatttcactggcctaatgagataatactcttatctttggctctacctaaaagttggttaaaaatgcaattggcattaacaaggaaaaatactgaattagtaattttaaaagtctcacaaagaaaatcccaggcctagatggctgcattgttgaattctgccaaacattaaaattagcactaattttttgcacactgtttctaaaagtaggagaggaaagaacacttcccaacttactctaggtcagtattaccctgatactagactagacatcacaagaaaactataagccaatattccttattaatacaaacacaaaaatcattaacaaaaatattagcaaactgaatccagcaacctataaaaaggattctatatcatgaccaagtggaatttatcccaggaattcaaggttggttcaacatctaaaaatcaaataagctaatatacagtcagttctcattattcacagtaattatgttctacagaatattctcccataaacactgaattaaatatggaacaactgcttttaggagaaagtgtatttgtgtatatgtgtgtatacatatgtttatctcacacacattatgagcttgaattcttaattcatcctagcaaattctaccttattttacagaagtgaaagtgaggtatcagaagtgttaagtgacatgcctgaggcacccccctaacaggtgtcagagctgaaattcaaaccccatccagctggccccggagccagagcttcttgtactacacagaattgcccctgccatttccaccctccagtcatttctctatgagactgaagcaggaaggcagagcatcatcttgttcagcctcagctgggaacatgtgtactgggtgactcaaatttttcacccatttacacatatccacaaatgactgcaaaagtgccacggatatcaatttgagggttataaattttagcaagttggtaaattcacaaatacataaccttgaataatgaggatcaactgtaccatatttaataaagcacaaaacccacacagattgtcttattacagcatttgataaaatccaaaactctttcataaaaacactcaacaaacttaggaataaaaggaatcttcctagatatgataaatataacatctatgaaaagcccacacctaacattatacttcatggtgatagactgaaggctgaatgttttccccttaagattgggaagaaggacaaggatgttcactcggcactacttctattcagcattgtacttgaagttctagccacagcagttaggttaggaattcaaggtttgttcaacatctaaaaatcaaataagctaataaagaaaagaggtttatactgcaaaagaagtgaaactatatgtattcacagttgatacatagttgtatatagaaaatgctaaagaatccataaaaagtaataaatgagttcaacaggt

SEQ ID NO: 1856 - DNA, 78753 bp, Homo sapiens; identical to SEQ ID NO: 1855
  source 1..78753: mol_type = genomic DNA

SEQ ID NO: 1857 - DNA, 44561 bp, Homo sapiens
  source 1..44561: mol_type = genomic DNA
cacagtggaaataaatattagctttattaacactcaaagtgccattcatttatattcattccatagtccagaaggttacttattagagtaagcctttgcaccacaatctttcaaaaaaatgaacatgtaagaaaaagcagttttcattgtgctaattattgcaggccttcatgcacgtaaacctcaacaaaatgtgtgccaacaatatacaaatttccatataaacaaagtcattgatcactaacaaaatataaacatggtttcttttatattagatttttttttaaaaaaaagctatttaccagcaagaaaaaacaagtacctagaaattataaaactcagaaattgtatacatttttacaagcacaattttgaatgacaaacaaaatcaaaatgtgcatgaaatgttgcacgtaccacactgtatctggcttctggtaggttttcctaatcacactggttccttttaacataataagcttagtgacattcaacttcaacagtggactttattcctaacacgagtaattttacatggtaccgcatatttaaaacaaagttttctttaatactacattgtctgattggaaatttcatttccaattctttttctgccagttacttaaaacacacagtacaatataaagacacacaacgtatgtttggacatttcaaaaccaatttatagtcaattacaaagaatcacaatatgccaatatattgttttataaacccagtctgaccttgcccagtgatagaaaaactaaaagttgaaatcttttggggtggaatacaggaaatattcaaagacaacagtaggacaggccaatagcaactggagatagaaaaatcttgacatctcgagacaatttagtttctcacatttttccatagctctgagaattcaaaggccatttttagcggtgtgtttttgctactgcttaaaacctatttttcccttaatttgcatttcacggaattctcaaagagaatttaatgctttttcttgcaagagtattttaattgagctctaagtatgacttgcattcaattctgaaaatacaaatacattttgaatggctaaaaacaaaattttaaaaatacttttgatcagccagctgaaaatatattcatatagtaaataatctctcagaaagcttttatatatatttaattatcacaactaaacagtacccttataaaacaagttcataaaaatgtagaaatgaaatgaaaataagaacttactgggatatatacatgtgcctacagacagaaaaaaacatctccacacaaacatacatcccctgatacacagttaaaagcatactttcaacttagtaatggattttataatacattataaaattttctaatttctattaatgtcgaactcctgagttcttcaacaaagaaccatagataagtatagtttgtaaaagcaaaaaggtccatttaagtcagtaatagcagtgcagtaactgatggctacatcttgaaagaagttaaaacataaagacacagacagtagttcaatgcacgcattcatgatgctcatacactcatcaacaattattggtcagagtagtaaatcagtgtacaaattaaacatttccaaaaatgtgcaaaaatgtcaatcttaataggaaaaaaaccctttgtacataattataaactgcccagcattcaactgagattaaaaacatttagagagaaaccaataggttaaatatagagaatttaatggctacatttaaaaatgtacattattatgtcaaagggtaaatttacaaattgataatcatagtttgcaacaattcaaagtttattctcaaatttatccaagtttacttttatttacaatgaataaaaagaaccatgtgaaatgtaagagatgtcagacattaaaagtatttttggtattaactcttataatatttcagaattcagggtagcaaattttaaaaccaataacaatagaaaaaatgtaaaccatttactaattaagattgcattaaaacaattgttggtctttaaagaagtattcttatccttagacactgtactttcaattgaatagggtgtattgcaagaatttggcccacttcatattgcccataagcctctccagctcaaatgtttcaactagtcctctcttcttattccaggtggaaaaaattctttggaaaagtaagaatacatcaaatccattttgtagtctatctaatagagtttaaggtgtaattttgtttcttctcccctccaagtaaagctaatgctaaaatcatcactagttacatatgcttttaaaaaataaattctaaaaaaatatttaaaaagaagtgaacttaaaagtgcttttcggtatggtcatgaactttactgttctcaactgcattaagggattctcaactgcattaagggattcagaaattatttggggacaagtcctgtacatatagtagaagcagatacttccttatgttccaaaatgtctatggcacaaagcagacatcagtccagaacctacttttcctcacagctttgctgaaatgcccctcaagtcaaacataagttcataaatgttaagacactaggaagaaagttcgccatcaacctgaggcatcagacgttaatgtctgtctatgtgaatcagtggtcaagtgacattaacaagattggcacatgtacaagcttaaattcatgtctacatagttcctcaatagtggaagtaacttctggatgtctaaatgcactgatcacctgtccttttccttgaaggatataccagaatacaaattctactagtatctgctttataatttttatactattagcttacaagtggacagaagtaacagtgctaattattttggctatgtgtacagggaatataaaagctttggtttaaagtgattctgataatacagattgtgttacaaacaagaagtcatcaggcagaaggaacaatggtactgatttaatgcctttgctgttattaacaaaaataccatatgactatcaattaaaatgcacaattatgaaaaataagaattctatgagactgtatacaggcaacagataaaatctattcttttctttactgtagctatgactcctccctcatctttctgaagctcaaccttgaatgcttacaggaccactgaaaaaagaatctctaggctcccccaagagctcatttccatcaacagctctggaaggtgagtatgggaagatgggaggccctgatacttcccacacctaccatggcatcctgtccaaaccatggcagaagtcaaagccaagccaaagacaactataagtaggaatagctgcttcacagcatgcttcccctagccaaccaaaaagaggtacaagagaatttccttgtgaatacttggtaagctaaggaagcttattttgataatgtttggcagaatttcagttccaaaaagttcaggaagaactatgtaaaatcaattactttctatttaagaattatatataagattattttacatatacacaaattgaattttaatctacctttagcaaccaagagtatggcaatttacaatcaatattattatacaatcatttgtactagctacttctggaaaatgtactggtgttcctacccaaggatgactacactcactgtatgtcatcagtaggtcatacatttgagttgttcttccaaaaccagaaactgacctaattgaacactcatacctttccccttcttccttcccatccctgcctccaactctaaccacacacacacacacacacacatgcatgcaaacgcacacatacatgcacacatgcacacacttcacagaaaagtaacttttctgtgagtattacccaaaatgttagctgagaattaaggactagaatctgctatccctggatttcctactcactgtcctatctcattgccttaacatttgtaaaccatgtgaatgacttctttagggcaaaaacaagtattgtaactctaccatgaaaatcataactgaactataatatgccaagaacttggacagtgccaatgtgattgaaaatcaaatattcaacccagaaaacatttacatgtctctttagaacgagaatacctctttctatgcttgtgttgggaattcatgtctagtggaagctgcagcatgtctatcacagacaaatcctaatgtttctctcctaacatttatttatttatttatttatttttttaaaaaggaggtagaaaagggtaggaggaggcaggcattaagaaacatttaaggaccaatacacagtctaaggccaaatgaacttgtgaagcctactgattttggaaaaaatcttcattttggtgggtaacttgaattattaatataaaataaaattaaggcatacagagaaaaggcactactaaaaattaacaattggattgcttttcattaacatttaaccaatcttaaaattcaaataaatatgaacattacatttgtaaaacaaaggccaaacttagtaataaaacagtatgatctcaaggaactgtcctgatcttagtataaataacactgttgacagagttcaatttctatcaaatgttttgggtattttcacaatttagaccaaaataaagtatgttttctttaaaagagacactggggaaaaaaaaaaaaaagaacaaaaaaacactgttatggaataaatgctccccatcaccagaactgttgagtagaggctgggttttgcagtaagagggggtcctgagagagatgctatgtgacctggttggggaggggatccctctagtttggagatacttttactctaatccctgttgtcagtgacatttccgtttataacagccaatgattacctaaaattgcttttcccttaataaaaaataacattttaaaacatcattgctgaactttcagagttagcgtatgccataaaataagtaactgtttgcccatgttcctcctagattgtgacctccttaaggatgttaatttagtacctgacataataagttacaattattgaacaaacaaagaagattcattctattaaaaaagatagatttgtatatttaattgacaccaggtgattttatatcaagctatcagttcccagactccaaataaaatcactggcacagaactttgccataggccaaggagtctgcatctggcttggtcatcctgctaaactattcacatctgattttattttctaagtgatttcacatatcttataacaactccatgtcagaaatactacagagcagatctgacatatatatgagctggagtagcagagacttagtctaaagaaatagtttcatctttttaatgcagtttctttgggaataaggtaaagactctctcaagtgaaagccaatccaattcactctgaaatcaaggtttaaaattttcttttacagttcagcaaatgcattaatattttaattccttatatatgttatgtaagggtaactgtgccttttaaaactttctaaggcaatagtcatttttttaagttagaaagatgttttgtaaacaaggaaaagtgctgaaaattttcaagatattcatactgaaattttcagtctgtatactttcaaatacattttaaataattaacaacccatcaaaatttccactagtcattatgatttttttaacccttttattcaatacaacattttgtttgcaatgtaaaagatcttatatttggtccaagcctaagtcatgccactttgaatctctcaaggccttaagtagaaagatatttcctgaaaagcacatataagactgctagtgaatcttctccagcaccaaaaagtctgccactgtcaaagcagaatgcattttaaaggcacaaagtcagcagtctgaccattttccagcgtcagcaaagaagcattacagtatagaagaatcaattgtgcatttaagaaacaaaacacatttagagttatcttaaaaagttcaaattgcatttgttgatccatatcattattagaaagaagaaaaaaacggagtgttatatttaacttcccctgataaagctgtttcctttcaaaaatttcttttttaaatttacttttggtcttccataccctccacccccacaccttcaagcttttttgttctagtagtttttatatatattaacttttattgtggtttttggtaccttcacaacttgtttgaaataaattcacatcgtattttatataataactctgtaaactattagtctatttttaagtctttacataaagaacattactttcccatagctaataatatttttcttataaagcaaaggccttccacagcagtgttaaagtagtagtttcttttcaggtgcctttattttctatagcatttagaaaagaaaacagagactgaaaaaaaaacagttttgctctgggttctacagtctcaccagatttctctctaaagagcatttgtctcatattgtgcactgctggttaccctgacagaccaaaaacgagccaaaggaaaagcacaactacacaagacagatatgaaggaaaagcccactggtcaaggaccatgatcttgctcaagtagaaaagatgccctcattcataaaagataaagaaattataatagatccacacacttggggattctttctagaacaaaatttggcagttgctttaccaaggcagggacacctcattcttgttcttccctgcaaactgcttcaattttaagaatatgagagaagcgttgacaattaattttgtgctttgacttcttagactagctagtggaatttcaaatattcctacagggaatgctaggtaggaccttggcacagtaaaccaagatctacctaacttcagaaacaaagtatcgtaaaagagtccctaaataagcacaccttttggcagaaaataagaatacctgagtcccttatgaatcccatgaaagggattctggggcctccaggaagactgttgttttctagacctttaaaataaagtactaaataaagtactaataaagtacttagcacttgctttaacatgctgaaaaaaactgcaagtggccaaattgctgatatcttcatgttttatagtagcacaattctattagagatagtggggcctttcccagctgtcttgttccatttaacaatgtccttgctcttattggatacattgtactagaaatacgtggcagctttttaaccttcccattagtagttaaaattttgttttgatatgcttttttttttttttttgcccaaaatcatgaattttaaggaaagaatatatagagatggctgagttcaaaaggctcagtgttcaaattcagtttgttcctaaaatgaagagttacctatgtgggtgcaatatgcagctggtaaagtgattgctatttgctgtttgttgagattattcacccttgacttaaagcagcagtatctgatcttgtaaaatcctcaatttgcattacatcactttctctttgcgacttccttttctttcttgcatttactgctttgtaaatagctgttttcagtttataactgggactgatctttacatcagggtttctcagcctcagcacttctgacattttgggaggggtaattctttgaggctgctttccttgtgtattataatctatttagcaacatccctggcctctacccaattcatgttactagtatccctccaattgtgacaaccggaaatgtctctaagaattgccaaatgcctagtgaaatcatcctcgctccacttttggcaaccactgtttcacatgatacctgtttttttgaggtgctttagtattctgtgatcctaagaacaagggtttcatctcctgacataacacataaacattactaattgaactcttcgctcctaagggatgttacctatggggaatcaggagctggaaatagaagatggtatacatgattttgattatttctccattcctttaattttgggacgtccccctcaagtaaaacaaaacaaaactgtttaaaatacactaaacacctaattttttttcattatttctattgactgtaaatgtggtctcttctactgctcacacatttgataagagtgatgtccttttgtcttttatttctatttgctcacaacttgactttaaaataaaggttttccgtgtgtgtgtgtgtgtgtgtgtgtgtgtttttaagcagaaagctatccctcaaggtttacagattccagtaacgtggatctattatagtgtatttgcttattatactggttaggattaacaaataaacatacctctcagagattcatatcttctatcaagactcctactgagcaaaaaggttggtagacagaggttaggatctaaagaatacagatataagaagaaacctatattctttaagttgagtacctaccctaaactaaagtttagggctcaaccccacaaatgaggatatattttaaatactatcactaaaaactacaaattatacatcattttcttctccttgttttccatgtcttcccatcgtcactgatgtgtcagtgatagagggaatgactctacaatctttaggtattccaaatgatttgtttgtactaaaaagagtgactatgtactaaagtgctttatctctctgaaccacatcagtacattataaaaattaaaaaaaaaaacttcaagttcttgtaagggaaaaaaagattaaatataaaaaatttaggatattattattattaaacaaatttaaccaagaatcaagagaaatactttccctcttgtcttttttctcccccatctctctttttttataaaaaagaaaagtgcagtcagagagaaggtgaatgaatagatgggagctaggtagaggcacaggagaggttactggctgctagtgataatgcacaaacatgtgccttaagagttcatcagctgaaggtctcagtttggcctctacaaaaatccgtttgaggaaatctcgagtatagtctgagacatgaggtggcagctttgggtttgttggctgagtggcgattttaaagatggcagccattgcttcaaattcagcccaaggcggcttttcagttagcatttctaccacagtacatgcaacactcctgaaaagaaacaaaaagaaatacattacacaaacaacaacatgaaagaaagctagttagctagaaaatgagaaacaggcattaagtccatatatatttaaatatgacttaatttcaagttcaaagtttcattaaaaagttctaatttcgtaaaactaatttaaacataaaaatcaattaaaataaatttaatgactatcacttaattcaaacggttgggcaaagaacattattcatcttattatttttgttttatataatttctaacctgattttaaaaataatttttgtctttatcttacaaagaatataagcattagaaatcaattgccttcaggtgcctaaaatgaatgtctattaaagtcttttctgggtgggaagtagaaaatggccatttcatgttctaacttaaaattataaaagaattaaagattaaatgaattataagacactgacaacaaagatgaagtacttttaaaggtctttagacaaacaaagtaactatttatttacttctgtaatagcaaaaagctttttaatgctgaggtttgctcacgacaaaatccttcctaaagaatggaggacaggttcaaggattctaactatttagtcaattataagcctcaataaggcacaattaatatagtgttaatcttcgcaattcttacgtcctattttggaagtacaaaagattatttacatctgcctcagtaattcaatcccaggtggaaatacataggcggcaggtggttttcaagcaaacttcgtatcaaaacctaccagatgtctgcttttcttccatagccttctccactgatgacttcagggctcatccagtatggtgtgcccgtgacagacttcattcctgtccctgagagacagatggtctgaagccgtttgctggccccaaaatctcctagtttgacgttgcctgttgaatctcgcaggatatttgcgcctaaaaataagacattgcctcatttcattaattttattggcagtctcgaatatagcataaaagaacaatggcagagaattacttcatagactctttgatttgtccccaaagttaggctgcttttcatcctctggcagtagctggcataatgctagtcacacaggtggtgctcattaaggatttgctgcaagaacactacatttttaggtcagctgtgtgtttaggacctaggacgtttctattgaaaaggactggtgcaggttggaggtgggggtgaagaggaggagaaaggggaaaagggctaagaatgaagctcagtgaaggaccaagaaagcccccagtttctctatcataaagcaagaagcccatggatgaagcttatttccctgagaagtcagccttttctcagaaacttccttagggaccttcagaacaaaagcattttccccctctattacttaaatttagttaccttacattttagagttttcttaatattgaatcttgctttatattaattttacttcccaatttctaatattttaaatgtctcataggcaggctttgagcttttcatttaaaatttcattagcttttataataaactttttagatagcttcagatttacagaattattgcaaagacagtatagagagttcccatatacccccacacccagcttctctattactaatatcttagtatggtacatttgccacaattaataaaccaatactgaaatattattaaccaagttcatactttgcttagatttcctcagtttttccctaatatcatttttctggatccaggatcctaaccaggatcccacaccatatttagtcatcgtgtcccctgaggctcctcttaggtgggatactttctcaaattttccttgtttttgatgaccatgacatttctgaggagtactggggtcaggtttttgtagaatgcccctcaattaggatttgtctcatgttctcataacgggggttgtaagttttttggaggaagaccgcagctaaactgccattctcatcatacgatattaaaggcacatagtgtcaacatcattgttgatgctgaccttgatcacctggcttaagatagtgtttgtcaggttctccactgtaaagtcattctcccccaccctttccgtactttggaagaaattcgccacgcacagcccacaattaaggagtaaagagttatgctccaggctgagtagctacataaattatttggagttatgctgcagaagagatttgtctcccctctcccacatatttattaaatcattcatttgcatcactatgaacatggatatttgttttatacactgggttataatccagtactactttatttgcctgctatttatcagtttcagccactggagttctttccactgactctgtgtccctttgccatacccccatcattgtatccttggcttttgttttggagcactttcttgctttctggcatttgaagatgctccaggctcatcttgtatatttcctgcaccagtgctagaatcagccatttctcaaggaggcctggttccttttagtggagaatggtattaaaaaaacaagatattggccaggtgcagtggcacacacctgtactcctagcactttgggaggcaaaggtgggtggatcgcttgagctcaggaattcaaggccagcctaggcaacgtggtgagacaccatctctacaaaaaaatacaaaaaaattagctgggcatggtagcatgtgcctgcagtcccagctacttgggggctgaggctgaaggatcgcttaagcccagagggccaaggctgcggtgaactgagatcatgccactgcactcccgcctgggtgataaagtgagaccctgtctcaaaaaaacaaaaacaaaaaaccaagcttgggcactaggctcacttgttttttattctctattttcactcttatcattttaaaaactctattttttctgggattataaatctagtttccgtcttttataaatcatttctcttctcatttttttccacatagccctcattactttggaccttctcatttttaactttttctttacctattcttaaataagccatttattttattatctaattttaaaattttacttcaattcttatttttaactcttccataaccttaaccatattttatattacaaagattcattttcttggttctcttacccttttcttaaaaaacggtctctaagaaggagactgaatagtggagaaaagctaccttacagactggagaggataaagagaccccacccctatcacggggcttctgtacctgtctttctgttctaccagcaaattccccagtctagtcaatgatggttccctaaagcctctctccagaggagagtccagggtccattctctgcacaccttaagtgtaaacatgccatgacattagtgatcttctgaaagagcactgtctaacatttcctaccatccagtactttaagaaggaatgtcaaaaaagccaccgtctctagaatacttaaccagtggaaggacaacaaagcccattttttactggctacaagcagggctctgataggggaaggaacagtccaaggcaggtcacagacaggggaagctgtctctggggcggaatcaccaatattgaaccaatgcttatccacaagaagggcggaggagaaaacgggtagccaggctccaacagaagtttctaaaaacttattttggacatgttaaaaataagttattaaggagacttttcagacatacacaaaggtagagcagcatgcgcagccatcacccagcctcaacatccatctggacaatcctgccccagccatactgccaaccactccccctcccctctctaggatttgaagcaaattcaagatgtcatgatcaacaaatggttcagtacatatctttcaaagataaggactcttatcacacccaagaggatgaacaataaattgttaatattatcaaatatatagtcggtgttcaatttgttacattaaaaaaaactagaatccaaatgaagtccatacattgggagtcactgataaatcttctaagtctttcctaaagttccctccaatctccttttcttttttctttgcaacttatgaagaaactaagttgtttgcctatagctttctcatggtctagattttgctgactgcgtcccaaagaatcattttaacatgctcatctgtcctatatgtatattacataattctgtaaccgaatttggaggcgtgatcagattcaggttcaatttctgggggactgaggaacaaaactagatagatgatgctgtattctagacagtctctatttaagtgatatcagcagctattaatgtttaatgcaatatctgttcattattctttctccgcttgttagccaaaatacttctatgaagataagtttcctttcatccattaatttcatcttcagtggtctagtttgtaaaacaaacggaacaaaaacaaaggcagaagagcaactagttcttgaaataatgagttggttccctagcaatataatcaattaattttcatcctaggtttcattatgacttcacgggtctaaattgaaaaccaatcaactatcttccttttctcttacgatttaaaagttgctcatggaaatttgagaaatacagaaaaagtatataggagcttggcaacatagcaataccctatctctacaaaaaaaaatttaattaactgggcatggtggtgtgtgcctgtagtctcagctactcaggaggctgaggtgaaaggactgcttgagctcaagaggttgaggcttcagtgagccatgacagcaccactgtactctagcctgggtgacagagggtgaccctgactcaaaataaaaaaacaaacaaaggccgggcacggtagctcacgcctgtaatcccagcgctttgagaggccgaggcaggtggatcacctgaggttgcgagttcgagaccagcctgaccaacatggagaaaccccgtctctactaaaaatacaaaattagccgggtgtgatggcacatgctggtagtcccagctcctagggaagatgaggcaggagaatcacttgaacccagggtgggggcggaggttgtggtgagccgagatctccccattgcactccagccctgggcaacaagagtgaatctctcttaaaaaaaaaaaaaataaaaacgaccatcactcatcctgccacttgatgataaccaccatcaatcatatggaaattttccttctaggtcatacttgaattttacaaacttaagatcatattgcacatccaattttatattttacatttattctcttatcaatatatttgccctatgctttaaaatcagcttacttccagccttctcttttgaccaggatggctcatcacttctggcaaagtttgaagaagatccactcggcgggtagctccctcagttcctttgccttgcctcattatgagggctaacgagaagctggcttgaatggacattattcctaactgaataacttctctatgaggttcttcaagctatcaggtttcgtacttaacaagggaggtctgcctaagatgcgtagatcatgagcaatgtccccatcttttcagacttactctaagtcccactctagtacaggtgatctggcttaggcattctgcattctactctatcaccaggaactggttaggaatgttcttgttggtctgaatatggccataattaggacgtgccacacctcaaaggggaagtgaaagcctgggagctcgtaagagtccccagcaagaccaatgagtaatatctttatacatgcaaatacaaacgtgtacacatacacatttacagtaatacattgcttaatgatggagatgcattctgaaaaatgcatttttaggcaattttgtcattatgcaaacatcatagagtgtatttacacaaacctaaatggtatagcctactacacacctagtctatatagtatagccactgttgtaaatgtggtccataatgacgtggaatcatcattatgtggcacatgactgtttatttattaacagatggggtctcgctacattacccaggctggacttgaactcctgggttcaagcgatcctcctgcctcagcctcccaggtagctgggactacagtcatgcaccatcatgctgctattcattatttttattgattgatttataaagtgatgtctaaatttggggccacaacctacctttacaggactaaacctccaggtatgttttgtagtatagattttgaagcattcttaaattgcacctatccccaccacttgcttttgtgtgactttatgcatttacctacatcctttatccctgcaaacagctgagtttttgagttttaaagtcagtttgacatagttggggttcatcaaagctcagtttggggctcttttcttcgcttctcttcattctttccctcggtagtgacacccattcctccgagtttaaattaaagcatattgcatgcattaactcatttactccttacaagaatcctatgagctggatactattatctccatcatttaagaatgaggaactgagagactgagtaacttgtccaaggccacacggtgtggataaaagcccaaatttgaatcaggccatctggcagcagggatcctactcttagccaatctatcctaatacctatgcaatatgtatgaaaacatgatctcacttgtatggtctcttaaactttactggttctgtgagcccccacagtagagctacccatttgtggagacaggactggtgtgatagaacactgacagagtccataagaaagcaagagaactgtttccctgtagtatttcagagacagatgaattaatgttaaatgtcttacccacatcacttgtttcattcacattcactaagaactgtgtacttaaaatagaaaatacctcattacttacctttgatatctctatggacaatcatattactgtgcaaataatggacaccctccagaatctgacgggtgtatttcctagtcacattctcagtaagagcgccatatgcttttaattggtccttaattgaaccctaggagaaaagaaaacaaaaataaaaactactgtatatggtttgaaatgaaaactgctattaaatctttatcagtaaagagggcaggaattctcatctcactcgtctaagcatgtcctacttgaattttacttattttgttcttattctgtttttaaagtattttattgacatctgctgattttctcagaaaaaggaatgggtgtaactagaaagaacacagagattttaaagtttttttctttatatactcaacactcaagttcgaaacatgagaacatacacaaaaggagaatagattttcttaagtgttttttagggcaggataaggtgccatctctgagaaagctgaatcagtctgaagtgaggaataggtatttgaattttgaaaacttccctagtgattccaatgtataagtttgattaataatccctttaaaagacagaaataaaatgcttcctgagggacaaatctcttttttgacaggaaaatacatccaaatgtttctgcttttccttgaattttggtaaacggtgtactctgtcatatgaaagtaaatccttggattttacagatttaaccatttgtcctttccactgtttatgagccatccttggagggagagcattttgcaattctgtggacccaaatttgcaaacacacatatggaaagcggcaagtgtggccagtcaactactcacacctacagttcagcacggcttgtttgttcagtctactgtgtctctacttgtagtattatacagaataggccaggcacagtggctcacacctgtaatcccagcactttgggaggctgagtgaggaaggcagatcacctgaggtcaggagttcaagaccagcctggccaacagggtgaaaccccatctctactaaaaatacaagaattagccaggcatcggctgggcgtggtggctcacgcttgtaataccatcactttgggaggctgaggcgggcagatcacctgaggtcaggagttcgagaccagcctagccaaccccgtctctactaaaaatataaaaaattagctgggcatggtggcaggtgcctgtaacctagctactcaggaggctgaggcaggagaattgatttaattcaggaggtggaagttgcagtgagccgagatcgcaccactgcactccagtctaggcaacaaaacaagactccttctcaaaaaataaaaattgtagccaggagcaatggctcatgcctgcaatcccacgacattgggaggtcgaggcaggcgggatcacctgaggtcaggagtttgagaccagcctggccaacatggtgaaacctcgtctctactaaaaatacaagaattagctgggtgtggtggcatgcacctgtaatcccagctacacgggaggctgaggcaggagaattgcttgaacccaggagacggaggttgcagtgagctgagatcgtgccattgctcagcctgggcaacaagagcgaaactccatctcaaaattaaacaaataaaaattatggaaatgcatgtatttttaaataagtaaacatattaatcaccaccttgaaaatcattaatactagatgtactctatataatgacagatgtcacaaatcacattttataactcctaatgaaattatagactctagtgatgactatcaatcagtgctaaaaacattaggtggatggctgaaaaggaacaggctattcctatgtgccactgctatacctcatattactttctggtgtgcaggaaaaaacaaaactttacaatgcaggactcaatatgtcaatcatcctcatctaatggtagctctttgcattgctacagtggaataaccagaaattggctcctgataggatgcaacataaagtacacagcttcatctatgacgtatcagataaaaaaggctgaatgtgaatctaatttagacctcagatctaacttggagtttatagtaaaaaagggataaagaaacaaattaaaatccgcatgctcatttcggcagcacatatactaaaattagaacgatacagagaagattagcacggcccctgtgcaaggatgacacgcaaatttgtaaagcattccatataactaaaattataaaaaatttaaaacaaaaaaacaaaatccacaagaatgctactagagaaatccatgagaatttttttttttttttttcaaattcttccagatcctgagagtgaagactcttaacaggctatcctcttctctttgtcaaatctatatcatgtacaaattgactgctctagatagtaatcctagcactttgggaggctaaggcagaagaatcacttgggctcaggagtttgaaaccagcctaggtaacagagtgagaccttgtctctacttctttttaagaattataaaaaattgtttaagaagagagagataattaaggggcataacaattaaatgtatgtatagactggaacttggtgtgaatatatcagctataaagggcattttagggcatttaaggaaatctgaagatgggctgctaagatgtctgtaacctacttgagaatacttttatcattaatgagttaaaaaatacaaagacagaggaagaggatagaaaatactactcagctctaatttaaaactcttccaaaatgtccttaactagggttaacattttataatctacgtttttgttgtttttcttttattaactaaaattttaaatagaatgtgtattttcaaaaagatgtactaacttacccctggcatatattccataaatatggaaagtgttttttcctggggatccctcaaacagccataatactgaacaattcgctcatgtagcaagtttttcagcaactgaatttcacactcaagtgcatttacttcctgaaagagagaattcattgttaagtcttcaacaatgtcagtaaaagcaaaaaattctaacttcatggaccatcaaggtgatttcattctgaaaattttagttcccaagtaataaacatctgaaagtctctaaccaataactttttaaacagtccttgatgatatgctaaagcaacactgactcagattaggattataactgaagtactaaaaaagaaaaatccatattaaaaaatagacaaacatatctaatctgttttacaaataatttatactaaagaaaactgcttttttttttttttgaaaaaaaatgcttcttatttagaatggaaggggcttaatgttaaaaaataataatgaataaagtttcttataatgtgacaaagtaatttgtgcagtgatttttaccttgctggtctcaggactatcggggtcaaattgaacttgcttaacagccaattctcttcctgtatcaacatcataacagaggtagacccttccaaaggctccttggccaagcagtttgcccaatctccagttggtcggagctcgaggtgctgaaaaagaacactttcttaaagtgaaatatcaaacagcacacaaataaatggttaataactaaatgagcatactgcattagtgacatccttcattgaatgtacttggatataaggaaaaattatgattatccaaattcacagttaccgtctttcaaatttttctctttcgtcaattttctacaaatcctaaatcaaaaagagattcatatcccaagactcatttttttctgaaattgttttcctaattacacatgtgacagcatctttctttcactcaatctaacattccaaagactgtaagatgcaccatttctattcttcactgcagtaatatttgtacttagtttttcagcctccacctacaatgtagaaagctggaaagagtatcattcccatccaaacaacaagagaaatctgggtaatctacaaaatttaacttttgttgaacacatatcaaaaaactaagattgcagggcaaccaactaacctgaaatctaaggaaaaagtggtacctccaaggagagacagaacagaagcactggctcacttgtggcaaagcacagacaaagacccacacaagcaaggaagaattcacctccattttaaacaaatgtgggctggcatgagagtattgaacccttgggagatctagacacaggtgagctcacacctgctctaagtcttttctgtggacctctaccatgcactcataggagcaggagacaccagggaaagcctcccttggtggtcaaggcctggaaaaggggaatggcccactgttgtgggaaacgcagaaagtccttccaaacccttttcccctaagaaacgagagccttcagccgctggagaaagcagcaaaccctgtcacccctgcattacagttaaagacccactgaggctaggggaatgcaaaagaaaaaaaaaaaaaaaaaaaccctacccctgagagagaggctgaggctggaaaccttctgtgaccctgatcattagagcactcctactcccggaaggtgggcaagcccatctctgagaactgaggagataaagcctgcctaagactgaagctggataggacaacacagaaccctctagtctgcctcccctctcctaggctggcaagtaacagcaatccacttactgagagcatgacaaggccatggagagatcctccctctctgagaagtaggcacaaaagaaaggccaaggctgggcgcagtggctcacctgtaatcccagcactttgggaggccgaggcggacagatcacctgaggtcaggagttcaagaccagcctggccaatgtggtgaaaccccatctctactaaaaatacaaaaaaaaaaaaaaaaaaaaaaaaaaaagaaaaagaaaaatagccaggtgtggtggcagatgcccgcaatcccagctactcgggaggctgatgcgggagaatcgcttgaacccgggaaggggaggttgcggtgagctgagatcgcgccactgcactccaacctgggcaacaagagtgaaactccatctcaaattaaaaaaaaaaaaaaaagctgatggagcaggaccattgagaaaatccctttaggaaaccagcacaaggtaattagaagaatttaaagtcagtggtgcacagagaccatgacaacaacaaaatccaaacccagctcaactcctaactagactgattgacttagctcctcacagtaacggcctagcagaagaagagctgtgcctatttccaggcatacattctatttacctcctcccttatcctatacatgatatctggcattcaatgtaaaatgataagacacaaaaaagcaacccttccaaaaaaaatcaaaagagaaagcaattaatacaaccagactcaggaggttcagaagggaaatttaaaataactatgactaacatgttaaaggttctaatggaaaaggtagacaacatgcatgaacagatggtgaacagagcgatggaaactacaggaatgagtcacatgaaaatgcatgaaatgaaaaacaatgacagaagttaagaattccttcaacaggatcataaatagatgcaacaaggctgaggaaagaatcagtgaacctgaaaatagatcaatggtgggggagagagggagacagggagaaagggagagggagggagagagagagacaacagaggtatgagacagtatcaaatagtctagtgtataggtaataggaatcccaaaagaaaaaggaagaatgagacagaaaaaatacttggagaggtaacaactgagaacttttcacagacaaactataaatataataaactgaaagaacaccagctgggaaccctacacaaatatacctagacacgtcatattcacactgtagaaaatcaaagacaaaatcttgaaagcagctggggcagctgtgggggaagaaagcatattacatatggaggaacaaagataagaattatagcagatttctcttcaggaagtatataagccagaagacaatgggacaatagctttaaagtgctagaaaggccaggtgcagtggctcacacctgtaatcccagcactttgggaggttgaggcaggtgaatcagcttaagcccaagagttcaagaccagcctgggcaacacagcaaaacccactctctacaaaaaatacaaaaattatctgggcatggtggtgcatgcctgtagtgccagatacttgggagtttgaagtgggaggattgcttgagcccagaaggcagaggttgcaatgagttgagattgcaccacagcctgagtgacagagtgagatcctgtttcaaaaatgaaggagaaatagacttttttcaaacaaacaaaagcagaatgaactcagtaccagcatgcctatattacaagaaaggttaaaatgcagtttttcaggcagaaggaatttgatacccaatagatcttggatctgtctttgtttatacagattttggatatatacaaagatctataaaaatgaatagactgaagatatatataaaagacatttttctcttatttttaatcacttcaaaagatagctgtctaaagcaaaaataacagcaatatagcatggggtcaatatggatataaaagtaaactatgacacactagcacacaaaaaggaattcagagtatgcaaatagtgctgcaataaacatctttgaacatgaatctttgtatgcactgcttacacagtaaggtctgaatgctttgcaatccagcctgagttaccactgtaggcctattcccactatttcaagtaagatactcccacatcagccaaaaattgaactattccccatttttagatgatgttatggcctcttgcacattatctcctcagctggtgatttctactcacatttaaatgctatacaataattatttctccatgtatcatctatcccattagattatgtcttggagattatgtttgaaatctcagtggtaggcattcaacaaggatatgtggaatgcatggataaagaatgactagttggtaataattttcctaatacaagtgaagaacagaattatctaaagtaattagcagtgataccatgcttatacctgacattccaaccacctttagaaacaccattattaccttttttgagtagttcatctgaccccaaaaactcacttagtatttattccttttaataatataaaattctgcaaagattctgctctacatttcactataccaagttctattacttacaacggctgggtgggctgatgtccattacggtcaaagtaggattgtctatgtcacttccccttcttcttattcgactatcatcatactctggggtaaagatactgcttccactactagtgcttaaggaatgatcagtaggactgaaactcacaggagaccgtaagctggtcccctgggtccttctagctcttggaaaagttttacgacctaaaaaatgaaaagagaatgaccttataccttttattaatatgttatacttttaaagtatttaaaatttgtaatgtagagaatagaaatttgtcctgtgactaggctaagaaactcaaataggaatgattgggtgggaaaaaataaacaggatctgaatacaaattcaaataatctcttatgataaaacatgtatgagtgtgcacacagaaacatacacacacacatcttaaaaaggaacctcctcacttctggataaaaaggaggaaaaaaatttactctcatttccaataatgattttaaaatctaaaacaaagatgcagaagttcacaggtagtaatttttttcttttctttttgagatggagtttcactcttgttgcccaggctggagtgcagtggtacaatctcggctcactgcaacctccgcctccagggttcaagcgattctcctgtctcagcctcccaagtagctgggattacaggcgcccaccaccatgcccagctaattttttgtatttttagtagagacggggtttcatcacgttggccaggctggtctcatactcctgacctcaggtgatccacccgcctcggcctcccaaagtgctgggattacaggcatgagccaccgcacctggccagtaattttttttcttaaagggatgatgtaagtatcaatctcatcatcaaagagtaattttctaatatcatttaaaagttactccttttggatgggtgcagtggctcatgcctgtaatcccagcactttgggaggccaaggcaggcagatcacttgagcccaggagttcgagaccagcctgggcaacatggcaaaaccccatctctactaaaaatacaaaaattaggccgggcacggtggctcacgcctgtaatcctagcactttgggaggccaaggcaagtggatcactggagatcaggagttttgagaccagcctggccaacatggcaaaaccccatctctactaaaaatacaaaaattagccaggtgagaatcgcttgaacccaggaggtggagggtgcagtgagcagagatcatgccactgcactccagcctgggtgacagaacagagtgagactctgtctcaggggaaaaaaaaaaaagaaagaaagaaaattactccttcttggccaagtgcagtggctcacacctgtaatcccagcactttgggaggctgaggcaggaggaccgcttgagcccaagacttcaagaccagcctgggcaacatggtgggacactgtctctacaaaaaaaattttttaattagctgggtgtgatggcaaatgcctgtaatggcacacacctgaactcaggaagccaaggcaggaagatcacttgagcccaggaatttaaagttacagtgagctaagatcatgccacagcactcccgcctgggcaacaaaaccttgtctcttaaaacaaaaaattattcattttcttttaagggataaccaagtcttataagttgtcataaagccaaaatgcccattatacttttgttataacacaattcctcatatttttctaatggtattaacacaaatatgaggttttaaaaaatttttgtatttatttttgttgttgagattttttaactattcttgtggtctaattgctagaaacttaccatcattatactcttgatgatgatatgaaacatgataccttcttggatatgttcctccttttccaaatttctcaaagatagggttatcatagtctgttaagacatataagatggttatcttttatttaaaaaaaaaagttaaatatttctaatgatgaaaagcacatttataaatctttatttgacttttcaaaaatcccccctctccctcccagccaaaacattatccaatgacataaacatttaaacatttagaatttataaagtctaacctgaaaattcctgatgattatctgggtagctctgagccctaggcattcgtgattttggatagctctctctataaagaaaaaacatcacattaagtttacagaaagaacgtaagacattaaaaagaaaatctttgagcaatatctatatctatctgtgcctctctgtatgtgtttgtgtaaaggagctcactttgaaaggttagcatacctaaaaaagaaaaactacacttacttggtacatgtaggcaaagagcatgacttaaaattaaccttacagtacagtggaagaatgacgtattttggaatcattaggtgtttctaagcactgtgtttcaatccaagctctgccacttaactatgtaaccttggcaaatcacccttctgcatcaacaaaaaagataatttccaactattcaagtgtacataagtaaggtatccaggatagtgttttgcaaatggtaagtactcaaatatatagctttctcgttactacttccctgaatttcttaaatgtctaccttaagatagacattgacacagacagaaatttcatatacatggataaaagaaacttaaatgtgcattcccacgcaatattagttatttttttcagaatttgctttcataaagcaattccagagaggattaccaagaatactgtcctattgagaccaggagggggagcacgtgtaacaaaaaattcacattttgcaactttatcctgctcatattcctgaacagctttttcacaaaagtacttaaatttttgcctacatgtaccaatgtgacacagtgggctacaatttccaagaatttaaattatttctaatctggtgccagaatgaacataatcctgaacaggtgaaataactcaggaaatttccaaaaccaaacatattaatgtaaaagttgatagcacttttcataaacacagttttaaaagtaaatgtacataaattctaaatttgatttgccttcaaacacacaattttgacaagcaggaatactcaaactattataatcagatttccttttaactaacaaagatactgagtcccatgaggtaaagggatttatccacactgtgcaaaaattcatctgccgtcatcatacacaagtaccaattctattcctctgaatgtagcacaaaaaagttactgataattcaacattctatctgtatgaatatttactcatatctattaaaaaagaaaactacagtaagctgagcatggtggctcatgtgtgtaatcccagcgctttaggagaccaaggcaggaggttcgcttgagcccaggagttcaagatcagcctgggtaacaaagtgagacccccatctctacaaataatacaaacaaaatagccagatgtggtattaatagcaaatgcctttggtcctagttcctcgggggtcagaggtgggaggactgatggagccaaggaggtcaaggctgcagtaagccgcattcacgccactgcgctccagcctgggtgacagcaaaactctgtctcaaataaacaaataaaccctccaaaaactacgataaacattacccatccaaaggactatcaagtgatggacaacttcctgagccagaattttcagggctgcttaaagataatggatccagcatctaggaaaaaaaggagttccaccatgattcaatttgatataaccaaaagttgcttattaaaaaaacctgccttaattagacatacttcatgtaacataaaattcacccatttaaagtatacaagtcaaggcttttagaatactgagagttgtgcaaccctcactcacaattttagaacaattccatactcaatagtggtcactctccagagttactcattttcaaatgtcccttgtaagcaagccacgacttcaaaatttcctaagagaaaaatattctttctctatagactattgactaaataattaaaagctacaatatttcacactattttgcttactgaaaactgaacaatggccccacccaaactgagactaatgacactatgactattacattattagaaaatgtaaactactataatagtgtgaacatataatgcgatgcaatgcaatgttaagggaataacagcaactccatgaaaacattttaatactataaaattgaagtattttttaaatgtttcagaaagttcacaaacctcagtttcacaaaggtaaatatttgtagtttcattctatctttcaaatgtttaaaaaaaaaatctggctgttaaattacaaagcaaatgcattatcattcactcactctcattcattcacttattgagcaatataaaaccagctgtattccagctttctttatacaggcacatgtaaattaatgggcattttcctatattttttctattttgttcagttaagaagatatgtaattagagaagagataatacacacacacacccagttacgtgccaaatcacactgaccctgacaacatctctttaaattaaatttaaaaaatcaaacttttgcttacttggtccatgctctctggaatgaactctccttcactgttgatactagtgaatgacccattccgggcaacctggtgtaattcatctggaatgtaacctgggggaggagaacttctatctctactagtaggacctcaaggaagaaaaataatgtaatttataattataggcaagggaatcaagttttgttttaaataggctatatttctgaattatatcattaataatttcagcaaaagaaaattcaatttttattaaaacttatcagaacattcatttgtaaatcttcaaatggctttataacctttgtaaattcccaccctatcataattattaacctcaccataatattcatttatactcactaggtaggatggtattctgactgctgataggatgataatacaatatagatttctggcattaagacagtttatttaagtaatcacatttcttatgagacaataacccactctattttacttggttctgtggaaatgatgctatatttattagtacagtgtctcacctttcctcatagttttttgaaattaaactatgtgagcatttaagttctggtccaatttaaagcaaaaaacattttagccttatgtaaaggagtcattgtgagtatatgcaagcatttgttagtgagacagggaggaaaaagaaagcaaaattattaccaagacatgtgcataaaagagagtactgtctacacttgtctgtaaaatgattaggagctcaatttgagtcaggattgatttaggcttcataacaactgtagccacaataatactggtccctaatatttttattccttccatatacccgtgcttacaaaagatcaatatagtcaattactaaaaggagataggaccaaaaaaaaaaaaaagctatgaaaattttgtctccttatttgacaaccctttttcacagtaatgcgtatgccaacgcactcttggttgagacctgtttatcagcatacactcctaacctaaaggagtttttcctccatctcccttttataaaaacaattaaaaagaataactgccaacatataagaaaaatagataatggtcatatctagcaaagccattccaagtttaaagcagtgccaataaaagaccactaattctatactttatgatttccaatttcttcttatgctggcactgacgtcaaacaagaatatttattagaataagactgaggtattcagtgtaattttaattcaaaatatatttaaaatgtcaatttaactagtacatttagcttgttttgtctaatgcaactaaagtgaattagagctgggcactgtggctcacgcctgtaatcccagcactctgggaggccaaggtgggtggatcacatgaggtcaggagttcgagaccaatctggctaacaggctgaaaccccatctctactaaaaatataaaaattagccaggcatggtggcgggcgcctgtaatctcagttattcaggaggctgaggcaggagaatcacttgaacccaggaggcagcggttacagttagctgagaccgcgccactgtactccagcctgggtgacggagtgagactctgtctcaaaaaataaataaaataaagtgaattagcaattttttaaaaaatgacaagtaccgtaatgtgataagaaatggggataaagaaagaaatgtacaatgaacatctgagctttgtacaatgtacaaaatgtataaatgtacaataagctttctagtttgaaaagtaaaatgtacaagtgttctctcaatttaatgctacaacaatcccatgatttaaagatgaagacacatttactggtctcaggttcatcagagagctggaatttgaatttgggtgtttcaaatgttctttcaccaaattttaaaactatatcgaaatatatctgaatgcaaaagacaagccatttgtattttgcttgtgtatcacctctgctgctcgcatttctgcattcctgaaacccaaagtaggacttatttaagacagacacttcgaagagaatggtcataaaatagcttcttctggggaccaaaagagaacatgaataatgtctatttttttgatggtccacatgccaattcaattttttctttgattatcaacaatcctcttctgttaccaatcttttttagattcccaaccacatttgtttttcctcctctttaacttttctcttttaaatccgcccctcatacatgttttcatgccatctttaatggccatactcactgccctctctcaaagaacatttataccagcggttttttgaaacaatgttaatgcttttatcaaataaaaatgtagattatcaatgttttatacaaattgaagaacagacagaatggggagttgagagtacctgtgtcaaactcatgttgcacgaataaagcctccttaaactacagcatgcaagatctttatttctttatatcataatcttaattataacaataaattaatggcaaatgaaaatgaatactaataaagtaataataaagcataatataaaaattcttagtatctttattttgagagcattcttggcaatcactaaaaccctagagaaaggcttgtgaatttacactctattaattttaatacattataattacttcttttaatttttttcctccattctatttgtacaattaaaacctttttttttgagatggagtcttgctttgtcgccaggctggagtgcagtggcacaatctcggctcactgcaacctccgcctcccgggttcaagcaatcctcttgcctcagcctcctgagtagctgggactacaggcatgcaccaccacgcccagctaatttttgtaattttagtagagatggggtttcaccatgttggctaggatggtctcgatctcttgaccttgtgatctgcccgccttggcctcccaaagtgctgggattacaggcatgagctaccgcgcccagcctaaaacctctttaaagttttatttgaatttgttaacattaaaataccctgagtatataaataaagaatttaaattggagattactaatcctgtaaacttgaatttccaagggacgtcaaatattagagtgtatttaaattaaattataggaagtagagaaataaaatattatttatcaggaatatgtttaggtgccacactacattaaaggatggagaagaaattgagaaatcattcatttcataattcagacactagtttcttacctattatagatagccgttttttcctctctgctccaaatactgtattatccaaatcttctagtgatggcaatggttctaaattagtagcctacaaaggagaaaagacagttaatgctattcttcctccttggggctttaaacagaatcctctcccctaccaagtacaaaacattttatattgtttgtgagccttaatcaaatcctctactctttgaaattttaattctaacataattctaagttgtcagtttctattagcttcgtatgtacaacatattatacttatttataactatgactgtggtttttgaggagtaaggatattaaagtatagtaattaaaggatgtaagtttacatttaatcataatgaaaatattgcaatgattatagaatataattatgtttcatatgttaacttttacaagcctaagtcctataattcttactgaaaaaaatatcccaaatcatacctgtgtacttccatttattacaagtaatatcttgaggctcttcatatgaatactacgatccagcagttccacagctttgtccaagtcatcttgagtagttaatggaattaccaactaaaaacaaacataaggaaccatgcagctatctcaccaggtcaagttcttccatgagcatctccactactaaggaattacaaatgtcaaaataccttgctctttgatttgttactatgatgaaagtctgaatgtgtatgtgtatattgttttgccctcctcattctaccgccactaaaatcttagaatgaacatgtatgtttttaaatttttctttattaatcattacattcttctagaaaataacatttaaagattaattttctaggatatttccataatattgctaaatttaagttatagtatgttcgcccctaaaaagaatgaagaagtacagacaaagaccatatgaaataaaggtactacttttcttctgtatagatgaaactcagttcttttttcaatagtaaccacaaatttgcactctcagctggtgtgctcttcaacataccaacatcctgagcacctgccatggaggacagctgccatggaggggtaccactagtaacatatctgcaatctacagcccacctagagttcttctctctgagcctagtgacctgaccactataccctaaaacaaataagctaatgagttaactattccatagtaaaccctgcatgtggaatctgctttcactagtcttctcatgcagcagatgttatagaggacaaaagcacctaagaggtctatgagaaaaagtgtaattcatacaatttaagaaataaaaatatgtcctttttttaaaaaaaaagtcaatttagtaacttaagaagactctgtcaataacttcaaagtatattccatttcattgaaggaggaacagaataaaaacaagtgaacatattctgcactagttaacctgctctactcagcacaatatatgagccattaaaatgcaaggctgaattaatttggggtctctacagtataaattctttgaagacaaggaccccctacaccagcaatgagcaaagagcagacaacctggtaaatgctgtctaataaatctcacagtgttaaaagctcaatctgaacccaaacccactagctggcatggtgtatgttcattctgcagacttctttgtgaaaaaagtccttggggtttttgattttttgttttgaaatggagtctcactgtcattcaggctggagtacagtggcaatctcagctcactgcaatctgcctcctggtttcaagtgattctcctgcctcagcctccccagtagctgggtttacaggcatgcaccaccacgcgtggctaatttttgtatttttagcagagacagggtttcaacatgttgaccaggctggtctcaaactcctgacctcaaattatctgcccgcctgggccttccaaagtgctgggattacaggcgtgagccaccatgcccagccaaaaaagtccttgttataagaaaggctgccaaacacgaatataaagaaggatttatgtgaattccatcagacaatctgcttgcatttacttactctgttgttaaaatatattcccaatttctgtttgtagctaattttgtattactgtaagggaccgactaactgggctcttttcgctctatgagaatttttttctaataaaatacaattattaactgtttggtatcatagaacaagcctgatctactgatctacttaaacacatttctatttcccaccaattatgaaacatattggtatatcttgcttctatcttcaatagtctattacttttcaagcactggaaaacattttaaagcaatggtaatgactgttccgccgatttttcatttgaggggaaaatctgaatacttacttttattattcatttataactggattgtttacttctccaagatactgctacttttgggggaaaacaacactaagtcaaatgacagaaaaaaatatgaacataaatgattctgctgctcttcagtttgctgctgtaaaatgtgaacatcctggaggggtgcctggtgcagcagcttaggcacttgcctacagacctaatgtgatcctgcctgtgttctaaggttacctattacaaaccgtaaaatgaggactaagagtcatgaacaagtcccaggttatctacattacactaaataaatcagataatgttttctggcttggtgaattcatttcagtctcattcatgaaatctatcaccctctggcttatttttgataaatcagttgtttgttgatataaatgctttctagaaaggaaacttaaaattgagttcgagaaccattaaacagaactgaaatctgaaagaactgaattatcttcctgaatttacatagtgaagtatgaagacagccattaaaaggttctccaggctggacgcagtggctcacacctgtaatctcagcactttgggaggctgaggtatgcgggtcgcttgagccctggagtttgagaccagcctgggcaacatggtgaaaccacatctctagaaaaaatacaaaaattaacaaggtatggtagtgcatgcctgtagtcccagctacttagaaggctgagtggggagaggattgattgagccagggaggtcaaggctccagtaagccatgactgtgcctctgtactacagcctgggtgacagcgggagatgctgtctcaaaaaaaaaaaaaaaaaattcctgctctactcatctaaaatggaagtgatcttagaaaatccttacttggcttgaacacctccacatccaacccccatgacacacacacacatgcaccctgaacacctccacaaccaaccctcataacacacacacacacacacacacacacaccccttattaaagagaagccaaactaacaaatccaaacaacctcagcttatatttccagcttaaatttccttaacgtttcaattctagccaactagaagtttatagagtaacagttcattttgaacagaggaattaatattacactagaaaaatatttatagaagtggaataacatgcagtataaatgaattttttgcctgaccacatgtccacaaaactagtaagactttctttagtacccccagtgtccaagatcatgcatttggtttgggacaatatgtcaagatatgaaacaggatacggttcactcacagaatctcagggttgcaagaaatcttaaatgtaatcttatcctaatgccacccctaccacattcctgccaagaggccaccaaaatataatggtagaaccactcacagaaatccttcagaaagcatgagaaaaataaactaaaatggagcagttttccaatttttagaaaatgggaaaaggttcttaaaaatacagatcaggccaggcgcggtggctcatacctgtaatcccagcactttgggaggccaaggcaggtggatcatctgagctcaggagtttgagaccagtctgggcaacatggtgaaaccccgcctctaccaaaaatacaaaaattatccgggagcagtggtgcctgcctgtggtcccagctactcaggaggctgacgtgggaagatcgcttgagtcctgggaggcaaaggttgcagtgaggtgagatcgggccactgcattccaacctgggtgacagagtgaaacctcgtctcacacaaaaaacaaaaacaaaaaccagttagcttgatgtcaatcctcaagaaaaccccagaaaaaaattacatagcaaactgggagaagtcactaaaaaaaaaaccagcaattcttaggaggtgacataggtataatatggacaaatcatgtcatgctaacctcatttttcttgatagacctactaggctgtagataaagacaatattgtagtcttaatgtatcttggcatttgaaagttttccataatacaattttagaaaaaagaaaaaaagatatgtctaggctcccctataatcatcctatgagataataattcaagttcaagacattttttaaaaatttattcttttttgttcagacagctctgtcacacaggctggagtgcagtggttcaactgtagctcactgtaccctcaaattcctgggctcaagctatcctcccaccttaaatccccctgcctcagcctcccgaatagctgggactacaggtgtatgccatcacactcagataattttacttttttgtagagatggagtctggctatgttgcctaggctagtcttgaactcccggcctcaggtgatcctcctgccttggcctcccccgatgtgctgggattataggcatgagccactgtgctctgcccgttattcttcaacacaatactttatgcatttttttttttttttgagacggagtctcgctctgtcaccaggctggagtgtagtgacgcggtatcagctcattgcaacctctgcctcccgggttcaagcgattctcctacctcagcctcccaggtagctggaactacaggtgcacgtcaccacgctcagctaatttttgtatttttagtagagatggggttttaccacttggccagaatggtcttgttctcttgaccttgtgatctgcccacctctgcctcccaaagtactgggattacaagcgtgagcaaccatgtctggcctactttatgcatttctttcaaagaacttcgtatattcaaacaactcatttattaatggtttgcttgtaccacaagtctataaggtctatactccatgaggtgctgcaacttataacttatagcattatgcctgaaaaattaataaatactttctgaatataaaaaacaaattcacctaattactaacccaattattaactaaattgtcctataaattttaagatcacaagatcctgatatctcatagaatctcaagaactaaaagaaacttcagagatcactgaatccaatcctaagtttacagaacattaaaaaggggtttctccacaacgcagagctcctcactgctagagcaagcccttcagatcatacatactgattcccaaacataataagctaattgagccctaaccaacactaaaataatcctttaactcaattgtttaactaccaaagctctgtcatctgtagccaagtgtagagtatgagaggaaaagacagttcaccaataaagtacacagaataaaaacaaaaccataaataagcagcaaaattccaagtaatacatatattttcccctataatacaccctcattcaattatttgcatagtagcaccctctattattttccacaatgaaataaatccattttagtcagttaaaatttacttgttttatccttctgacataccatatatttatcaatccctaaataaaaacacgagtcttaaaagcagtctcttaaacgaacacattacttttgaaggtaagatctactaaagttaaactgtacatgtttacctcgttattggtataatgtagatccatagactgtccaaaggcaattttagctttagatctcagatcttccagtttaactggtctggggaactgaaggattctatataaacacaattttaagattttattttcttaggcaaagttaaataataaacttgcaaaagttacctccttttagagtgatacaagattaactaaaaattacgtaaatattcactttacttaacactacaacagcacattttttaacacaggcacacattttcaacacaaagttcaaaaactctgaagtctgttttatcctaatacaaattttaaaaaggaaattctcaaaattttctgcagtttttaatttgcactgaaactaccatatgaatgttaaagagcaatgcaaaatgtttattcaggaaactgattaaacttaactatgtgacatctgtatgacagaatgaaatgaaactgttaaaaagaataaagttgttctccagggattcaaattttgatttctgtatccttatcaactcaacatttttgggtacatatatcatgtaggcatacttccaaaataaatatttttacaagattaaaattctagtgttttctttctacttcccaaagactggcctgtgctgcccctagagagcatgcacctaaagcttgaagaccaccaataccacactataagccccataaggaaaaagactgtgtctgctttgctccctttattccttcagggcctagcatatactaagtactcaacaaataatgctgaatgaatgaaaaaattgggaaaatatccaaaaaagaatcttaaataggaaaatagattggatagttccatggtttatctgatatattccagttttaaatatttctatgtagaatatgcttatatgatttgtgagccactttaaaatccttaaaactgttaggcttttcactacattaatttcatgagacactaatagcagaaatgaaattctatcatcaggctgggagcgtgggtcacgcctgtaatcccagcactttgggaggccggggcgggtggatcatctgaggtcaggagttcgagaccagcctggccaacatggtgaaaccctatctcgactaaaaaatacgaaaattagccaggcatggtggctgttgcctgcaatcccagctactcaggaggctgaggcaggagaattgcttgaacccgggaggtggaggttgcagtgagccaaaatcacgccattgcactccagcctgggcgacagagtaagactccatctcaaaaaaaaaaaattctatcggccttaattcctattaggtcttgttagcaattttgttgtcaactaccaccctatcatttgtgcactgagatacagataccaagtagaagactaggtttacatctctgctaaataatttgcagccactagtccaattcactttcctcaacattactaatgacgtaaatgtcataaaactgaggtctcttgagaataatcagaattgtaaatgttaagctcacatatataaatgctatatagtatctggagggatgaaacaattataaggaaaaatatatttaatttcccccaagtaaaaatgaaaggaagtgaaaatatgtaaaggctgtattaaacagtgatcttatttatctctgaaaattgcaaagacattaatcatttctaatatttaacctgaattttgacatattttatctatcttaagtctaagcacattacacattcccaaggactactctattctcaatttgtaaaccatgaaacttcattcaaatctgaaaagaacctttcaaaagcttaattagaatacacatttgattaaatcaattaattaacatgtaatgtttccttccttaccttttttctcctctatgttcaaatttgactcggacatcattctgtaatgaaatgacaaatcagtctttcagagattagacagatcattcagagattagataaaatttctacaatttctaaatgattttgttttttagccattcatttaaaatagaccagacgaggagggaattttgaagttctgtaccagctccaaacaattgatagtgtctgctaaaaagttgagaattatgttgctgaatctgggctcaacaggaaagaacaccaagatctattagtgaaggtaccaggagtatgagacatttgctgatcctgttatgggaaatacagaatattatatttttatgtgtcatgctgagtatccaaaactaatttcatttatcagaatcaaaaacatcctcatttctaaaaatccagagtagactatttgaagaacaaaacaaaacacaatttgcttaagtgcttgaaaaatggatgaaatgtcagctttggagaacagttaccacattaaatgaaatgctaccttattttttctgggaaggggtcaacgttggctgcagaatgctacaattctttatgaacacaaacttaaaaaaaatttttttaacttttaagttcaggggtacatgagcagttttcttatacaggtaaactcacgtcacggggagttgcttgtagattatttagtcactcaggtatcaggcctagtacccattagttatttttcctgatcctctccctcctcctgccctccaccctctcgcaggccccagtgtctattgctcccctctatgtctccatgtgttctcattatttaccctccacttataactgagaacatgtggtatttggttttctgttcctgcattagtttgctaaggataatggtctccagttccatccatgttcctgaaaggacatgattttgttatttattatggctgcacagaattccatggtgtatatgtaccacattttctttatccagtctaccactgatggacactgaagttgattccacgtctttgctactgttaatagatgaacacacactcttacacgaaaatgtgtaacaaacactaacaaaattcttgattcgaaagtgtaaaagctgaacacattaaacaagtcctccataagattaggatattaaaggaaagtaattcataaaaaaatacttattaaaataaatacctgtttttttggtgatgaagattttgcttttctggtttcctgcaaggataatgctggtcgactggccttatgaaggacagccaaatcttgcatgattgagttcaaagcttgctgatcatctaggtagttttgaaacaacacatacatagaattgtaattgtgacatatatatcaacatgtatagacatcaaacacaaaatttaaaataaaatttgatgtagagaatgtattaatgcaaaaatgcatctagaacatttttaatgcctacacttttggtaaaataaaattgcactagacttaatctctagcatcagtccacacatgagacactaatggacaagatgaagtcattctgattcttccaatgatttaatatcctagaataaggtcaaaactgccctgttataacaaattcttttctatgactcctaaacaaaacatcaaggtatctaaaatgttttaaaaagtagggaaaaaaaaataaacaactttgtataaatctcattacttagcatttatattcaaagtacagacttaattttggaaggtttttttattctttcatcaatacttaagagtcagaaacaaagaaaagcttcacctgtggatactggcctactgtatttggaaatgctctttcaaacttcttcaccataaggtttgacaagactaaaaacagactatttaaagatcttggccagcaacaatgtaagaaaattcctttccttagaaaaagtaccaagtccataaaactgagagaaagcatcatgaacatgaacttttagactcttataaatataccaaagatttccttctgagactaaaaccatgtgcctgccagtaatgccaattataagctctccagaagacatcagggacaacttaatttattttcactagtaaatcaattctactaatgataatcacaaatgataaataaaggaatcaagagactttacactttacattttaaaatgtaaccattttggtgagcagtaacttatgttcttggagtagtaaaaattaaaacatgccatatcctgtatgggaaatcactaaaaatattccaacaattcagtagccctaatagtctctcaaacacacaaacagctgacttctctaatttactaatttttaataacacttaatatagtctattttgtagtgaaattatttgcatattaaaatttaaaagtaatggttgccatggttttattggtttattaatttattaatatttccaggttaagaaaaaattttataatccttcaccaaggattttttataaaataaagttttatcataatgttagtttagccaaataggtaaccaagccacagtcaggtacaatataatcacaatagatgtacccatcaataagctcacaatgatctcaactggaataaaagcatttgatgtgaccttctttaagaaggtaaatccttggccaggcacaatggctcaagcctgtaatcccaacactttgggaggccgaggggggcagatcataaggtcaggaattcaagacaagtctggccgatatggtgaaaccccgtctccactaaaaatacaaaaattagccaggcatggtggcaggtgcctgtagtcccagctacttgggaggctaaggcaggagaatctcttgaacccaggaggcagaggttgcagcgagctgagattgcaccactgcactccagcctgagcaacagagcatgaatctgtttcccaaaaggaaaaaaaaaaaaaaggtaaatccttaattctatactagggatagatgaactctaattctttttttatttttttgtagagatgggggtctcaccatgttgcccaggctggtcttgaactcctgggctcaagcgatcctcccaccttggcctcccaaagtgggaacttaaatctatctatgttgttctaatttttattagaagaaacctaaacatttgaatttaaacaattttatatgcttaatattacaatgtcaaaataaatgccttgggggagggcctttggctaaaattatcacatttataaatacttctttctttttgggggggacgggggaagcaaggggagatggattctcgctctattgcccaggatggagtgcagtggcgccatctcggctcactgcaagctccacttcccgggttcacaccattctcctgcctcagcctcccgagtagctgggactacaggcaccccccaccacgcctggctaattttttgtatttttagtagagatggggtttcaccgagttagccaggttggtctcgatctcccggcctcgtgatccgcctgcctcgacctcccaaagtgctgggattacaggtgtgagccactgcacccggcctacttatttattaagaaaaatgagaacggaaaaaaaaataagtaccgttttctgttatatatgtaaaaaatggtggggccagttgaacaaaacttcccatattaggaaggtgacataaaaaacaaagggcaatttaattgagttccttacttggcgggcttgaagaattactactgggcacttatttacccataagtacacttacgtacttatgggtaagtacaatgggtttttttttgttgttttttttttttttttttttgagacagagtcttgctctgtcgcccaggctggagtgcagtggcgtgatctcggctcactacaagatccgcctcctgggttcacgccattctcctggctcagcctcctgagtagctgggactacaggcgcacgccaccatgcctggctaattttttgtatttttagtagagatggggtttcactgtgttagccaggatggtctcaatctcctgacctcgtgatccacccgactcggcctcccaaagtgctgggattacaggcatgagccaccacgcccggcccaatgggtttctgacacatgttggaaggacactgaattgagcacaaaaccaaaaaatacttggaaaataattttttcaaaaatcttttatcagaaatgttgaattaaataccttatatgcttattcatgatatttgaaaaataattacagaagaacatcctcaatcaaaaattcaaacatctgtcatggtgttctgtgactaactttgtatgtttttaagcaatgaatgttgccctactatagagcagtattatttgaggctgacaaaaataaatttgatcgatacatagagtacaagtgacagcacccaaaataaaaagttgaaagaagttcagtaaaagtacatccaatttggagctgaaagtaaggctgactagagtggagaatttgggctacaagggggcactgctactcatgactacagaagaggaagtggaagaacaatttttaaagtagggaggtgaagtctaagcttacatacttgctacaatgacacacagtgaaagtgtcctagcccccactttcatcacatgggcaaatataagttcttcatgagggtgtgtgtgtgtgtgtgtgtgtgtgtgtgtgtgtatttgttttgttaagcaagaagtagaaaatgtgtgataaaggcaaactctggcaagcaaatgtcagaattaaatcccaggatcagtctaagtttcaaaatttagcatccaactactcagtaccatttttcttgatttaggatagggtgggccattcgtgactccatttccttctagtgtcttcctgtctaactaattccctgcctcatgctggaacccttaacacaaaggagaaaaggaaaaaacaaaaaggaggtaaacaggaaaacaaaatatgtaaactgaacatacacaatccattcccatactttagtgtctttaaactaacattataccacaatatacgaccaagagttgtataacatattctccctgagcaccaatgatttgctgctctatgaatgataaaattaaattttatgatttctctcttgccatcagactttaagcaaatcacaacacatcttaacagcttattttgaatgtccctgctgttacgcataaaatgatcattctaaaactacagcaacacaaaaagtactttaattcaaagtctattaagtaaatataaaacatttcataaatctgctatatcataaaatttatttataaaaaggtttataataacacataatagagaaagttttttcacttccattctatcctttaattattgctgaaaaatgcttttagtttgaactcacccattatggcaaacagctcaacaatttgaaaattaggaaaatggttctcccatcagcattctttatggcctgagaagataaaacagatcagcatattaataaaa

SEQ ID NO: 1858 - DNA, 108024 bp, Homo sapiens
  source 1..108024: mol_type = genomic DNA
ttaaaaagacttgctatttactgagtacttgctttgaagtactatgctgaacagttgaaatgtatttttataatctttaccatatacaaggcaagtaatattgcttccactttacagctgacagtctgaagcagaggaagaaagcagagacgcagaatgactggcccacagccagccgcagttataagcagggggtagttctgaacccagctggatgggtccaaggcctgtgctctttccataacaccacatccaaaacattttccagtatctttgttttgtaaataagtcattacataatgcccaatattgataagaaccaaatgtccaagaaatcctatctttatgacttcttgctctgaaaaaaggggttgcccaggatgtctgcccagcagtggggttgcagaagttcaggaggatgaggagatgggcgtgggcaccgcctacccccccccccacaggtgaaggtctgaagaaccacctggagaaccctaggagcactgacatccccattcaactcgaggaacagctcacagccctaacacaagttaccacatgcagagcaaatctggaagacatctggggaacataacgaaggactagacaatttcacgttttcacagatgaaactgcaattaaactatacatgcacggtgctgtgttattttggtaatacagggacacaatttaatgattctaaggatttttttgtagttttttttttttacaagtcaggtgccataaacattcaaataatccatcttttaaaaagtacgtttacaacatcaaaagaattaagatgaaatataaacctttctacttacaatttttatacagattaaccaaatcacaaataccacaaataaatgttaatgttaaattgtaacaatataatgaataaacattcagattcttaataaaatcttcctttaacattttttaacttaccattatactaaataatctatgcagaattttggggtacaataccaagaaggcaccaacagtacaaagcagatacaaagcagtttcagaactttcttgagtgctctacacgcataaacagcacaagaaaaggcaacaagctttaggtaaacctggtgcaaccctggaggacttgctctggatttccatttgtttctgacccatcatgtcaaggtggatgacgtaagagaaaccacatattcactgttatagcttctcatctgcaccacaggagtatcatgtttcaaacaccagcataacaattttaaagcacaaatgctttaaaaatgtataagcaaaaggattgctcagattttcaaaaccattacatttacaaaaatatttcccttaaacttgggattgctccaaaacattgatttacaaatataaaagtattatggaaggacccaaagcatgtgtgcgtatgtatgtgtgtattaacatactgttaccatactatataaaagttaccaatttaaaaaccatattaacatataagcaaataaagagaaaacagtttcctctgaatggctgaaatattacgtggcatgtggttgggtagtttacttttgtgattccttagagaaaaccactggtgagctacatgtagcttctcaaagctactggttacctctacacccactgcctgtgcccaagagcagaaggaatgagtgtgcacacaccacacactgtgcactgcacacacaatacagtattcttctacccagatgccacaatgtctgcgtatctctgctagctttgaggacctgtgtcaggacagagtcctcatgattagttctttcaattccatcccactggcttgttcagtatttcttttatactaaatgaaaggactggaatgtttcagcaggaattttttgcttacattttagacaccaaaaaagctattagtctgaaagcttatttgaacatacaaatagtggaggtgctgttccgtgtcactaatatgaattaagatgacctaatctgtacatttttacaaatgtaagaagagccaaaatgatgcatctactacacatgatagctagcgcttttcataggtaccttggttaggaccattctctgcccagttacattatgtttggcatgattaataaaaagcacacaacttatggctacaatgattctagaatgaagttagtggtttcatgccaatctgactccacagtaccaggaaggggaatgggaaggagctcacagtctccagatgttagtagccaaggatatggttttctatttagaagaggactccaaattaaccttataatagtaactttccatttaaaaagaaacaagagtaataaaactgtcaatgcttttttataaatgaaaactgactaatcagtgttatccggtaacagtcacatttctgtgtcccgtcaatgctgtgtggaccttcagacggcagctctgagcacgcaagtgaaaagcgcgtatttcagggcaagaatagagatgtgggtctgttttccgaggatgagccagctatccttcctcagccacaggagtggtgagcgtgagcaccctgggctgggtggtgaggactgcgtactgtggggcggcccttcccaactcttggctgtgcccagcagcacctctggggcacaagggcaggccctctttagagagaaccagggaatccaacctgagatgtcggggcttctttgttagggtttgacagaatatttgagacctaagattgtgaataaaggaacatgacagcatcgattctctgccgagcagaggtaaaaaggaccctacagaagtacctttctaactcatcttatgtaaatccaagtgctgggccagtgcctgggcggcaaagtgaggcctgtgagcatttctgtgttcagcacaacctgaacctgactgtccattcagacacgctgatccagaggaaagcaacactgaatcttaacatgaatgtgaagatagaagatgtacatttattttcatgaattacaaatgcatttctgttcatattagcaggcagtctttatataacccattctccattgctgtcaaaaatcaaacaagaaaaaaggacagctgagaaatgaaaagctaaaaatagaattatttttcctaaatgatctgctggatagcattttccgtggaacacaactcagaggtaacaatagagttttcatttcaatcgtaggcatgtggcacttggacagtcatctctgcacagaaagctgtaacagtcatgcgagggtacagtaattattgaacaaggcaaatttctcaccacagagagcagtggggaagtcaagaggaggcaccgcactgggacagaacaccgagtcaactccacagtacacagtggcaggaacaaatacttaaagagatcagtaaaatatggatagagctccaaacacgagttagtgctagctttttctgacagtctgactcagcagtatcagaaatatttgagtacttgaggacagaacagtgcttcacgtcatgagctcctggaggctttattacaaattgttatactgtaggttgaaaaatgaacttgagatgctgacatgctgtagaaggaaaaagaattgtatactttctcatttaaagacgcagtgttcctctctgctaaatcctcaggcatggaacgtggttactgaaacacccacatttgaagtagctcaagggcgtatatgcaccagcatgtggagttccaccctgggacatccccagaaaccgcccacagctcagcactgcaacctttgtacttctctcaccaaatgtcgagtgaagctgccactttaaatctttttttgtaagtcttacaaacattaagtactgcacataacgcttcttgacaagtgttacacctctatatggtacaagtgaccacagtaactacagagtgacactgctgggtgcagtacttcctttttatttagaaaaatgactgcattttctaaaagctgggccaatagcacataccttatatatgttagtgactaccatgatatgagaaaagacgtggacaagtgctccccaaggattccggagacggaagcacttgctgcaggctgcaacatcagccaaggtatttccacaagctcctgctctggggaaacagttatggtcaaaaggtgaagtgcaaataaggggctgtcactgacttaaagtgccctaggtagtagccttccctatcataaagtgagatgccagtgactagagccaattggggaagaatctctctctggtgcggctgcatggtcagcagggcatcatgtagaaaaggattcaggagagggaggaaccactgcatctttcaaaccagaaagcaattagtgactaaagcaacagtaagcagtaggtgcactgaagtacatactgccgcaggtcaccaatgggtgacacacacagggctgccaggaggaattctctggactgaagaaattctttgaaagcataaaagccacaactaccagaaaccgcccctccaaacggctcaaaggagtcaaagtggataagccaagacgggctggagacaggaccaggggtcaagaactgggaagaagaacaccgatgtctgagcacgtccagtcctctgagcccttgtcctatagaaacacaaacagaccactgagttaagagtgagccatgtgaaaacagcatcatcatcagcatcacaaaacacaaaagtgacaacagtgaaccacattaaaacagcagcagcagcaatagcattatgaaaacagaaaagggaaaaaagactcctgcaaaatggccatttctttggacacatttgggcaaggataacacatggcagttctgaaggggccagggtcagccctcactccacaggcacctcctctcagacagttctgaggtggtttccacaacactcataggaaagacgccactcccccagcctacgctgactgcagtgttcctaagatgtcctttatttaccgtaagatatccaacactagtgcatgaaaatctagcagagtatcacttactatttcacagagcactttcagagctgtggtttccatctgccactcaggaggtggggcaagaagaatgggctaactatagccaaactgtggacttggagatgggctaagagggagaagtggtctcttttatgtagaggtgaactgcagccaaacctacgggttggcaggaaattaaagctgccctaaaatgctttcatcttcaataaaccaaagggaaatgcggttcatgcccctagtgatcaatccacctgagaaaattcacaatcaggcagatgaagaaggaagttgagcactgacctctaccttcacccgcctcacagggtaggagactgaggacatgggctgggtaggaatgaggcttgtcacaggtagtaggcatgatcagcttttaaacttgcccatggaaacatttctaaaactgacccccttaagcaaaatacaatgaatataatttgacccttttttaagacctttcggccaccactacaaatatcacttcattgcttcctctaccaaaggggccccacagctgtgctctgtggtcctggggtgtatgtttctaagcctttcttgctgcagccaaacggtcaaccgtgccctcccagtgttcccatgttttattacacctttacctcctgagctctccaattcagagctcctgatctccagtgtgtgggctgggaactcagagacaatgctccttagtattgtgaatgagtcctgagaactttcccaaggagcaaggctaatcacaggcagtgtgcagcctgccactgtttcatgctggcaaacatttcaagaaaatgacattctgggtccaaaatacctggattctctgcctagttttgccacttgatgtacaattttgagcgaagtgctcaaaggctcctgtcttcagtttcctcaattataaacatggatgcatgctgacttcccaaaattctgttgtgatcaccaaaatgaaatgtttatgaaagaacctatcccatagtttaatcagccaacccagccccagcttcccctggattcatgtgatattctagatgactaaattgtaagtcagtctagacgttggcaacgtcctttgcaatgaatggataaaatgcgatgggttgatgggtggatagaggaacagatggacagatctatgagaaaacaagtaagatgttaatgttaactgtataatctaggtggtgggaatatgggtgtctactttaaattccttcaacttttcagaatagttgaaaactgtcactaaaagaatgttgggaaaaaaaatcatgctataagcacatagggagcatctgtgtgtcttctgtgtctggagcaaatgaacaacgcacagaggtgactgtccttgccacgccgggactctcagagtggtggtggacctgagagggatactggtcccccgccttgcaaagctggcttcaggaggcgttctgccagcaactgcgccctgtggcctcaggagcaaccctgcctctgtcttgccatccttgtgcctgcggtgctgcctgtctcttcagtggcctgaccagttttcccccaagtccctgctctcagaggtcctcctgcatccttactgccaccagagtcacctgagccactgcttcaggtcaggcagctacctgtgagggagagctggcctcctggggaagcaagggccacagcctgggctggcctctttctctgcagcccccctcttgcccagctgtctggcatgcccgccttccagggtccacacagctgtgcccctccccaaccagcaaagaacccaactgtcaggtttcagctgcagcacaactgccgcgagtcggccacactctgtgaggctttaatgtctgccttactctctgggacccaccatgcctgtgtccatctctgggactctgtatactccttgttgtttacatttcctgctatgaggctgctggaaagcaaaacctgggttttattcatctttgttcctttcctaactggcgaaaggaagtgctcaatgctgattaaatgatgaaaaacaaattatcacgtcaaccccagaagctcttttatactaaaaatgtgcacagttgtgtgtgtgtgtgtctttctcccctactacatgggcccctctgaggctgtgtttaggtcctgcttgccgcgtttgctgttagtgtctaatgcagactaagcaggcagcactgccgcctgacctgaagcgacagagatgagatgctcacaagccaccacctggctgagggaaaatgactgtgaaaggaactgtgaaggaagaaaagcaacagaagttgctcagctcaatattctaggttctgtaaacggcaagagagtgctcttcacagaagggcaggcctcacaggccatccaggtctgttatgactaccccacgccgctgctgtagaggaaaggcagcgggctgaccaaggtctagttaacctgaccttgtacagacactgggagtgtgtcctggagcctcacggagggagagggacggactcttgagaaacagagacaattgctccactgtgagcacctcacagaggagccaggaaggaagttctgtggggactgcaggtgtgaaaatggttggatcctggggcccagctttctgtcagtgagtgattgtgcaaatcactgtggctaacacctcctccactagagagccacatgtgtatggggcaacagaagacatgaaccagctcagcccctgctgataacaggcttctttctcagtcactccgcaaggcttatggctagcagtccactgcacgtcctgttcgcgtgactccacaacacttcccttgggtttgagagatcgtcttttggggtgcgtctggtgttaacagcaggctaagtgagggcttaacagtgccagcagccctgcctcccccaagttggtaggtttagaaaacttggagtctttaagactttgcctttcctcctcctcttgaatttgccgcttctcaccacttcatttctagtccaaggctacggcccctttggtatggaagaccaggcatttgttcttagctgatctcctacccagtattccctcatttcaacccctcctgctttgatgtcagacttttgaaaacaccattttccggcccccaaactactagtgtctattccctaccaattcctcgttctgttgccctgcctggctttcagggctatctgcttggaggctgagttggtcatgtcagtcctcagctcatgtctacttggttctttgttcttactgacggggaatggacgcctctaactgcaacacggttctgtccaaagcatctccccagcaactgcttctaccttggctcacaattctttttttttttttttttttttgagacggagtcttgctctgtcgcccaggctggagtgcagtggcgcaatctcggcttgctgcaagctccgcctcccgggttcacgccattctcctgcctcagcctcccgagtagctgggactacaggcgcctgccactgtgcccagctaattttttgtatttttagtagagacggggtttcaccgtggtctcgatctcctgacctcgtgatccacctgcctcggcctcccaaagtgctgggattacaggtgtgagccaccgcacctggcccacaattctttattcactgcttctttctatagagttctaaacacaagtccagttctctctcctcttgtcacatactctctaaaatcaagatttgcattcttttcctgtatacttttcttttctgacacagggttcacccaggatggagtgcagtgatacaatcatagctcattgcagccttggactctgagattcaagcgatcctctcccctcagcctctcaaagtgctgggattataggcatgagccattgtgttgggcctgctcaatttttaaaatctaccaatattgtcacattgttcaccttcccttatgatctaagcacatgtagcttctgtgcaggcccatgtaaatccccctgactggccagcccagcctccatctcctggatgaagtttctccagctctccagcctacactgctagtctgaactggtaacagggtctgggccccttgcatgtgacatcaactgtagaaccaggtcccagctaggagtttctgaaggggcaggcacagaggactctaatactaaatttatttaactggtggctctgctttccatgggagggagtcctgaggcgaaccctttccagagagatgctcatgtaactgtgaaactgctctggacaggcagcaaggaaaggatgagaacccaaagatgaacaatctggaatatgaaaaagttgtttccaaataatcacattcactacccttgagagtaaaggaggtacttggagtttctaataaacgagagagagattcctaggagaatatatgtaactttctaaataatttttaattctaaatttaaaaaaataccttccaataaggagcttggaaaagaatacaaaataatggaccttgaggaacataatattctagaaacaaaaggcagcgcctcccttgctagagctcactgtattaaactccaggtacctgacaaatttaagatctgtatcctggctggaatctagcagtctcttcaaaaattagttctttgagcttttccttaggcaagtcatccaattccatgtcgaacttgaatggtgcttcggcgatgggctttaaaagaaaacaaaacatttaacagtcaaagttgttatgggtaaggcagtaatttactgattcataaaatgaccactgctcagattctgaatttacaacaggactgatgtctcataaaaacttaagagttgatggccgggcgcggtggctcacacctgtaatcccagcattttgggaggctgaggcaggcggatcacttgaggtcaggagttcgagaccagcctggcccaacatggtgaaaccccatctctaccaaaaatacaaaaaattagccgagtgtggtggtgcacgcctataatctcagctactcaggaggctgaggcaggagaatcgcttgaacccaggaggcagaggttgcagtgagctgagatcgtgccactgcactccagtctgggtgacagagagagactgagagttgtgcccacactcctcaagttctcataaacacttagcctgggagcaactgaatctgtttcaagtgtttttctgaacttaccacaaatcccagaataatttttaaatgttttaaggcagtgaatgtcgaaataagagaaatgtgctgctgttggggtggtggtacgtttatccaatcaacacccataatactaaaatacatgcatttcattaaataaatcatggtatctttgtatgaaaaaacatcttagagctgttaaaaattaagctgcaaggccaggcgcagtggctcacatctgtaatcccagcacgttgggaggccaaggtgggaggatcatgagaccagcctgaccaacatagtgaaactccatctctactaaaaatacacaaaaattagctaggcatggtggcaggcccccgtcgtcccagctactcgggaggctgaggaaggagaattgcttgaatccaggaggcggaggttgcagtgagccgagattgcgccacggcactctggccgaggcaacagagcaagattccatctcaaagaaaaataaaaaaaactggccaggcacggtggctcacacctgtaatcccagcactttgggagaccgaggcaggtggatcatgaggtcaagatattgagaccatcctggccaacacagtgaaactccgtctctactaaaaatacaaaaattagctgggtgtggtggtgcgtgcctgtagtcccagctactcgggaggctgaggcaggagaattgcttgaacctgggaggtggaggttgaagtgagccgagatcacaccacggtactccagcctggcctggtgacagagcaagactccatctcaaaaaagaaaacaaaattaagctgcaaggaagattaataggaaaatgcctatgttgtgtcaagagaatgaaaactattttatttttaaaatttagatacagaaatacaagactgagaaggaaatactccaaaatgttagtaactgtaacaagattataaagctacatatttgtagtatgaaaaaaatctctcctgtattttcttacaagtttgcttttctctttttttttctatacaaaacctcgctttgttgcccaggctggagtgcagtggtacgatcccggcttactgcaacctctgcctcctgggttcaagcgattctcctgcctcagcctccggagtacctgggattataggcgcctggcaccacacttggctaatttttgtatttttagtagagacagggtttcactatgttggccaggctggtctcgaactcctaacctcaggtgatccaccaaccttggcctcccaaagtgctgtgattacaagtgtgagccaccatacctggccccatttttttttttgagactgagtctcattctattgcctaggctggtgtgtactggcatgatcttggctcgctgcaacctctgcttcccggggtcaagcaattcttatgcctcagcctccagagtagctgggattacaaacatgtactaccacgcccagctatttttgtatttttagtagagacggggtttccccatgttggccaggctgggcttgaactcctgacctcaagtgatcctcctgcctcggcctcccaaagtgctgggattacaggcgtgagccactgcgcccagcccccattttaatttttaaccatactccagaaagctatttaagtaaaatataaactgtctatttagatcaaagaaccccatacacactcagtgacaaactgattattattttttagagaaagagttttgctctgtcaccgaagctggagtgcagtggtgtgatcacagctcactgaaacctcgatctcctgggctcaagagatctttccacctcagccttctgaatagctgggactacaggtgtgagccaccatgcctggccacattttgatttttaaatgcccgtgaactaatgcaatgttacagaactaagctgatgataataccagctgtcaatcagtgaatgcctagaatctcacctctcacccatgtaatcctcacatggggcctttagggggaggaagcacagaccccaaactctgcactaagctttggccatctgaaaggggagaaggactcatgtccagaagaataaatagctcagcccgaaggagggctatgcatctgggatcacaggaggtgtcctacacgcatcacccaccaccccagccagctgatttggactcggaagcttgggaaatctccagcccactaagcttgtaagagccccaaacctgtattctctcctattctgtgttactggctatgttgtaggtatttcacaagctgcctaacttgttgctggaggcagagagatggatgtggaagggaaagctgattctttcaaaaataggagggtaaagactattctctgtgcatatgagcctcaactacaacaatccaaacttttggttcatattgcatttttctttgttatcctccagagaataaagttaaaattgaaccccagagacaccagagagccaaggcactaggactgtcttggggagaacatgacatgcagcatcttctacctgaatgccctgcctgctctgaagagctgccatatccactctggcctcatcacttcttacaacaggctctcgtgtccttgtctctagggaatagcacacccgacatggagtcgccaagccacagtggaaactgtccaagttgacttccctccccactctgtgtgctgtccctgtcagcaggctgcccacctcctctccaccccggccatcctcagggccagcacttcacttcaggtgtctcttcctgtcacaccatgacaatggcctccagtctcagacccatgccctctgtgctccatactggtgcagctgtcccctttatacatgcgtttaccccgcccctacctgttgcaggtggcctggaggaagtcttctgagatagacagagttacggggggagggatttcaagctgtgccccacagcactcgtcctcaaggcaaaggtgggcttgttggaagaaccgggtatggcagcaggtatatctcaggaaaatctaagcaagatatggttggtccactgctggctgatctatgtccctgaagcagcagccaggaacatgagctcttacctcgtcactcgggtcgtaatactgctccagatatgggtgggccagagcctgttctacttcaatcctcttgtgtgggttgaatgtcaacattttgtccaataagtccagagctataaagagaaaggttttgcagtagtgagagcagaagtagtcacagaaatacttcaatttcctgtttaagtaacttacccacaaaacaactgagctaagcatgactacagagagagcagccagcacaaagggtgctgactatatctccaagcctcccgagactgtgaacatagggaccgaccatctgacaattgcagaccgcaaacaaaaacactggcactacttaatgaagcgtcttttctgacaatgatcatttcttttttttttttttttttttttttttgagacggagtctcgctctgtcgcccaggctggagtgcagtggtgcaatctcggctcactgcaagctccgcctcccgggttcatgccattctcctgcctcagcctcctgagtagctgggactacaggcgcccgccaccacacccggctaattttttgtatttttagtagagatggggtttcaccgtgttagccaggatggtctcgatttcctgacctcgtgatccgcctgcctcagcctcccaaagtgctgggattacaggcgtgagccatcgcgcccggccagcaatgatcatttcttattaggttatttgtaggtaaaggtcaacttcatccatctgcaaattagcacatactattaagccctcaaagtagaatgataaaatatcattatttcttcttaaaacattttaaaatttaattgtatgtcccttctcaccattcctaaaatgataaacaatcacgtaaaatttggtacaatttaatactcatgatcagtttaaggaatcacttctagccactactttcaaaaagtaagttttcactatttactaagaaaatgtttcctaacccttaagaacaatcagtagaccttccgaagggattgcttgggtgctggggggaggtgggaggcatcttgctgcctgaggtcactgaagggctgtgggtgtgtatttgtgctcagccccggccaattttgacctcccttgttgcaacccctgaccttaagacaacaggagatgataaacatggtaaaccacatgctggacataatgagaaattccgcatagaaaacatttaaaagttatgtatgtttctatctataatcttttcaatacatacaagtgcactttaggaaattacggaataatgatattttgttttatagcctagataacttttcagagtagagaatccagacaggttttgctgtgactgaaggagtgtctgcgcagtagaagaggtggtcatgcctgcagctgtgaccctgggtctgtgggcacacaaactggctaggtttaggaagtggccctctcaagggtcaggacaaagacgcatgatggtcaagaacccaggaatctctggttcaaatcctacttccaaggaacacttgtagatatgtgtgcaagacacacaacccttgccgaatcttaagattcctgtggttggctgggcacgggggctcacgcctgtaatcccagcactttgggaggccaaggcgggcggatcacaaggtcaggagatcgagaccatcctggctaaaacggtgaaaccccgtctctactaaaaatgcaaaaaaaattagccgggcatggtggtgggcgcctgtagtcccagctacttcggaggctgaggcaggagaatggcgtgaacccgagaggcggagcttgcagtgagccgagattgcgccactgcactccagcctgggcgacagagcgagactccgtctcaaaaaaaaaaaaaaaaaaaaaaaaagattcctgtggtctataatataggtaataaatcccactttgcttcctgctcccaaccagccctccccacatagaactcacagacattttctcaaggactttcttgaaactagattaagtcatttggcttttcacccaattagatactgtctgtgctaagaaaagtccagaaggcctggaccacaataagattctaacagtattacttctaaaccactgggggcagaagggtcctactcaaacttgttcgtattaagtagacaggcactccaagccaactggatgttttgcagcttaagcatttctaaaacagatccattagttccttaaagttaaataaattctaggcccttaaacctccaggcataaatttcaaagaagacagctttttaaaaaaagatttgctacttgaaaagtagctagatctccagccttctgttactgcaagtgctatttctacattattcatagctacagaaggagaaaaggagagaaccgggaagcagctggcaggtgcggatcccacagtcaagaatgtccggactccctcctcccacgccacatgggcattcattggtaacactcagatggtgtgaatcatggctgcctgtgtggatgcttacttggatacaggttttatttcccctaaaagactggaagtccctttgaggctagtattactcctgaccacaaatcctgactttccctagtgccttccagaatactacattttctctttctgtgttttttaaaacagagtttggattttgttctatggcccaggctggagtgcagtggcatgatcatagcttactgcagccttgaactcctgggctcaagcaatcctcctgcctcagcctctcgagtagctggtactacaggcacatgttaccacacccagctaatttttttaaattaatttttctgtagagatggggagtcactatgttgcccaggctggtcttgaactcctgggctcaagtgatcctcctgcctaagcctcccaaagtgctgagattacaggtgtgagccactgtgcctggcccttgtctttttttttttgaaacgggagtctcactctgttgcccaggctggagtgcagtggcgctgtctcggctcactgcaacctccacctcctgggttcaagcgattctcctgcctcagcctcccgagtagctgggattacaggtgcctgccaccacgccaggctaattttttgtatttttagtagagacgggggtttcaccatgttggccagcgtgttctcaaactcctggcctcgtgatccacccgccttggcctcccaaagtgctgggattacaggtgtgacccaccgcgcctggccagcctggcccttctctttaacttcaaatagtatgtaacaacctgattccaaccctttcttctaatccatcatccttttttccttcttgccctgtcctggacctggggaaagccattgactggctctccacagtgcctcttcatgtctatcttgcctgcctcgtgaaactctgaccctgaatcaatgctgcaacctgtcacttccatcctcaactcatgtttctgtgcggggccagagaaaagactgaactgtgcaaagtgtgccagtgcgacagtgcttctcaaactttctgatctcagaactctttatactcatcaaaactgagggacgatttaaaaaccagttaattctgctcatagctcaaatagttacataagtgcttttccctgagaaaaccactgcattcagtatgcagcagaaatgctatacgtgtttgtcacacagacatcgtgaagacatgtattaaggatggatttaatatggtgagtactttttactggcactggttttgagcagtgggggtgtggcagtgcagagctcagtaacctctctagttccactgccttgacctgcctgtggtgctggggactctgctcatcattgctcctgtgccacaagtgctgatggcaacatagagagcagtgtgagtaactctttaagaagattattaaaacagctttaaccttgtggacaccctgaaaggatcctggggatctcaggtgtttaaggagcacactatcagtaactaccgttctacaaaaactcaagattttcagcctcatcaaggccctcaacagcttctggaaagctttggtcagtcccctcctctactctcagatttcacccaacttgcacggcttgaatcatgaccttcttgctaactgaccctcattactctcagcatatcttcttgagggtgctacagagaaaactgaggcacccaagagtgatcttcgcggaattccctcctagccagattcacacacacccttactgacactgccaagaaagatatcctctctctactcaaagtcaattctccccaacttgtggcctggtccacaaccccttcccctcatgtggaccagtcgtttctgtctccactttccatttcaaatttctcacttccattcactgtttcaactcctcttgcatggtcaccaacaagcccctcattggaaaatcaacccacattttccaatctatatcttgctagacctctctgctgcatggacactgttgtgcatgcctactttctcaaaatgccatcttctgcttctgtgatatcacatggcactagtttcttttctttgtccctattccatcactggctgaaggtttgtgttctccaacttctcacaatctcactcttcttcttcttcttcttcttttttttttttttgagacagggtctcactttgttgcccaggatggaatccagtggcctgatctcagatcactgcaatctctacctcctgggttcaagcgatcctcctacttcagcctcccgagtagctgggattacaggtgtgtgtcaccacatcaggcttatttttgtatttttggcagagacggggttttgccatgatgctcaggctggtgtcgaactcctgggctcaagtgatccacctgcctcggcctcccaaagtgctgggattacaggcatgagtgaccgcacccggccacaatctcattcttctatcttttcaatctcttgcaagatttaaaagaccacaggttaaatacctcccaaagctatattgagctgagggtgaccaagctgtagatcaataaatccaagtttgtgtaggtaataaaatatatagcctatgattccatttacaatcaatgtatgtatctatatgtgtaataaagtctgcaaggttttcaaacattaggttatctgagaaatggagacagacttcttatagaaattgcgttttttaatttaaaaaaaaaaagtgggggccaggagtggtggctcacgcctgtaatcccagcactttgggaggctgaggcaggcagatcacgaggtcaggagatcaagaccatcctggctaacacggtgaaaccccgtctctactaaaaaatacaaaaaattagctgggcatagcggtgggtgcctgtagtcccagctactccagaagctgaggcaggagaatggcgtgaacctgggaggtagagcttgcagtgagccgagatctcgccactgcactccagcctgggcgacagagtgagattccatctcaaaaaaaaaaacaaaaaacaaaaaaaaaaaaaacggggggcggggggggtccgggtgtggtagtggcaggaggatcccttgagtccaggagttcaagacaggactgggaaacatagcgagaccccatctctacaaaatttatttaaattagccaggcacggtgcttgcccgagcccaggagttcgaggctgcagtgagctgtgattgtgccactgcactccagccttccagcctgggcaacagagggagaaccctgtctcttcaggaaaaaaaaaagggggggggtgggggggagaaaatagaattccttatcttccctcactctcgggatcacctgctggttgtgcccaccagcatccactgcccctctaatccatccaacagtgtttgctataggggagcgctcaggcttgcccacgctcctgggctgtgctgtgggaatggtgacactcactgggccatattcacctgagtccccttggccacagtgactgctcagggataggcatggcatccaagctgagcacaaagaggtgatgagagtcagcctaagtcctggctgcagtgatcaggtcaagtgtcttactctcatcatgaaaagagaggctgactgacagacagcccagagcaaggcaaaactggatgataaagaagtccagattctagacacagtgtctgtgcccatcaatccacatgtgactgaacttttcagttatcagagccaataaagctctttcttgggccagtaagttcttgttatgtggaactgtggaactgaaaagacctcagacggttgacccaccaaacccggccttctggtctgtgtgaatgactcacccacattcccttgctccccaagcaccatcattcaatggtaaccactgcttatcttttcacatatgttgttgaattcttttctatgcattttcttgtagaaggctgaaatcatattatgtatgacaaatgctgttttattttcccttagtaaatactgttcattagcattttcccccactatcaaaactttgtaaaaaaaatcacttttagcggccttaaaatattcctttaagtagatgtctcataatttactcagccatttgattaacatttggcacttaggttgtttctaatgcctaacaggtgccttaaattaaacacagactaaaccaaattctcaactgctgtcacccaaactgctcctcctatagttttcctcatctcagtatttcctgtagactgtgtgttcttgtcctttgctcatttatttatacactgtggtcttagatttgtctctgctctttagatactaataatattaataatgaatctaaagttaacaataattccttaactcttttaattatcctatgaggtgggaactacaattgtctcaatttagggttgaggaaatcatgaaacagcttaaataacttgtccaaagtcaaaaatccaagtagcagaaccctagtttgaactcaggaggcggactccagagcaccgggtataaccactgtactttgctgccttctacagaacagttaggagaaggtccagtgttactcaatttagaacattttagacctattgtccacacctaatctaattttatttagcttttaaacttttatatgtctctctttccttgatgtttgttttaaaacataggaagtctttctccatgcagagatcagaaaaatactgaatactctattgttagtttctcatgatataaattttaaataagtatcaattcttttagaattcattttgatgtgtaatgatttaaattgattttcctccaaatagctattcaactagcccagtaccatctgctgaataataatttcttctccctcactgaagtcatttgagagaatcgtaagctaagactcctttaaagaaaaatctacaatagtgtcggtttaagggatacagcaatcaaaaatttccaacaaacatgaaaaaatttcaatctcactcttaattacagaaaaacaaattaaatgccactcccccatttggttggcagacctaaaagttcaatacccagaattgctggaacaaaagacatgtgacagaattgccagactgtcctctacagagactcaaccagtttacactccaccagctctctccgaaaacacccttttccccacagccttgaccacacagtagggtgtcaaactttgatgtctgctactctgttgaggagggcgttaaaaaaaaaaaagaattactgacttttcaatgtttgtatcttgtataatgagtaaacatgagtaccttttatatatttaagagctgtttcatcttccttttctgtgaactctcattaaaaattctagcttgtaagttttttaatctcttgagttccctgaggtcttccattcatttcctgacaaatctagactatcagttctgtaagaaagctctctctctcttttttttttaatgagtcctcagacttcccatctccaaacaggttcttaatccctcttattgctggtactatgtatgtccagggccttagaagccttgatggcaccaaacagacactcaaatctatccactgaatgaatgaatttatgtatgttttcttaaaaatataaaaacaactggctagatgtggtggctcatgcctgtaatcccagcacttttggaggccaaggcgggtggatcccgaggtcacgggatcaagaccatcctggccaacatggccaatatcttggctaaaaatacaaaaaattagccaggtgtggcggtgcgcgcctgtagccccagctactagggaggctgaggcaggagaattgcttgaacctgggaggcagaggctgcagtgagccgagattgcaccactgcattccagcctgggtgacagagtgagactccctctcaaaaaaaaaaaaagaaaaaaaagaaaagaaaaataacagtgctgggtgcggtgctcacgcctgtaatcccagcaccttgggaggccaaggtgggcagatcacgaggtcaagagttcgagaccagcctggccaacatggtgaaaccccgtctctattaagaatacaaaaattagctgggcatggtgacatgtgcctataatcccagctactcgggaggctgaagcaggagaattgcttgaacctgggaagcagaggttgcagtgagccgagatcgcgccactgcactccagcctgtgtgacagagtaagactctgtctcgaaaataaataaataaataaatacatacatacataaaaagcaaaaattagccaggtgtggtggcacgcacctgtaatcccagctattcaggaggctgaggtgggagaatcgcttgaacctgggaggcagaggttgcagtgagccaacatcgtgccactgcactccagcctgggagacagagcaagacgctgtctcaaaaaaaaaaaaaaaaattagccacgcatggcggcacatacttgtggtctcagctattcaagagactgaggcggaggattgcttgagcccaggtggcggaggttgcagtgagccaagactgtgccaccgcactccagcctgagtggcagagtaagaccttgtctcaaaacaacaacaaaaaaacatggtagaactgttgaagtgatgttctgagatttggttccaagagaccttgcagcataggctcttgctcttttggaatatttctgccatcatgagaagccactgagtctagtctactttaggataaagaggcaactgtaggaaggaccaactgttaagacgttaaaccaccacaattgagggatggtgaagggagccagcagatgactgcagtgcatggctgaacccaggtgggctcagcagaactacccagctgtgccagcccaatggactcatgaacaaatgcatggctgttatttcaagcctgagttttggagtgtttttttaatgcagcaataggtaactgatgtaaactttaatgtccaatgtgagtctggctgaaggacacttatgggtcacatccctacaagggaacaccatgtagtcactctttaacaactagaggccgggtgcagtggctcacacctgtaatcccagcactttgggaggccaaggcaggtggatcaactgaggtcaggagttcgtgaccagcttgaccaacatgatgaaaccccgtctctactaaaaataaaaaaaaattaggccgggctcagtggcttacgcctgtaatcctagcactttgggaggccgaggcgggcagatcaggaggtcaggagatcgagaccatcctggctaacatggtgaaaccccgtctctacttttagattgtgtttttgtttggttttgttttgagatggagtcttgctctgtcacccaggctggagtgcagtggcatgatcatagctcactgcaacctcaaactcccgggctcaagcagtcctcccacttcagcctcctaagtagctgggactataggcatgcaccaccacatctggctaatttttgtattttttgtagagatgggttctcactatggtgcccaggctggtcttgaactcctaggctcaagcagtcctcccgcctcagcctcccaaagtgctcggattataggcatgcgccactgcacccagtcagttttcttttatagacgattgtcgatagtacctgcgtcacaggattgtgtgaatgttcataccactggcatttgtaggtctaacatctttccatatcttgctctgttgcccaggctggagtgcaatggtgcaatctcgcctcacggcaacctccacctcccgggttcaagcgattctcccacttcagcctcctgcgtagctgggattacaggcacctgccaccacacccagctaattttttaaaatttttatttatttatttatttagagacggagtctcgctctgtcggccaggctggagtgcagtgacaccatctcggcttactgcaagctctccctcccgggttcatgccattctcctgcctcagcctcctgagtagctgggactacaggctcccaccaccacgcccgtctaattattttgtatttttagtagagacggggtttcaccatggtctcgatctcctgacctcatgatctgcccgcctcggcctctgaaagtgctgggattataggcgtgagccaccatgcccagcctgtaattccaacattttgggaggccaaggagggtagattgcttgagcccaggaattcaagaccagtctggcaatgtgatgcaatactgtctctaagaaaaatacaaaaaattagctgggcgtggtgacatgcgcctgtggtcccagctactcaggaggctgaggtgggcagatcgcttgagcccagggaggtcgaggctgaagtgagtcgtgatcacgccattgtactccagcctgggcaacagagtaagaccccatctcaaaagaaacaaagtaaggccaggtgcggtggctcatgcctgttaatcccagcactttgggaggccgaggaggcagatcacctgaggtcaggagattgagaacggcctggccactgtgacgaaaccccatccctactaaaaatacaaaaaattagccaggcatggtggcatatgcctataatcccagctacttgggaggttgaggcaggagaatcgcttgaacctgggaggtggaggttgcagtgagacaagatcgcaccactgcactccagcttgggcaacaagagtgaaattctgtctcaaaaaaaagtaaaataaaaacaaaaaacaaaatgaaggccgggcactgtggctcacgcctgtaatccgagcacttcgagaggctgaggcaggtgcatcacctgagatcaggagtttgagaccagcctgaccaacatggtaaaaccccatctctattaaaaatacaaaattagctgggcgtggtggcgcatgcctgtaatcccagctacttgggaggctgaggcaggagaatcacttgaactcgggaggcagaggttgcagtgagcccagatcacgccattgcactccagcctgctgggcgatagaagtgaaacttgaaagaaagaaaggaagaaagaaaggaggagaagggaggggagaaaaaagaaaatgaaaataagcagccaggcacagtggctcaggctgagacgggtggatcatgaggtcaggagttcaagaccagcctggccaagatggtgaaaccctgcctctactaaaaatacaaaaattagccaggcgtggtggcgggcgcctgtaatcccagctactcgggaggctgaggcagaaaattgcttgaacctgggaggcagaggttgcagtgagccaagttcacaccactgcactctagcctgggcgccagccagagtgagacgccgtctcagaaaaaaaagaaagaaaaaaaaatgaaaatgaaaataagcataaaaaaagaatcagaaatagtttgatgcaactcatgattacagacaagagtaaggaaacaaacaggagaggaacgtttgggagtaggcctatttattacagttttgttgtttttttttttttttaagagataagagtgtcaccgtcagcgtggagtgcaatgatgcaatcacagctaacagcagctttgacctccttgggctcatgcaatcctccctcctcagttccccaggtagttcagactacaggcaggtactactacactcggctgaattttaagtttttaatcttgtagagatggggtcttactatgttgtccaggcaggtctcaaattcctggcctcaagcgatcctcctgcgttgacctcccaatgggctaggatcacaggcatgagccacattaccaggcctaatgatgcagctttgttgcttatgcagctctttaaaaaagtgactcaggaaataacatttagtaacatttagataacatgcttaggtggtataatatacaagcaaatctaatcagtaacatgtattatgcatgtgacattctagctaaaaatatcctaccatcaaaatacattacaggccgggtgtggttgctcacacctgtaatcctaactcttcagaagcccagggtgagcagatagcttgagctcaagactttgggatcatcctgggcaacacggcgaaaccctgtctctacaaagaatacaaaaattagctgggcatggtggcacaggtagtcccagctactcagatggctgaggtgggactacctacctgtagtcccagctactcaggtggctgaggtgggaggatggcttgagcctgggaggtggaggccgcagtgagcccagattgtgccactgtgctccagcctgggtgatagagccaaacccgtctccaaaaaaaaaaaaaaaacccaacccccaaaaaccggtcaggcacggtggctcacgcctgtaatcccaacactttgggaggccaaggtgggcagatcacaaggtcaggagatcgagaccatcctggctatcatggtgaaaccccgtctctactaaaaatacaaaaaattagccaggggtggtggcgagcgcctgtagtcccagctacttgggaggctgaggcaggagaacagtgtgaacccgggaggcggagcttgcagtgagccgagatcacgccactgtactccagcctgggcgacagagcgagactctgtctcaaaaaaaaaaaccacaaaaaacaaaaaaaacaaaaaaaaaccacaaaacaccccaaaaccaaaatacattatataattacaaccacacagaagcttgcacacattagtgcaaaaaaagtgaaaggttactgtgggatcctggtgatcaatatcttactcccttaccattcctcccatacttcttaactgtctacaatgatgaaattcttctacctttatatgaaagattaaaagaaaatttctcccattttcaaaagaaattcatttctaaacaaccaagtatttctcaaccttcactcaggtcaatacataaaaccaattcaacatttaagtagacagttgttaaatatacatatacacatatattcatatgcatgtatagataaacacatacagataaaataggaagttagaaatagctaaatttctaacagaacactggataaaaatgctataaaatcattaacgataacctagatctatgcactgatgtggaaaagatattcaagacacaattctattaaccatgacatttagggaataattataaaagaattttaccttcttaaatatttctataatttctgaatttttaaaaaagttaacctttataataattatttttaaaaaataaattatagagaaaatatgcacatgtatgtagataaagatatggaaggacaagcaccctattcagattccctcctcaacttttaaggaaccctgtttttataaatgggcccacctagataatccacctacctagacaagacaatccaggataaccttcctatctttaaagtcagctgatgggcctattcggggcataccacactgcccgtggattagccctgctctgtaaggagcagttaaaaaaaaaataaggtcagctgataaacaatcttgattgtatctgcaaccataattcctgtttgccaggtaacctaacatagttataggctctagaaattagaatacagccatgggggtgggtggggggtcattagtcggcctatcatggttttataacagcatgaagttttaaaaactagctgcctaatatatttaacaggtacacgttaaatgggaataaagaataatacaattattaaacgaagctaacctaaaaaaaaaaaaggataaaaaaatcaaatgtatcacttttttttttcatgggtactctaaaaaatctttgcttaacataaggtcatgaagattctctcctgttttcttcttgaaggttaataactttaggccttatatttaggtttatgctccattttgagttttgtaaattttgcatatgggtgtctaattgttccagcaccatttgctgaagagactgacacaaacaatgacatggatttttataaatctcaaatgcattatgctgaatgggagaatctagacataaaaaggctacatactacatgattccattaacatgacatgccggaaaaggcaaaactatagggatataaatcagatcaatgattgccagagcttggggttgcagagggatgactgactacaaacggcacaaggcaacttttggggatgatgggaatattccacatctcaattgcggtggttgttacatgacagtttatgtttgttaaaactcagaggcccacacaactaaaaagtgtgaattttattctgtgtaaattattcttcaataaacctgattttaaaaattatcaagtgacaagatgaaaaggtgtaatttgtttgcagggtcctagacttcctgagacctaaaaatgtgaccttaggctgaacgctgtggctcacgcctgtaatcccagttttgggaggccaaggtgggcagatcaaaaggtcaggagttcgagaccagcctggccagcatggtgaaaccctgtctctactaaaaatacaaaaatgagccaggcgtggtggtacgcgtctgtagtcccagttacttgggaggctgaggcagaagaatcgcttgaacccgggaggaggaggttgcagtgagccgagatcgggccactacactccagcctgggcgacagagtgagacactgtctcaaacaaaaacaaaaaaaaagtgaccttaatgcaaattaaaattagcaaagaaaccaaaaggtggagaactagaccgtcattaccaggttcccttactgcactgccactgtttccaaaaaaaaaaagggggaagacaacaattcagagtgagcactaaagaaagcattatccaatagccataggctcatttttcaggctagtgacctaacaatttaacaaataaacgcgaagctaagcctaagaaaaaactaatcaacgaaataacatttacctttggagtcagcatttgggaacagcctgttccatggcaccttatttttgtgtggaagagaaagcaaatagttcctagcttttaaatttattatacaattcaggtcttcttgtgatggggatccaagaatacctatcagataaaaaaattagctattagttatcaggaccaaggtaaatgactacacaccatcaactctgagtcggaatgaaccctgataattgatatgagccgttgcttatcaccactcctgatgtttacctttcttatgtttttacacaaaagtccttaacattttaaatcagagaaggttaaaaattcacacctaccacaggttaaagagtatattagaactcttcttaatttaatgaagtgactttgatgtaagctgtacaaacttgagtaaatctagctcctgaagggctcgggaaccttacccaaaatgtggttcagctggtcaagataatgcttccctggaaagatgggcctgttagaaagcatttctgccagaatgcagcctacagaccaaatatcaatggacttggtgtagccctgcaggagaaagagagaaaagactgaaaatggtatctggtgttacaggacatgatgagatcttcctgtatgacaggtgcattgctgatgggactctgaacttctcctttgactctacaattcagaaatacaagtaaacaacatggaaaagcaaaaaacaatttggctttcttatgagaggctgaacaaccaagattatgtgattttatttttctcttcatagttgattaacttgggctgggcacagtggctaatgcctgtaatcccagcactttgggaggccgaggcgggcggatcacttgaggccaggagtttgagactagcctggccaacatggtgaaaccccatctctactaaaaatacaaaaaaattagccgggcatggtagtgggtgcccgtaatcccagctacgtgggaggctgaggcaggagaattgcttgaacccaggaggcagaggttgcagtgagccaagatcgtgccactgcactccagcctgggtgacagagcgagactctgtctcaaaacaacaacaaacccacaaagttgattaacttattaaattagaatttccaaagtatacatccgtccttttttgaaacaatttgagagacagatttagaattgtcataaattggagctggaaaaagaaaaaaggtctaaaaaccttttctgggtttgggggagtgtgtgctagctccatcatattttaccaatctcttctaaaatattctcagctgggcatggtggctcacgtctgtaatcccagcactttgggatgccgagacgggcgaatcacctgatgtcagaagttcaagatcagcctggccaacatagtgaaaccctgtctctactaaaactacaaaaattagccgggcgtggtggtgggcacccatagttccagctacttgggaggcagaggcaggagaattgcttgaacctaggaggcagaggttgcagtgagccgagattgcaccactgcactccagcctgggcaacacagggagactccatctccaaaaataacataacataacatataacataacataacataacataacataacataacataacataacataaacataacataaaacataacataacatataacataacataacaaataaaataaaataaaagaattctcatcttcttttcctattcatttttcaggaatatgttttcttttaaaggaatcctgttagaagtcatgggaggatactttgggaggctgaggtgggagtactgcttgaggccaggagtttgaggctgcagtgaactatgactgcagttgcactgttacactcctaatagcagcatgtgaaagaaaatgcatttcctcatgtcctcaacaacactgggtattaactaattattattattattatcattattattattattttgccacacatggtggctcacacctgcagtcccagctactcgggaggctgaggtgggaggatcacttaagcccagggattggaggctgcagtgagctgtgaccgagccaatgcattccagcctgggtgacagagtgagaccctttctctaaaaattaaaaaaaaaaaaaaaaaatcatggaaggattctgtctgaatcataacaatggtgcaaaaaagatgtttctccaaggaatataagctgactcttttaaaattaagagatggtgtcatcactctgtcactcaggctgaagtgcaatggtgtaatcatgcctcactgcaaattcaacttccttgtctcaggtgatcctctcacctcagccaggtcctgagtagctggcactactgagtagctggcacacagtaggtgggccacaggcatacaccaccacacctggttgatttttaaattttttgtagagaaggggtcccactatttgcccaggctggtttcaaactcctgggctcaaatgatcctcctgcctcagcctcccaaagagctgggattacggcatgaggcaccatacctggctccagaagtgccttctaatacaatgaagtgcttttctggtattcatgttaaaaatgcatgacccaaaactgaggggcattctacaaaatagctcatctgcactcttaaaggagactaaagaaacacaacaacctgtctctatgaaaagcacaaaaataaataagtaaatcagccatgagcagtagcacgtgcctgtagtctcagatacttgggaggctaaggtgggaggatggccttgagcccaggaggcggaggttgcagtgagccgagatggtgccacggtaccccagcctgggtgacagaatgagaacccgtcctttttttttgagacggagtcttgctttgtcacccaggctggagtgcaatggcacgatctcagctcatgcaacctccacctcctgggttcaagcgattctcctgcctcagcctcctgagtagctgggatcacaggtgcctgccactatgtccagctaaattttttgtatttttagcagagacagggttttgccatgttggccaggctgatctcgaactcctgaccccatgtgattcacccaccttggcctcccagagtgctgggattacaggtgtgagccactgtggctggcctgcgaacctggtcttaaaacaagcaagcaaacaagcaaacaaacaaaactcatgacagtacaacatgtgaacctgtgcccaggtcggggggtggtttgggtggggtatagttcaaaggttattgggataatatctaaaatgtgaatataaactgtgcattagatactgaatcagtattaagtttcttgattttgaaaactgtactgtggtcatgttagagaatactcttaaggcagggtttttcaacctcggtatgactaacattttgggctgagaaagtttctgtttggagggctgttctgtatatcgtaggatttttagcagcatctctggcctcttgatgcagggagtacccctacccctcactgtgacaaccctgccacatgtccccagggaacaacaggaccatggtttgaagtaaagacatactgaaacaaggtgaaggggtgtatctacaatttactctcaaatgactcagagtgcgtgggagtgcccacacacatgcacacaaagaatgataaagcaaatggggcaaaagataaaaaatcggtgagcctgaatctggggtaaagggtatttaggagttctatctggcggttctacaagagtgttccagagactcctatgggttccctctagaggatctgagaggtcacagtacatttattatactactatgacattttcatccttttcagtcacgagtgaaaagaagatttttccagatgcaatatgatgagtgatgatgtgtacatgaaaatgtgacacttggaatatctgtgtaactcagtgaaccagtattttccaaatacgctaaaaaatcatgcatgagtatgagtgcaaggtagactaatggattttaacgaaatagtatcaagaattcactgatatgatttcagattccacactgcaattaacctttaagaaaccaccacttgtttaaactgggggtaggatcaaagaatagccacaagtggctgaaaagactactaaaatttccctcctttttccagctacatacctgtgtgaagagttttcctctggccataccaccctgaacacgcccgatcttgtctgatctcggaagctaagcagggttggcctggttagtgcttggatgggaggaatagatcttgaatttcataaatagcactcagacatctatttttaggcttatttgtaaatgtcttgataaaatgtctgattactgttacatactagggaaaaatctcacttttttgtgtgttatgcttttaagcatagattttgtttgctaaaatgttatttagaattttgcatgtatttttcactggcttgcgatttttctttttatataacatcttttttaaagggtctttattaatattgcactcaagttttcttctgttttctatgctctgaattcaagcagttaaaatccatgggaaagagttttccttgacatttttgaagaactatgcatgtaatattatattgattattaaattgattaaagcctgaaaaaaaaaaaaaaaagagttttcctcatgaacttaaaccaaaacaacatatttgacagactgaatgcagaaccagatgagaatccaactgtcttctattaagccagacattaaagagacttgcaaaaatgaaaacaatgccactcttctcactaaaaggttgtttttcgttttgctttttttaaagacagggtctcaccctgttgcccaggctggagtgcagtggcgtgatcacggtacaccgcagcctcaatttcctgggctcaagaaaatctcccatctcagcctcttgagtggctggaactataggtgcacaccaccatgcccagctgattttaaaattttttgtacagatggcagggcacagcagctcacacctgtaatcccagcactttggaaggccgaggcaggtggaccacaaggtcaggaggttgagcccatcctggctaacatggttaaaaccctgtctctactaaaaatacaaaaaaattagccaggcgtggtggcggacgcctgtagtcccagctactcgggaggctgaggcaggagaatggcgtgaacctgggaggcggaccttgcagtgagctgagatcacaccactgcactccagcctgggtgacagagcacgactccgtctcaaaaaataaataaataaataaataaatttcttttttgtacagagtctcactatgtcaccagggctggttccaaactcctggtgatcctcctgcattggccttccaaagtgttgggattataggtgagagccatcatgcctggcctcactaaaacgtttttattgtagaaaataaacttattcttaagaaaaacatgtaatttatcttaacatgtagtgggtttactatttaaaaattaattaatacattttaaagtttcatattgtaggccgggtgtggtggctcatgcctgtaaccccagcactttgggaagccgaggcgggtggatcacctgaagtcagaagttcaagagcagcctggccaacatggtgaaaccccatctgtactaaaaaatacaaaaattagccgggcatggtggtacacacttgtagtctcagctacacgggaggcgaggccggagaatcatttgaacccgggaggcagaggtcgcagtgagccaagattgagccattgcactcaagcctgggggacaagcgccagacttctctccaaaaattaaaaaaaaaaaagtttcatattgtaaataacaatagatataacctacgtaactaaaaaaaggtgtgtgggtccttgactttttttttttttttgagacagagtctcactctgtcacccaggctggagtactgtggcaagatctcggctcactgcaacctccacctcccaggttcaagcgattctcctgcctcagcctccaagtagctgggattacaggtgtgtgccaccatgcccagtgcattttttgtatttttagtagagacagggtttctccatgttggccaggctggtctcgaactcctgggctcaactgatccacccgcctcggcctcccaaagtgctaggattataagtgtgagccaccatgcccagctggtccttgataatttttaacaaatgtaaagggatcttggctgggcgcagtgggtcatgcctgcaatcctagcaatttgggaggctgaggtgggtggatcagttgagcccaggagtttgagaccagcctggccaacatggcaaaaccctgtccctacaaaaacatacaaaaattagccgggcatggtggtacacgcttgtagtcccagctacacaggaggcaaggctggaggatcgcttgaggagggggtggctaccagcctgggtgacagagagaaaccccgtctcaaaaaaaaaaaaaaaaaaaaaaagccaggcacggtggctcatgcctgtaatcccagcactttgggaggctgaggtgggtggatcatctgaggtcaggagtttgagaccagccaatgtggtgaaaccccatctctattaaaaatacaaaaattaggcaggcgtggtggcaggtgcctgtaatcccagctacttgggaggctaaggcagggagaactgcttgaacctaggaggccgaggttgcagtgagccgagatggtgccgttgcactccatctgggtgacagagcaagactgtctcaaaaaaaaaagaggctgggcgcagtggctcacacctgtaatcccagcactttgggaggctgaggggggtggatcacttgaggtcaggagtttgagaccagcctgaccaacatggtgaaaccccgtctctactaaaaatacaaaaattagctgggcttggtggcatgcatctgtaatcccagctacttgggagactgaggcatgagaatcgcttgaacctgggaagcagaggttgcagtgagccgagatcataccactgcactccagcctgggtgacagagtgagactcggtctcaaaaaaaaaaaaacagaaagaacaaaagaaagaatgaaccaatgaaagaaagaaatgtaaaggtatcctgagacaagaaggtttgagaatggctaccttatacttttcttgcaacttttatgtttttagacagagtctcactctgccacccaggctggagtatagtggtgtgaccttgcctcactgcaacctctgcctcccgggttcaaacgattctcatgcctcagcctcctgagtagctgagattacaggtgtccaccatcatgcctggctaattttttgtatttttagtagagatggggtttcacaaagttggctaggctggtatcgaactcctggcgagtaatccacccaccgcggcctcccaaagtgctgggattacaagtgtgagccaccacacccagcaacttttctttaaaaaattttttttctttcctaaacaagctaaaacagcgcaagttttctgaaagctgaaattctataaaacgttacaaatatgtacacagagtgctctagcttctcaaaactgggacaatatgagtttaaaaaaaaaaaagaaagaaaattaaaatggagaacacataaaaaaaaaatcctgggtctgcaatagtgttttaaaaacaaaggtaggatacagaggaagagaaagggtaaatgggaaaaatcttcataggagaattctagctaatacaagtaaaagaaagaacaaatttagaaaattaccattttataacctccagtatgataactgacagaagtgagtgctgaaccactgggggaaggctgctgggaaacaaggatggccatcctggctaacatggtaaaaccctgtctctactaaaaatacaaaaaaattagccgggcgtggtggcgggcacctgtagtcccagctacttctgcaccgtcttcaggaatctgtagtggtcgtgttagaaacgtgcaagctacatctcatcagaaagaactcactggaggaatccacaatgtgaaccactctgtgaaacaactgatctgtacattgcaaagtactgaatgtcttaaagaagagaggaagggcaagactgttctagactaagaataatgcatgaaacaattaaatcatgtgttgaaaacagagttacctagacttttttgggaggatgggatgtcatggaattaatgctgatcattttatgaaagggtaagggtactctagctgtgggaagaacaccttccttgtaaggagcattagtatgccccaaagggtctaggagtgaagtgttatatgttggtgaagtgtcacatggtctgacaaaagagaagagacagaagaagaaagagagagagaaaggaaagagtaagagagggaaggagggataagaaatatgacaaggtgttaatagctggagaaccaaggacaggggcatatgggtattcactctactctcaatttttctatgggtttgataattttctacattaataaaaataaacaaaatgaagacaactgctagaagtaacattctcaggctacaggtatcgcaaataagaaaaaaatgaacactcaattttcactttggtgaccctgcaagtagaaggaaaagctggtcatcttgaagaacaccctctctggctacttctccctggagggtaatagagaagtggagacagtggcggcgtctaagtcagaacggagactgcaagaccaagccacaccaggacaaaggcacaccaacagctccctttacaactggcactgaacactggcatgccaatgctccttgtttagaatggctgtcacgtggccagtcagagaaagaacctgttgtgtgggattatttgtgatatagaattacagagaatcaacatggcattttcttctctgaaacatctgttacaccaaatccttctttataatggaatttatgttaatgagattttacttttataactaaactgaacaaatgtaggatatcaagaaaaactaaatgctttaaacaaattccatttccttatgaaaaaatctaatagcttatctgtactagtaataaaggatggaggaagaaaaagaagactataagctaattagacctgttctttcatttccactaagcctctcaggactatttctggttcctgggccctagatacaagatccaatgtctatttttattgcttttcttcaagtatctttacatgacagcagagggaactgtgtttaagaatcttataatcctgagatactagatacaggtagtatgtcaggcctacttaactactcaattttcacaccttattcatatattatttgcaaataacagaaaaatactgaatctcaatctccatagcagccctcaatttttgcctcctggctcataaacccaacaaaaaatgtcagacttcacttttctgggcttttgtaaacttattcaaccatttcttatgaccaagacacagaccttgctagtagagtgtggatgagacctggatgcactctctatagccactcacagatgcagaggaaagcacttcatttggaagcaggaaatcacgtaatttcaaaagaatccacggcagttcctactctgtccacatttatgttttcttcaagtacaacaaattacaatataattctgccgaagagacattcttcattatcagataaatttgacctttatagaatagccctggcccatgttcacagaaatacacattactgaataacctctacaacaaacccagcctgcacctaacagtgacagcgataggtaggacttcaggacagctgtccaaggagtgaaacacagaccacttatggtaacagtgactggagaggcacaccccctcctactctacaaccgtcagcactatatcagctgaggtagagaggctgagccctagggcccagaagttcaatgccgaacaaaatttagacagcaccttggggccaggtgtggtggctcatccctgtaatcccagcactttgcggggggcgtggggggtgctgaggtgggtggatcccttaagctcaggagttcaagaccagcctgggcaacatgcgacataggaagacgccctacttttacaaaaaaaatttaaaaattagccagatgtggccaggcacagtggctcacgcctgtaatcccagcactttgggaggctgaggtgggcggatcataaggtcaggagatagagaccatcccggctaacacggtgaaaccccgtctctactaaaaaatacaaaaaattagccgggcatggtggcgggagcctgtagtcccatctacttgggaggccgaggcaggagaatggtgtgaacccaggaggcggagcttgcagtgagctgagattgtgctactgcactctgcctgggcaacagagtgagactccatctcaaaaaaaaaaaaaaattagccaggtgtagcggtgcactctgtagtcccagcaactccggagactgaggtgaggagggtcacttgagcccaggaggttgagactggtaagccgtgatggtgccactgcactccagcctgggtgacagagtaacaccctgtctcaaaaaagacagcaccttgtctctggccagacaggcaaactctcaacgcagagggagacttacggcttactgcaatgcattcagaaagttctcttacttactggatttctttttatgcaaacttcatccttaccttggaattcaacataatttctggagccctgtaccaacgtgtggccacatattctgtcaggaaccctgtgtgatcatggtctggatctgcaacacgggccaggccaaagtcacagatctaagagagaaaaaaaacaggataacttcttagaaattctaacctttcatatcaaaacatcacaaaaataaaaaaggcaataggaataataatgctactaagtggcagatactttctgggcattctagaaaatcattatttaattttcccaacaacctgaaaagcaatcaacatgttagagaccaggatgcaggctgaagaagtctttacagagcacactttaagaagcatccctacctttcattatctgcttagcacaaagcaatctcaataggtgaattgacaaaaactgttctgagtagtcaccaaaaccaaccagtacccttttctcagcctgtcctgctggagctctcaggactgctgtgaagatctgcactggccttctattctcagactctactttctgctagtcttctacttagtctataaatataagtatttccaaagattcttcccacttccttcttctaggtagtcaaacctactcccaaagctttttttttttaaagtttcatatacttaagaatattttatttttaaaaaatacatagtttctcattttctccggtctcaagcatctactggcctttcatcatctggccctccaatatcatggtgtggcttattttctatttttagtagagatggggtttcaccacgttggccaggctggtctcgaactcctcacctcaggtgattcaaccacctcagcctcccaaagtgttgggattacaggtgtgagccaccatgcctggccatgatttttttttaaggtctgtcaacactataaaatcaaagactaaccaaatttacatgacactaatcaatacaatgccaaggctacaaaataaaaaagcagtagtactcagtataattccatacaaaggaaaataaataaggatatggtacaagaaaatataccttttgggctgtgtaaattcagattttcaaaaacaaaggatgccccaaagacgtgtttcatttgtatctatcagagtctttctttcataggcatagccagaattttcacatgttgtgatcccagcatcttgtgactcctactgggatttctgtgggatcagtctagtaaacaagggcacagactagtatagctcacgttccctggtagttacactagaaatgtgctagcagagcctccaaatagggtctgtaaccctggtgagttcctgtggtcctgaagaataaagtctacaagagaggatcccggaagggtcctaagatgtcaatgtctgctgggtcttaagcttcataaaataagtgcaaagcatgtttatggaaaccaaaaagcaagcttatttctgtcggccttgactgataacagagccaaaagttaaaggtctaagacactgataatagctgatatcgataagggttcaagatattttggtaagggttcaagagtaaaaaacactgtaacatagaagtcattggatgaaggttgaagaaatcttcttgaaaatctgaaaggacctaaataacaggaggtcagtgacgctgcaagttacaaacttcctaggccaaggggcctgtgggaataggcatcatggtcacatggcactgaggatgtgataaatgtgcagtgatcccagagctccagcaaacacaagtcctctcctcatgtggtgttctcaactgtcatatgcacactgaactgccactgcctcttgccctgctttgacacgctcactgtaacaaatcagtgacataccatactcatctttgaatgagattctctcttctcgcatttatacccatgagaatgatgcacacacattgctgtatacttttttttttctgagatggagtctcaccctgttgcccaggctggagtgcagtggtgccatctcagctcactgcaacctctgcctcccactgattctcgtgcctcagcctcccaagtagctgggattacaggtgtgcgccaccacacccagctaatttgtttgtattttcagtagagacagggtttcaccaagttggtcagactggacttgaactcctgacctcaggcgatccgcctgcctcagccactcaatgtgttgggattacaggcgtgagccatggcacctgactgctgtatacttttaaaatatcagtaaaggccgggtgtggtggcaaatgcctgtagaatcccagcactttgggaggtcaaggcgggcggatcacgagatcagaagttcgagaccagcctggccaatatggtgaaaccccgtatctactgaaaatacaaaaattagccaggcatggtggtgggcacctgtaatctcagctactcaggaagcttcagcaggagaattgcttgaacccaggaggtgaaggttgcagtgagctgagatcatgccactgtactcctgggcaacagagcaagactctatctcgaaaaagtataaaataaaaataaaaataaataaaataaaaataaaataaaataaaataaaatgttagtcaatttgttatgcttctgattctttgtgttaacttgggttttcaagacgatgcctaaattatgccacggccaacaactcgtgtgtgtgagtgtgagtaggtgaacagaatggccttaaagacaagtccataaactgggaagagacaacagagagagtagtctggttctatttgttttattcttaaagatgaacactttcaagcaaaaataagagccaattcttcccagaaatgttatatgcttaaaatattgattgagaatgtctctccaaaaacaaaagcaatctgccataacagggctatgatgataaccaaaagaaaaaaaaaacacgaggagacataaaaatattcactgcaaattttcaagacaatcattaagtgccaaagaagtagtacagccatcctaaacatagctttattcgttttgtgcccacctgactcttggttgcactgatccaggtaaaggagctggttccatcccatgtggaaaagacataaacctgtatcagaaggatcctaagaggggacagagtccaatccacacaatatctgatgaaggaagctgtcctttacatctcactggacattggccaccgtgttcacccaccgtgacaaaacccaccgctttttacacacagttctagaaggttccccacgatctacttgcaaccaacctttttagcttagtgtcgatgactccctattactcatccaatgctgcagccacagggaggaagactcagtgctttcggtagtagtcccttccttcttattttatttctgtactctctgcctatgataccctatgtccaatagagccactggcctcccgcaagaaaagctacccaacctcgagggccggcacagataccaccttcttcctgctgcctcccagtcccagccagcgctagcccacctctctcctttgcatttgtacaccatctttttctccatctcagttacagaacatctcattataatcacctactgtctaccagatttctgatctatcagttttcagatttcaagggcagaccctcatctctcttgtctggcgtatctcaaagggcttctcataggagtgtctgttgaactgaaatccaataaatgattattgctatacatatatatgtacttaagcagctttattaacctataattcacacaccatacaatttgctcatttaaagtgtataactcaatggttttagtattataatggtggaaattaaccattaccaccatccaatttgaaaatatttttataacctcaaaaagaaattccagtgagttagtattccttccttctttattctcccaactcctctagccctaggcaatcagtaatccactaattctaatttttgtctctatggatttgcctattctagacatttcacgtaaacagaatcatacaatatgtgtcttctgtggctgccttccttcacagacatgtttccaagattcatccatgttgtagcattatcagtacttcactcctttctcttctactgtgtggatccaccacactgtatttattcatcatcagctggacatttggattgtttctacttactggctatagtgaacaataccactatgaagatttgtgttcaagtttttgtatagatgcatgttttcattttcactaaggagtggaatcctcaccaacacttattatctgactttttaactacagccatcctagttagcatgaagttgtttcaatgtaattttgatttgcatttttctactgactaatgatgtcaagcatctatcattccatgtgcttattgccatctgtatatcttctttagagaaatgtctattcagatcctttgtccattttttaaactaggctatttatcttttcattattgagttataagagttcttcatatattctagttttaagtcccttatcagatgtatgatttgcaaataccttctctcattctgtggcttgccttttcacttttttgatggtttgctttgtagcacaagtttctaatcttgatggaatccacttacttttttcttttgttgcttgtgcttttggtgtcatgtctaagaagctttgcctaacataagattgcaaagatttacttctatgttttctaagagtattaaagttttagcttttaattgagttcttcaatccattttgaatttttttttccttttgagacaaggtctcactctgtcaccccagatggagtgcagtggtgcaatctctgctcactgcaatttccacctcccaggctcaagcagtcctcccactcagcctcctgagtagctgggaccacaggcacatgccaccacgcccagattaatttttttgtattttcggtagagatggggttttgccatgttgcccaggctggtcttgctccggagctcaggcaatccacaggccttggcctcccaaagtgctgggattacaggcgcgaaccactgcacccagccattttgagttaattttttcatctttttgtatgtggctattcagttgtcccagattcatttgctgaaaagactattctttccccagtgaatggtcctggcatccttgccaaaaatcagttgaccatagatacacgggtttatttactgactctcacttctattccactgacctatatgtctattcttatgccagtagcacactgtcttgattactgtgttttgcagtaagttttgaaatcaggaagtgtatcagttctccatatgaatttccatatgaattttgggatcagcctgtcaatttctacagaaaaaaacaactgggggctttgatagggattgcactaaatctgcaaatcaatttggagaatactgccatcttaacagtattaagtcttatgatccacagacatgggatgccttcccatttatttaggtcttcttgaattcctgtgcatttttttagactgaatcgacatcgctccgtcacatctaagatatccataaatttccctcgtttacctgtaacacccattaaaacagaaatatgtaaatgctgcatattttcagaactctgaggactgtaaagaatttggggttttcttatttagttggaatgccttattaggtattaaagtcagtgacgttaagttttctgctgctatcttttgaataaaatttattgaagaaaaatgtcaccaacaaaacatgattttaaaactaacacataaggccaggcgcggtggctcacgcctgtaataccagcactttgggaggccaaggtgggcggatcacaaggtcaggagattgagaccatcctggctaacacggtgaaaccccatctctacaaaaatacaaaaacaaagaaaaattagccaggcgtggtggcaggtgcctgtagtcccagctactcgggaggctgaggcaggagaatggcgggaacctgggaagcagagcttgcagtgagctgagatcgcgccactgcactccagcctgggtgacagagcgagactccatctcaaaaaacaaacaaacgaacaaaaaaactaacacataatgtacgtgatcctgtttatctatataaagtataaaaatacacatgtatgcaagagcatagaaaatactttgggagaaaatacactttgttttttaggacagagttttgctttgtcacccaggctggcgtgcagtggtgtgatctcggctcactgcaacctccgcctcccaggttcaagcggttctcctacctcagctcccatgtagctgggattacaggcgcatgccaccacgcccggctgatttttgtatttttagtagagatggggtttcgccatgttggccaggctggtcttgaactcctgacctcaggtgataaggcccaccttggcctcccaaggtgctaggattacaggcgtgagccaccgcaactggccaccaatttgttatagtagttagttatcacggcctggtgctgtggcccacatacataatcccagcactttgggaggccaagaaaggaggactgcttgagcccaggagttccagaccggcctgggcaacatactaagactctgtctttaagaaaaaaaaaaaaaaggtatctctggggagaaaggagcaatgggataaggaagaagaagaggactaccacactttattagcatttttgccataaacatgtttttgggtatttctggtgtaatttaaaatatgaataatgacaaatataactatgcttcagtgaaagggtttttcaatatatatcaccttaatagtaaataacctggctgaccttgagatcacaggtggtgttgagcagcaggttggaaggcttgaggtcacggtgcagaacgttagctgaatggatatattttaaccctctgaggatctggtagagaaaatagcagatatggtcattgctgaggtgttgtgtcttcaagagcttgtaaagatctgtttccatgaggtcctgtactatatatctgtttgcacaggttaaggtaaaacaccaattagctggtcacatttagcaaagcattgaaaacaaaaatgcatcctctcttgactctcttcccaaacagtccatcattacaccatgaagcccttaaaggaaagaagaaactgaggaaaacttggtttccttcatggaaagaatctgaagtcgttaactccttttaggtcctgtgagatggcaggcattccagcattacatctgactgatgcggctatgggcctagactgagatctgaaacaggctgttagggaaattctggtcaatcttgaagtctcaacctctttgctctctaaattgtccaccatcaacgaaccccctccaaggtttgctggaaacactgttagcctgtaagtagcagatactccctcctctgtttggtccagtaacctgtaatgtcactattctttttacttcttgttgccgctcccctcctctcccaagctcctcaaaagccaaacataaaacttccagaaatacaggtctagaaacatactcttactagtaaatccaaccctaagtctattttcttgactcttccattactgttaagatcttaaataagtaagactatgggcaagtcgttctaagaaggggtttgtgctagttttcctcctcatgctttcttgcctggtcacgtacttaactacctaaaagtttagctatggctactttctttctcacagaaattaaattattaaagcatttagcctttaacttcatcatagtattatttcattagcagtatttctacatttcttttactcacttctgtgtaaacactagtctctgtttcttacagatttatgctataggaggcgcagcatgggattcaaaggaaacatgatttaaaaatctgtcatctgagagaggcttattttcatggcaaaaagtaaagcaggaccaacaggtggtagtggcaggaggcatttcacttcaaatatcactacaacttattaacagagctgtttaaaaatggaaagggctgcctagaaacagcgagctcccgcaccctggaggggcggaatacaaattgggtaaactggtaggagtgctgtataaccctttcccttctggcagatcctcttcagtatacttaacctctctatctttcaaatggagcctttacccaggcagcatcctctagatctgttcagtccagatttctaaatgttggtcagagttaatcacataatttcagacctcagttgaccttaaagatcatgacgaccagttccttcattttaaaggtggggaaactgagacctaaagtggtaacctgactcttaagatcaggacagtcctgatttcaccaggtagatagccagggcaccctctttcttagtctactactgatcttccctttaccttttcatcatcacaacaaaccatcccttggacagaagaaacatgactgcaaacagagttaaccaagattttccatgactagacttagggagtaaatagcaaacagattacgattttccctttagcatgtttaatgcacttttcctttaagttcaggaaatttcaagttctatttactcaacaaggttaccaagcagtggaattggccagttgcctaaaaaggatacacatctttcatttgctcgatggttggtgctcgaataatgtcattgattccaatgatgttctcatgtctgaagcgcagtaagatttttatctccctcagggttctctggcagtaggtctggtgctcaaaggggctgattttcttgatagctactcgaactttgttgacattatcataagcagagcttaaaaaagagagagagagatggcattaaaaacagccctcagaatatttgaagaaggcaagttggtaaagtattatatttttaacactgtgtaaacacctgtttcatacccgtgaaggcagcatgtatattatccacaaaaaggcctcaagctagggaggatggatgcaactgacatgagagagcacacagtgactctcaaaactaacagagaacctagccctgttaactgggtgaaagtcttgcctttataaacccagaaatacacaaacaagcattctcccattgtcttaaacagcaactgcattctggtgagagtaatcacttctgtctctgaaacaccttcttactgttgtatcaaattcctctgacacagaagaaacattcaaataacctacaactgtacatctttatccctaacaaaaatggacccaagagaacaccttgattacttctattaactttgtttctctcacttgcaaaacaacatgaccatttcttcccccaagaaactgaatcaagatgtttgggtagttttataacaaaacctagaaaagtattcttcaaaaaacatatttgtggcaataacatggggcccagttctttcctagttgtccttaatgtctgataaaccagaattataagcaaaagcaataataaaaattataccttcaattttatgaatttgaatcttgagtattactactatctttatgataaacattctattacaatcttgtgtataagaaattttcatattaataaatgtcaacatctggcccactgaccaaagcaatcaaataacattgacaggcagtaagacaacatttcttgtttccttggggtaagtgctagaatagaaagcagtaaaataactttattctaaaatttatgcttctagggccgggtgcagtggctcacacctgcaatcccagcactttgggaagctggggcggctggatcacttgaggacaggagttttgagaccagcctggacaacatggtgaaaccccgcctctactaaaaatacaaaaaaattagccaggcatggtggcaagtgcctacaatcccagctacttgggaggctgaggcacaagaatcacttgaacctgggagatgcacgtggcagtgagccaagattgtaccactgcactccagcctgggcgacagagtgagactccgtctctaaattaaataaagtttatgcttctataatatttatcagtctactaatcctaagaattattgatacatttgtctgattctatgacaagataatgctctggaggagaactttgtcttactaggatccaattatcctacaacaccattaacatatagtacacaggtggccccaaatgctttgaaatgaagtatattttcttaagtaaaataaccactactcaaatcttattttgctttggtttggtacatgaggccctaagccagtgattttcagttaggcaacagcatatataatagtaataatttaacatagtattaaaaagcatatataataagcaagcttattcaatattgggaatatttttagaaaaaaattctattttggtaattcaaatcatagaacaagagttcaacaacagcacggattagttataaaatgctggtttaaactcaacattacaattttctagtgttaatattataaatttctagtgttaacagtcacaagtggtcataatttgttctgcaaaattataatccaacaaaatttttggagagaggagtttatggtcagtgtgcccctctactgtatcaacactcagtgacgaaataactgccctcccccccggcctctttaaaatttttttgtggaagcagtctcgctctgtcgcccaggctggagtgcagtggtgcgatcttggctcactgcaagctccccctcctgggttcaggccattctcctgcctcagcctcccgagtagctgggactacaggccccgccaccacgcctggctaattttttgtatctttagtagagacggtgtttcaccgtgttagccaggatggtttcaatctcctgacctcgtgataggccccgcctcggccttgcaaagggctgggattacagggtgagccaccatgcccggccaactgcctccttttaagtaagaaaatatgagatcatcctcatctggtcccacttgaaaaaaaggagttttgtctgttcctgtctgctccgcttaaccattctgctgcctttttggtttatgcaatctatctttcatagaactgatgacaaagagggttacactcttccataatgattccatacttgctagtttctccttggatttctcggttttgttttacatattttattgttgatacttggtaaataaggcataccatgaactttcaggtgtctataaacatttatgctttaaaatcactttgacattaccaactgtgtcttgttttgctcaaccccttttgtccctaactaccaccacactacaggtttttgctataagtgtgtctcttatcacaggaatccaaagatggttcattaaaaaagaaggccgggtgcggtggctcatgtctgtaatcccagcactttgggaggccaaggcaggcggatcatgaggtcacggcaggcggatcatgaggtcacgagattgacaccatcctgtccaaaatggtgaaaccccatctctaccaaaaatacaaaaattagctgggtggggtggtgcgcgcccatagtcccagctacttgggaggctgatgcagaagaatggcttgaacccaggtgatggaggctgcagtgagccaagatcgcgccactgcactccagcctggtgacagagtgagactcagtctcaaaaaacaaaaaaaaaaaaagtgggggtcagtcctaatgggtgtgtggtgatagctcattgtggttttgatttgcatttctctgattcatgatgatgaccatcttttcttatgtcttcttttgaaacgtgtattcaacgttatgccttttttttttttgagacggagtctcgctatgtcgccaggctggggtgcagtggctcaatctcggcttactgcaacgtctgcctcctgggtttatgcaattctcctgcctcagtctcctgagtagctggaattacaggatctcctgacctggtgacccgcctgccttggcctcccaaagtgctggaattacaggcgtgagccacccaccacgaccagccaggactgccactatttaaaaacaaacaaacaaacaaacagaaaaccgtaagtgtgatgtggataaatttgaaccttcatactctattgttgagtgtgcaaaatggtgtaaccacttggaaattcctcaaaaaattaaaaatagaattcccatatggtccagcaatcccacttctgagcatatatccaaaacaattcaaagtagaatctctaagagctactggcaggttcattgtgcagcattacgcacaatacccaagatgtggaagcaaccgaaatgtccactatggatgaatggataaagaaaatgtagcatatacatagagtggaatattattcagtctttaaaaaaaaaaaaaaaaccacacacacacacaaagaaattcaattcagcatccaaaaaccatgcctaattgtttttattatttatttatttatttgagacagagtctcgctctgtcgcccaggctggagtgcagtatcgcatcttggctcactgcaagctccgcctcctgggttctcgccattctcccgcctcagcctcccgagtagctgggactacaggggcccaccaccacgcccggctaatttcctttttttttgtatttttggtagagatggggtttcaccatgttagccaggatggtctcgatctcctgacctcgtgatctgcccgccttggcctctcaaagtgctgggattacaggtgtgagccaccgcacccggccaattgtttttaatttaaaaactttttggtagatatggggtctcactatgttatccaggctggtcttgaactcctggtcataagtgatcctcccacctcagcctcccaaagtgctgggattacaggcatgagccattgtgcctggtctgacttaatattcttaaagtgtctacactactcagtgtggtctgcagagtcaatgtaatccctatcaaagttccaatggcatttttcacagaaacagaaaatgtaatctttaaattcatatatggaaccacaaaagatcccatatagccaaagcaatcctgagcaagaacaaagtggtggcttcacatcacttgatttcaaaatacactacaaagctatagtaaccaaaacagcacaacactgcggggatagggtgaaatgtgcagataatttgttagagtataaagtttcagttaaccaggatgaataagttctagagctctatcctacagcatggtgactacagttaataataatgtattatatacttgcaaattactaaaagattagatcttaaacattctcaccacaaaaagtatgtgagatgacagatatgttaattaccttgctttaatcatttcacaatatacacatatatcaaaacatcatgttgtatatcatgaatatatactaattatttttccagcacttccacctcagtttcatatactaatttgtatttgtcaattataccttaataaagctgggtggggggcagggaatcagcatggtactggcataaaaacagacaaatagacaaatggaacagaataaagagtccaaacataaaggatagtctcttcaataaatggtgctgggaaaattggatatctacttgctaaagaataaaatggatacttatttcacaccctatacaaaaatcaaatcaagacagattaaagacaaaaattgtaaaacctgaaattataaaaactagaaaaggctgggcgcaatggctcaccctgtaatcccagcactttgggaggccaaggcgggtggatcacgaggtcaggagatcgagaccatcctggctaatacggtgaaaccctgtctctactaaaaatacaaaaaaaaaaaaaaaaaaaattagccgggcgtggtggtaggcgcctgtagtcctagctactcgggaggctgaggcaggagaatggcgtgaacctgggaggcagagcttgcagtgagctgagatcgtgccactgcactccagcctggatgacagagagagattccgtctcaaaaaaaaaaaaaaaaaaaaaagcaaaagcaaacaaataaacaacagacaaacaaacaaaaactactagaagaaaatacagggggaaagcttcttgacattggtctgggcaattattttttggttgtgactcccaaagcacaggcaacaaaagcaaaaacagacaaatggaattgaatcaaactaaaaagcttctgcacagcacaagcaacaatcaacagagtgaagagacaacccaatgaatgggagaaaatatttacaaaccacatatctgataaggggctaatatttaaatatataagaaattcacacaattcaacagcaggaaacaaacaaaatatttaaaaatgggcaaaggccaggtgcagtggcacctgcttgtagtcctagctattcagggggctgaggtaggcagactgcttgagaccaggagttcaagaccagcctgggcaacatagagagaccctgtctcaaaaatggaaaaaagcaggtgcgggtggtagggagtgggggcaaagaacccgaatagacattactcaaagtaagacatacaaatggccaacaggtatatgaaaaaaggctcaacatcactaatcagaaaaatgccaatcaaaaccacaatgagatatcacctcacagctattagaatggctattatcagccacctacggtggctcacgtctgtaatcccagcactttgggaggccaaggcaggcggatcacctgaggtcaggagtttgacaccagcctggccaacatggtgaaaccctgtctctactaaaaataccaaagttagccaggcgtggtggtacgcgtctgtagtcccagtttcttgggaggctgagtcaggagaatcacttgaacccaagaggcggaggttgcagtgagccaagatggcaccactgcactccagcctggacaacaagagtgaaactgtctccaaagaagaaaaaaaaaaatgttcttgcccccaccacacacaaacgttaactatgtgagttgatgggtatcttaattagctttactgtggggatcatttcgcaaggtatacacatatcaaaacatcacatttaacacagtaaatatatacaacttttatttgtcaattatgccccaataaaggtgggggaaaaaccaaaaaggtcattctatcacatgctataacatggatgaagcttgaggacattatatcaacagaaataagtcacaaaagacaaatactgcataatttcacttatatgaggtatccaaaattaacaaactcatagaatcagaaaggagaatggtggttaaaaatggctgaggagagggagaaatggggagatgtgttcaagagtacaggttttcaattttccaagatgaaaaagttctagatctattgtgcaacaatgtgaatatacttaactctactgaactgtgtacttaaaaatgattaagatggcaaattgtatgctttttaccaaaacatataattaaccaaaacaattttactttgtaaagagatgaagtctcggctgggcacggtggctcacgcctgtaatcccagcactctgggaagctgaggtgggtggatcacgaggtcaggagatcgagaccagcctggctaacatggtgaaacactgtctctactaaaaatacaagaattagcagggcgtggtggcacgcgcctgtaatcccagctactcaggaggctgaggcaggagaattgcttgaatccgggaagcaaaggttgagtgagctgagatcacgccactgtactccagctctgggcgacactgcaagactccatctcagggggaaaaaaagcgagagagacagagagagagagagagagagagagagagagagagagagagagagagagagagagagatgaagtctcactatgctgcccaggccggtcctgaactcctgagatcacttcctcaggcttcagagtagttgggactatacgcacatgccatggcacctagcttaaaaaaaatttttttaagggggaaagaaacatgttaaagagggaaaaaaattaagtattaatttttttttgatggagtctcgctctgttgcccaggttggagtgcagtggtgccatctgggctcactgcaacctccgcctcctgggttcaagcgattctcctgcctcagcctcctgagtagctgggactactggtgcccgtcaccacgcacagctaattttttgtattttagtagagatagggtttcaccatgttggctaggatggtctcgatctcctgacctcatgatcctcggcctcggcctcccaaagtgctgggattacaggcgtgagccactgcacctggcccttttatttcttttgagatgggctactctgtcacccatgctagagtgtactggcacaattatggctgactgcagccccaacctctcaagtagcatagtggggaccacaggtgagcaccaccacacctggctaattttaaaaagtttttttgtagagacagggttctacaatgttgcccaggctgatctcgaactcctgaactcaagtgatcctcttgccttagcctcccaaagtactaggattataggcgtgaaccaccacacctggccaataaagggggaaacttttatccagctttgggttagtaccttctatatatcaagaactattctaacattaggacgcaaaaattataaataatactctgggctgggggtggttttcacatctgtactcccagcattttgggaggccaaggcaggcggatcatgaggtcaggagtttgagaccagcctggccaacatggcgaaaccccatctctactaaagataaaaaaaaaattagctgggcatggtggcatgcgcctgtagtcccagctacttgggaggctgaggcaggaaaatcagttgaacccgggaggcggaggctgcagtgagccgagactgcaccactgttctccagcctgggcgacagagctagactccatctcaaaaaaaaaaaaaaataataataataataataatactcttcccttgaggaacccaagatattgagagtgtctagtcatcttaaatgaacacaacctcaagtcccagatgaattctatcctaagacccataaattatggagaatgggaggacattaaggtctgaagtgagcacacccatctcaagtctcaaaacagatagattcctgctatttgataataaaaggaaatgagattcctatttgataataacaggaaatgaactattgatatatgcagcacagatgaatctcaagtaattatggtgagtgaagccagaccaaaagaaatgtatttccatctatagaaaatacaaagtaatcctgggtttactttggatttacccccaggattgcctgggaatgggaggaagaagattgcaaatggaaatgaggtaacttttggaggcaatgagtatgttccttatcctaattgtgttgatggtttcataggtgtataatgtattaaaacttatccaactttatactttaaatgtgtgcaatattttgtatatcaattacttcttagtaaagcagttaaaaaaaaaaaaaaagaaccagggttctttggccacatgattcattccagtgctggggcaattgggatacagattctagaagtgtaccgatcaataaacgtagaagtccatgaaattctgaagtagattatttaacagatgttttatgattgcttagggaaggaaagggaaccagcatgagtcaattatgaacaagtcatgctaaactagctttatttcctgttttgatagggttaccacaacaacacgaaatgaagacagagttctggtgaattcaagccacgcttgtcaagaacttcccatttgtgaggcttcatgttaggactggtggcaaaaacaaataatgatcctgctcttaagaaacttgcaattttgtgagagaaggagacaggaacagagaacatactttgccttttatcacattaaagcacttctgaaacccaaggaggagctgggttaacttcaaatactaagggaaggattaaaagaagatgaggcccgcaaaagccttatcctgaaggatgagtaggcttctgacagaaaagcaagaccgcaaagaaaagaaagaggaaacaggaggcgaggtaagagactgagacatctgtggtcactggccactaaccctcacccagacatgcccatgcccatgagagaaggttattggggtcggggaaaatgctcctcaggtgcccgggaattccctgcatctggaaaagtgtagtctgtacccagcaggtgcacttgaggtggtggtcaaaggggcagctgcttgctggcgtgtattgcacctacattgtgcaggcaggaggccacacacgtgctcaagctcacaacacatggatagtgctgtggctgggaagggaagagcactatgctgaaggtctgctctgccggaactactgacatagaactctaaggagcctgagtattttctatttgaacccaaccttccaggtcattaagaaggtatattaggcctggtgtgggcatggtgatgcacgcttgtaatcccagcactttgggagggtgaggagggcagatcacttgaatccaggtgttcgagatcagtgtggacaacatgatgaaaccctgtctctacaaaaaatacaaaaattagctgggcatggtggcactcgcctgtagtcccagctatttgggggactaggcaagaggatcacttgagccagggaggttgaggctgcagtgagccatgattgtgccactgcactccagcctgggtgacaaagtgagaccctatctcaaaaaaaaaaaaaaggaaaagaaggcatatctgtcatggcaggaggagagagcaaagtctgcttaatgtttcttaggttgattttttttttttttaatggtatgtagggctccatttgtattcttgacctagaccttataaacgtgagaggtgggcctgggtctgggaggtacaaaaagaaggtggaggtaagggacaaagatagttttcagcatcctgatttaaaaatctaagaatgcctgtcagtgattcagatggaggagatgacggttccatccttccagcagcatcaggagagagatcaagttgggaattcttaacagaagccacagtgattagcactcctgcagagagagaatttcaagaaaagaagtcggaagacagaactcaggagcagcatgaggatgaggaatcagttaaagaaagtggaaagaaatgataatggagtaagaacctttaggccaggcgccgtggctcatgcctgtaatcccagcactctgggaggccgaggcgggtggatcatgaggtcaggagatcgagaccatcctggctaacacggtgaaactctgtctctactaaaaatacaaaaaaaattagccgggcatggtggctggcgctacttgggaggctgaggcaggagaatggggtgaacccaggaggcagagcttgcagtgagccaaaattgtgccactgcactccagcctgggtgaaagagtgagactagtctcaaaaaaaaaagaacctttgttgtccaactccagaggccatgtagttctgcttaaccatgtagcagaaccagaaaagggtggtgtttcccaagacaaagaaggaaggcatttcaaacaggagagactgagaaaagtaagaactggaaagcattcactgaatctgcatgcaaccagacgatgtgtggtaactttggttcaagtaaggaaatggagaggatggggagaggagcagaaagagtacagccgactactttttaaagagtgatcataaggcaaggataacgaaaaaaacttaaatccaggtgaaaaactgagaggcacaggatgttatgaaagccatggtcgggggctgggggaggggaggctgaaggctgcaggaccgggtagggtgaaagagaaggctccaatggctaaccagggggaagagaagggagagtaaattccaggcagaggagatgtggggcagtggtgcagaggcctgtgggaacctggggcgacagagtgcctgcagagaggcggacacacagggacatgacaggggaagctggagggtgagcaagagccaggccatatttatattttcgtaattttatcctgggaagccaccaaaggatgctaagcacagactttaagcatggcaacatttatatttttataacttttcctcaggtagcagtttgttgaaagaatggaatggggaggatggtgcactgggtcacccggaggcaaggagccctttcagccaactcagaatgaaggggagccacagctctggataaatgggcaaagagcaggctcacaagaaatgggtgcttatttcacaaacctcacatgtcccagcagggtcctgttcaagcagtctccatccaattagatgaaattcctcaaggacacaactgtatgttctaaatagctcatgtcttctttactgcagttgtaaccaaatttgcagggcgggaaaaaaacagtatccttatctgatgcctctcaatgaagatatgacaacaaaaatcctacaggtggccacaaatgccataaggaacaggctgttagccagaagtactttggtcttgacaactcagcttccacctgtcctagccccaagatacatgaaataccagtgggccccaggctcaagtgacccaaggatatttcaaatgtctttttcttttctttttttttttttttaaagacagaatcttgctctgtcatccaggttggagtgcactggcgtgatctcggctcactgcaatctccccatcccgggttcaagtgattctcctgcctcagcctcccaagtagctgggacaacctacaggcacaagccaccaagcccagctaatttttttttttttttttttaagtagagacagagtttcaccatgttggccaggctggtctcaaactccagacctcatgtgatccacccacctcggcctcccaaagtgctgggattacaggcatgagccactgtgcccagcctattctttattcttaatactttattcatttgaaagctttccttttgtggtaaggtacagttcctttcactgatgtttatttgttctatcatttctcataacccccccacccccacatcctgaaggtacttgctttcttgtagaaatacttaggtctgtccgtggccctgaccctgtaaatagggcacttggcattactattgttctccaatgcccacagaaggtcagaaagcaatgaaccaatctgatcctcacagctataccacttccaatacggctaccactttttttttttggagacagagtctcgctttcttgtccaggctggagtacagtggcgccatcttggctcactgcgacctccgcctcccaggttcaagcgaccctcctgcctcagcctcctgagtagcaggcgtgtgccaccatgcccggctaatttttgtatttttagtagagacggggtttcaccatgttcgtcaggctggtcttgaactcctgaccttgtgattcgcccgcctcagcctcccaaagtgctgggattacaggcatgagccactgcgcccgcccgtctcctcctttcaacaccatatttactaccgtgtgaaaagcaacaaatgttaatatggttaatgcaatacacagtactttaaagtcttgtttcttcctatgtgaagacttccgtttttggtgtattttatatgaggcagacatatacactcattagcaatttaagtacattaaaggtattaaaaaacagaattcttttttttttttttttttgagacggagtctcgctgtgtctcccaaggttggagtgcagtggcgcgatctcggctcactgcaagctccgcctcccaggttcatgccattctcctgcctcagcctcccaagtagctgggactacaggcgcccgccaacacgcccggctaattttttgtatttttagtagaaacggggtttcaccgtgttagccaagatggtctcgatctcctgacctcgtgatccgcccgtctcggcctcccaaagtgctaggattacaggcgtgagccaccgcgcccggccaaaaaacagaattcttaggagcttgaggattctgtttcacaaaaaaagactgacagtactcgaaatcaatcttattatagattggtggggtttgtgattaagtatgaagaataagaaatgtccatgtctgcccatgaaatcattttctcactatgctctgattaaaactgacaaacatttaaactgagattaaaaataaattctacacattaatcatttacgcattcactttaaacttgcttacacttactgataatactgctttgtcttagtttatagatgtatattactcaaaatatttacagttcatttattgggaaccaggtaatgatggtattgaaaagaagttatgaacaattctcacttaataatacctacaatttattgagtgtttattatctgtcaggctctgctctatgttagtatctgtggacctctctctaagaaggtggtatttaatggtgccttgaaaagcaggtaggattttaataggcagcacacgaaaaagcacttaaggaagaaggagctacagaagctgaagcacggaaggctgggtaccaggtgctggatagttcaatatggctggagtttacacctgtccaggggaagaacaaaaggtgatgttactaaaaagctgagaaatctgtactttacttcaataacagaagatgaagagtctggatgtggtggctcatgcctgtaatcccagcactttgggaggctgaggcaggtggaccacctgaggtcaggagttcaagaccagcctggccaacatggtgaaaccctgtatctactaaaaacacaaaaattaggcatggttgtgcgtgcctgtaatcccagctacttgggaggctgaggcaggagcatcacttgaacccagaaggcggtggctgcagtgagccaagatcatgccattgcactccagcctgggtgacagagtgagactctgtctcagggaaggcaggggaggggaggggaggggaagggaatcagaaacacaggtatagaactgactgaaggccaggcgtggtggctcacgcctgtaatcccaagcactttgggaggctaaggcaggtggatcacctggagtcaggagtttaagaccagcatgaccaacatggtgaaaccctgtctctaccaaaaatacaaaaattagccaggcacgtagtggcaggctcctgtaattctagctacctgggaggctgaggcagaagaactgcttgaacccaggaggtggagggtgcagtgaaccgagatcgtgccactgcactccagcctgggcgacagagcaaaactccatttcaaaaaggaaaaaaaaagaaaaaaaaaactgactaaagaggctaaaactagacatagggagaccagttataattcttgaaatatctatacccatcaacactttgaaattacagtgcttgttagacctgctgcctgatcttgctatttacggcattagtaaagaagcacatataaagacttcttaatttttcaaaagtggtatttcagcataactgattccctttgtaatctcacattttattttattcatttaaaatattaatctgaaaaggagccacaagtttcaccaactgcctaaaggattcacgtcattaaaaaaaaaaaaaaaagatgagaactcttgttataagggcaatttatagattcagtggaaatggcagagacaggaaactagtacagaagtttgtattcaagagaaaaaaaacgtcagtttgggatcgtaaaggatgtgcatcaaataactttaaaaacatttgaatgttaaagttaattttatttatcaaataatcacctacattatgttaagcactgtggataaagcagtaaaaatataaagctctctgccctcataaactatgagaggagatagacatagaggctgggtgcagtggctcatgcctgtaatcccagcactttgggaggctgcggcgggtggatcacctgaggtcaggagtttgagacctgcctgatcaatatggtgaaactccatctctactgaaaatacaaaaattagttgggcgtggtgccgtgccatctgtagtcccagctactcgggaggctgagacaggagaatcgcttgaacccgggaggcagaggttgcagtgagctgagatcgcgccactgcactccagcctgggtgacagagggagactccatcacaaaaaaaaaataagagagagagacataggtattaataaacatatttgtcataaacatgactacattataaattatgataattgctaaggaaaatgcaagttatataattaatgttattaaggataactagaaaacttagtttaaattagaagcttacggaagactcttcttctctaaagaaattagggaaggcatttaaacagagaactgaaggataagccggaattagccaggttgctgggtggcaaaggcagcaagtattctacaagcagggagagggtagaccagaagtagaccagaagtagaccagaagccctaagaagaccactgtggctacagtgtaccagagagagcgtggctcacgatgaggcagaagaaatgcgcagtgacccagcagttatgctaaggatttatcttttaagtgtcctttcactttaaactggggaataaaagtatccaacttatattttgtaaatgatcttaccaaataagagaaaaactgaactgtaaaaaggaaaaagtggctgggggcagtggctcatgcctgtaatcccagtgctttaggaggccaaggcaggtggactgcttgaacccagaagttcgagatcaggttgggtaacatagtgagatcctgtctctattttaaaaaaagaaaataaaaataaaaaaaggaaaaagttaaaaaaaaaaaaaaaggaaaccgttccaagcactgccataataccagcaagaggtgactgacagtggcgtggactaagcaacaaggatgtaattggcatgttaagcaggtcagttcagtgttcagtgtgaaaccataccacccactgcaggacatctagcaacccagacccaaggtcactatcaatccagcagcactctcaagtcagtaaaataataatttaaaaaaaaaaaaaaaacacccaccacatctctgaagggagtagtaaagtccttggaatgcgtaagagcagtgacagtggaaatggaaagagacagccaagactgaaagggaaaggctgctgagtgggatccacgaatgagatggtgagcagagcaggccagataagatcatcaaggtcaaaaatgaattgtgcagagaggagaaaaaatttgcaatatgtaggacttgtatttagcatacataaagaactcttaaaacttcaaaacaagactacaaacaacccaatattacaaataggcaaaagaataaacacttcctttgtgacaacaaatatgaaaatatgactgatgagtcataaaggaaatgtaaattaaaaccaaatacccattagaatagctaaaataactgaccaataccaagtgttggtgaggatgcagcaaagttgaaactctcatatacagatgtctgtaggagctttattcctaacagccctaaactgtgtacgacccaaatgttaattaacaagcaaagggtaaacaaactgtggtacatccatacaacaggacagtactcagcaataaaaggaattactactaatccatgcaacaaggacaaatctgaaaaacactatgctaaatgaaagaagccaaacacaaagagaacaaacttttaaatcccatttatatgagattctagaaaagctgaagctaatctatagtgataggaagccgtggctgggtgcagtggctcacacctgtaatcctatgactttgggaggctgaggtgggtggatgacgaggtcaggagtttgagaccagcttggccaacaaggtgaaaccccatctctagtaaaaatacaaaaattagctgggcgtggtggtgtgcacctgtaatcccagctagtcaggaggctgaggcaggagaatcggttgaacctgagagacaggaggttgcaatgagccgagatcgcgccattgcactccagcctgggtgacagagctggactctgtctcaaaaacaaaaggaaagaaagccgtgcttgcctgaggcacaaactgactgcaaaggtacccaagaaagctttttgaagtgatgtaaatattctgtatctttattgtggtggcagttacacaactacatacatttgtcaagatttcactgaacagtacacataaaaagatacattttattgcatataaattatatctcaaaaggtgattttttaaaaatttagctgtgctacaaaattaaggggttgattctctttcatggttcataagctcatattcaaggaaattccaagggaaatgttccaaacaggttttaagtaatgacagtatcattagaataaatgcccagccttccacaatcatttcaaaggctttgacataaaatttctaatatttttaggttttcttcccatcctcttcatcccctgtcattatagtcatgtctcatagcagaggctcaatatttgtggataatatatccaccttatttagacaaacgttattatcatgcacaagcaccatatactgtagcaactaaaatgctacctaacaactgtgaatgggttatttttagggaaagctattaagctgttctctaagccacccattttggtgaactttaattatctgaacacgaaactacagcactctgtttcacagataaaaattatcttgtcttcagatgctaagtaagttagactgagccaaactcatgttccaaaaataaataggtagataatactaatgattgctttaaaagaaaatgtattccttactttagcttggttctctgacaattcactaaccaagaaaaacagtgcaaaggtttttttttttcagatgctgcaaaccattaagtgaactattaaaagctagcctaaggttatttaagcaataaaaccagtaatagcaaatgcttagcatttattcataattttttattattttaagagccaatgttccaatgtactataggtaccatggcttaaaatctagtcattaacaagtatgcaacttctctagaaaaggtgctctggagagcccagagcttgaacaagttttgttggttacatatgcatttgtcaatttcttcagtaataaaacagactaaaagacccagaaaaggtttcaattctggtcctatccctcactagctgagagacactggctgaattacttagtatctctgagtaatcacttgcttggctagaaaatgaggaaagcccggggattgtgaagattagaaaaagcagatgcagcctaaaagatagtaggccttcaaaaaaaagttgtatggtcttttaaaaattattttacttggccgggcgcggtggctcacgcctgtaataccagcactttaggaggccgaggcaggaggatcacgaggtcaggagatcgagaccatcctggctgacacggtgaagccccgtctctactaaaaatacaaaaaattagctgggcatggtggcaggcgcctgtggtcccagctatttgggaggctgaggcaggagaatggcatgaacccgggaggtggaggttgcagtgagctgagattacgctactgaactccagcctgggcgacagagcgagactccgtctcaaaaaaaaaaaaaattattttacttattattattcattacatttatcatgtgataccctaaaaaggaagtaacatcagaaaagaacactgggcttcaaatcaggaggtctgagttttagtcctaactcagctatgccctacatatatgctttgataatgctggccaagttacaaaaagaagattccattatttcatgttcaggctacatccaaacataagcagcacaaaataaaaaatatggataaagagacacactcagttatacaggtgtatgcgcagacactgacatagatgaagacttgtagtgacttatattcagaaaagtttccacaaatttttggtgaactgtggtacccaaattattaaagtatgaaaaacatttctctcttcatgaatgggaaaaatgtctattttacttgatctaagatatactaccaggatttagtactgcgactatccatcatcttaaaaatccataaccaagcagctctgttttacttaaagcatgctagggtagcccaaagtgagacttggtaacagatactatctaatgcaaagcagttactgcttagaagtgttctgaacttgccatgagaaagaaagggagaccctgatgaaatagatggagtatccacttcttgatcatttccctacatttcctttctcctcatttatttcctcccactttcactggaaaagaactttacaatggtctgggtgaggctagctggcagtgagttatgacaacagctagaagtagtatcaacacaaaccaagagcattaagtgacccctgaggtagagtgagaaaataaggaaggactacatttaatcataatgatcatagtcactagcacagtgctaagaacttaagaaaaatccttatatattatcttcaccacaaccctatgaaacataacccctactttatagatgaagaaactgaggcagagtggagggtcaactaacgtgtccatgattacatacctagtagttaacagaactgagattcaaatccaggtgtgctgacccccaaaacccatgttctgaaccatgacactttatataggccaacagtccttggccacaggctcttgtggtgatcaaccaagttcaggttcatcattgagccagattcagacaggtcaactgaaaagaagctgaagaaggcaggcagtaaggacaagaaaaataatcataatgatcatgatatagaaaatgtactgcttcccaaagtagcctatccatttggaaggttctggctatttagatctatttcctcaggataagtcaaaacctgtctttcctgaaataaggtgagtatgtgctgtaaatgaggtgtgggagtatgggagagcaggctggaaggcagaagatgtgaaggcaaaccaggcacagggaaggtgagaaagggacccgaacggggacaagttaaaagaaaacattgaagactcagcagaaagaatccagagatgtttagtgctgccaatcatgacaattaagtgactttctccagtatgtatcagcagtctgagcaagatcagacaaaataaacagtagggttcctatagagtgggagtggagagatcaggagaactgagaatctggtcagagtggggaggtcagcagacagaatccagagcgaggccagagaggaccagcacaccgggaaaacacaaaggtgagggtctcaagccaggggtcgtcagggagagagggcaggatagggagccatggtctagaaaagaggatgatctactttgtcatggtgaccctggcatgcttttgtaagctgtaccccaacgagtcaagtcaaaggaagagaggctcagatgaccacctccgtcactgaaatgtaagagtgaagaaatgcaaatattttctgaactgcctcacttttggaaatattaaacacctgtctcagaaatctggaaaatgactaagatggggaaaatgtttaaacttgcagtatccagtattattatctaaactgaaaagaactgcctgcacaactaagcaggtggtgagatgttacataacagatgctaaactaggtaaagtggaaaaatgtaatacataattataactttaaaatgccagtaagaaaatcttcagtcagctctggaaaactaattttacttcttttcatgaaaaagttgcagttagtttcttttgcaacctgtcatgatagaagaggaattgcagaaggaaaggaagaccctaaacaaaactgataatcattcatctgtatgtgttttaaaacatatgcaggtagttttcatatatggctggtgggaatgcaaactgtacaactcttctggaggggaactgggcaatacctaacaaaattatatatgtgtacatcttttaacccagcaatcctacttctaagaatctactctgaaggtacacctccaatgatatgaaaaaacatatgtacaagattatccacagtagcactatttgtaattgcaaaatactggaaacaatctaaatgcccacacattggaggagactgaagacactatgttatatccacatggagtactatgcagcagtaaaaatgaatgaaaatcattctaagatgtctaagaacagacacagaatgaattccaagatatattgttaagtgaaaaaaccaaagtacaagatttagactatgctatccttcatataagaaatgggcaataagaacatatacatatatctgcttatttgtacaaaagaaatacaggaaggataaaccagaaactaaagagatcagctacctacaggggataggtgggaaagggataaaacgaaatgggaatggatggtagggataaggaaggagtgatatttctctgagtatatctttgtgtatagatgactcaaaaccagagtaatgtagcgcataccaaaaaaattaaagaacccagaatacaaacagtaacaagtgaatctaactgcgttacaaaggaataacataaccacactgaagggcatgaggaagaaactttgaaaacctattttgactggatattgtaaagctaaaggcataaagaactgtaacacaaatgctgctacctagtaagtaaatttgtttctcacaaagatgtgagttagcaattctgacactaattcatgtagacagtggtactgactgaaaaagtaagtttaaaaaaatgaaggataatgacagccaggttggcaaaataattacaaataagagggaaggctaaaataaaccacacagtgttggattagaatgagatatcagtatgaactcataatttctaacatatacacagacatacacagaaataaacatagatacatgtgtaatatgtagctgagtatacataagcctattttcctagttctgtctgctgagaagacttagaagcagtgacacccagtagcaatgagcacacttaaaagcatattgacagccaggctgtaatcccactttgggaggccgaggtgggtggatcatttgaggtcaggagtttgagaacagcctggccaacatggtgaaactcctcttttactaaataaattcctttactaaataaaaaaattagccaggcgtggtggcgggcatctgtaatcctagctactcaggaggctgaggttcaagaatcacttgaacccgggaggtggaggttccagtgagccaagattgcaccattgcactccagcctgggcaacaagagcgaaactccatttcaaaaaaaaaaaaaaaaaatacaaaagcatattgaaagggcctagaggccaacctgaaagagcaaactaaagttgaaattgtaacaatctgagcaacaaaataaatcacagtattagactaaatccatagaataaaacacatatccatgcatccacacctatataaataagtgaataaatgagagggaggatagttcttccttacagatgcactccaattaatacagaaggaatgaaggaaattggggaaaaaaatcagaattaggcaaaaaccacaataataagtttcagacaagacccatggatggatgctaaaatcagtgagtaaaattgatcacagtctcagagtacatcccctaagatgtctacgataatagtcgtaaaaggataaacaggcagataccaccaccttaaccaaatgattaacatctaagacacagcaacatcatgaattctcagatatgatgtgctgagaagagcacaacacacttaaaaatgcataatctcattctaatcatgaaaaaactcagacaagtccaggtgcagcggctcacgcctgtaatcccagtgctttgggaggctgaggcggatggatcacctgaggtcaggagaccagcctggccaacatgatgaaaccccatctctattaaaaatacaaaaaactagctgggcacgatggcaagcgcctgtaatcccagttatttgggaggctgaggcaggagaatcgcttgaacctgggagacagaggttgcagtgagccaagattgcgccactgcactccagcatgggcaacaggggcaaaactccatctcaagcaaacaaacaaacaaacaaaaacaaaaaaatcagacgagccaaatgcagtggctcacacctgtaatcccagctatttgggaggctaaggcaggaggactgctttagcccaggagtttgaggaagaccctgtctcgaaacaacaaaaaaaaccctaagaataactgtcctagactgtgtgtatatgtgtgtatgaattgggattttattttgtaaaggaccccaggtgattctaaagttcaactaagatggagagtcactgcaccaacccttttcttctcagctcactttgtcctgggcccatatctcatggttttgggtctactgtggaagtaccttctctacagaacaaagacaaagcaatagaacccaaattcttccaattccctttgggatctattcccttcttctcctgcctaccagtatgaacttctatgggattatgctgatgagaaaaaataaattacatttaagtgactgataccaaaaactggaattacttcacagatgagaaacctggtcccagatacagtgcaccttctggacctcagtatcttcaattttaaaatcattgttttgaatctgatttctaattgttaagctgaagtgtttctttaaatttttaagttggttaaaatgtgtgtgtgtgtgtgtgtgtgtgtgtgtgtgtgaaagaacctgctccctcatcctcaacagcctcatcaatctccacccattacccatttttattagttgcttatctttccattatttcctcatgcaaacacaaatacatattaatttatttacacgtattagagtaaagtgatttctaaatctgaagaggcatcagactcatccagggagctttttaaacaagtggacacttagtttctattttatacctattgactgaacaaaacccctggagagtggagcccagaactttgacaaagttctctcaggcagttttctgtgacagacacctctcagggtacttaccccagcccacatcacctttacccaatagggatctgtccccttttgtctgtgctgttgagagtattgctcctggccacagctgatgaggtactacccagcccagacaagaatccattctaaggtagagctgggccaactagctcctcttctcagacagcctggagctggagcacagagactccaaggggccaggctggctggcagaagagtatctggttgcataactgggaatgctgggatgggccacatgcacccagacttcattctgcagagaggagccaagtagtagacagatctggactgcagaaacaaggcctgctgctccacagagaatgacagaggcactgccttggttctcagtgacttcccaattcttcaatctagtcctccattcctcaggtcttcagtaggttttctggagtgagtgaaggcagcaggagtttcagcagtcgtcctgcagatcatctgttactctgaatatgcagtgggtgagtgttgtgggcgtggctgttatctgggggcaggttgaaaagctgcaacactgccactgactctggcagttatttctctgtctaggtctttgcttgtgtttggaacagatgtatttactgctcaagagtgcaaatgaggagacaatatgggaagaaaagaaaagaaatttcagaaataagatttccactgtaacttgagaaataaaaaatttgagtaatttcacaagaactcataattctgcttaactagtattccgtaggatgacagtggcaatgtggcagcttttcaacctgcccccagatagcagccatgcccacaacactaacccacgatacattcagagtaacagatgatctccaggacgaatgttcaaacttgtgccgtcttcgctcactcccgaaaacctacttaagtgatagagtatatttgaagaaataaccttcaaactattcaacttttattttgggtcaagatacaaagccttggtcttggaagtcctgaaacctgaattcaagttcttgtattgtatcacagctctgtgcttgtaacctcgggcaattatcttaacctcactgaacctcagtatcttcctctgtaaaatgtaaagaatacttatctcacatataaggttacttggatgaacaggtacgtgaacttgtttcataaattcaatacaaacagtgtcactgccatctagatttttatcactttcatctccaatctcacttttttcattattttaatataattttaaataattacctttttttttgagatggagtcctgctctgtcacccaggctggaatgcagtggcgcaacctcgggtcactgcaacctccgcctcccaggttcaagcaattctcctgtctcagccacccaagtagctgggattacaggcaccccgcaatttttttgtatttttagtagagacagggtttcaccatgttgggcaggctggtctggaactcctcgcctcaagtgatctgcctgccttggccacccaaagtgctgggattacaggtgtgagccaccgcacctggcccttaaataattaaatttaataatcattatcattcttattctttttgttgataactgtaaactctgcattagttttccttatatttcttttcctttttttttttggagacagaatctcgccttggctagagtgcagtggtgcaatcttggctaactgcaacctctgcctcccgggttcaagtgattttcccccctcagcctcctgagtagctgggattacaggtgcccgccaccacactcagctaatttttatatttttcagtagcgacagagtggtcaggctggtctcgaacccctgtcctcaggtgatccacctgctttggcctcccaaaatgctgggattacaggcgtgagccaccaggcctgcccagttttccttatatttcattaggcataaaaattatgaagctgggtgcggtggctcacacctgtaatcccagcactttgggaggccgaggcgggtggatcacctgaggtcaggagttcgagacccgcctgaccaacatggcaaaaccccacctctactaaaaatacaaaattagccaggcatggtgctgcatgcctttaatcccagttacttgggaggctgaggcaggagaatcacttgaaccagggaggcagaggctgcagtgagccaagatcgcgctactgcactccagcctgggcgacagagcgagactctgtctcaaaacaaaacaacaacaaaaacaaaaaacaaaaaactctatctatctatctatctatctatctatctatctatctatctgcatgctaatttttagaacatgataactacataggactttaaaatagttaaaagtcctaccatagagtcgaggtgacttagccagtcacccaaaaacagagctaggattaacccttattcattcttctgaattctatgttctttccattatacaagaatgtgcccagaaaatcctacacaacagaactctgggaagagctaagctgagaaatggtacagaatgctgccttcaaaacccaagaaaataaacacattataaacaaagaacaaagataagactcaactgcaaggaacacagcaagcaaattttaaagggcagcccaggaaggagctgagagtgttaagtacaaaccatcaaggctcaagagaaaaggagatggcttcacagaatcaaaaacccacaagaagtcaggcatgatggctcgcacctgtaatcccagcatttggggaagctgacgcagatggatggcttgcccctaccagtttcagaccagcctgggcaacacagaaagcagtctccatcaacacgaaacattttaaaaattagctgggtgtgatggctcctgcctgtagtcccagctactcgagaggctgaactgagggaggaagggacccagaatcacccagctatgatcactgcagtctagcctgtgcaacagagaccctgtctctaaaactaactaaagaaataaatagcaggaagaagtaaaaagaaagatctaggatgcaggaagagaatgagaagacacatacccggacccagccaaaaaaataaaaatcaacaatgattactctcgaaattgatgttatgaaatcaatgccaaacagtaatacataaataaataaatcctgatacaaaatagtaaaatgcatgcagaaatgtaagcaaacaagagtgcaaaagaatacctgcacactcagagtcaagtagggctggttctacattgttaaaggacacagaggctggctgctacacgctgggggagggaagaaatggagagtgactgctcatgggaatggggttgctttttgaggtaataaaatgttctgggattagacagtggtggtggttccaaaactttgtgaatatatactgaaaacaactaaattatattctttttaaaggtgaagtttttcttttctctggtaggtaaattatgtccaaaaaaaaaaaaaaaaaaagcatggtcccttcaaacaaaaatcccttttctcagatcattatttcaggagctaacacttaaaagagagatcccttcactctggaaagctgacagtaatcaaaacagggcatgaaagcctggagcagggagacagatcagctctgggagttgggatggggaagaagagagaaatggcatcttgatgatactttttatcctggccaacccacttcaccagcgaaaagctgataagcactcaagacagaggccctacactaaagaatttaaaagtatacaggccgggtgtagcaatttgtacctgtaatcccagcactttgggaggctgaggcaggcagatcacttgaggtcaggagttcgagaccaggctggccaacacagaaaaacccagtctctactaaaaatacaaaaattagccaggtgtggtggtacatgcctgtagtcccagctacctgggaggctgaggcaggataatcacttgaacccaggaggcggaggttgcagtgagccaagattgtgccaccacactccagcctgggcgacagagtgagactcaaacaaacaaacaaacaaaaacaaaaacagaacttaaaagtatacatctggggggagaaaaaaaatgtaggggtggacgtggtggctcatgcctgtaatcccagcactttgggaagctgacgctgtggatcccttgagcccagaagttcgagatcagccctgggcaatatggagaaacccagtgtctacaaaaaatacaaaaaaattatctgtagccgggtgtggtggcacgcgtccgtaatcccagctactcaggaggctgaggcaggagaatcgcttgaatccaggaggcaagaggttgcagtgcgccgagatcgcgccactgcactcctgcctggacgacagagcgagactccgtctcaaaaaaaaaaattatctggggtgatggtgtgcgcctgtggtcccagccacttggggggctgaggtggtagaatcacctgagcccaggagatcgaggctgcagtgagccatgatcatgccattgcactctagcctgggcaacaaagtgaggctgtctctaaaaagttaaaaataaattaaaactaaaatgagggccaggtgtggtagctcacgcctgcaatcccagcactctgggaggccaaggtgggaggatcgcttgagtccaggagttcgagaccagccttggcaacatagtgagaccctgtctcttgaaaataaaataaaaaatttaaaaatttttaaaaactgaaaaaatgaagcaatataaatgcccaacaaatgggggcaacagttatataaataacctgtttttaataaaatttaacattatgttgatgttacatgttggagtcagatacatagaaaaaggaaaaaataggacacaatagtatgggataatcattacgtaggtttaaaaaaacaaaagaatccttgctgagaacaggtctggcagagcaaagtgagctttagcctgaagtgggagggagaaagtaaaacagtgggcagggctctggaggaaagaaggatggtagtgcttcaaagggaagcagaagttttggctttgttttatttttaggacagaagagtgatcagcccctaggaatttggatgagatcatccagagagtgtgtatgggacacagagggcccaagaactaagaacaaagagtcaaagacttgggaaaaccagaggtgtctcagcaaagtagtagatgtaactttttaaaaaggaaatggcttataacatcaagtgctccagaaaaaatcaaaatcttttgattttccagggagaatggcaaaaaaaggggaaaaagaatctttggtgaggaaggccttcaggaaaaagcaaccagtccagaaagatcaaaatcaagaaagactgtacatagagtgtgcacaccatcagttcagagtgcaagagtgggggtagggggctaaagtctggctctcgtgggcagaagaggtgggcacagaaagcagagcaagcagcacgaaccattcccgagagagcctgactatgaaggggagagaacaaatggcacttgtctcacagactctggggcagtgcccaggaaattaaatttaggactatatatcaatttaaaagtactggatagagtaacgaaagtgatgttttcagtaagtgttgtacagcagaaggcttgtttttgttgattttaaaaatctttcatgggagattggagagatgctggtaaaaaaaaatacagcattaaaataaaatctttcactataaaactagctagtacggccaggagtggtgactcacacctgtaatcccagcactttgggaggctgaggcggggtggatcacctgaggtgaggagttcaagaccagcctggccaacatcgtgaaaccccatctctactaaaaatacaaaaattagccaggccgtggtggttcatgcctgtaattccagctacttgggaggcggagacagaattgcttgaacccgggaggcggaggttgcagtgagctgagatcgcaccactgcactccagcccgggcgacagagcaagactcggtctcaaaaaaataaaataattaattttttaaaatgctagtgtaacttcagaaaacttagaatatgattttaaataaaaataataactaaactaaaaaagcaaatcctgtataagcccttagttacttgggaagtcatttaaaagttaagcccatatcatctcaaattccaaaacttattgcaaggtaaataatcaaaagggtggtgctggcacaaagaaaaaagatatagattgatgggacagaaatgaaaatctagaaataaacccatctatggtcaactgatttttgacaagggtgccaacaccactcagtggggaaaggaaaagactatcctttcccttcaacaaatgatgctggtacaactagacagccatgtgcaaatgaataaagctggatccttacacttcacaatatacaatggctcaaacacttaaatgtaagagctagaacaataaaactctacaaagaaacatagggataaatcttcagggtaaaccctgaaaatctggcaatggattcttacatatatgacatgacaggcataaacaacaaaagaaaaaaatagataaattggacttgaccaaaatttaacaactttgtgcttcaaaggacactagaaagaaaatgaaaagacaactcacagaatgagagaaaaatatttgcatatcatgtatttgataaggaatctgtatctagaatgtataaagaacttttaaaactcaatcacaggagctgggtgtggtggctcatgcctgtaatctcagcactttgtgaggctgaagtgggaggatcacctgaagtcaggagtttgagaccagcctggccaacgtggtgaaacctcatctctactaaaaatacaaaaattagctgggcgtggtggtgggtgcctgtaatcacggctactcgcgaggctgaggcaggataatcgcctgaacctgggaagcagaggttgcggtgagctgagatcgcaccactgcactccagcctgggcaacagagtgagagtgtgtctcaaaaacaaaaacaaaacaaacaaaaaaactcaataataggccaggcatggtggctcatgcctgtaatcctagcactttgagagactgagatgggaggactgcttgagcccaggaatttgagaccagtgtgggcaacatggcaagtccctgtctctacaaaaaattaaaaattagccagatatggtggtgcatgcctgtgatcccagctacttgggaggctaatgcaggaggactgcttgagcccaggagttcaaggctgcaacgagccgtgatcacaccactgcactgcagcctggatgacagagtgagaccctgtctctaacaaaacataattaaaagatcaatacttcaatttatgttcaagtggttaaacacagaattaccatatgacctggcaaatgaaaaccatgaccacatagaaacttgtacacaaatgttcgtagcagcattattcataataatcaaaaggtggaaacaaaccaaagctccatcaactgatagacaagcaaaaggtggtgtatccacacaatggaatattattcagccataaaaatggaatgaagtactgataaatgctacaacatggatgaaccttgaaacatgctaagtgaaagaagccacacatgtgatgccatttatacaaaatgtccagataggcaaatctatacagatagaaattagattggtagttactttacactgaaaaagaaggggagagagagagagagagtaaatagctaaaggatacaggattggtttctttctttcttttttgacacagggtctcgctttgttggccaggatagagtgcagtcgcgtggtcacaggttactatagccttgacctaggctcaagcaattctcctgcctcaccctcccaagtagctggaacctcagggccatgccacaattcctggctaacttttaaattttttgtagaaacaaggtttcactattttacccaggctggtctcaaactcctaggctcaagtgatactcctgcctatacctaccaaagtgctgaaattacaggtgtgagccactgtatccagtcaagggtttcttgttgaggtgattattctaaaaattgactttgatggttattaaacatatctgtgtatatattttaaaaagctaccctgggaggccaaggtgggcagatcacgaggtcaagatcgagaccatcctggccaacatggtgagaccctgtctctactaaaaacacaagaattagctgggtgtggtggcgggagtctgtgatcccagctactcaggaggctgaggcaggagaattgcttgaacccgggaggctgaggctgtggtgagctgagatcacgccactgcactccagcctggcgaaaaagtgagactccatctcaagaaaaaacaaaacaaaacaaaaaaacacgctgaattgtacactttaaacgggtgaaatgtttgtaaattatctctctctctcttttttttttttttgagacagagtctctttctgtcacccaggctggagtgcagtggcgcgatcttggctcactgcagcctctgcctcctgggttcacgcaattctcctgcctcagcctcccgagtagctgggattacaggcacacaccaccatgcccggctaattttttttttgtattttcagtagagacggggtttcactatgttggccagactggtcttgaactcttgacctcgtgatccgcctgcctcagcctcccaaagtgctgggattacaggcttgagccaccgtgcccagccataaattatatctcaataaagccttggttcttttgaagttaagtccctggggcaagaaatatactagatgaacttagaacatattgtagtgccaggaagtatggagctaaacatttttttacatgtaaataattaaggtatgtcaaagggacacagaagccaactgaaagagctcccaatgcccaaagctggaaaaacataagcaccaaaatcgaagtgccattgggattgtaacccaaaatgtaaaattaatattcacaagtccatagtgatatatacaaatggggagaagagacaatctcccaaatagaagaataccaaataatttatgttgatactacaccatcaaggaggtggaagataactccctactccttcagtgtgggatacacttaatgacttgcttccattgagtatattacgcaaaaaggagaaaacagtgagacacctggcaaacactttagccaggtgatcaaggtcaacaacaagagtgttctgttgacagtatatgcccttgatgtgatgtgatgagaatggcactatctttgtggtcttcctcccctccaaacccacaaccccactttaatcatgcgaagaacattaagcaaagctgggcatggtggactgtgcctgtaatccctgctacttgggagactgaggcaagaagatcacttgaacataggagcttgaggctgcagtgagctatgattatgccactatactccaccctgggcgacagagtaacaccctgtctctaaaataaaatttttaaataaaataaaaaatttattttaaaaaagttaagccctttttagtatttaaatatattgctaacaagtaaaaaaaaatgcatgaataatgatatggtttaaaatttttttttttgagatggagtcttgctctgttgcccaggctggcgtgcaatggtgcgatctcagctcactgcaacctccgcctccagggttcaagcaattctcctccctcagcctcctgagtagctgggactacaggcatgtgccgccacgcccagctaatttttgtatttttagtagagatggggtttcaccatgttggccaggatggtctcaatctcttgacctcgtgatccacctgcctcggcctcccaaagtgctagaatgataggcgtgagccactgcgcccagccggttttaaaattttgactgttggccaggtgtggtggctcatgcctataatcccagcactttgggagaccgaggtgggtggatcgcttgagtccaggagtatcagagcagcctgggcaacatggtgaaacctcgtctctacaaaaattacaaaaattagctggctgtggcacacgtctgtagtcccagctactaaggaggctgaggtgggagaatcacttgaacctgtgaggcagaggttgcagtgagccaagatcgcgccactgtactccagcctgggtgacagagtaagaccctgtctcaaaaaaataaaataaaatttttactgttttcaaagactgattagtggtctggaaaatgattatactactgtgttggatcaaagattcagaataccaaatgatatgatgtatataaaatgtaatcccaattttactaggaaaaaaatgtgccaggatgttgacagcagatatccctgggtagcagcattacaggtgaatgctttttgcataaatgtgcctttctgtgttttccaaattttctctaaagaaaaaaaactgagatgattatcaaactatattatttggggattacaaattgtagcaagttcaggagaagcacagattcattagcccttggaacaaagctgtttcagaattcagtatttttcagattttagaaaggtaatacagtgcatacatatgtgcatacatccctggcgaggtctggtgtgtaccaaggaatccagcactgatatttctgcagcaaacatacaaataatcacactagatgggaaaaatacagactatgaatagtctcgtggcagtccacgtcaggttttgccccaaatgagcttacaaaagatacccagaaaggtctgaaaccctgagctgcaaataaagcactgtggacctgtggaaggatcctgaatgaggaatgagtttcaaccgttagaaccaattccagtggcgacgagcccctccctatagttttgctgaagtaagaacacttttatttgtggtgtgaggggtacagaccatatttagagatgagaagacatcagaggcagaagaaggggtaaagagaactcacttcttcagcaaagggtaaggctgagctctcctgtcagagaggagagtgcaggggtcaccagacagcactctgaggatcactatatctcaaccaagcccatcaagtttgtacttctgatatgtctgataatttacttgagttatgtcatttaacaggtcggccaagccttggagatctagtcagaatgcctgcatgcatatttttaaaatttagatgtatacatacttataatggagagtaaagattcaaaacccaaagaattactaggatatttttaaagaacaggtgagatttattaggaatagacatagtgatcaaatggttatagaagacaggaacacaacattaagctccagtgtacttatcccctttataatgttgatacttatgatacagtatgtaaataaaatattacctacccttacattgtagcaataggcttaccttttaacatggctttgctacaaccaacaaggtggtgtccactctaggtagtccacattcagtttccaaccatcccattaaaatcccttcgtctgttttgtgttgccataacagaataccacagactgggtaatttataggaaaagaaatgtatttcttatagttccgtaagctgggaagtccaaggtcaagaggcctgcatctggcagaggccttcttgctgtatcaccccatggcagaagggcaagcaaaggcaggagcgtaagagacagagagggcccaactcacttttagaccaacccactctgtgataatgacctaaatccattcatgagggcagaacccccatagccaaatcaggtcttttttttttttttctttttttctcagatggagtctcactctgtcacccaggctggagtgcagtggcgcgatctcagctcactgcaacctctgcctcctgggcagtgtgttggcaaggttgtggagaaactggaatccttttgccctgttggtgggaatgtgaaaaggtgcagccactttggaaacagtatgggaggctgagttgtgaggatcacttgaactcaggagtttgtggttcctcaaaattaaacacagaattaccatatgatccagtagtgcccttctgggttcctacccaaaagaatcgaaagcagggtcccaaagagatagttgtacacttatattcatagcagccttattcacaagaggcaaaagcaacccaagtgttcatcaacagatgagtggtgtgtgtatttacaatggagtatattgttccaccttaaaaaggaaattgtgacacatgctacaacatggatgagccttaaggccattatagtaagtaaaataagccaatcataaaaagacaaacactgtatgattccacttacatgaggtacctagagcagtcagacttcatagagacagaaagtagaatggtggctgccaggggcttggaagaaggaaaaatggagagttatttaattgctatagagtttcagcattgcatgatgtaaacagccctggaggccaggcacggtggctcacgcctgtaatcccagcactttgggaggccaaggcgggtggatcacgaggccagcagatggagaccatcctagctaacagggtgaaatcccgtctctactaaaaacacaaaaaattagccaggcgtggtggcgggcgcctgtagtccccgctactcaggaggctgaggcaggagaatggcgtgcacctgggaggctgagattgcaccacggcactccagcctgggcgacagagcaagactccgtctcaaaaaaaaaaaaaaaaaaaagagctctggaaattggttgcacaatgtgaatctacttaatgctacagaacagtacacctaaaaatagttaagatggtaattttttttttttttttgagatggagttttgctcttgttacccaggctggagtgcaatggtgcaatcttggctcaccgcaacctctgccagccaggttcaagtgattctcctggctcagcctcctgagtagctgggattacaggcatgcaccaccacgcccggctaattttgtattttcagtagggacagggtttctccatgttggtcaggctggtctcgaactcccgacctcaggtgatccgcccgcctcggcctcccaaagtgctgggattacaggcgtgagcacctggccaagatggtaaattttgttatgtgtatattaccataattttttaaaaaggctccatgaaattatctatgtacataggtatctagcctatatcccacagtcattcactccaatactttattctctaccccattctgggatgcataaagattgctcttaggattacatagtgatttagttaatacagtcatttcaacactcaaaagacatgatccttgtttcaccagagtaaaatgagactctgagaagttacaggacatgctctaagtcacccagccataagtgtcagagctgaattttcaaatgcagttactaatttgataaatgagatatgttaccttgctgttcttaaaaaggcttgtaacttcagtgaggaacttattcctgtcttcattcatgtattcaactaatatagagaaatgaatgggaaagtgaagagaagatgaagactattacggagatggcacagggttagccagccttatttgtgttatgcagatggggaaacagacctaggcaggaatctgcctgattcaacaaatatttactgagtacctactatgtgcaatgtgtatactaggtgctggggatacagcagagaacaaagtccccactctcaatgaaaggggccagtctttttattcatctttagttaattttaagcacacaacagctatctcaaactttcttcacactttccaagcccctgatcccttatgtactcttggcagatgccccaccttatctcttaccagaacctaaggccaactagcataaaatcccttgagcacacttagattggcatgcttttactgtgacatctgttcctacagcacccttactttcttctcttgagctgagggtgaagatctctttctttcccatctgtaatctcacaatatgcacaactacaccagagacaatggaggcacaatacaggccagaggtctgttcctcattccttctgcggggccttcctccagtgaatatctcttctaacattgtcaatcatatccaacagaaaaagagatctctccattggtacaaaaacctacagctcctaagaagattttgactctcactgctcaacttctcaaataaaaattcctccactttagttctaattatcactcaaatgctgttagacctgtgggcaggtcactatatccctgcctaggtctgtttccccatctgcgtaacagagaaataattgtgctttatctgtcctacagaagtgtgaagaggtttgatgtgacagcagtgaaagcaatttaaaaagtacaaagtgctgtataaaagaagacgttttcataattattctgttttcacatgctatctttattccaatgatctcaaagtacctacccaagcacagttctaactctagtatatgtaagcaaacgtgcaagtctgtcaccttccacacaaagagtccccccacccccgccaaacacaccactccctctccctctccttctccctctccctctctccttctcccgctttccacggtctccctctgttgccgaagctggaccgtaccgccgtgatctccgctcgctgcaaccttcctgcctgtttctcctgcctcagcctgccgagtgcctgggattgcaggcgcgcgccgccacgcctgactggtttttgtattttttggagacggggtttcgccatgttggatcggctggtctccagctcctaaccgcgagtgatctgcctgcctcggcttcccgaggtgccgggattgcagacggagtctcgctcactcagtgctcaatgttgcccaggctggagtgcagtggcgtgatcttggctcgctacaacctccacctcccagccacctgccttggcctcctaaagtgccgagattgcagcctctgcctggctgccaccccgtctgggaagtgaggagcgtctctgcctggccgcccattgtctgggatgtgaagagcccctctgcctggccgcccagtctgggaagtgaggagcgtctctgcccagccgcccatcgtctgggatgtggggagcgcctctgccccgccgccccgtctgggatgtgaggagcgcctctacccggccgcgaccccgtctgggaactgaggagcgtctctgcccggccgccaccccatctgggaggtgaggagcgtctctgcccagccgccccgtctgagaagtaaggagcccctccgcccggcagccgccccgtctgggaagtgaggagcgtctccgcccggcagccagcccgtctgggaggtggggggcagcccccgcccggccagccgccccgtccaggaggtggggggcaccccccgcccggcagctgccccgtcggtggggggcgcctccgcccggccgccccgtctgggaagtgaggagcccctctgccgggccgccaccccgtctgggaggtgtgcccggcagctcattgagagcgggccatgatgacaatggcggttttgtcgaatagaggggggaaatgtggggagaggagagagatcagattgttactgtgtctgtgtggagggaggtggacatgggagactccattttgttctgtactgggaaaaattcttccgccttgggatgctgttgatctatgaccttacccccaaccccgtgctctctgaaacatgtgctgtgtccactcagggttaaatggattaagggcagtacaagatgtgctttgttaaacagatgcttgaaggcagcatgctagttaagagtcatcaccactccctaatctcaagtacccagggacacgaacactgaggaaggccgcagggtcctcctctgcctaggaaaaccagagacctttgttcacatgtttatctactgaccttccctccactattgtcctatgaccctgccaaatccccctctccgagaaacacccaagaatgatcaataaatactaaaaaaaaaaaaaaaaaaaaaggaatattttcacgtgcaaatgaaaaagccctaaacaaatcttaaaatatataaagtggttcaaaaaatgtttattgttattattttaatagaggcctatacatggagcatttatttgggaaagttttaaatgaatgttttcccctgttttggttgttatcaatctacactttaccaattttcaataatgatcatgcctaattaattcaaattaaaaggtgtgtaatacaaaaaaaaaaaaaaaactgcaaccaaccctcgaatcagctcaatctctcactgaattatggttatctgtcaccactgtatctgcctatcagtgattagggagagctctctctggagaaaaatgtcacctagagcatcaacaattttcatacacagtatccagcattcacttgaacgttaccaagcatacaaggaaacagaaacgagaaaaaagagacaacatatccacatatccacagtgacccagttactagttactgaagatgatctttaaaatagctgtaattcggccgggcgcagtggctcacgcctgtaatcccagcactttgggaggccgaggctgaggtcaggagttcgagaccagcctagccaacatggtgaaatcccgtctctaaaaatacaaaaattagctgggcgtggtggggcgtgcctgtaatcccagctacttgggaggctgaggcaggagaatcacttgaacctaggaagcagaggttgcagtgagcctagggtgtggtggggcgtgcctgtaatcccagctacttgggaggctgaggcaggagaatcacttgaacctaggaagcagagattgcaccattgcactccagcctgggcgacaaattgcgactgtatcaaaaaaaaaaaaaaaaaaagaggtaactcttggaaaggagaaaatatctgcagcacatgaatctaaaaaaagactcatcaaaatctacaaagaactcctataatttaatgaaacaaaaatctccacagaaaaatttgcaaaataacccttaaatacttcacgagatagccgaatgtcataaacatacaaaaaagagttaaccaccaaaaaagagctaaaatatcagagaaatgcaaacaaaacccacaatgcataccacttcatacccactagagaggctaaaaatgataccaagtgttgttgagaatatgcactggtctgaactctaatacactgctaatggaaatattttaccactttggaaaacagtttggcacatctactaaaatggaatctatgcacagactgacacagtcattctgctactaaatatatacccagcaggacaatgtggctcacgtctataatcagcccaggctggtcttgaactcctgagctcaaagtgatcctctcaccttggcttcctaaagtgttgggattacaggcatgagccaccacatctggccacttttctttatgtatattatacatcaataaaagtaaagaataaaaagggagaagagtctgaaaagaacaattatcacaaaattaaggaacgtactcaactcttaaagatttgagaaggcgtttctaaggtactagcaatgttccattttgcaatctgcacagtgatgacaagtatttaacttattctgtaaacagtaccttttttttttttttttttgagacagagtcttgctctgtcgcccaggatagagcacagtggcgcgatctcagctcacggcagcctctgcctcctggggtgacgtgattctcatgcctcagcctctggagtagctaggattacaggcaggcgccaccacgcccagctaatttttgtatttttagtagagacaagattttgccatgttggccaggctggtcttgaactcctgacctcaagtgatctgcccgccttggccttccaaagtgctaggattacaggcatgagccactgtgcccagccacaaacagtacttatatcttacctatgtttaaatggatattcaaaataagattaaaagaggtaagaaaatacaatactctagtaaatgtaaaaataagtgagaagaataaatgccaagagaaatataattaccaagaagaaattcaaagtaggaacagtcgtataaccatttttaaaataattttgaatcagcttaacatgttttcaacaaaaaaccaaacacataccaaaaccaaaaaaccacccaggtccagacttgtacaggcaagttctaccaaactttgaaggaatcattctaattttacagaaataaaaacagaagaataggaaaagaaacacttgccaattcattttgtaagggtagtctaattttcataccaaaccacatgagaaaaaccctattatttattaacaagccaaatccagcaatatataataataatacatcatgaccaagttgggtttaatcccaggaatgcaaaattgattcaatattagaaaatctattagggtaacatgaaacttaaagaaaaaaaacaagaaaatttctatacatgcaattaaaaagcatctgtagaaattcaatcattcaggattctttttttctttaagtttaaaaaaacttgacaaagaaagctttatgaagccaggtgctgtggcatgtgcctgtaatcccagccattcaggagggtaaagtgggatgatcacttgagcccaggagtttgagaccagtctgagcaacatagcaagaccctgtttccggggagggggtgggtgggaagtaagccttatgaaaaaccagtagcccctatcactcaataaaagctttccttttaacatcagaacaagtcagggatgccctctgtatcaccactgctcttcaactttgtaatggagagtccggccagcacagttaagacaagataaaatatatctaagtcatgaaaagaaacaaaatatcatgattttcagatgatatgtttgtccttaaaaaatttaaagagggattactggaataagagtttgttggacaatctttttattccagtaattcatcagtttacaaaagtcaaatgcatttctataaaccatctacagatatctcttagaatatagccgggcatggtggtgggcgcctgtaatcccagctactagggaggctgaggcaggagaatggcgtgaacccaggaggcggagcttgcaatgagctgagatcgccactgcactccagcctgggccacagagcgagactctgtctcaaaaaaaaaaaaaaaaaaaaaagatatcacttagaatagcaacaacaaacataaagtatcaaggaatcaattaaacacatgatgtgcaataataataacacaaaactttactgggaaaacaacttaggaaaacaatgtggaatacccggtgaatgtacatatgccctaccatccagcaattccactactggggaatctgtctaaagatctgtgaaactcttgtgtatcaggagaaatgtgcaaggttacttgcaggaacactgtaataacaacaaacctaatgtccattaatactagaatggataaattgtggtatatttatacaatggtatataaagcagtgaaaacaagtaactatactatactcaaaaacataatgatgaatgaaaaaagctagttgaagaatacacacagtatgatttcacttatatgaaattcaaaaccaggaaatactaagtactgtattgtttaatagaaagataatagtccagcccgggtgcggcggctcaagcctgtaatcccagcactttgggaggctgaggcgggcggatcacctgaggtcaggagttcgagaccagcctgaccaacatggagaaaccccatctctactaaaaatacaaaactacctgggcgtagtggcacatgcctgtaattccagctacttgggaggctgaggcaggagaatcgcttgaatctgggaggtggaggttgcagtgagtcaagattgcaccattgcactccagcctgggcaacaagagcaaaacttcatctcaaaaaaacaaaaaaaaaaacaacagaaaaacaagaaaaaaacaagaataaacacatcgagccgtgatcatgccactgcactcaagcctgagtgagagagtgacaccctgtctcaaagaaaacaaaagacaaaaatacataacaggctgggctcagtggctcacacctataatcccaggattttgggaggtagaggtgggtggatcacttgaggtcaggagttagagaccaccctggccaaggtgatgaaaccctgtctctactaaaaatacaaaaattagccagatgtggtagcgcacacctgtaatcccagctacttgggaggctgaggctggagaactgcttgaacccgggaggtggaggttggattcaagtgacagcgccactgcagtccagcctgggcgacagtgagactttgtatcaaaacaacaaaacacataacagtcattaattaccacacataaaggtgcttaatggataataagtgctcaaggaaatggcagtcatggtggtggttgcagagaacaactggaggggattaagagtggtggtagaaaccaagcagaaaccagtctaagaaaaccaaaaaaataccaggcaaatagtttcaaaggaaaattataccattttaagataaggtagactggtggctggcgcctgtaatcccagcactttgggaggccgaggtgggtagatcacctgaggtcaggagtttgagaccagtctggccaacatagtgaaaccccatctctactaaaaatataaaaattagttacacgtggtggtgtgcacctgtagtcccaacttcttgggaggctgaggcaggagaatcacttgaacctgggaggaagaggttgcagtcagccgagatcatgccactgcattccagcctgggtgacagagcaagactctgtgtcaaaaaaaaaaaaaaaaagacaaagtagtcttaatgctatttcagaacacagaaaaggaaagaaaacttccacactcattttatgaagcaagtgtaatggtaaccccaacctgacaaagactgcacaaaagatactacagttgaatactacttacgaatatcaacacaaaatctctgaatattagcaaacagaatccaatggcacattataaaaaggaatacaaataaacaagcacagtttattccaggtatgagagattccatataaggaaatctattgacatgatcttcacattaacaatgttaaatgtgatgaaatcatatcatcttcacggaggcagtaaagacatctgacagctgggtgcggtggctcatgcctgtaatcccagcactttgggaggccaaggcgggtggattgcctgagctcaggagttcacgaccagcatgggcaacagggtgaaaccctgtctctactaaaatacaaaaaattacctgggggtggcaatacgcgcttgtagtcccagctacttgggaggctgaggcaggagaattgcttgaaaccaggaggtggaggttgcagtgagctgagatggcaccactgcactccagcctgagagacagagcaagactccatctcaaaaaacaaacaaacaaaaagaaacaaaaaactaaaataggaaatgatggatactgccttaagtaaacaaaatacacctcggtccaaagccagcatctgacttcatgtgaaaacattagagacttccctgctaacatcacacaccacataaggctaaaatattttccaatttacatttttagaggtaagcattaaattctatgatgccagacaaacatttaccagatttttttttttgagatagagtttcactcttgttgctcaggctggagtgtaatggcgcacaatctcggctcgccacaagctccgcctcccaggttcaagcgactctcctgcctcggcctcccgagtagctgggattacaggcatgtgccaccacacccagctaattttgtattttttgtagagacggggtttctccatgttggtcaggctggtctcgaactcctgacctcaggtgatccgcctgcctcggcctcccaaagtgctgggattacaggtgtgagccaccgcgtctggccaaaatttaccagttcttgaatgctgaatcctgctgggataactggaaacactcctaatgttactataaactctcacactgccttgttggcaataattaaatagctctttctagcagttgtgttcaagtggacagataatcacaaatgtcttttctttctagctccctttggacgaaagaaagaaagaatttacaacacgtctaaagattgtcacttttatcatccctttgaatgataagtgatcagggctgtcccaaaagaatgcctgaaaacattacaaaatgttatcataagcagaatggctcactaaggggatgaacattctggcaagtcttaatctagcatcactaccaactgttttttcactggtctaaaacataacatctaatatttttatttgcctatatagccctgcagtaataattaacttgtgaaaggtctacactgatttttttctttataaagtatttgcttcaaccatggaacagaaacaaagttgatttaatgggaaaaatgtaaatttatttgaggataggttcagcactgctaaattgaaaagggaaagaaaatttcaaacaaaccccaaaaagaaacattttcacatctgtagtgaaaaagctaaatagcagtacactaaacttggttactgacaaaataaatccttgtggccaaggtgaggcaaagatattactctctactttgctagcctaccttgtgttcagtgaattcaaacattaattggggcaatgtattgtttttgcttcattttctttagctgtgcagtaaagtctttgctttcatagaaagattgtgccaagttctttctttttcagaattgcttttaaatcagttctatttaagtatttctctctctctcaaacttgacatttttcattacaccttttttttccaatgccaaaatagcagcattaacattcattccagtcactaggtaaaaactctcttcagtcaaacacacatgaataatctaattcgtgaggtaaacgactactgtcatacagtattacgaagttccaaccttacttgcagagcaaaaaataaaaaataaaaatagtcattttcctcaagggtttaattgtgggcttttaatgttgaagtaaatcaatttactagtttttaacctcaagtttttccctatttcattatatctcaataatgattatccagagatttctgaggtaaattacattaaagacagcgctagtaactgggaaacaatccacacatgaatcttaatatattgcatatatgctaatttcatgtaatgttcctgagggcggtgacaatattagagctgtacgagaccctagagaccatcccaatcccttaactccacagatgagaaacacaaaaacttgcagaagcagagtgacgagcacatgcccatgtgacatgtcatcagaagcagggaccaagactcaggtctcttgccttccaggccagtcctcttttggtaggctaaaagctgcctttcacagcttcccacaaatttcaacacatcctcactcaagtacgtttctgaaagggactcaccgacaactctttagagaaaaggaactatatctcaaaccataggaaaagttctatatctagcttatcaaacttttagtctctgaagcatgtgagagtaagtttgccagtatttctttctcattatcccccaatactttagtgactatttccaacaaacaaaactagactattctcccatacaaacaaaatgctaccatcaaaatcgtcaacgctcacctgtcagattatgaccaaaggcctctaagtcagaatcccgcccaggcaaaatgacatggcagccaactgtggagcctcggttggcctcggatagctggtccccccttcattcacaccacatatctgaggaccagatatggaaagcctctcatgctggaaaacttggcacagtagaaaggcggccacacttttgcccgtcacacaatgcacattcacgggggacctgtgctaaaccattcacagacaacctgtttctgggtcagggtttcgtatacagcagagcagtcagctatcgacacaagggtttgtaacaaaaaacaaaaaacaacaaaaaaaaggaaggacaaaccaaaacaaaaaagaaaataccaaaaaaaagaagagttaaaaaaaaaagaagataaaaataaaatcattaacacagatacacgactacaatctaattttcagacattctagttttgccaatcatgccgattcagaatcatgaaccacatggagttgccatgtttctgcacacttctttagtgtggaacaattcctcagtgttttcttggttccatgatcttgacttaattttgaggtttacaggccagttattttgcagaatatccctaaactcgggttaccttgatgttgcctcctgaagatttggattatgcatgaaacacttgactgtccctattctaactatataaagatgctccttgacttactatggacttacatcccaataaacccttcataaatggaaaacctcataaggtgaaatgcttgttttttttgggaaagtttcttgctctgttgccaggcgggaatgcggtgacacgacgacggctcactgtagccttgaccactcaggttcaagcgatcctcagccccaggctcccaagtagctgggactataggcacgtaccaccacacctggctaattttttttttttttaatttttagtacctttagtacagaaaaggcctcactatgttgcctagattggtctcaaactcctaagctcaaggaatcctcatgcctcggtctcccaaagtcctgggattataggcatgagtcctgcacccagcctagctgaaaatacatttaatacacctaacttaccaaacatcacagcttagcttagcctaccttaaacatgttcagagcacttacattagcctacagttgggcaaaatcatctaacgcaaagcccattttataataaaagtgttgagtaactcatatgatgtatgaaatactatactgaaaatgaaaaacagaacagttgcgtgggtactcggaagtaaggtttctactgcatgtgtatcacttccataccattgtaaagtcatctgaccaccaagccaaatatttgtacttctgcacatgctgctttacatagagaccgagacaaagggggattcacatcttgtcaaccctgtttacttcaaaggaataacagagcattaactaggtaccaagtgctcaggacttcaagtatactgttttatttaatactcatgacaatcctttgaccccttacttgtgactggcaagttacccaacttttgtttcattttcctcatctgtaaaaaccggagagtgatacacactccctggagaatgacagggaaaacagtaccaagaactttaacctaacaagtcagaaatcaatgagaccccttttgacaattcccaccttgccctttagacattccgagatatgcagctttatttaataaatgaccccaccttgggcctcagctgactagaccagaggcagacactctcccaggctggaaaggccaggtggagtgagctgttctgtgcagaatgatctccctaacagtgtttttacacattctgttccacttggaattggattcagagtgttctcagcctctggtcatcaaaaaacctgaagacacataccttcagggagctagggtcagctctcctctgctgagtgcatggggaagtgacaaaagagaaaagaggggggaaaatccagctgctgagagatgtagggtacaagaagcttttgtaactgtaaagagggagggaggtagctacgttggtctattttccagttcctggttccaactatacctaaagctttaactgcactttctatccttgcagtaatatgacaaaggcccccagatcttaatcataaacttttcattttctataatgcagtctctacaaagtagtgcctaaaacattccagcactctaccctaccttttacccagctagctctaagtcttccttcaggtcccagcttaaacaccacttcctcccggaaacccttcatgactactcagaatatcttatatcatccagtggcactccacacctcaccatactcagtaaatgttattactgccctgttggactgtaaacaccaaagagtaagaacaacttttgttcactactttgttcctactgcctagcacataatccggtacgtgtttaataatattaaatgaatgaaaatcaagaaactggtagaggtaactagaaggaatgggaagaaatcaatactgcttcctgataaaaattaagttgctagatgacagatcctttggagataaagaaaaaacaaaaacaaaaaacaaagttactttaactctaatcctttctagcctcttcttcaggtctgtctgcaatggcataatcattttatactttagggctaatccattcaggaacccaggctgtaggaagtacgtttctaggtaactcggtataacagagaaaagcctatagtagttaaaagaaaaaaggtcacaggatttggggtctgcataaatctcaatttacatctcagttctgcaatatacttactggctgtgaaccctgaacgagttacctgacacccagttcccttatgtgtaaagtgcaaaatataatacctcaaagacaaggatgacggtcaggcgcggtggctcacacctgtaatcccagcactctgggaggctgaggcgaatggatcacgaggtcaggagttcaagaccagcctgggcaacagggtgaaagcccatctctactaaaaactacaaaaaaaaaaaaaaacttagccaggtacagtggcaggcacctgtaatcctagctactcaggaggctgagacaggagaactgcttgaacctgggggcagaggttgcagtgagccaagatcgcgccactgcactccagcctgggcaacagagtgagactctgtctcaaaaaaaaaaaaaaaaaaaaagacaagaatgagaatgaagcttaaaccagcaaggcaggcttgcaactaacattagtcagttgatcatggcatattatccatgcagacacctgctatccagctcctactggccataggttcaaaccccagggcctgccttgagtctgagaatctgggagggaccttggagaccatctatcctgtgggttgcccaacatcattttcaaagcaatcaaatcctttttccaaatgggatcttgccctgctaaccctaatagttactacctatgtgaactgaagatgataatgactaaaaggaaattaagaaaaagaaaaaagactaagggcagaggaagaagggaaacgggaggggaaggaggtagataagagaagagcaaagaatagaaaaaacagggattaggggagagaatgctgtatgtgaagtttccctatttggggtgaggcctgaagcccctaagagaggaggagatttgaaaaccacagacagagcccagtcctttcatgttatagcaggggaaatagaaacacataaattttgttcagctgcctatagctttctcctcctgtggttctgctcagtttccagaaagcctgggtaacgtctgaatcctcctggaatctctcttcttccttctggtacggtgtgggccatttcaaagctcaggcaggtggcctttcctagagggagcagagacagcgcagctactggatgagctcctaggcacctttcagtgtgggagcctcaagaagtgaaagaaaaaaagcaaatctaaaggggagcaaaatagcatctcaggattaggcaagagggtgggtggagtaggccggaggcaaggagctctagatgtttgttggggaatgaggtgtttttcaattaataggtatataaattgtgagcaaggtgaggaataaattacatacagttttggggaaaagtcaacttgaatttacacaaatcagattatgggaatggtgtaatggttatagctaactaccaggaatacatcattagggatgctattaatataaaaattaattttgttttgacttatccttttactctaaactctgctcagaaacactagattcttctgttactcatgtaagctgctgtccttgcatctttgagctccaaaagtgtagaggagacttcttgattaaaaaagttaagtaaacaatgagcaagcaaaattaagaatctcaatatctctgtctccaggtctagagtttttatatatgatatatgttattgctgttcctgcctttcaaacaggtggtacaaacacccagcagagatccatgaagagagtgcattaacaggaagcaatagggcaaagttcatagagatgagctttagagaaaagcgggacttaaatagagcctgatgtttcttggggcaggctggggtgctgtactatgggcatcttggcaggatgattctccagtggagggagtgtaccgtgcaatccagaccatttagcatgtctgcccttgacatgcctactgacggccaataacaccccctaatcaacgtgacaacacaacaaaaagccgcccccctatacatttccaaatgcctctgtagcagggaggtaaaatcacccccactgagtaccacgagataaagtaggcacaatgcggccaggtgcaatggctcacgcctgtaatcccagcactttgggaggccgaggcaggtggatcacctgaggtcaggagtttgagaccagcctggacaacatggcgaaatcctgtctctactaaaaatacaaaaattagccaggcatggtagcacacacctgtaatcccagccactcaggaggctgaggcagaattgcttgaacccaggaggcaaggttgcagtgagcctccaagcaaaactctgtctcaaaaaaaaagtaagtaagtaggcaaaatgggcagaaagcataagagataaagtgggagtggaactggcagacagaaacagggccatcctttaatgactccgtcacccacaagatcaagtccaaagtccttaccaaataatgcccttcaggatttggccctgcctacccccagctgtctcaactcccaccttcttactaaggcaccctacactccagccttcccaagtaatttgtggttttcctgacctgatgcactgtgttcacggtctgtgcctttacatgcacacttcgctttgcctagaaggcatttctcaaggcaaactcctactcacacatcaacacctagctcagaagtctgggaagccaaagaaagacagccccaagtcactcagctcttctcttcctctcagcacttcacaaactcctgggtaacactggtatcttctctgtattattccccaattccatcccattatttggatgaagagttcaataaacattttctgagtaaataactctacatgaaaggttttaaaggctaaaaagtgatacaagcaaaagcagacaacagatatttcttgttactgaaataatctattttctcaactctgatctttggtggagcactacttaggaaccagaaaaactggggttgcttcatcacttcctagctgtgtgtcattgggcaagttaactaacctctgtgtgcctcaagtttcttcacttgtggggtaaaaaacaaacagaagttaccacttttgctgtacagttatatggcttagcattaatgtatgtaaaatacaaaacaagagtgctgaaaaagtggtagttctactagtctgctataatcacaataaccttaacaagacaggaggacattgtaccatcaggaatgtgatcacaatgaaattttagttgaaaccatccccctcttttttcttttattcattcagctttcccaagttgaacatccccgctttaaaaaaaaaaaaaaaagaggccaggcacagtggttcacactgtaatcctagcactttgggaggctgaagcagggggatcacctgaggtcaggagtttgagaccagcctggccaacatggcaataccccgtctctactaaaaataaaaaaattagccgggtgtggtggcacacacctgtaatcctagctactcgggaggctgaggcaagagaatcacttgaacccaggaggcggaggttgcagtgagccgagattgtgcaactgcactccagcctgggcgacagaacaagactctgtctcaaaaaaaaaaagagctgaaagtcaacaaatataatggcttgtcagctgcattctgtttccctcctatagtactcaataccaatcccttaatgagtaccatctcccttggctcctttgataacgtgcactcccagttctttggtctctctggccacatttcctctgtcctcttccataacttgacctttattgacacagtaaaggcaggcactcctttggcttagttctcagatgtcttatccactcttaaggcttcaattaatatctctatgaagatgaccccatgagctctcttgtcgcattcagaaacagcatttcaaactcaattaaaccaaaatagacacttgctatcttagtctaagatgaccaagcatactaagagtgtttcaatctctcctcctctccctcctccccgtctacactgttcccttatacatctgaccagtcatcagtttcctcttctttgccagagttacctggttggtcctctgttctacttcagtggttcttaatgtttccaggataatggactcatttgaaaatctatcaaatgctatgtattttttaaccaaaaagataaatatagaaaacatataattacaatttcttttttttttttttttgagacccagtcttgctctgtcacccaggctggagtacagtggcgcgatcttggctcactgcaagctctgcctcccgggttcacaccattctcctgcctcagcctccccagcagctgagactacaggcgcacaccgccacggccggctactttttttttttgtatttttagtagagatagggtttcaccatgttagccaggatggtctcgatctcctaacctcgtgatccgcccacctgggcctcccaaagtgctgggattataggcgtgagccaccgcgcctggccatgattgcaatttcacctaaccaatgacccagataagaatctgtgctcatccactcaagattttaactaccatttacacaaattttcatctccagctcctgctcccctcttacaaattttaagatggtttctggatatagcctgaatggcctacaggcattacaaacttaagttcaaaccagaactatttccccctgacaaatctgctctaacagtattcctttacttggataatggcaccaccatctcccaggctcccaacctagaggcctcagaatgaacaaccgcccatagccaatcaaccagcaagccttgttctatctcagaaatccctccaaatccaaatcccacctctcttggtctcttaccctttaaggtctcataatcctttgattccactcagacttgccatgattaaaagtctttttaccactcttcccacaagggtccctgttactatttctgtcaatacaaaactcctcacctccatctgctaccttccgctgccactttattactgcacctctaggtggttaggctttcctaatttattcctccactccggttcttcttccttcattcccactagtgttgatttgtcttcccaaaaaatttcaaaattgaccatgtatgactgcctctttcaaaaaaaggccgggcacggtgactaaagcctgtaatcacagcactttgggaggctgaagtcagggggaccacctgaggtcaggagtttgagaccatcttggccaacatggcaaaacgctgtctctacaaaaatacaaaaaaaaaattagctgagcatggtggcacgcgcctgtagtcccagctactcaggaggctgaggcaggagaatcgcttgaacctaggaggcagaggttgcagtgagccgaggtcatgccactgcactacagcctaggcaacaagagtgagactccacctcaaaaaaaaaaataaacaaataaataaataaataagatgcttcctccactgaacaaatatacagtcaaacttagttttgcctttggagtcctctacagtttgccacctaagtacatttccaagattagattccacagctcaagctgtcacttgttcctattatctgcatatcaaaatcacacccactcttaaaggcccaactcaaatcccactcttcatctttacatcctctacataatcattaggaaaggactctaaacaaaatagtcacaattcctaatgaactgataaggaaacagaagggggtaaatctaaaaaatggctagaaatccataaatccttttggaagcattttttaaaagatcaccattcaaatattagtgaatatttcaacgagccctccataaatccagcactgttagccaatatttattaaatgctaataatgtgcaatggagaaggttaacagcagggtatttcatcaacctgataaaaggctataatctggatcttggattcaaattccaattacatttgtatttcacttaggaaacgacaatcacaaaaaggggacttagcatttcaaatggagagtcagaaggtcaaacaagcctacagcagtgacagaagtagttcccacatctaaacaacttcagactagtaaaaaccttatcagacaggagaaatcttatcagatgggggtatcttttcaattgacatgtcctaaacgtaaaatacttttttcagtccacattttagataagctaatcttgttaaaagggccaaaggatgtgatgggaaattctgagcctctcataatgagacatgttcactggcacacttcccagtgagtgcaacagcaatgcgatgtgtggtggagaaatgatgctactggcaatactttctctccattactttttagggccttatttctttcaggctcgacctaatttaaattctgtcttggctcctaagcctgtgagttcacattaattttcacagttgtattcagcattttgctcctaaacaaagtgaaaacattaaagattcaattaaaatctctttaaaaagaattttaactaatctttctatctagctacaatacttggtaaaacataccttctatggcatttctaaaattatgattgaaatttgaatacatttccgaaacagacttatatttactttataacagtaagatacagaaaattctgcaagtattaattacactaaggaacgcagagtgttttcctaaaaacagctgaaaagagctacagtgtgtctagtagaatctcagtctacaatcttaataactctagttctatgacctcaagaattggcttcacctcgaaatactttctcacctgaaaaaaggaataacaccatcttttcctccctcaatgtggctgctcaaataaaatgaaataatatatgtagcacagtacctgccacgaagggttcaataaattattagtttactttcttcagtcaacacaaaagacacattcacaagattcagatttaaggaaatctatttccacaagtcctcaccagcacaaaatgctatcgctagtttgctctaataaaaactaccatcagccgggcgcggtggctcacgcctgtaatcccagcactttgggaggccgaggcgggcggatcacgagatcaatacatcgataccatcctggccaacatggtgaaaccctgtctctactaaaaaatacaaaaatgggccgggtgtggtgtcgcgcgcctgtagtcccagctactcgggaagctgaggaagaagaatcgcttgaacccaggaggcggaggttgaagtgaaccgaggtcacgccactgcacttcagcctggagacagagcgagaccccgtctcggggggaaaaaaaaaaccgtcactatcatttcacttttctaagggacctgaatcaagatgagggagtctacgtgtgattctgcaagaactccattaaggctgcatacataatgaccactaaatcattaacaggagtccatagcaattgggctaaaacatctgggagcatttatgctggtaaaagagctcacttgggggctaaaaaaaaagtcaaattaggcccaactctaaacggatctttaacaaatcaagagagtaatgttagtttatccttcctgaaacgccagcagtacgatattaaaatccacttagaagtaaaaacttcaagacggaaatatgccaccaacactggcgtcagtaatccattttagaaagcctgcgcggagaccaccattagcaccgctgaggatatttaatgaaagccgttggctgcaaacagaggcgaagagagaaaaacgattatttcggtgttctgcacacacgcggaggcaaaacgctttcaggacctcagcagccaccgccgccaacaccgacaagcatctgatggaattcacagttttacaatcgaaagtccaaaagaaggccatgatactagcaaattgaggggtggggacccttccgttgccttcccgagggtccagactttaaaggccgcgctgcgcccggggccaagggtccactagtaccggcctacgccccccgcgccactccctgagccccttcccgagcgaccgaaggcccgggaaccgcgagcaacaacacctaaacctcaaccggcccggggccgcgcccgagccctggcgcgcggaccgcggtgaagtccgggttcgaggtcgccgcggcgcctgaggccgaggcgcgggcgaggccgaggctgcgtccgctgcggccccgggcggtgggggggccgggcgtggccggtcgcggacactcaccacaccatgccgtaggcgccctcgccgatgtacgagaggttggtgtagcgcggccccacgtcgaacacctgcccgcggaccatctccgggcccgcgcccgccgccgccgccgccgccatgttggctgccgggccgccgccgcctccgccgcgctgagctcgacgctcggcggccgccgctcagctcttgtcgcccctcccgcagggactgcgccgccgccggtgcagccgccgacgctgaccgggaggaggaaggaagacgccgagcgggagagctgaagagccgacagccactcggaccgattgcctgcctgcctgccagactgacgggcgggccggcgggcgggcggagggaggggc

SEQ ID NO: 1859 - DNA, 98652 bp, Homo sapiens
  source 1..98652: mol_type = genomic DNA
tatatgtaactttctaaataatttttaattctaaatttaaaaaaataccttccaataaggagcttggaaaagaatacaaaataatggaccttgaggaacataatattctagaaacaaaaggcagcgcctcccttgctagagctcactgtattaaactccaggtacctgacaaatttaagatctgtatcctggctggaatctagcagtctcttcaaaaattagttctttgagcttttccttaggcaagtcatccaattccatgtcgaacttgaatggtgcttcggcgatgggctttaaaagaaaacaaaacatttaacagtcaaagttgttatgggtaaggcagtaatttactgattcataaaatgaccactgctcagattctgaatttacaacaggactgatgtctcataaaaacttaagagttgatggccgggcgcggtggctcacacctgtaatcccagcattttgggaggctgaggcaggcggatcacttgaggtcaggagttcgagaccagcctggcccaacatggtgaaaccccatctctaccaaaaatacaaaaaattagccgagtgtggtggtgcacgcctataatctcagctactcaggaggctgaggcaggagaatcgcttgaacccaggaggcagaggttgcagtgagctgagatcgtgccactgcactccagtctgggtgacagagagagactgagagttgtgcccacactcctcaagttctcataaacacttagcctgggagcaactgaatctgtttcaagtgtttttctgaacttaccacaaatcccagaataatttttaaatgttttaaggcagtgaatgtcgaaataagagaaatgtgctgctgttggggtggtggtacgtttatccaatcaacacccataatactaaaatacatgcatttcattaaataaatcatggtatctttgtatgaaaaaacatcttagagctgttaaaaattaagctgcaaggccaggcgcagtggctcacatctgtaatcccagcacgttgggaggccaaggtgggaggatcatgagaccagcctgaccaacatagtgaaactccatctctactaaaaatacacaaaaattagctaggcatggtggcaggcccccgtcgtcccagctactcgggaggctgaggaaggagaattgcttgaatccaggaggcggaggttgcagtgagccgagattgcgccacggcactctggccgaggcaacagagcaagattccatctcaaagaaaaataaaaaaaactggccaggcacggtggctcacacctgtaatcccagcactttgggagaccgaggcaggtggatcatgaggtcaagatattgagaccatcctggccaacacagtgaaactccgtctctactaaaaatacaaaaattagctgggtgtggtggtgcgtgcctgtagtcccagctactcgggaggctgaggcaggagaattgcttgaacctgggaggtggaggttgaagtgagccgagatcacaccacggtactccagcctggcctggtgacagagcaagactccatctcaaaaaagaaaacaaaattaagctgcaaggaagattaataggaaaatgcctatgttgtgtcaagagaatgaaaactattttatttttaaaatttagatacagaaatacaagactgagaaggaaatactccaaaatgttagtaactgtaacaagattataaagctacatatttgtagtatgaaaaaaatctctcctgtattttcttacaagtttgcttttctctttttttttctatacaaaacctcgctttgttgcccaggctggagtgcagtggtacgatcccggcttactgcaacctctgcctcctgggttcaagcgattctcctgcctcagcctccggagtacctgggattataggcgcctggcaccacacttggctaatttttgtatttttagtagagacagggtttcactatgttggccaggctggtctcgaactcctaacctcaggtgatccaccaaccttggcctcccaaagtgctgtgattacaagtgtgagccaccatacctggccccatttttttttttgagactgagtctcattctattgcctaggctggtgtgtactggcatgatcttggctcgctgcaacctctgcttcccggggtcaagcaattcttatgcctcagcctccagagtagctgggattacaaacatgtactaccacgcccagctatttttgtatttttagtagagacggggtttccccatgttggccaggctgggcttgaactcctgacctcaagtgatcctcctgcctcggcctcccaaagtgctgggattacaggcgtgagccactgcgcccagcccccattttaatttttaaccatactccagaaagctatttaagtaaaatataaactgtctatttagatcaaagaaccccatacacactcagtgacaaactgattattattttttagagaaagagttttgctctgtcaccgaagctggagtgcagtggtgtgatcacagctcactgaaacctcgatctcctgggctcaagagatctttccacctcagccttctgaatagctgggactacaggtgtgagccaccatgcctggccacattttgatttttaaatgcccgtgaactaatgcaatgttacagaactaagctgatgataataccagctgtcaatcagtgaatgcctagaatctcacctctcacccatgtaatcctcacatggggcctttagggggaggaagcacagaccccaaactctgcactaagctttggccatctgaaaggggagaaggactcatgtccagaagaataaatagctcagcccgaaggagggctatgcatctgggatcacaggaggtgtcctacacgcatcacccaccaccccagccagctgatttggactcggaagcttgggaaatctccagcccactaagcttgtaagagccccaaacctgtattctctcctattctgtgttactggctatgttgtaggtatttcacaagctgcctaacttgttgctggaggcagagagatggatgtggaagggaaagctgattctttcaaaaataggagggtaaagactattctctgtgcatatgagcctcaactacaacaatccaaacttttggttcatattgcatttttctttgttatcctccagagaataaagttaaaattgaaccccagagacaccagagagccaaggcactaggactgtcttggggagaacatgacatgcagcatcttctacctgaatgccctgcctgctctgaagagctgccatatccactctggcctcatcacttcttacaacaggctctcgtgtccttgtctctagggaatagcacacccgacatggagtcgccaagccacagtggaaactgtccaagttgacttccctccccactctgtgtgctgtccctgtcagcaggctgcccacctcctctccaccccggccatcctcagggccagcacttcacttcaggtgtctcttcctgtcacaccatgacaatggcctccagtctcagacccatgccctctgtgctccatactggtgcagctgtcccctttatacatgcgtttaccccgcccctacctgttgcaggtggcctggaggaagtcttctgagatagacagagttacggggggagggatttcaagctgtgccccacagcactcgtcctcaaggcaaaggtgggcttgttggaagaaccgggtatggcagcaggtatatctcaggaaaatctaagcaagatatggttggtccactgctggctgatctatgtccctgaagcagcagccaggaacatgagctcttacctcgtcactcgggtcgtaatactgctccagatatgggtgggccagagcctgttctacttcaatcctcttgtgtgggttgaatgtcaacattttgtccaataagtccagagctataaagagaaaggttttgcagtagtgagagcagaagtagtcacagaaatacttcaatttcctgtttaagtaacttacccacaaaacaactgagctaagcatgactacagagagagcagccagcacaaagggtgctgactatatctccaagcctcccgagactgtgaacatagggaccgaccatctgacaattgcagaccgcaaacaaaaacactggcactacttaatgaagcgtcttttctgacaatgatcatttcttttttttttttttttttttttttttgagacggagtctcgctctgtcgcccaggctggagtgcagtggtgcaatctcggctcactgcaagctccgcctcccgggttcatgccattctcctgcctcagcctcctgagtagctgggactacaggcgcccgccaccacacccggctaattttttgtatttttagtagagatggggtttcaccgtgttagccaggatggtctcgatttcctgacctcgtgatccgcctgcctcagcctcccaaagtgctgggattacaggcgtgagccatcgcgcccggccagcaatgatcatttcttattaggttatttgtaggtaaaggtcaacttcatccatctgcaaattagcacatactattaagccctcaaagtagaatgataaaatatcattatttcttcttaaaacattttaaaatttaattgtatgtcccttctcaccattcctaaaatgataaacaatcacgtaaaatttggtacaatttaatactcatgatcagtttaaggaatcacttctagccactactttcaaaaagtaagttttcactatttactaagaaaatgtttcctaacccttaagaacaatcagtagaccttccgaagggattgcttgggtgctggggggaggtgggaggcatcttgctgcctgaggtcactgaagggctgtgggtgtgtatttgtgctcagccccggccaattttgacctcccttgttgcaacccctgaccttaagacaacaggagatgataaacatggtaaaccacatgctggacataatgagaaattccgcatagaaaacatttaaaagttatgtatgtttctatctataatcttttcaatacatacaagtgcactttaggaaattacggaataatgatattttgttttatagcctagataacttttcagagtagagaatccagacaggttttgctgtgactgaaggagtgtctgcgcagtagaagaggtggtcatgcctgcagctgtgaccctgggtctgtgggcacacaaactggctaggtttaggaagtggccctctcaagggtcaggacaaagacgcatgatggtcaagaacccaggaatctctggttcaaatcctacttccaaggaacacttgtagatatgtgtgcaagacacacaacccttgccgaatcttaagattcctgtggttggctgggcacgggggctcacgcctgtaatcccagcactttgggaggccaaggcgggcggatcacaaggtcaggagatcgagaccatcctggctaaaacggtgaaaccccgtctctactaaaaatgcaaaaaaaattagccgggcatggtggtgggcgcctgtagtcccagctacttcggaggctgaggcaggagaatggcgtgaacccgagaggcggagcttgcagtgagccgagattgcgccactgcactccagcctgggcgacagagcgagactccgtctcaaaaaaaaaaaaaaaaaaaaaaaaagattcctgtggtctataatataggtaataaatcccactttgcttcctgctcccaaccagccctccccacatagaactcacagacattttctcaaggactttcttgaaactagattaagtcatttggcttttcacccaattagatactgtctgtgctaagaaaagtccagaaggcctggaccacaataagattctaacagtattacttctaaaccactgggggcagaagggtcctactcaaacttgttcgtattaagtagacaggcactccaagccaactggatgttttgcagcttaagcatttctaaaacagatccattagttccttaaagttaaataaattctaggcccttaaacctccaggcataaatttcaaagaagacagctttttaaaaaaagatttgctacttgaaaagtagctagatctccagccttctgttactgcaagtgctatttctacattattcatagctacagaaggagaaaaggagagaaccgggaagcagctggcaggtgcggatcccacagtcaagaatgtccggactccctcctcccacgccacatgggcattcattggtaacactcagatggtgtgaatcatggctgcctgtgtggatgcttacttggatacaggttttatttcccctaaaagactggaagtccctttgaggctagtattactcctgaccacaaatcctgactttccctagtgccttccagaatactacattttctctttctgtgttttttaaaacagagtttggattttgttctatggcccaggctggagtgcagtggcatgatcatagcttactgcagccttgaactcctgggctcaagcaatcctcctgcctcagcctctcgagtagctggtactacaggcacatgttaccacacccagctaatttttttaaattaatttttctgtagagatggggagtcactatgttgcccaggctggtcttgaactcctgggctcaagtgatcctcctgcctaagcctcccaaagtgctgagattacaggtgtgagccactgtgcctggcccttgtctttttttttttgaaacgggagtctcactctgttgcccaggctggagtgcagtggcgctgtctcggctcactgcaacctccacctcctgggttcaagcgattctcctgcctcagcctcccgagtagctgggattacaggtgcctgccaccacgccaggctaattttttgtatttttagtagagacgggggtttcaccatgttggccagcgtgttctcaaactcctggcctcgtgatccacccgccttggcctcccaaagtgctgggattacaggtgtgacccaccgcgcctggccagcctggcccttctctttaacttcaaatagtatgtaacaacctgattccaaccctttcttctaatccatcatccttttttccttcttgccctgtcctggacctggggaaagccattgactggctctccacagtgcctcttcatgtctatcttgcctgcctcgtgaaactctgaccctgaatcaatgctgcaacctgtcacttccatcctcaactcatgtttctgtgcggggccagagaaaagactgaactgtgcaaagtgtgccagtgcgacagtgcttctcaaactttctgatctcagaactctttatactcatcaaaactgagggacgatttaaaaaccagttaattctgctcatagctcaaatagttacataagtgcttttccctgagaaaaccactgcattcagtatgcagcagaaatgctatacgtgtttgtcacacagacatcgtgaagacatgtattaaggatggatttaatatggtgagtactttttactggcactggttttgagcagtgggggtgtggcagtgcagagctcagtaacctctctagttccactgccttgacctgcctgtggtgctggggactctgctcatcattgctcctgtgccacaagtgctgatggcaacatagagagcagtgtgagtaactctttaagaagattattaaaacagctttaaccttgtggacaccctgaaaggatcctggggatctcaggtgtttaaggagcacactatcagtaactaccgttctacaaaaactcaagattttcagcctcatcaaggccctcaacagcttctggaaagctttggtcagtcccctcctctactctcagatttcacccaacttgcacggcttgaatcatgaccttcttgctaactgaccctcattactctcagcatatcttcttgagggtgctacagagaaaactgaggcacccaagagtgatcttcgcggaattccctcctagccagattcacacacacccttactgacactgccaagaaagatatcctctctctactcaaagtcaattctccccaacttgtggcctggtccacaaccccttcccctcatgtggaccagtcgtttctgtctccactttccatttcaaatttctcacttccattcactgtttcaactcctcttgcatggtcaccaacaagcccctcattggaaaatcaacccacattttccaatctatatcttgctagacctctctgctgcatggacactgttgtgcatgcctactttctcaaaatgccatcttctgcttctgtgatatcacatggcactagtttcttttctttgtccctattccatcactggctgaaggtttgtgttctccaacttctcacaatctcactcttcttcttcttcttcttcttttttttttttttgagacagggtctcactttgttgcccaggatggaatccagtggcctgatctcagatcactgcaatctctacctcctgggttcaagcgatcctcctacttcagcctcccgagtagctgggattacaggtgtgtgtcaccacatcaggcttatttttgtatttttggcagagacggggttttgccatgatgctcaggctggtgtcgaactcctgggctcaagtgatccacctgcctcggcctcccaaagtgctgggattacaggcatgagtgaccgcacccggccacaatctcattcttctatcttttcaatctcttgcaagatttaaaagaccacaggttaaatacctcccaaagctatattgagctgagggtgaccaagctgtagatcaataaatccaagtttgtgtaggtaataaaatatatagcctatgattccatttacaatcaatgtatgtatctatatgtgtaataaagtctgcaaggttttcaaacattaggttatctgagaaatggagacagacttcttatagaaattgcgttttttaatttaaaaaaaaaaagtgggggccaggagtggtggctcacgcctgtaatcccagcactttgggaggctgaggcaggcagatcacgaggtcaggagatcaagaccatcctggctaacacggtgaaaccccgtctctactaaaaaatacaaaaaattagctgggcatagcggtgggtgcctgtagtcccagctactccagaagctgaggcaggagaatggcgtgaacctgggaggtagagcttgcagtgagccgagatctcgccactgcactccagcctgggcgacagagtgagattccatctcaaaaaaaaaaacaaaaaacaaaaaaaaaaaaaacggggggcggggggggtccgggtgtggtagtggcaggaggatcccttgagtccaggagttcaagacaggactgggaaacatagcgagaccccatctctacaaaatttatttaaattagccaggcacggtgcttgcccgagcccaggagttcgaggctgcagtgagctgtgattgtgccactgcactccagccttccagcctgggcaacagagggagaaccctgtctcttcaggaaaaaaaaaagggggggggtgggggggagaaaatagaattccttatcttccctcactctcgggatcacctgctggttgtgcccaccagcatccactgcccctctaatccatccaacagtgtttgctataggggagcgctcaggcttgcccacgctcctgggctgtgctgtgggaatggtgacactcactgggccatattcacctgagtccccttggccacagtgactgctcagggataggcatggcatccaagctgagcacaaagaggtgatgagagtcagcctaagtcctggctgcagtgatcaggtcaagtgtcttactctcatcatgaaaagagaggctgactgacagacagcccagagcaaggcaaaactggatgataaagaagtccagattctagacacagtgtctgtgcccatcaatccacatgtgactgaacttttcagttatcagagccaataaagctctttcttgggccagtaagttcttgttatgtggaactgtggaactgaaaagacctcagacggttgacccaccaaacccggccttctggtctgtgtgaatgactcacccacattcccttgctccccaagcaccatcattcaatggtaaccactgcttatcttttcacatatgttgttgaattcttttctatgcattttcttgtagaaggctgaaatcatattatgtatgacaaatgctgttttattttcccttagtaaatactgttcattagcattttcccccactatcaaaactttgtaaaaaaaatcacttttagcggccttaaaatattcctttaagtagatgtctcataatttactcagccatttgattaacatttggcacttaggttgtttctaatgcctaacaggtgccttaaattaaacacagactaaaccaaattctcaactgctgtcacccaaactgctcctcctatagttttcctcatctcagtatttcctgtagactgtgtgttcttgtcctttgctcatttatttatacactgtggtcttagatttgtctctgctctttagatactaataatattaataatgaatctaaagttaacaataattccttaactcttttaattatcctatgaggtgggaactacaattgtctcaatttagggttgaggaaatcatgaaacagcttaaataacttgtccaaagtcaaaaatccaagtagcagaaccctagtttgaactcaggaggcggactccagagcaccgggtataaccactgtactttgctgccttctacagaacagttaggagaaggtccagtgttactcaatttagaacattttagacctattgtccacacctaatctaattttatttagcttttaaacttttatatgtctctctttccttgatgtttgttttaaaacataggaagtctttctccatgcagagatcagaaaaatactgaatactctattgttagtttctcatgatataaattttaaataagtatcaattcttttagaattcattttgatgtgtaatgatttaaattgattttcctccaaatagctattcaactagcccagtaccatctgctgaataataatttcttctccctcactgaagtcatttgagagaatcgtaagctaagactcctttaaagaaaaatctacaatagtgtcggtttaagggatacagcaatcaaaaatttccaacaaacatgaaaaaatttcaatctcactcttaattacagaaaaacaaattaaatgccactcccccatttggttggcagacctaaaagttcaatacccagaattgctggaacaaaagacatgtgacagaattgccagactgtcctctacagagactcaaccagtttacactccaccagctctctccgaaaacacccttttccccacagccttgaccacacagtagggtgtcaaactttgatgtctgctactctgttgaggagggcgttaaaaaaaaaaaagaattactgacttttcaatgtttgtatcttgtataatgagtaaacatgagtaccttttatatatttaagagctgtttcatcttccttttctgtgaactctcattaaaaattctagcttgtaagttttttaatctcttgagttccctgaggtcttccattcatttcctgacaaatctagactatcagttctgtaagaaagctctctctctcttttttttttaatgagtcctcagacttcccatctccaaacaggttcttaatccctcttattgctggtactatgtatgtccagggccttagaagccttgatggcaccaaacagacactcaaatctatccactgaatgaatgaatttatgtatgttttcttaaaaatataaaaacaactggctagatgtggtggctcatgcctgtaatcccagcacttttggaggccaaggcgggtggatcccgaggtcacgggatcaagaccatcctggccaacatggccaatatcttggctaaaaatacaaaaaattagccaggtgtggcggtgcgcgcctgtagccccagctactagggaggctgaggcaggagaattgcttgaacctgggaggcagaggctgcagtgagccgagattgcaccactgcattccagcctgggtgacagagtgagactccctctcaaaaaaaaaaaaagaaaaaaaagaaaagaaaaataacagtgctgggtgcggtgctcacgcctgtaatcccagcaccttgggaggccaaggtgggcagatcacgaggtcaagagttcgagaccagcctggccaacatggtgaaaccccgtctctattaagaatacaaaaattagctgggcatggtgacatgtgcctataatcccagctactcgggaggctgaagcaggagaattgcttgaacctgggaagcagaggttgcagtgagccgagatcgcgccactgcactccagcctgtgtgacagagtaagactctgtctcgaaaataaataaataaataaatacatacatacataaaaagcaaaaattagccaggtgtggtggcacgcacctgtaatcccagctattcaggaggctgaggtgggagaatcgcttgaacctgggaggcagaggttgcagtgagccaacatcgtgccactgcactccagcctgggagacagagcaagacgctgtctcaaaaaaaaaaaaaaaaattagccacgcatggcggcacatacttgtggtctcagctattcaagagactgaggcggaggattgcttgagcccaggtggcggaggttgcagtgagccaagactgtgccaccgcactccagcctgagtggcagagtaagaccttgtctcaaaacaacaacaaaaaaacatggtagaactgttgaagtgatgttctgagatttggttccaagagaccttgcagcataggctcttgctcttttggaatatttctgccatcatgagaagccactgagtctagtctactttaggataaagaggcaactgtaggaaggaccaactgttaagacgttaaaccaccacaattgagggatggtgaagggagccagcagatgactgcagtgcatggctgaacccaggtgggctcagcagaactacccagctgtgccagcccaatggactcatgaacaaatgcatggctgttatttcaagcctgagttttggagtgtttttttaatgcagcaataggtaactgatgtaaactttaatgtccaatgtgagtctggctgaaggacacttatgggtcacatccctacaagggaacaccatgtagtcactctttaacaactagaggccgggtgcagtggctcacacctgtaatcccagcactttgggaggccaaggcaggtggatcaactgaggtcaggagttcgtgaccagcttgaccaacatgatgaaaccccgtctctactaaaaataaaaaaaaattaggccgggctcagtggcttacgcctgtaatcctagcactttgggaggccgaggcgggcagatcaggaggtcaggagatcgagaccatcctggctaacatggtgaaaccccgtctctacttttagattgtgtttttgtttggttttgttttgagatggagtcttgctctgtcacccaggctggagtgcagtggcatgatcatagctcactgcaacctcaaactcccgggctcaagcagtcctcccacttcagcctcctaagtagctgggactataggcatgcaccaccacatctggctaatttttgtattttttgtagagatgggttctcactatggtgcccaggctggtcttgaactcctaggctcaagcagtcctcccgcctcagcctcccaaagtgctcggattataggcatgcgccactgcacccagtcagttttcttttatagacgattgtcgatagtacctgcgtcacaggattgtgtgaatgttcataccactggcatttgtaggtctaacatctttccatatcttgctctgttgcccaggctggagtgcaatggtgcaatctcgcctcacggcaacctccacctcccgggttcaagcgattctcccacttcagcctcctgcgtagctgggattacaggcacctgccaccacacccagctaattttttaaaatttttatttatttatttatttagagacggagtctcgctctgtcggccaggctggagtgcagtgacaccatctcggcttactgcaagctctccctcccgggttcatgccattctcctgcctcagcctcctgagtagctgggactacaggctcccaccaccacgcccgtctaattattttgtatttttagtagagacggggtttcaccatggtctcgatctcctgacctcatgatctgcccgcctcggcctctgaaagtgctgggattataggcgtgagccaccatgcccagcctgtaattccaacattttgggaggccaaggagggtagattgcttgagcccaggaattcaagaccagtctggcaatgtgatgcaatactgtctctaagaaaaatacaaaaaattagctgggcgtggtgacatgcgcctgtggtcccagctactcaggaggctgaggtgggcagatcgcttgagcccagggaggtcgaggctgaagtgagtcgtgatcacgccattgtactccagcctgggcaacagagtaagaccccatctcaaaagaaacaaagtaaggccaggtgcggtggctcatgcctgttaatcccagcactttgggaggccgaggaggcagatcacctgaggtcaggagattgagaacggcctggccactgtgacgaaaccccatccctactaaaaatacaaaaaattagccaggcatggtggcatatgcctataatcccagctacttgggaggttgaggcaggagaatcgcttgaacctgggaggtggaggttgcagtgagacaagatcgcaccactgcactccagcttgggcaacaagagtgaaattctgtctcaaaaaaaagtaaaataaaaacaaaaaacaaaatgaaggccgggcactgtggctcacgcctgtaatccgagcacttcgagaggctgaggcaggtgcatcacctgagatcaggagtttgagaccagcctgaccaacatggtaaaaccccatctctattaaaaatacaaaattagctgggcgtggtggcgcatgcctgtaatcccagctacttgggaggctgaggcaggagaatcacttgaactcgggaggcagaggttgcagtgagcccagatcacgccattgcactccagcctgctgggcgatagaagtgaaacttgaaagaaagaaaggaagaaagaaaggaggagaagggaggggagaaaaaagaaaatgaaaataagcagccaggcacagtggctcaggctgagacgggtggatcatgaggtcaggagttcaagaccagcctggccaagatggtgaaaccctgcctctactaaaaatacaaaaattagccaggcgtggtggcgggcgcctgtaatcccagctactcgggaggctgaggcagaaaattgcttgaacctgggaggcagaggttgcagtgagccaagttcacaccactgcactctagcctgggcgccagccagagtgagacgccgtctcagaaaaaaaagaaagaaaaaaaaatgaaaatgaaaataagcataaaaaaagaatcagaaatagtttgatgcaactcatgattacagacaagagtaaggaaacaaacaggagaggaacgtttgggagtaggcctatttattacagttttgttgtttttttttttttttaagagataagagtgtcaccgtcagcgtggagtgcaatgatgcaatcacagctaacagcagctttgacctccttgggctcatgcaatcctccctcctcagttccccaggtagttcagactacaggcaggtactactacactcggctgaattttaagtttttaatcttgtagagatggggtcttactatgttgtccaggcaggtctcaaattcctggcctcaagcgatcctcctgcgttgacctcccaatgggctaggatcacaggcatgagccacattaccaggcctaatgatgcagctttgttgcttatgcagctctttaaaaaagtgactcaggaaataacatttagtaacatttagataacatgcttaggtggtataatatacaagcaaatctaatcagtaacatgtattatgcatgtgacattctagctaaaaatatcctaccatcaaaatacattacaggccgggtgtggttgctcacacctgtaatcctaactcttcagaagcccagggtgagcagatagcttgagctcaagactttgggatcatcctgggcaacacggcgaaaccctgtctctacaaagaatacaaaaattagctgggcatggtggcacaggtagtcccagctactcagatggctgaggtgggactacctacctgtagtcccagctactcaggtggctgaggtgggaggatggcttgagcctgggaggtggaggccgcagtgagcccagattgtgccactgtgctccagcctgggtgatagagccaaacccgtctccaaaaaaaaaaaaaaaacccaacccccaaaaaccggtcaggcacggtggctcacgcctgtaatcccaacactttgggaggccaaggtgggcagatcacaaggtcaggagatcgagaccatcctggctatcatggtgaaaccccgtctctactaaaaatacaaaaaattagccaggggtggtggcgagcgcctgtagtcccagctacttgggaggctgaggcaggagaacagtgtgaacccgggaggcggagcttgcagtgagccgagatcacgccactgtactccagcctgggcgacagagcgagactctgtctcaaaaaaaaaaaccacaaaaaacaaaaaaaacaaaaaaaaaccacaaaacaccccaaaaccaaaatacattatataattacaaccacacagaagcttgcacacattagtgcaaaaaaagtgaaaggttactgtgggatcctggtgatcaatatcttactcccttaccattcctcccatacttcttaactgtctacaatgatgaaattcttctacctttatatgaaagattaaaagaaaatttctcccattttcaaaagaaattcatttctaaacaaccaagtatttctcaaccttcactcaggtcaatacataaaaccaattcaacatttaagtagacagttgttaaatatacatatacacatatattcatatgcatgtatagataaacacatacagataaaataggaagttagaaatagctaaatttctaacagaacactggataaaaatgctataaaatcattaacgataacctagatctatgcactgatgtggaaaagatattcaagacacaattctattaaccatgacatttagggaataattataaaagaattttaccttcttaaatatttctataatttctgaatttttaaaaaagttaacctttataataattatttttaaaaaataaattatagagaaaatatgcacatgtatgtagataaagatatggaaggacaagcaccctattcagattccctcctcaacttttaaggaaccctgtttttataaatgggcccacctagataatccacctacctagacaagacaatccaggataaccttcctatctttaaagtcagctgatgggcctattcggggcataccacactgcccgtggattagccctgctctgtaaggagcagttaaaaaaaaaataaggtcagctgataaacaatcttgattgtatctgcaaccataattcctgtttgccaggtaacctaacatagttataggctctagaaattagaatacagccatgggggtgggtggggggtcattagtcggcctatcatggttttataacagcatgaagttttaaaaactagctgcctaatatatttaacaggtacacgttaaatgggaataaagaataatacaattattaaacgaagctaacctaaaaaaaaaaaaggataaaaaaatcaaatgtatcacttttttttttcatgggtactctaaaaaatctttgcttaacataaggtcatgaagattctctcctgttttcttcttgaaggttaataactttaggccttatatttaggtttatgctccattttgagttttgtaaattttgcatatgggtgtctaattgttccagcaccatttgctgaagagactgacacaaacaatgacatggatttttataaatctcaaatgcattatgctgaatgggagaatctagacataaaaaggctacatactacatgattccattaacatgacatgccggaaaaggcaaaactatagggatataaatcagatcaatgattgccagagcttggggttgcagagggatgactgactacaaacggcacaaggcaacttttggggatgatgggaatattccacatctcaattgcggtggttgttacatgacagtttatgtttgttaaaactcagaggcccacacaactaaaaagtgtgaattttattctgtgtaaattattcttcaataaacctgattttaaaaattatcaagtgacaagatgaaaaggtgtaatttgtttgcagggtcctagacttcctgagacctaaaaatgtgaccttaggctgaacgctgtggctcacgcctgtaatcccagttttgggaggccaaggtgggcagatcaaaaggtcaggagttcgagaccagcctggccagcatggtgaaaccctgtctctactaaaaatacaaaaatgagccaggcgtggtggtacgcgtctgtagtcccagttacttgggaggctgaggcagaagaatcgcttgaacccgggaggaggaggttgcagtgagccgagatcgggccactacactccagcctgggcgacagagtgagacactgtctcaaacaaaaacaaaaaaaaagtgaccttaatgcaaattaaaattagcaaagaaaccaaaaggtggagaactagaccgtcattaccaggttcccttactgcactgccactgtttccaaaaaaaaaaagggggaagacaacaattcagagtgagcactaaagaaagcattatccaatagccataggctcatttttcaggctagtgacctaacaatttaacaaataaacgcgaagctaagcctaagaaaaaactaatcaacgaaataacatttacctttggagtcagcatttgggaacagcctgttccatggcaccttatttttgtgtggaagagaaagcaaatagttcctagcttttaaatttattatacaattcaggtcttcttgtgatggggatccaagaatacctatcagataaaaaaattagctattagttatcaggaccaaggtaaatgactacacaccatcaactctgagtcggaatgaaccctgataattgatatgagccgttgcttatcaccactcctgatgtttacctttcttatgtttttacacaaaagtccttaacattttaaatcagagaaggttaaaaattcacacctaccacaggttaaagagtatattagaactcttcttaatttaatgaagtgactttgatgtaagctgtacaaacttgagtaaatctagctcctgaagggctcgggaaccttacccaaaatgtggttcagctggtcaagataatgcttccctggaaagatgggcctgttagaaagcatttctgccagaatgcagcctacagaccaaatatcaatggacttggtgtagccctgcaggagaaagagagaaaagactgaaaatggtatctggtgttacaggacatgatgagatcttcctgtatgacaggtgcattgctgatgggactctgaacttctcctttgactctacaattcagaaatacaagtaaacaacatggaaaagcaaaaaacaatttggctttcttatgagaggctgaacaaccaagattatgtgattttatttttctcttcatagttgattaacttgggctgggcacagtggctaatgcctgtaatcccagcactttgggaggccgaggcgggcggatcacttgaggccaggagtttgagactagcctggccaacatggtgaaaccccatctctactaaaaatacaaaaaaattagccgggcatggtagtgggtgcccgtaatcccagctacgtgggaggctgaggcaggagaattgcttgaacccaggaggcagaggttgcagtgagccaagatcgtgccactgcactccagcctgggtgacagagcgagactctgtctcaaaacaacaacaaacccacaaagttgattaacttattaaattagaatttccaaagtatacatccgtccttttttgaaacaatttgagagacagatttagaattgtcataaattggagctggaaaaagaaaaaaggtctaaaaaccttttctgggtttgggggagtgtgtgctagctccatcatattttaccaatctcttctaaaatattctcagctgggcatggtggctcacgtctgtaatcccagcactttgggatgccgagacgggcgaatcacctgatgtcagaagttcaagatcagcctggccaacatagtgaaaccctgtctctactaaaactacaaaaattagccgggcgtggtggtgggcacccatagttccagctacttgggaggcagaggcaggagaattgcttgaacctaggaggcagaggttgcagtgagccgagattgcaccactgcactccagcctgggcaacacagggagactccatctccaaaaataacataacataacatataacataacataacataacataacataacataacataacataacataaacataacataaaacataacataacatataacataacataacaaataaaataaaataaaagaattctcatcttcttttcctattcatttttcaggaatatgttttcttttaaaggaatcctgttagaagtcatgggaggatactttgggaggctgaggtgggagtactgcttgaggccaggagtttgaggctgcagtgaactatgactgcagttgcactgttacactcctaatagcagcatgtgaaagaaaatgcatttcctcatgtcctcaacaacactgggtattaactaattattattattattatcattattattattattttgccacacatggtggctcacacctgcagtcccagctactcgggaggctgaggtgggaggatcacttaagcccagggattggaggctgcagtgagctgtgaccgagccaatgcattccagcctgggtgacagagtgagaccctttctctaaaaattaaaaaaaaaaaaaaaaaatcatggaaggattctgtctgaatcataacaatggtgcaaaaaagatgtttctccaaggaatataagctgactcttttaaaattaagagatggtgtcatcactctgtcactcaggctgaagtgcaatggtgtaatcatgcctcactgcaaattcaacttccttgtctcaggtgatcctctcacctcagccaggtcctgagtagctggcactactgagtagctggcacacagtaggtgggccacaggcatacaccaccacacctggttgatttttaaattttttgtagagaaggggtcccactatttgcccaggctggtttcaaactcctgggctcaaatgatcctcctgcctcagcctcccaaagagctgggattacggcatgaggcaccatacctggctccagaagtgccttctaatacaatgaagtgcttttctggtattcatgttaaaaatgcatgacccaaaactgaggggcattctacaaaatagctcatctgcactcttaaaggagactaaagaaacacaacaacctgtctctatgaaaagcacaaaaataaataagtaaatcagccatgagcagtagcacgtgcctgtagtctcagatacttgggaggctaaggtgggaggatggccttgagcccaggaggcggaggttgcagtgagccgagatggtgccacggtaccccagcctgggtgacagaatgagaacccgtcctttttttttgagacggagtcttgctttgtcacccaggctggagtgcaatggcacgatctcagctcatgcaacctccacctcctgggttcaagcgattctcctgcctcagcctcctgagtagctgggatcacaggtgcctgccactatgtccagctaaattttttgtatttttagcagagacagggttttgccatgttggccaggctgatctcgaactcctgaccccatgtgattcacccaccttggcctcccagagtgctgggattacaggtgtgagccactgtggctggcctgcgaacctggtcttaaaacaagcaagcaaacaagcaaacaaacaaaactcatgacagtacaacatgtgaacctgtgcccaggtcggggggtggtttgggtggggtatagttcaaaggttattgggataatatctaaaatgtgaatataaactgtgcattagatactgaatcagtattaagtttcttgattttgaaaactgtactgtggtcatgttagagaatactcttaaggcagggtttttcaacctcggtatgactaacattttgggctgagaaagtttctgtttggagggctgttctgtatatcgtaggatttttagcagcatctctggcctcttgatgcagggagtacccctacccctcactgtgacaaccctgccacatgtccccagggaacaacaggaccatggtttgaagtaaagacatactgaaacaaggtgaaggggtgtatctacaatttactctcaaatgactcagagtgcgtgggagtgcccacacacatgcacacaaagaatgataaagcaaatggggcaaaagataaaaaatcggtgagcctgaatctggggtaaagggtatttaggagttctatctggcggttctacaagagtgttccagagactcctatgggttccctctagaggatctgagaggtcacagtacatttattatactactatgacattttcatccttttcagtcacgagtgaaaagaagatttttccagatgcaatatgatgagtgatgatgtgtacatgaaaatgtgacacttggaatatctgtgtaactcagtgaaccagtattttccaaatacgctaaaaaatcatgcatgagtatgagtgcaaggtagactaatggattttaacgaaatagtatcaagaattcactgatatgatttcagattccacactgcaattaacctttaagaaaccaccacttgtttaaactgggggtaggatcaaagaatagccacaagtggctgaaaagactactaaaatttccctcctttttccagctacatacctgtgtgaagagttttcctctggccataccaccctgaacacgcccgatcttgtctgatctcggaagctaagcagggttggcctggttagtgcttggatgggaggaatagatcttgaatttcataaatagcactcagacatctatttttaggcttatttgtaaatgtcttgataaaatgtctgattactgttacatactagggaaaaatctcacttttttgtgtgttatgcttttaagcatagattttgtttgctaaaatgttatttagaattttgcatgtatttttcactggcttgcgatttttctttttatataacatcttttttaaagggtctttattaatattgcactcaagttttcttctgttttctatgctctgaattcaagcagttaaaatccatgggaaagagttttccttgacatttttgaagaactatgcatgtaatattatattgattattaaattgattaaagcctgaaaaaaaaaaaaaaaagagttttcctcatgaacttaaaccaaaacaacatatttgacagactgaatgcagaaccagatgagaatccaactgtcttctattaagccagacattaaagagacttgcaaaaatgaaaacaatgccactcttctcactaaaaggttgtttttcgttttgctttttttaaagacagggtctcaccctgttgcccaggctggagtgcagtggcgtgatcacggtacaccgcagcctcaatttcctgggctcaagaaaatctcccatctcagcctcttgagtggctggaactataggtgcacaccaccatgcccagctgattttaaaattttttgtacagatggcagggcacagcagctcacacctgtaatcccagcactttggaaggccgaggcaggtggaccacaaggtcaggaggttgagcccatcctggctaacatggttaaaaccctgtctctactaaaaatacaaaaaaattagccaggcgtggtggcggacgcctgtagtcccagctactcgggaggctgaggcaggagaatggcgtgaacctgggaggcggaccttgcagtgagctgagatcacaccactgcactccagcctgggtgacagagcacgactccgtctcaaaaaataaataaataaataaataaatttcttttttgtacagagtctcactatgtcaccagggctggttccaaactcctggtgatcctcctgcattggccttccaaagtgttgggattataggtgagagccatcatgcctggcctcactaaaacgtttttattgtagaaaataaacttattcttaagaaaaacatgtaatttatcttaacatgtagtgggtttactatttaaaaattaattaatacattttaaagtttcatattgtaggccgggtgtggtggctcatgcctgtaaccccagcactttgggaagccgaggcgggtggatcacctgaagtcagaagttcaagagcagcctggccaacatggtgaaaccccatctgtactaaaaaatacaaaaattagccgggcatggtggtacacacttgtagtctcagctacacgggaggcgaggccggagaatcatttgaacccgggaggcagaggtcgcagtgagccaagattgagccattgcactcaagcctgggggacaagcgccagacttctctccaaaaattaaaaaaaaaaaagtttcatattgtaaataacaatagatataacctacgtaactaaaaaaaggtgtgtgggtccttgactttttttttttttttgagacagagtctcactctgtcacccaggctggagtactgtggcaagatctcggctcactgcaacctccacctcccaggttcaagcgattctcctgcctcagcctccaagtagctgggattacaggtgtgtgccaccatgcccagtgcattttttgtatttttagtagagacagggtttctccatgttggccaggctggtctcgaactcctgggctcaactgatccacccgcctcggcctcccaaagtgctaggattataagtgtgagccaccatgcccagctggtccttgataatttttaacaaatgtaaagggatcttggctgggcgcagtgggtcatgcctgcaatcctagcaatttgggaggctgaggtgggtggatcagttgagcccaggagtttgagaccagcctggccaacatggcaaaaccctgtccctacaaaaacatacaaaaattagccgggcatggtggtacacgcttgtagtcccagctacacaggaggcaaggctggaggatcgcttgaggagggggtggctaccagcctgggtgacagagagaaaccccgtctcaaaaaaaaaaaaaaaaaaaaaaagccaggcacggtggctcatgcctgtaatcccagcactttgggaggctgaggtgggtggatcatctgaggtcaggagtttgagaccagccaatgtggtgaaaccccatctctattaaaaatacaaaaattaggcaggcgtggtggcaggtgcctgtaatcccagctacttgggaggctaaggcagggagaactgcttgaacctaggaggccgaggttgcagtgagccgagatggtgccgttgcactccatctgggtgacagagcaagactgtctcaaaaaaaaaagaggctgggcgcagtggctcacacctgtaatcccagcactttgggaggctgaggggggtggatcacttgaggtcaggagtttgagaccagcctgaccaacatggtgaaaccccgtctctactaaaaatacaaaaattagctgggcttggtggcatgcatctgtaatcccagctacttgggagactgaggcatgagaatcgcttgaacctgggaagcagaggttgcagtgagccgagatcataccactgcactccagcctgggtgacagagtgagactcggtctcaaaaaaaaaaaaacagaaagaacaaaagaaagaatgaaccaatgaaagaaagaaatgtaaaggtatcctgagacaagaaggtttgagaatggctaccttatacttttcttgcaacttttatgtttttagacagagtctcactctgccacccaggctggagtatagtggtgtgaccttgcctcactgcaacctctgcctcccgggttcaaacgattctcatgcctcagcctcctgagtagctgagattacaggtgtccaccatcatgcctggctaattttttgtatttttagtagagatggggtttcacaaagttggctaggctggtatcgaactcctggcgagtaatccacccaccgcggcctcccaaagtgctgggattacaagtgtgagccaccacacccagcaacttttctttaaaaaattttttttctttcctaaacaagctaaaacagcgcaagttttctgaaagctgaaattctataaaacgttacaaatatgtacacagagtgctctagcttctcaaaactgggacaatatgagtttaaaaaaaaaaaagaaagaaaattaaaatggagaacacataaaaaaaaaatcctgggtctgcaatagtgttttaaaaacaaaggtaggatacagaggaagagaaagggtaaatgggaaaaatcttcataggagaattctagctaatacaagtaaaagaaagaacaaatttagaaaattaccattttataacctccagtatgataactgacagaagtgagtgctgaaccactgggggaaggctgctgggaaacaaggatggccatcctggctaacatggtaaaaccctgtctctactaaaaatacaaaaaaattagccgggcgtggtggcgggcacctgtagtcccagctacttctgcaccgtcttcaggaatctgtagtggtcgtgttagaaacgtgcaagctacatctcatcagaaagaactcactggaggaatccacaatgtgaaccactctgtgaaacaactgatctgtacattgcaaagtactgaatgtcttaaagaagagaggaagggcaagactgttctagactaagaataatgcatgaaacaattaaatcatgtgttgaaaacagagttacctagacttttttgggaggatgggatgtcatggaattaatgctgatcattttatgaaagggtaagggtactctagctgtgggaagaacaccttccttgtaaggagcattagtatgccccaaagggtctaggagtgaagtgttatatgttggtgaagtgtcacatggtctgacaaaagagaagagacagaagaagaaagagagagagaaaggaaagagtaagagagggaaggagggataagaaatatgacaaggtgttaatagctggagaaccaaggacaggggcatatgggtattcactctactctcaatttttctatgggtttgataattttctacattaataaaaataaacaaaatgaagacaactgctagaagtaacattctcaggctacaggtatcgcaaataagaaaaaaatgaacactcaattttcactttggtgaccctgcaagtagaaggaaaagctggtcatcttgaagaacaccctctctggctacttctccctggagggtaatagagaagtggagacagtggcggcgtctaagtcagaacggagactgcaagaccaagccacaccaggacaaaggcacaccaacagctccctttacaactggcactgaacactggcatgccaatgctccttgtttagaatggctgtcacgtggccagtcagagaaagaacctgttgtgtgggattatttgtgatatagaattacagagaatcaacatggcattttcttctctgaaacatctgttacaccaaatccttctttataatggaatttatgttaatgagattttacttttataactaaactgaacaaatgtaggatatcaagaaaaactaaatgctttaaacaaattccatttccttatgaaaaaatctaatagcttatctgtactagtaataaaggatggaggaagaaaaagaagactataagctaattagacctgttctttcatttccactaagcctctcaggactatttctggttcctgggccctagatacaagatccaatgtctatttttattgcttttcttcaagtatctttacatgacagcagagggaactgtgtttaagaatcttataatcctgagatactagatacaggtagtatgtcaggcctacttaactactcaattttcacaccttattcatatattatttgcaaataacagaaaaatactgaatctcaatctccatagcagccctcaatttttgcctcctggctcataaacccaacaaaaaatgtcagacttcacttttctgggcttttgtaaacttattcaaccatttcttatgaccaagacacagaccttgctagtagagtgtggatgagacctggatgcactctctatagccactcacagatgcagaggaaagcacttcatttggaagcaggaaatcacgtaatttcaaaagaatccacggcagttcctactctgtccacatttatgttttcttcaagtacaacaaattacaatataattctgccgaagagacattcttcattatcagataaatttgacctttatagaatagccctggcccatgttcacagaaatacacattactgaataacctctacaacaaacccagcctgcacctaacagtgacagcgataggtaggacttcaggacagctgtccaaggagtgaaacacagaccacttatggtaacagtgactggagaggcacaccccctcctactctacaaccgtcagcactatatcagctgaggtagagaggctgagccctagggcccagaagttcaatgccgaacaaaatttagacagcaccttggggccaggtgtggtggctcatccctgtaatcccagcactttgcggggggcgtggggggtgctgaggtgggtggatcccttaagctcaggagttcaagaccagcctgggcaacatgcgacataggaagacgccctacttttacaaaaaaaatttaaaaattagccagatgtggccaggcacagtggctcacgcctgtaatcccagcactttgggaggctgaggtgggcggatcataaggtcaggagatagagaccatcccggctaacacggtgaaaccccgtctctactaaaaaatacaaaaaattagccgggcatggtggcgggagcctgtagtcccatctacttgggaggccgaggcaggagaatggtgtgaacccaggaggcggagcttgcagtgagctgagattgtgctactgcactctgcctgggcaacagagtgagactccatctcaaaaaaaaaaaaaaattagccaggtgtagcggtgcactctgtagtcccagcaactccggagactgaggtgaggagggtcacttgagcccaggaggttgagactggtaagccgtgatggtgccactgcactccagcctgggtgacagagtaacaccctgtctcaaaaaagacagcaccttgtctctggccagacaggcaaactctcaacgcagagggagacttacggcttactgcaatgcattcagaaagttctcttacttactggatttctttttatgcaaacttcatccttaccttggaattcaacataatttctggagccctgtaccaacgtgtggccacatattctgtcaggaaccctgtgtgatcatggtctggatctgcaacacgggccaggccaaagtcacagatctaagagagaaaaaaaacaggataacttcttagaaattctaacctttcatatcaaaacatcacaaaaataaaaaaggcaataggaataataatgctactaagtggcagatactttctgggcattctagaaaatcattatttaattttcccaacaacctgaaaagcaatcaacatgttagagaccaggatgcaggctgaagaagtctttacagagcacactttaagaagcatccctacctttcattatctgcttagcacaaagcaatctcaataggtgaattgacaaaaactgttctgagtagtcaccaaaaccaaccagtacccttttctcagcctgtcctgctggagctctcaggactgctgtgaagatctgcactggccttctattctcagactctactttctgctagtcttctacttagtctataaatataagtatttccaaagattcttcccacttccttcttctaggtagtcaaacctactcccaaagctttttttttttaaagtttcatatacttaagaatattttatttttaaaaaatacatagtttctcattttctccggtctcaagcatctactggcctttcatcatctggccctccaatatcatggtgtggcttattttctatttttagtagagatggggtttcaccacgttggccaggctggtctcgaactcctcacctcaggtgattcaaccacctcagcctcccaaagtgttgggattacaggtgtgagccaccatgcctggccatgatttttttttaaggtctgtcaacactataaaatcaaagactaaccaaatttacatgacactaatcaatacaatgccaaggctacaaaataaaaaagcagtagtactcagtataattccatacaaaggaaaataaataaggatatggtacaagaaaatataccttttgggctgtgtaaattcagattttcaaaaacaaaggatgccccaaagacgtgtttcatttgtatctatcagagtctttctttcataggcatagccagaattttcacatgttgtgatcccagcatcttgtgactcctactgggatttctgtgggatcagtctagtaaacaagggcacagactagtatagctcacgttccctggtagttacactagaaatgtgctagcagagcctccaaatagggtctgtaaccctggtgagttcctgtggtcctgaagaataaagtctacaagagaggatcccggaagggtcctaagatgtcaatgtctgctgggtcttaagcttcataaaataagtgcaaagcatgtttatggaaaccaaaaagcaagcttatttctgtcggccttgactgataacagagccaaaagttaaaggtctaagacactgataatagctgatatcgataagggttcaagatattttggtaagggttcaagagtaaaaaacactgtaacatagaagtcattggatgaaggttgaagaaatcttcttgaaaatctgaaaggacctaaataacaggaggtcagtgacgctgcaagttacaaacttcctaggccaaggggcctgtgggaataggcatcatggtcacatggcactgaggatgtgataaatgtgcagtgatcccagagctccagcaaacacaagtcctctcctcatgtggtgttctcaactgtcatatgcacactgaactgccactgcctcttgccctgctttgacacgctcactgtaacaaatcagtgacataccatactcatctttgaatgagattctctcttctcgcatttatacccatgagaatgatgcacacacattgctgtatacttttttttttctgagatggagtctcaccctgttgcccaggctggagtgcagtggtgccatctcagctcactgcaacctctgcctcccactgattctcgtgcctcagcctcccaagtagctgggattacaggtgtgcgccaccacacccagctaatttgtttgtattttcagtagagacagggtttcaccaagttggtcagactggacttgaactcctgacctcaggcgatccgcctgcctcagccactcaatgtgttgggattacaggcgtgagccatggcacctgactgctgtatacttttaaaatatcagtaaaggccgggtgtggtggcaaatgcctgtagaatcccagcactttgggaggtcaaggcgggcggatcacgagatcagaagttcgagaccagcctggccaatatggtgaaaccccgtatctactgaaaatacaaaaattagccaggcatggtggtgggcacctgtaatctcagctactcaggaagcttcagcaggagaattgcttgaacccaggaggtgaaggttgcagtgagctgagatcatgccactgtactcctgggcaacagagcaagactctatctcgaaaaagtataaaataaaaataaaaataaataaaataaaaataaaataaaataaaataaaatgttagtcaatttgttatgcttctgattctttgtgttaacttgggttttcaagacgatgcctaaattatgccacggccaacaactcgtgtgtgtgagtgtgagtaggtgaacagaatggccttaaagacaagtccataaactgggaagagacaacagagagagtagtctggttctatttgttttattcttaaagatgaacactttcaagcaaaaataagagccaattcttcccagaaatgttatatgcttaaaatattgattgagaatgtctctccaaaaacaaaagcaatctgccataacagggctatgatgataaccaaaagaaaaaaaaaacacgaggagacataaaaatattcactgcaaattttcaagacaatcattaagtgccaaagaagtagtacagccatcctaaacatagctttattcgttttgtgcccacctgactcttggttgcactgatccaggtaaaggagctggttccatcccatgtggaaaagacataaacctgtatcagaaggatcctaagaggggacagagtccaatccacacaatatctgatgaaggaagctgtcctttacatctcactggacattggccaccgtgttcacccaccgtgacaaaacccaccgctttttacacacagttctagaaggttccccacgatctacttgcaaccaacctttttagcttagtgtcgatgactccctattactcatccaatgctgcagccacagggaggaagactcagtgctttcggtagtagtcccttccttcttattttatttctgtactctctgcctatgataccctatgtccaatagagccactggcctcccgcaagaaaagctacccaacctcgagggccggcacagataccaccttcttcctgctgcctcccagtcccagccagcgctagcccacctctctcctttgcatttgtacaccatctttttctccatctcagttacagaacatctcattataatcacctactgtctaccagatttctgatctatcagttttcagatttcaagggcagaccctcatctctcttgtctggcgtatctcaaagggcttctcataggagtgtctgttgaactgaaatccaataaatgattattgctatacatatatatgtacttaagcagctttattaacctataattcacacaccatacaatttgctcatttaaagtgtataactcaatggttttagtattataatggtggaaattaaccattaccaccatccaatttgaaaatatttttataacctcaaaaagaaattccagtgagttagtattccttccttctttattctcccaactcctctagccctaggcaatcagtaatccactaattctaatttttgtctctatggatttgcctattctagacatttcacgtaaacagaatcatacaatatgtgtcttctgtggctgccttccttcacagacatgtttccaagattcatccatgttgtagcattatcagtacttcactcctttctcttctactgtgtggatccaccacactgtatttattcatcatcagctggacatttggattgtttctacttactggctatagtgaacaataccactatgaagatttgtgttcaagtttttgtatagatgcatgttttcattttcactaaggagtggaatcctcaccaacacttattatctgactttttaactacagccatcctagttagcatgaagttgtttcaatgtaattttgatttgcatttttctactgactaatgatgtcaagcatctatcattccatgtgcttattgccatctgtatatcttctttagagaaatgtctattcagatcctttgtccattttttaaactaggctatttatcttttcattattgagttataagagttcttcatatattctagttttaagtcccttatcagatgtatgatttgcaaataccttctctcattctgtggcttgccttttcacttttttgatggtttgctttgtagcacaagtttctaatcttgatggaatccacttacttttttcttttgttgcttgtgcttttggtgtcatgtctaagaagctttgcctaacataagattgcaaagatttacttctatgttttctaagagtattaaagttttagcttttaattgagttcttcaatccattttgaatttttttttccttttgagacaaggtctcactctgtcaccccagatggagtgcagtggtgcaatctctgctcactgcaatttccacctcccaggctcaagcagtcctcccactcagcctcctgagtagctgggaccacaggcacatgccaccacgcccagattaatttttttgtattttcggtagagatggggttttgccatgttgcccaggctggtcttgctccggagctcaggcaatccacaggccttggcctcccaaagtgctgggattacaggcgcgaaccactgcacccagccattttgagttaattttttcatctttttgtatgtggctattcagttgtcccagattcatttgctgaaaagactattctttccccagtgaatggtcctggcatccttgccaaaaatcagttgaccatagatacacgggtttatttactgactctcacttctattccactgacctatatgtctattcttatgccagtagcacactgtcttgattactgtgttttgcagtaagttttgaaatcaggaagtgtatcagttctccatatgaatttccatatgaattttgggatcagcctgtcaatttctacagaaaaaaacaactgggggctttgatagggattgcactaaatctgcaaatcaatttggagaatactgccatcttaacagtattaagtcttatgatccacagacatgggatgccttcccatttatttaggtcttcttgaattcctgtgcatttttttagactgaatcgacatcgctccgtcacatctaagatatccataaatttccctcgtttacctgtaacacccattaaaacagaaatatgtaaatgctgcatattttcagaactctgaggactgtaaagaatttggggttttcttatttagttggaatgccttattaggtattaaagtcagtgacgttaagttttctgctgctatcttttgaataaaatttattgaagaaaaatgtcaccaacaaaacatgattttaaaactaacacataaggccaggcgcggtggctcacgcctgtaataccagcactttgggaggccaaggtgggcggatcacaaggtcaggagattgagaccatcctggctaacacggtgaaaccccatctctacaaaaatacaaaaacaaagaaaaattagccaggcgtggtggcaggtgcctgtagtcccagctactcgggaggctgaggcaggagaatggcgggaacctgggaagcagagcttgcagtgagctgagatcgcgccactgcactccagcctgggtgacagagcgagactccatctcaaaaaacaaacaaacgaacaaaaaaactaacacataatgtacgtgatcctgtttatctatataaagtataaaaatacacatgtatgcaagagcatagaaaatactttgggagaaaatacactttgttttttaggacagagttttgctttgtcacccaggctggcgtgcagtggtgtgatctcggctcactgcaacctccgcctcccaggttcaagcggttctcctacctcagctcccatgtagctgggattacaggcgcatgccaccacgcccggctgatttttgtatttttagtagagatggggtttcgccatgttggccaggctggtcttgaactcctgacctcaggtgataaggcccaccttggcctcccaaggtgctaggattacaggcgtgagccaccgcaactggccaccaatttgttatagtagttagttatcacggcctggtgctgtggcccacatacataatcccagcactttgggaggccaagaaaggaggactgcttgagcccaggagttccagaccggcctgggcaacatactaagactctgtctttaagaaaaaaaaaaaaaaggtatctctggggagaaaggagcaatgggataaggaagaagaagaggactaccacactttattagcatttttgccataaacatgtttttgggtatttctggtgtaatttaaaatatgaataatgacaaatataactatgcttcagtgaaagggtttttcaatatatatcaccttaatagtaaataacctggctgaccttgagatcacaggtggtgttgagcagcaggttggaaggcttgaggtcacggtgcagaacgttagctgaatggatatattttaaccctctgaggatctggtagagaaaatagcagatatggtcattgctgaggtgttgtgtcttcaagagcttgtaaagatctgtttccatgaggtcctgtactatatatctgtttgcacaggttaaggtaaaacaccaattagctggtcacatttagcaaagcattgaaaacaaaaatgcatcctctcttgactctcttcccaaacagtccatcattacaccatgaagcccttaaaggaaagaagaaactgaggaaaacttggtttccttcatggaaagaatctgaagtcgttaactccttttaggtcctgtgagatggcaggcattccagcattacatctgactgatgcggctatgggcctagactgagatctgaaacaggctgttagggaaattctggtcaatcttgaagtctcaacctctttgctctctaaattgtccaccatcaacgaaccccctccaaggtttgctggaaacactgttagcctgtaagtagcagatactccctcctctgtttggtccagtaacctgtaatgtcactattctttttacttcttgttgccgctcccctcctctcccaagctcctcaaaagccaaacataaaacttccagaaatacaggtctagaaacatactcttactagtaaatccaaccctaagtctattttcttgactcttccattactgttaagatcttaaataagtaagactatgggcaagtcgttctaagaaggggtttgtgctagttttcctcctcatgctttcttgcctggtcacgtacttaactacctaaaagtttagctatggctactttctttctcacagaaattaaattattaaagcatttagcctttaacttcatcatagtattatttcattagcagtatttctacatttcttttactcacttctgtgtaaacactagtctctgtttcttacagatttatgctataggaggcgcagcatgggattcaaaggaaacatgatttaaaaatctgtcatctgagagaggcttattttcatggcaaaaagtaaagcaggaccaacaggtggtagtggcaggaggcatttcacttcaaatatcactacaacttattaacagagctgtttaaaaatggaaagggctgcctagaaacagcgagctcccgcaccctggaggggcggaatacaaattgggtaaactggtaggagtgctgtataaccctttcccttctggcagatcctcttcagtatacttaacctctctatctttcaaatggagcctttacccaggcagcatcctctagatctgttcagtccagatttctaaatgttggtcagagttaatcacataatttcagacctcagttgaccttaaagatcatgacgaccagttccttcattttaaaggtggggaaactgagacctaaagtggtaacctgactcttaagatcaggacagtcctgatttcaccaggtagatagccagggcaccctctttcttagtctactactgatcttccctttaccttttcatcatcacaacaaaccatcccttggacagaagaaacatgactgcaaacagagttaaccaagattttccatgactagacttagggagtaaatagcaaacagattacgattttccctttagcatgtttaatgcacttttcctttaagttcaggaaatttcaagttctatttactcaacaaggttaccaagcagtggaattggccagttgcctaaaaaggatacacatctttcatttgctcgatggttggtgctcgaataatgtcattgattccaatgatgttctcatgtctgaagcgcagtaagatttttatctccctcagggttctctggcagtaggtctggtgctcaaaggggctgattttcttgatagctactcgaactttgttgacattatcataagcagagcttaaaaaagagagagagagatggcattaaaaacagccctcagaatatttgaagaaggcaagttggtaaagtattatatttttaacactgtgtaaacacctgtttcatacccgtgaaggcagcatgtatattatccacaaaaaggcctcaagctagggaggatggatgcaactgacatgagagagcacacagtgactctcaaaactaacagagaacctagccctgttaactgggtgaaagtcttgcctttataaacccagaaatacacaaacaagcattctcccattgtcttaaacagcaactgcattctggtgagagtaatcacttctgtctctgaaacaccttcttactgttgtatcaaattcctctgacacagaagaaacattcaaataacctacaactgtacatctttatccctaacaaaaatggacccaagagaacaccttgattacttctattaactttgtttctctcacttgcaaaacaacatgaccatttcttcccccaagaaactgaatcaagatgtttgggtagttttataacaaaacctagaaaagtattcttcaaaaaacatatttgtggcaataacatggggcccagttctttcctagttgtccttaatgtctgataaaccagaattataagcaaaagcaataataaaaattataccttcaattttatgaatttgaatcttgagtattactactatctttatgataaacattctattacaatcttgtgtataagaaattttcatattaataaatgtcaacatctggcccactgaccaaagcaatcaaataacattgacaggcagtaagacaacatttcttgtttccttggggtaagtgctagaatagaaagcagtaaaataactttattctaaaatttatgcttctagggccgggtgcagtggctcacacctgcaatcccagcactttgggaagctggggcggctggatcacttgaggacaggagttttgagaccagcctggacaacatggtgaaaccccgcctctactaaaaatacaaaaaaattagccaggcatggtggcaagtgcctacaatcccagctacttgggaggctgaggcacaagaatcacttgaacctgggagatgcacgtggcagtgagccaagattgtaccactgcactccagcctgggcgacagagtgagactccgtctctaaattaaataaagtttatgcttctataatatttatcagtctactaatcctaagaattattgatacatttgtctgattctatgacaagataatgctctggaggagaactttgtcttactaggatccaattatcctacaacaccattaacatatagtacacaggtggccccaaatgctttgaaatgaagtatattttcttaagtaaaataaccactactcaaatcttattttgctttggtttggtacatgaggccctaagccagtgattttcagttaggcaacagcatatataatagtaataatttaacatagtattaaaaagcatatataataagcaagcttattcaatattgggaatatttttagaaaaaaattctattttggtaattcaaatcatagaacaagagttcaacaacagcacggattagttataaaatgctggtttaaactcaacattacaattttctagtgttaatattataaatttctagtgttaacagtcacaagtggtcataatttgttctgcaaaattataatccaacaaaatttttggagagaggagtttatggtcagtgtgcccctctactgtatcaacactcagtgacgaaataactgccctcccccccggcctctttaaaatttttttgtggaagcagtctcgctctgtcgcccaggctggagtgcagtggtgcgatcttggctcactgcaagctccccctcctgggttcaggccattctcctgcctcagcctcccgagtagctgggactacaggccccgccaccacgcctggctaattttttgtatctttagtagagacggtgtttcaccgtgttagccaggatggtttcaatctcctgacctcgtgataggccccgcctcggccttgcaaagggctgggattacagggtgagccaccatgcccggccaactgcctccttttaagtaagaaaatatgagatcatcctcatctggtcccacttgaaaaaaaggagttttgtctgttcctgtctgctccgcttaaccattctgctgcctttttggtttatgcaatctatctttcatagaactgatgacaaagagggttacactcttccataatgattccatacttgctagtttctccttggatttctcggttttgttttacatattttattgttgatacttggtaaataaggcataccatgaactttcaggtgtctataaacatttatgctttaaaatcactttgacattaccaactgtgtcttgttttgctcaaccccttttgtccctaactaccaccacactacaggtttttgctataagtgtgtctcttatcacaggaatccaaagatggttcattaaaaaagaaggccgggtgcggtggctcatgtctgtaatcccagcactttgggaggccaaggcaggcggatcatgaggtcacggcaggcggatcatgaggtcacgagattgacaccatcctgtccaaaatggtgaaaccccatctctaccaaaaatacaaaaattagctgggtggggtggtgcgcgcccatagtcccagctacttgggaggctgatgcagaagaatggcttgaacccaggtgatggaggctgcagtgagccaagatcgcgccactgcactccagcctggtgacagagtgagactcagtctcaaaaaacaaaaaaaaaaaaagtgggggtcagtcctaatgggtgtgtggtgatagctcattgtggttttgatttgcatttctctgattcatgatgatgaccatcttttcttatgtcttcttttgaaacgtgtattcaacgttatgccttttttttttttgagacggagtctcgctatgtcgccaggctggggtgcagtggctcaatctcggcttactgcaacgtctgcctcctgggtttatgcaattctcctgcctcagtctcctgagtagctggaattacaggatctcctgacctggtgacccgcctgccttggcctcccaaagtgctggaattacaggcgtgagccacccaccacgaccagccaggactgccactatttaaaaacaaacaaacaaacaaacagaaaaccgtaagtgtgatgtggataaatttgaaccttcatactctattgttgagtgtgcaaaatggtgtaaccacttggaaattcctcaaaaaattaaaaatagaattcccatatggtccagcaatcccacttctgagcatatatccaaaacaattcaaagtagaatctctaagagctactggcaggttcattgtgcagcattacgcacaatacccaagatgtggaagcaaccgaaatgtccactatggatgaatggataaagaaaatgtagcatatacatagagtggaatattattcagtctttaaaaaaaaaaaaaaaaccacacacacacacaaagaaattcaattcagcatccaaaaaccatgcctaattgtttttattatttatttatttatttgagacagagtctcgctctgtcgcccaggctggagtgcagtatcgcatcttggctcactgcaagctccgcctcctgggttctcgccattctcccgcctcagcctcccgagtagctgggactacaggggcccaccaccacgcccggctaatttcctttttttttgtatttttggtagagatggggtttcaccatgttagccaggatggtctcgatctcctgacctcgtgatctgcccgccttggcctctcaaagtgctgggattacaggtgtgagccaccgcacccggccaattgtttttaatttaaaaactttttggtagatatggggtctcactatgttatccaggctggtcttgaactcctggtcataagtgatcctcccacctcagcctcccaaagtgctgggattacaggcatgagccattgtgcctggtctgacttaatattcttaaagtgtctacactactcagtgtggtctgcagagtcaatgtaatccctatcaaagttccaatggcatttttcacagaaacagaaaatgtaatctttaaattcatatatggaaccacaaaagatcccatatagccaaagcaatcctgagcaagaacaaagtggtggcttcacatcacttgatttcaaaatacactacaaagctatagtaaccaaaacagcacaacactgcggggatagggtgaaatgtgcagataatttgttagagtataaagtttcagttaaccaggatgaataagttctagagctctatcctacagcatggtgactacagttaataataatgtattatatacttgcaaattactaaaagattagatcttaaacattctcaccacaaaaagtatgtgagatgacagatatgttaattaccttgctttaatcatttcacaatatacacatatatcaaaacatcatgttgtatatcatgaatatatactaattatttttccagcacttccacctcagtttcatatactaatttgtatttgtcaattataccttaataaagctgggtggggggcagggaatcagcatggtactggcataaaaacagacaaatagacaaatggaacagaataaagagtccaaacataaaggatagtctcttcaataaatggtgctgggaaaattggatatctacttgctaaagaataaaatggatacttatttcacaccctatacaaaaatcaaatcaagacagattaaagacaaaaattgtaaaacctgaaattataaaaactagaaaaggctgggcgcaatggctcaccctgtaatcccagcactttgggaggccaaggcgggtggatcacgaggtcaggagatcgagaccatcctggctaatacggtgaaaccctgtctctactaaaaatacaaaaaaaaaaaaaaaaaaaattagccgggcgtggtggtaggcgcctgtagtcctagctactcgggaggctgaggcaggagaatggcgtgaacctgggaggcagagcttgcagtgagctgagatcgtgccactgcactccagcctggatgacagagagagattccgtctcaaaaaaaaaaaaaaaaaaaaaagcaaaagcaaacaaataaacaacagacaaacaaacaaaaactactagaagaaaatacagggggaaagcttcttgacattggtctgggcaattattttttggttgtgactcccaaagcacaggcaacaaaagcaaaaacagacaaatggaattgaatcaaactaaaaagcttctgcacagcacaagcaacaatcaacagagtgaagagacaacccaatgaatgggagaaaatatttacaaaccacatatctgataaggggctaatatttaaatatataagaaattcacacaattcaacagcaggaaacaaacaaaatatttaaaaatgggcaaaggccaggtgcagtggcacctgcttgtagtcctagctattcagggggctgaggtaggcagactgcttgagaccaggagttcaagaccagcctgggcaacatagagagaccctgtctcaaaaatggaaaaaagcaggtgcgggtggtagggagtgggggcaaagaacccgaatagacattactcaaagtaagacatacaaatggccaacaggtatatgaaaaaaggctcaacatcactaatcagaaaaatgccaatcaaaaccacaatgagatatcacctcacagctattagaatggctattatcagccacctacggtggctcacgtctgtaatcccagcactttgggaggccaaggcaggcggatcacctgaggtcaggagtttgacaccagcctggccaacatggtgaaaccctgtctctactaaaaataccaaagttagccaggcgtggtggtacgcgtctgtagtcccagtttcttgggaggctgagtcaggagaatcacttgaacccaagaggcggaggttgcagtgagccaagatggcaccactgcactccagcctggacaacaagagtgaaactgtctccaaagaagaaaaaaaaaaatgttcttgcccccaccacacacaaacgttaactatgtgagttgatgggtatcttaattagctttactgtggggatcatttcgcaaggtatacacatatcaaaacatcacatttaacacagtaaatatatacaacttttatttgtcaattatgccccaataaaggtgggggaaaaaccaaaaaggtcattctatcacatgctataacatggatgaagcttgaggacattatatcaacagaaataagtcacaaaagacaaatactgcataatttcacttatatgaggtatccaaaattaacaaactcatagaatcagaaaggagaatggtggttaaaaatggctgaggagagggagaaatggggagatgtgttcaagagtacaggttttcaattttccaagatgaaaaagttctagatctattgtgcaacaatgtgaatatacttaactctactgaactgtgtacttaaaaatgattaagatggcaaattgtatgctttttaccaaaacatataattaaccaaaacaattttactttgtaaagagatgaagtctcggctgggcacggtggctcacgcctgtaatcccagcactctgggaagctgaggtgggtggatcacgaggtcaggagatcgagaccagcctggctaacatggtgaaacactgtctctactaaaaatacaagaattagcagggcgtggtggcacgcgcctgtaatcccagctactcaggaggctgaggcaggagaattgcttgaatccgggaagcaaaggttgagtgagctgagatcacgccactgtactccagctctgggcgacactgcaagactccatctcagggggaaaaaaagcgagagagacagagagagagagagagagagagagagagagagagagagagagagagagagagagagatgaagtctcactatgctgcccaggccggtcctgaactcctgagatcacttcctcaggcttcagagtagttgggactatacgcacatgccatggcacctagcttaaaaaaaatttttttaagggggaaagaaacatgttaaagagggaaaaaaattaagtattaatttttttttgatggagtctcgctctgttgcccaggttggagtgcagtggtgccatctgggctcactgcaacctccgcctcctgggttcaagcgattctcctgcctcagcctcctgagtagctgggactactggtgcccgtcaccacgcacagctaattttttgtattttagtagagatagggtttcaccatgttggctaggatggtctcgatctcctgacctcatgatcctcggcctcggcctcccaaagtgctgggattacaggcgtgagccactgcacctggcccttttatttcttttgagatgggctactctgtcacccatgctagagtgtactggcacaattatggctgactgcagccccaacctctcaagtagcatagtggggaccacaggtgagcaccaccacacctggctaattttaaaaagtttttttgtagagacagggttctacaatgttgcccaggctgatctcgaactcctgaactcaagtgatcctcttgccttagcctcccaaagtactaggattataggcgtgaaccaccacacctggccaataaagggggaaacttttatccagctttgggttagtaccttctatatatcaagaactattctaacattaggacgcaaaaattataaataatactctgggctgggggtggttttcacatctgtactcccagcattttgggaggccaaggcaggcggatcatgaggtcaggagtttgagaccagcctggccaacatggcgaaaccccatctctactaaagataaaaaaaaaattagctgggcatggtggcatgcgcctgtagtcccagctacttgggaggctgaggcaggaaaatcagttgaacccgggaggcggaggctgcagtgagccgagactgcaccactgttctccagcctgggcgacagagctagactccatctcaaaaaaaaaaaaaaataataataataataataatactcttcccttgaggaacccaagatattgagagtgtctagtcatcttaaatgaacacaacctcaagtcccagatgaattctatcctaagacccataaattatggagaatgggaggacattaaggtctgaagtgagcacacccatctcaagtctcaaaacagatagattcctgctatttgataataaaaggaaatgagattcctatttgataataacaggaaatgaactattgatatatgcagcacagatgaatctcaagtaattatggtgagtgaagccagaccaaaagaaatgtatttccatctatagaaaatacaaagtaatcctgggtttactttggatttacccccaggattgcctgggaatgggaggaagaagattgcaaatggaaatgaggtaacttttggaggcaatgagtatgttccttatcctaattgtgttgatggtttcataggtgtataatgtattaaaacttatccaactttatactttaaatgtgtgcaatattttgtatatcaattacttcttagtaaagcagttaaaaaaaaaaaaaaagaaccagggttctttggccacatgattcattccagtgctggggcaattgggatacagattctagaagtgtaccgatcaataaacgtagaagtccatgaaattctgaagtagattatttaacagatgttttatgattgcttagggaaggaaagggaaccagcatgagtcaattatgaacaagtcatgctaaactagctttatttcctgttttgatagggttaccacaacaacacgaaatgaagacagagttctggtgaattcaagccacgcttgtcaagaacttcccatttgtgaggcttcatgttaggactggtggcaaaaacaaataatgatcctgctcttaagaaacttgcaattttgtgagagaaggagacaggaacagagaacatactttgccttttatcacattaaagcacttctgaaacccaaggaggagctgggttaacttcaaatactaagggaaggattaaaagaagatgaggcccgcaaaagccttatcctgaaggatgagtaggcttctgacagaaaagcaagaccgcaaagaaaagaaagaggaaacaggaggcgaggtaagagactgagacatctgtggtcactggccactaaccctcacccagacatgcccatgcccatgagagaaggttattggggtcggggaaaatgctcctcaggtgcccgggaattccctgcatctggaaaagtgtagtctgtacccagcaggtgcacttgaggtggtggtcaaaggggcagctgcttgctggcgtgtattgcacctacattgtgcaggcaggaggccacacacgtgctcaagctcacaacacatggatagtgctgtggctgggaagggaagagcactatgctgaaggtctgctctgccggaactactgacatagaactctaaggagcctgagtattttctatttgaacccaaccttccaggtcattaagaaggtatattaggcctggtgtgggcatggtgatgcacgcttgtaatcccagcactttgggagggtgaggagggcagatcacttgaatccaggtgttcgagatcagtgtggacaacatgatgaaaccctgtctctacaaaaaatacaaaaattagctgggcatggtggcactcgcctgtagtcccagctatttgggggactaggcaagaggatcacttgagccagggaggttgaggctgcagtgagccatgattgtgccactgcactccagcctgggtgacaaagtgagaccctatctcaaaaaaaaaaaaaaggaaaagaaggcatatctgtcatggcaggaggagagagcaaagtctgcttaatgtttcttaggttgattttttttttttttaatggtatgtagggctccatttgtattcttgacctagaccttataaacgtgagaggtgggcctgggtctgggaggtacaaaaagaaggtggaggtaagggacaaagatagttttcagcatcctgatttaaaaatctaagaatgcctgtcagtgattcagatggaggagatgacggttccatccttccagcagcatcaggagagagatcaagttgggaattcttaacagaagccacagtgattagcactcctgcagagagagaatttcaagaaaagaagtcggaagacagaactcaggagcagcatgaggatgaggaatcagttaaagaaagtggaaagaaatgataatggagtaagaacctttaggccaggcgccgtggctcatgcctgtaatcccagcactctgggaggccgaggcgggtggatcatgaggtcaggagatcgagaccatcctggctaacacggtgaaactctgtctctactaaaaatacaaaaaaaattagccgggcatggtggctggcgctacttgggaggctgaggcaggagaatggggtgaacccaggaggcagagcttgcagtgagccaaaattgtgccactgcactccagcctgggtgaaagagtgagactagtctcaaaaaaaaaagaacctttgttgtccaactccagaggccatgtagttctgcttaaccatgtagcagaaccagaaaagggtggtgtttcccaagacaaagaaggaaggcatttcaaacaggagagactgagaaaagtaagaactggaaagcattcactgaatctgcatgcaaccagacgatgtgtggtaactttggttcaagtaaggaaatggagaggatggggagaggagcagaaagagtacagccgactactttttaaagagtgatcataaggcaaggataacgaaaaaaacttaaatccaggtgaaaaactgagaggcacaggatgttatgaaagccatggtcgggggctgggggaggggaggctgaaggctgcaggaccgggtagggtgaaagagaaggctccaatggctaaccagggggaagagaagggagagtaaattccaggcagaggagatgtggggcagtggtgcagaggcctgtgggaacctggggcgacagagtgcctgcagagaggcggacacacagggacatgacaggggaagctggagggtgagcaagagccaggccatatttatattttcgtaattttatcctgggaagccaccaaaggatgctaagcacagactttaagcatggcaacatttatatttttataacttttcctcaggtagcagtttgttgaaagaatggaatggggaggatggtgcactgggtcacccggaggcaaggagccctttcagccaactcagaatgaaggggagccacagctctggataaatgggcaaagagcaggctcacaagaaatgggtgcttatttcacaaacctcacatgtcccagcagggtcctgttcaagcagtctccatccaattagatgaaattcctcaaggacacaactgtatgttctaaatagctcatgtcttctttactgcagttgtaaccaaatttgcagggcgggaaaaaaacagtatccttatctgatgcctctcaatgaagatatgacaacaaaaatcctacaggtggccacaaatgccataaggaacaggctgttagccagaagtactttggtcttgacaactcagcttccacctgtcctagccccaagatacatgaaataccagtgggccccaggctcaagtgacccaaggatatttcaaatgtctttttcttttctttttttttttttttaaagacagaatcttgctctgtcatccaggttggagtgcactggcgtgatctcggctcactgcaatctccccatcccgggttcaagtgattctcctgcctcagcctcccaagtagctgggacaacctacaggcacaagccaccaagcccagctaatttttttttttttttttttaagtagagacagagtttcaccatgttggccaggctggtctcaaactccagacctcatgtgatccacccacctcggcctcccaaagtgctgggattacaggcatgagccactgtgcccagcctattctttattcttaatactttattcatttgaaagctttccttttgtggtaaggtacagttcctttcactgatgtttatttgttctatcatttctcataacccccccacccccacatcctgaaggtacttgctttcttgtagaaatacttaggtctgtccgtggccctgaccctgtaaatagggcacttggcattactattgttctccaatgcccacagaaggtcagaaagcaatgaaccaatctgatcctcacagctataccacttccaatacggctaccactttttttttttggagacagagtctcgctttcttgtccaggctggagtacagtggcgccatcttggctcactgcgacctccgcctcccaggttcaagcgaccctcctgcctcagcctcctgagtagcaggcgtgtgccaccatgcccggctaatttttgtatttttagtagagacggggtttcaccatgttcgtcaggctggtcttgaactcctgaccttgtgattcgcccgcctcagcctcccaaagtgctgggattacaggcatgagccactgcgcccgcccgtctcctcctttcaacaccatatttactaccgtgtgaaaagcaacaaatgttaatatggttaatgcaatacacagtactttaaagtcttgtttcttcctatgtgaagacttccgtttttggtgtattttatatgaggcagacatatacactcattagcaatttaagtacattaaaggtattaaaaaacagaattcttttttttttttttttttgagacggagtctcgctgtgtctcccaaggttggagtgcagtggcgcgatctcggctcactgcaagctccgcctcccaggttcatgccattctcctgcctcagcctcccaagtagctgggactacaggcgcccgccaacacgcccggctaattttttgtatttttagtagaaacggggtttcaccgtgttagccaagatggtctcgatctcctgacctcgtgatccgcccgtctcggcctcccaaagtgctaggattacaggcgtgagccaccgcgcccggccaaaaaacagaattcttaggagcttgaggattctgtttcacaaaaaaagactgacagtactcgaaatcaatcttattatagattggtggggtttgtgattaagtatgaagaataagaaatgtccatgtctgcccatgaaatcattttctcactatgctctgattaaaactgacaaacatttaaactgagattaaaaataaattctacacattaatcatttacgcattcactttaaacttgcttacacttactgataatactgctttgtcttagtttatagatgtatattactcaaaatatttacagttcatttattgggaaccaggtaatgatggtattgaaaagaagttatgaacaattctcacttaataatacctacaatttattgagtgtttattatctgtcaggctctgctctatgttagtatctgtggacctctctctaagaaggtggtatttaatggtgccttgaaaagcaggtaggattttaataggcagcacacgaaaaagcacttaaggaagaaggagctacagaagctgaagcacggaaggctgggtaccaggtgctggatagttcaatatggctggagtttacacctgtccaggggaagaacaaaaggtgatgttactaaaaagctgagaaatctgtactttacttcaataacagaagatgaagagtctggatgtggtggctcatgcctgtaatcccagcactttgggaggctgaggcaggtggaccacctgaggtcaggagttcaagaccagcctggccaacatggtgaaaccctgtatctactaaaaacacaaaaattaggcatggttgtgcgtgcctgtaatcccagctacttgggaggctgaggcaggagcatcacttgaacccagaaggcggtggctgcagtgagccaagatcatgccattgcactccagcctgggtgacagagtgagactctgtctcagggaaggcaggggaggggaggggaggggaagggaatcagaaacacaggtatagaactgactgaaggccaggcgtggtggctcacgcctgtaatcccaagcactttgggaggctaaggcaggtggatcacctggagtcaggagtttaagaccagcatgaccaacatggtgaaaccctgtctctaccaaaaatacaaaaattagccaggcacgtagtggcaggctcctgtaattctagctacctgggaggctgaggcagaagaactgcttgaacccaggaggtggagggtgcagtgaaccgagatcgtgccactgcactccagcctgggcgacagagcaaaactccatttcaaaaaggaaaaaaaaagaaaaaaaaaactgactaaagaggctaaaactagacatagggagaccagttataattcttgaaatatctatacccatcaacactttgaaattacagtgcttgttagacctgctgcctgatcttgctatttacggcattagtaaagaagcacatataaagacttcttaatttttcaaaagtggtatttcagcataactgattccctttgtaatctcacattttattttattcatttaaaatattaatctgaaaaggagccacaagtttcaccaactgcctaaaggattcacgtcattaaaaaaaaaaaaaaaagatgagaactcttgttataagggcaatttatagattcagtggaaatggcagagacaggaaactagtacagaagtttgtattcaagagaaaaaaaacgtcagtttgggatcgtaaaggatgtgcatcaaataactttaaaaacatttgaatgttaaagttaattttatttatcaaataatcacctacattatgttaagcactgtggataaagcagtaaaaatataaagctctctgccctcataaactatgagaggagatagacatagaggctgggtgcagtggctcatgcctgtaatcccagcactttgggaggctgcggcgggtggatcacctgaggtcaggagtttgagacctgcctgatcaatatggtgaaactccatctctactgaaaatacaaaaattagttgggcgtggtgccgtgccatctgtagtcccagctactcgggaggctgagacaggagaatcgcttgaacccgggaggcagaggttgcagtgagctgagatcgcgccactgcactccagcctgggtgacagagggagactccatcacaaaaaaaaaataagagagagagacataggtattaataaacatatttgtcataaacatgactacattataaattatgataattgctaaggaaaatgcaagttatataattaatgttattaaggataactagaaaacttagtttaaattagaagcttacggaagactcttcttctctaaagaaattagggaaggcatttaaacagagaactgaaggataagccggaattagccaggttgctgggtggcaaaggcagcaagtattctacaagcagggagagggtagaccagaagtagaccagaagtagaccagaagccctaagaagaccactgtggctacagtgtaccagagagagcgtggctcacgatgaggcagaagaaatgcgcagtgacccagcagttatgctaaggatttatcttttaagtgtcctttcactttaaactggggaataaaagtatccaacttatattttgtaaatgatcttaccaaataagagaaaaactgaactgtaaaaaggaaaaagtggctgggggcagtggctcatgcctgtaatcccagtgctttaggaggccaaggcaggtggactgcttgaacccagaagttcgagatcaggttgggtaacatagtgagatcctgtctctattttaaaaaaagaaaataaaaataaaaaaaggaaaaagttaaaaaaaaaaaaaaaggaaaccgttccaagcactgccataataccagcaagaggtgactgacagtggcgtggactaagcaacaaggatgtaattggcatgttaagcaggtcagttcagtgttcagtgtgaaaccataccacccactgcaggacatctagcaacccagacccaaggtcactatcaatccagcagcactctcaagtcagtaaaataataatttaaaaaaaaaaaaaaaacacccaccacatctctgaagggagtagtaaagtccttggaatgcgtaagagcagtgacagtggaaatggaaagagacagccaagactgaaagggaaaggctgctgagtgggatccacgaatgagatggtgagcagagcaggccagataagatcatcaaggtcaaaaatgaattgtgcagagaggagaaaaaatttgcaatatgtaggacttgtatttagcatacataaagaactcttaaaacttcaaaacaagactacaaacaacccaatattacaaataggcaaaagaataaacacttcctttgtgacaacaaatatgaaaatatgactgatgagtcataaaggaaatgtaaattaaaaccaaatacccattagaatagctaaaataactgaccaataccaagtgttggtgaggatgcagcaaagttgaaactctcatatacagatgtctgtaggagctttattcctaacagccctaaactgtgtacgacccaaatgttaattaacaagcaaagggtaaacaaactgtggtacatccatacaacaggacagtactcagcaataaaaggaattactactaatccatgcaacaaggacaaatctgaaaaacactatgctaaatgaaagaagccaaacacaaagagaacaaacttttaaatcccatttatatgagattctagaaaagctgaagctaatctatagtgataggaagccgtggctgggtgcagtggctcacacctgtaatcctatgactttgggaggctgaggtgggtggatgacgaggtcaggagtttgagaccagcttggccaacaaggtgaaaccccatctctagtaaaaatacaaaaattagctgggcgtggtggtgtgcacctgtaatcccagctagtcaggaggctgaggcaggagaatcggttgaacctgagagacaggaggttgcaatgagccgagatcgcgccattgcactccagcctgggtgacagagctggactctgtctcaaaaacaaaaggaaagaaagccgtgcttgcctgaggcacaaactgactgcaaaggtacccaagaaagctttttgaagtgatgtaaatattctgtatctttattgtggtggcagttacacaactacatacatttgtcaagatttcactgaacagtacacataaaaagatacattttattgcatataaattatatctcaaaaggtgattttttaaaaatttagctgtgctacaaaattaaggggttgattctctttcatggttcataagctcatattcaaggaaattccaagggaaatgttccaaacaggttttaagtaatgacagtatcattagaataaatgcccagccttccacaatcatttcaaaggctttgacataaaatttctaatatttttaggttttcttcccatcctcttcatcccctgtcattatagtcatgtctcatagcagaggctcaatatttgtggataatatatccaccttatttagacaaacgttattatcatgcacaagcaccatatactgtagcaactaaaatgctacctaacaactgtgaatgggttatttttagggaaagctattaagctgttctctaagccacccattttggtgaactttaattatctgaacacgaaactacagcactctgtttcacagataaaaattatcttgtcttcagatgctaagtaagttagactgagccaaactcatgttccaaaaataaataggtagataatactaatgattgctttaaaagaaaatgtattccttactttagcttggttctctgacaattcactaaccaagaaaaacagtgcaaaggtttttttttttcagatgctgcaaaccattaagtgaactattaaaagctagcctaaggttatttaagcaataaaaccagtaatagcaaatgcttagcatttattcataattttttattattttaagagccaatgttccaatgtactataggtaccatggcttaaaatctagtcattaacaagtatgcaacttctctagaaaaggtgctctggagagcccagagcttgaacaagttttgttggttacatatgcatttgtcaatttcttcagtaataaaacagactaaaagacccagaaaaggtttcaattctggtcctatccctcactagctgagagacactggctgaattacttagtatctctgagtaatcacttgcttggctagaaaatgaggaaagcccggggattgtgaagattagaaaaagcagatgcagcctaaaagatagtaggccttcaaaaaaaagttgtatggtcttttaaaaattattttacttggccgggcgcggtggctcacgcctgtaataccagcactttaggaggccgaggcaggaggatcacgaggtcaggagatcgagaccatcctggctgacacggtgaagccccgtctctactaaaaatacaaaaaattagctgggcatggtggcaggcgcctgtggtcccagctatttgggaggctgaggcaggagaatggcatgaacccgggaggtggaggttgcagtgagctgagattacgctactgaactccagcctgggcgacagagcgagactccgtctcaaaaaaaaaaaaaattattttacttattattattcattacatttatcatgtgataccctaaaaaggaagtaacatcagaaaagaacactgggcttcaaatcaggaggtctgagttttagtcctaactcagctatgccctacatatatgctttgataatgctggccaagttacaaaaagaagattccattatttcatgttcaggctacatccaaacataagcagcacaaaataaaaaatatggataaagagacacactcagttatacaggtgtatgcgcagacactgacatagatgaagacttgtagtgacttatattcagaaaagtttccacaaatttttggtgaactgtggtacccaaattattaaagtatgaaaaacatttctctcttcatgaatgggaaaaatgtctattttacttgatctaagatatactaccaggatttagtactgcgactatccatcatcttaaaaatccataaccaagcagctctgttttacttaaagcatgctagggtagcccaaagtgagacttggtaacagatactatctaatgcaaagcagttactgcttagaagtgttctgaacttgccatgagaaagaaagggagaccctgatgaaatagatggagtatccacttcttgatcatttccctacatttcctttctcctcatttatttcctcccactttcactggaaaagaactttacaatggtctgggtgaggctagctggcagtgagttatgacaacagctagaagtagtatcaacacaaaccaagagcattaagtgacccctgaggtagagtgagaaaataaggaaggactacatttaatcataatgatcatagtcactagcacagtgctaagaacttaagaaaaatccttatatattatcttcaccacaaccctatgaaacataacccctactttatagatgaagaaactgaggcagagtggagggtcaactaacgtgtccatgattacatacctagtagttaacagaactgagattcaaatccaggtgtgctgacccccaaaacccatgttctgaaccatgacactttatataggccaacagtccttggccacaggctcttgtggtgatcaaccaagttcaggttcatcattgagccagattcagacaggtcaactgaaaagaagctgaagaaggcaggcagtaaggacaagaaaaataatcataatgatcatgatatagaaaatgtactgcttcccaaagtagcctatccatttggaaggttctggctatttagatctatttcctcaggataagtcaaaacctgtctttcctgaaataaggtgagtatgtgctgtaaatgaggtgtgggagtatgggagagcaggctggaaggcagaagatgtgaaggcaaaccaggcacagggaaggtgagaaagggacccgaacggggacaagttaaaagaaaacattgaagactcagcagaaagaatccagagatgtttagtgctgccaatcatgacaattaagtgactttctccagtatgtatcagcagtctgagcaagatcagacaaaataaacagtagggttcctatagagtgggagtggagagatcaggagaactgagaatctggtcagagtggggaggtcagcagacagaatccagagcgaggccagagaggaccagcacaccgggaaaacacaaaggtgagggtctcaagccaggggtcgtcagggagagagggcaggatagggagccatggtctagaaaagaggatgatctactttgtcatggtgaccctggcatgcttttgtaagctgtaccccaacgagtcaagtcaaaggaagagaggctcagatgaccacctccgtcactgaaatgtaagagtgaagaaatgcaaatattttctgaactgcctcacttttggaaatattaaacacctgtctcagaaatctggaaaatgactaagatggggaaaatgtttaaacttgcagtatccagtattattatctaaactgaaaagaactgcctgcacaactaagcaggtggtgagatgttacataacagatgctaaactaggtaaagtggaaaaatgtaatacataattataactttaaaatgccagtaagaaaatcttcagtcagctctggaaaactaattttacttcttttcatgaaaaagttgcagttagtttcttttgcaacctgtcatgatagaagaggaattgcagaaggaaaggaagaccctaaacaaaactgataatcattcatctgtatgtgttttaaaacatatgcaggtagttttcatatatggctggtgggaatgcaaactgtacaactcttctggaggggaactgggcaatacctaacaaaattatatatgtgtacatcttttaacccagcaatcctacttctaagaatctactctgaaggtacacctccaatgatatgaaaaaacatatgtacaagattatccacagtagcactatttgtaattgcaaaatactggaaacaatctaaatgcccacacattggaggagactgaagacactatgttatatccacatggagtactatgcagcagtaaaaatgaatgaaaatcattctaagatgtctaagaacagacacagaatgaattccaagatatattgttaagtgaaaaaaccaaagtacaagatttagactatgctatccttcatataagaaatgggcaataagaacatatacatatatctgcttatttgtacaaaagaaatacaggaaggataaaccagaaactaaagagatcagctacctacaggggataggtgggaaagggataaaacgaaatgggaatggatggtagggataaggaaggagtgatatttctctgagtatatctttgtgtatagatgactcaaaaccagagtaatgtagcgcataccaaaaaaattaaagaacccagaatacaaacagtaacaagtgaatctaactgcgttacaaaggaataacataaccacactgaagggcatgaggaagaaactttgaaaacctattttgactggatattgtaaagctaaaggcataaagaactgtaacacaaatgctgctacctagtaagtaaatttgtttctcacaaagatgtgagttagcaattctgacactaattcatgtagacagtggtactgactgaaaaagtaagtttaaaaaaatgaaggataatgacagccaggttggcaaaataattacaaataagagggaaggctaaaataaaccacacagtgttggattagaatgagatatcagtatgaactcataatttctaacatatacacagacatacacagaaataaacatagatacatgtgtaatatgtagctgagtatacataagcctattttcctagttctgtctgctgagaagacttagaagcagtgacacccagtagcaatgagcacacttaaaagcatattgacagccaggctgtaatcccactttgggaggccgaggtgggtggatcatttgaggtcaggagtttgagaacagcctggccaacatggtgaaactcctcttttactaaataaattcctttactaaataaaaaaattagccaggcgtggtggcgggcatctgtaatcctagctactcaggaggctgaggttcaagaatcacttgaacccgggaggtggaggttccagtgagccaagattgcaccattgcactccagcctgggcaacaagagcgaaactccatttcaaaaaaaaaaaaaaaaaatacaaaagcatattgaaagggcctagaggccaacctgaaagagcaaactaaagttgaaattgtaacaatctgagcaacaaaataaatcacagtattagactaaatccatagaataaaacacatatccatgcatccacacctatataaataagtgaataaatgagagggaggatagttcttccttacagatgcactccaattaatacagaaggaatgaaggaaattggggaaaaaaatcagaattaggcaaaaaccacaataataagtttcagacaagacccatggatggatgctaaaatcagtgagtaaaattgatcacagtctcagagtacatcccctaagatgtctacgataatagtcgtaaaaggataaacaggcagataccaccaccttaaccaaatgattaacatctaagacacagcaacatcatgaattctcagatatgatgtgctgagaagagcacaacacacttaaaaatgcataatctcattctaatcatgaaaaaactcagacaagtccaggtgcagcggctcacgcctgtaatcccagtgctttgggaggctgaggcggatggatcacctgaggtcaggagaccagcctggccaacatgatgaaaccccatctctattaaaaatacaaaaaactagctgggcacgatggcaagcgcctgtaatcccagttatttgggaggctgaggcaggagaatcgcttgaacctgggagacagaggttgcagtgagccaagattgcgccactgcactccagcatgggcaacaggggcaaaactccatctcaagcaaacaaacaaacaaacaaaaacaaaaaaatcagacgagccaaatgcagtggctcacacctgtaatcccagctatttgggaggctaaggcaggaggactgctttagcccaggagtttgaggaagaccctgtctcgaaacaacaaaaaaaaccctaagaataactgtcctagactgtgtgtatatgtgtgtatgaattgggattttattttgtaaaggaccccaggtgattctaaagttcaactaagatggagagtcactgcaccaacccttttcttctcagctcactttgtcctgggcccatatctcatggttttgggtctactgtggaagtaccttctctacagaacaaagacaaagcaatagaacccaaattcttccaattccctttgggatctattcccttcttctcctgcctaccagtatgaacttctatgggattatgctgatgagaaaaaataaattacatttaagtgactgataccaaaaactggaattacttcacagatgagaaacctggtcccagatacagtgcaccttctggacctcagtatcttcaattttaaaatcattgttttgaatctgatttctaattgttaagctgaagtgtttctttaaatttttaagttggttaaaatgtgtgtgtgtgtgtgtgtgtgtgtgtgtgtgtgaaagaacctgctccctcatcctcaacagcctcatcaatctccacccattacccatttttattagttgcttatctttccattatttcctcatgcaaacacaaatacatattaatttatttacacgtattagagtaaagtgatttctaaatctgaagaggcatcagactcatccagggagctttttaaacaagtggacacttagtttctattttatacctattgactgaacaaaacccctggagagtggagcccagaactttgacaaagttctctcaggcagttttctgtgacagacacctctcagggtacttaccccagcccacatcacctttacccaatagggatctgtccccttttgtctgtgctgttgagagtattgctcctggccacagctgatgaggtactacccagcccagacaagaatccattctaaggtagagctgggccaactagctcctcttctcagacagcctggagctggagcacagagactccaaggggccaggctggctggcagaagagtatctggttgcataactgggaatgctgggatgggccacatgcacccagacttcattctgcagagaggagccaagtagtagacagatctggactgcagaaacaaggcctgctgctccacagagaatgacagaggcactgccttggttctcagtgacttcccaattcttcaatctagtcctccattcctcaggtcttcagtaggttttctggagtgagtgaaggcagcaggagtttcagcagtcgtcctgcagatcatctgttactctgaatatgcagtgggtgagtgttgtgggcgtggctgttatctgggggcaggttgaaaagctgcaacactgccactgactctggcagttatttctctgtctaggtctttgcttgtgtttggaacagatgtatttactgctcaagagtgcaaatgaggagacaatatgggaagaaaagaaaagaaatttcagaaataagatttccactgtaacttgagaaataaaaaatttgagtaatttcacaagaactcataattctgcttaactagtattccgtaggatgacagtggcaatgtggcagcttttcaacctgcccccagatagcagccatgcccacaacactaacccacgatacattcagagtaacagatgatctccaggacgaatgttcaaacttgtgccgtcttcgctcactcccgaaaacctacttaagtgatagagtatatttgaagaaataaccttcaaactattcaacttttattttgggtcaagatacaaagccttggtcttggaagtcctgaaacctgaattcaagttcttgtattgtatcacagctctgtgcttgtaacctcgggcaattatcttaacctcactgaacctcagtatcttcctctgtaaaatgtaaagaatacttatctcacatataaggttacttggatgaacaggtacgtgaacttgtttcataaattcaatacaaacagtgtcactgccatctagatttttatcactttcatctccaatctcacttttttcattattttaatataattttaaataattacctttttttttgagatggagtcctgctctgtcacccaggctggaatgcagtggcgcaacctcgggtcactgcaacctccgcctcccaggttcaagcaattctcctgtctcagccacccaagtagctgggattacaggcaccccgcaatttttttgtatttttagtagagacagggtttcaccatgttgggcaggctggtctggaactcctcgcctcaagtgatctgcctgccttggccacccaaagtgctgggattacaggtgtgagccaccgcacctggcccttaaataattaaatttaataatcattatcattcttattctttttgttgataactgtaaactctgcattagttttccttatatttcttttcctttttttttttggagacagaatctcgccttggctagagtgcagtggtgcaatcttggctaactgcaacctctgcctcccgggttcaagtgattttcccccctcagcctcctgagtagctgggattacaggtgcccgccaccacactcagctaatttttatatttttcagtagcgacagagtggtcaggctggtctcgaacccctgtcctcaggtgatccacctgctttggcctcccaaaatgctgggattacaggcgtgagccaccaggcctgcccagttttccttatatttcattaggcataaaaattatgaagctgggtgcggtggctcacacctgtaatcccagcactttgggaggccgaggcgggtggatcacctgaggtcaggagttcgagacccgcctgaccaacatggcaaaaccccacctctactaaaaatacaaaattagccaggcatggtgctgcatgcctttaatcccagttacttgggaggctgaggcaggagaatcacttgaaccagggaggcagaggctgcagtgagccaagatcgcgctactgcactccagcctgggcgacagagcgagactctgtctcaaaacaaaacaacaacaaaaacaaaaaacaaaaaactctatctatctatctatctatctatctatctatctatctatctgcatgctaatttttagaacatgataactacataggactttaaaatagttaaaagtcctaccatagagtcgaggtgacttagccagtcacccaaaaacagagctaggattaacccttattcattcttctgaattctatgttctttccattatacaagaatgtgcccagaaaatcctacacaacagaactctgggaagagctaagctgagaaatggtacagaatgctgccttcaaaacccaagaaaataaacacattataaacaaagaacaaagataagactcaactgcaaggaacacagcaagcaaattttaaagggcagcccaggaaggagctgagagtgttaagtacaaaccatcaaggctcaagagaaaaggagatggcttcacagaatcaaaaacccacaagaagtcaggcatgatggctcgcacctgtaatcccagcatttggggaagctgacgcagatggatggcttgcccctaccagtttcagaccagcctgggcaacacagaaagcagtctccatcaacacgaaacattttaaaaattagctgggtgtgatggctcctgcctgtagtcccagctactcgagaggctgaactgagggaggaagggacccagaatcacccagctatgatcactgcagtctagcctgtgcaacagagaccctgtctctaaaactaactaaagaaataaatagcaggaagaagtaaaaagaaagatctaggatgcaggaagagaatgagaagacacatacccggacccagccaaaaaaataaaaatcaacaatgattactctcgaaattgatgttatgaaatcaatgccaaacagtaatacataaataaataaatcctgatacaaaatagtaaaatgcatgcagaaatgtaagcaaacaagagtgcaaaagaatacctgcacactcagagtcaagtagggctggttctacattgttaaaggacacagaggctggctgctacacgctgggggagggaagaaatggagagtgactgctcatgggaatggggttgctttttgaggtaataaaatgttctgggattagacagtggtggtggttccaaaactttgtgaatatatactgaaaacaactaaattatattctttttaaaggtgaagtttttcttttctctggtaggtaaattatgtccaaaaaaaaaaaaaaaaaaagcatggtcccttcaaacaaaaatcccttttctcagatcattatttcaggagctaacacttaaaagagagatcccttcactctggaaagctgacagtaatcaaaacagggcatgaaagcctggagcagggagacagatcagctctgggagttgggatggggaagaagagagaaatggcatcttgatgatactttttatcctggccaacccacttcaccagcgaaaagctgataagcactcaagacagaggccctacactaaagaatttaaaagtatacaggccgggtgtagcaatttgtacctgtaatcccagcactttgggaggctgaggcaggcagatcacttgaggtcaggagttcgagaccaggctggccaacacagaaaaacccagtctctactaaaaatacaaaaattagccaggtgtggtggtacatgcctgtagtcccagctacctgggaggctgaggcaggataatcacttgaacccaggaggcggaggttgcagtgagccaagattgtgccaccacactccagcctgggcgacagagtgagactcaaacaaacaaacaaacaaaaacaaaaacagaacttaaaagtatacatctggggggagaaaaaaaatgtaggggtggacgtggtggctcatgcctgtaatcccagcactttgggaagctgacgctgtggatcccttgagcccagaagttcgagatcagccctgggcaatatggagaaacccagtgtctacaaaaaatacaaaaaaattatctgtagccgggtgtggtggcacgcgtccgtaatcccagctactcaggaggctgaggcaggagaatcgcttgaatccaggaggcaagaggttgcagtgcgccgagatcgcgccactgcactcctgcctggacgacagagcgagactccgtctcaaaaaaaaaaattatctggggtgatggtgtgcgcctgtggtcccagccacttggggggctgaggtggtagaatcacctgagcccaggagatcgaggctgcagtgagccatgatcatgccattgcactctagcctgggcaacaaagtgaggctgtctctaaaaagttaaaaataaattaaaactaaaatgagggccaggtgtggtagctcacgcctgcaatcccagcactctgggaggccaaggtgggaggatcgcttgagtccaggagttcgagaccagccttggcaacatagtgagaccctgtctcttgaaaataaaataaaaaatttaaaaatttttaaaaactgaaaaaatgaagcaatataaatgcccaacaaatgggggcaacagttatataaataacctgtttttaataaaatttaacattatgttgatgttacatgttggagtcagatacatagaaaaaggaaaaaataggacacaatagtatgggataatcattacgtaggtttaaaaaaacaaaagaatccttgctgagaacaggtctggcagagcaaagtgagctttagcctgaagtgggagggagaaagtaaaacagtgggcagggctctggaggaaagaaggatggtagtgcttcaaagggaagcagaagttttggctttgttttatttttaggacagaagagtgatcagcccctaggaatttggatgagatcatccagagagtgtgtatgggacacagagggcccaagaactaagaacaaagagtcaaagacttgggaaaaccagaggtgtctcagcaaagtagtagatgtaactttttaaaaaggaaatggcttataacatcaagtgctccagaaaaaatcaaaatcttttgattttccagggagaatggcaaaaaaaggggaaaaagaatctttggtgaggaaggccttcaggaaaaagcaaccagtccagaaagatcaaaatcaagaaagactgtacatagagtgtgcacaccatcagttcagagtgcaagagtgggggtagggggctaaagtctggctctcgtgggcagaagaggtgggcacagaaagcagagcaagcagcacgaaccattcccgagagagcctgactatgaaggggagagaacaaatggcacttgtctcacagactctggggcagtgcccaggaaattaaatttaggactatatatcaatttaaaagtactggatagagtaacgaaagtgatgttttcagtaagtgttgtacagcagaaggcttgtttttgttgattttaaaaatctttcatgggagattggagagatgctggtaaaaaaaaatacagcattaaaataaaatctttcactataaaactagctagtacggccaggagtggtgactcacacctgtaatcccagcactttgggaggctgaggcggggtggatcacctgaggtgaggagttcaagaccagcctggccaacatcgtgaaaccccatctctactaaaaatacaaaaattagccaggccgtggtggttcatgcctgtaattccagctacttgggaggcggagacagaattgcttgaacccgggaggcggaggttgcagtgagctgagatcgcaccactgcactccagcccgggcgacagagcaagactcggtctcaaaaaaataaaataattaattttttaaaatgctagtgtaacttcagaaaacttagaatatgattttaaataaaaataataactaaactaaaaaagcaaatcctgtataagcccttagttacttgggaagtcatttaaaagttaagcccatatcatctcaaattccaaaacttattgcaaggtaaataatcaaaagggtggtgctggcacaaagaaaaaagatatagattgatgggacagaaatgaaaatctagaaataaacccatctatggtcaactgatttttgacaagggtgccaacaccactcagtggggaaaggaaaagactatcctttcccttcaacaaatgatgctggtacaactagacagccatgtgcaaatgaataaagctggatccttacacttcacaatatacaatggctcaaacacttaaatgtaagagctagaacaataaaactctacaaagaaacatagggataaatcttcagggtaaaccctgaaaatctggcaatggattcttacatatatgacatgacaggcataaacaacaaaagaaaaaaatagataaattggacttgaccaaaatttaacaactttgtgcttcaaaggacactagaaagaaaatgaaaagacaactcacagaatgagagaaaaatatttgcatatcatgtatttgataaggaatctgtatctagaatgtataaagaacttttaaaactcaatcacaggagctgggtgtggtggctcatgcctgtaatctcagcactttgtgaggctgaagtgggaggatcacctgaagtcaggagtttgagaccagcctggccaacgtggtgaaacctcatctctactaaaaatacaaaaattagctgggcgtggtggtgggtgcctgtaatcacggctactcgcgaggctgaggcaggataatcgcctgaacctgggaagcagaggttgcggtgagctgagatcgcaccactgcactccagcctgggcaacagagtgagagtgtgtctcaaaaacaaaaacaaaacaaacaaaaaaactcaataataggccaggcatggtggctcatgcctgtaatcctagcactttgagagactgagatgggaggactgcttgagcccaggaatttgagaccagtgtgggcaacatggcaagtccctgtctctacaaaaaattaaaaattagccagatatggtggtgcatgcctgtgatcccagctacttgggaggctaatgcaggaggactgcttgagcccaggagttcaaggctgcaacgagccgtgatcacaccactgcactgcagcctggatgacagagtgagaccctgtctctaacaaaacataattaaaagatcaatacttcaatttatgttcaagtggttaaacacagaattaccatatgacctggcaaatgaaaaccatgaccacatagaaacttgtacacaaatgttcgtagcagcattattcataataatcaaaaggtggaaacaaaccaaagctccatcaactgatagacaagcaaaaggtggtgtatccacacaatggaatattattcagccataaaaatggaatgaagtactgataaatgctacaacatggatgaaccttgaaacatgctaagtgaaagaagccacacatgtgatgccatttatacaaaatgtccagataggcaaatctatacagatagaaattagattggtagttactttacactgaaaaagaaggggagagagagagagagagtaaatagctaaaggatacaggattggtttctttctttcttttttgacacagggtctcgctttgttggccaggatagagtgcagtcgcgtggtcacaggttactatagccttgacctaggctcaagcaattctcctgcctcaccctcccaagtagctggaacctcagggccatgccacaattcctggctaacttttaaattttttgtagaaacaaggtttcactattttacccaggctggtctcaaactcctaggctcaagtgatactcctgcctatacctaccaaagtgctgaaattacaggtgtgagccactgtatccagtcaagggtttcttgttgaggtgattattctaaaaattgactttgatggttattaaacatatctgtgtatatattttaaaaagctaccctgggaggccaaggtgggcagatcacgaggtcaagatcgagaccatcctggccaacatggtgagaccctgtctctactaaaaacacaagaattagctgggtgtggtggcgggagtctgtgatcccagctactcaggaggctgaggcaggagaattgcttgaacccgggaggctgaggctgtggtgagctgagatcacgccactgcactccagcctggcgaaaaagtgagactccatctcaagaaaaaacaaaacaaaacaaaaaaacacgctgaattgtacactttaaacgggtgaaatgtttgtaaattatctctctctctcttttttttttttttgagacagagtctctttctgtcacccaggctggagtgcagtggcgcgatcttggctcactgcagcctctgcctcctgggttcacgcaattctcctgcctcagcctcccgagtagctgggattacaggcacacaccaccatgcccggctaattttttttttgtattttcagtagagacggggtttcactatgttggccagactggtcttgaactcttgacctcgtgatccgcctgcctcagcctcccaaagtgctgggattacaggcttgagccaccgtgcccagccataaattatatctcaataaagccttggttcttttgaagttaagtccctggggcaagaaatatactagatgaacttagaacatattgtagtgccaggaagtatggagctaaacatttttttacatgtaaataattaaggtatgtcaaagggacacagaagccaactgaaagagctcccaatgcccaaagctggaaaaacataagcaccaaaatcgaagtgccattgggattgtaacccaaaatgtaaaattaatattcacaagtccatagtgatatatacaaatggggagaagagacaatctcccaaatagaagaataccaaataatttatgttgatactacaccatcaaggaggtggaagataactccctactccttcagtgtgggatacacttaatgacttgcttccattgagtatattacgcaaaaaggagaaaacagtgagacacctggcaaacactttagccaggtgatcaaggtcaacaacaagagtgttctgttgacagtatatgcccttgatgtgatgtgatgagaatggcactatctttgtggtcttcctcccctccaaacccacaaccccactttaatcatgcgaagaacattaagcaaagctgggcatggtggactgtgcctgtaatccctgctacttgggagactgaggcaagaagatcacttgaacataggagcttgaggctgcagtgagctatgattatgccactatactccaccctgggcgacagagtaacaccctgtctctaaaataaaatttttaaataaaataaaaaatttattttaaaaaagttaagccctttttagtatttaaatatattgctaacaagtaaaaaaaaatgcatgaataatgatatggtttaaaatttttttttttgagatggagtcttgctctgttgcccaggctggcgtgcaatggtgcgatctcagctcactgcaacctccgcctccagggttcaagcaattctcctccctcagcctcctgagtagctgggactacaggcatgtgccgccacgcccagctaatttttgtatttttagtagagatggggtttcaccatgttggccaggatggtctcaatctcttgacctcgtgatccacctgcctcggcctcccaaagtgctagaatgataggcgtgagccactgcgcccagccggttttaaaattttgactgttggccaggtgtggtggctcatgcctataatcccagcactttgggagaccgaggtgggtggatcgcttgagtccaggagtatcagagcagcctgggcaacatggtgaaacctcgtctctacaaaaattacaaaaattagctggctgtggcacacgtctgtagtcccagctactaaggaggctgaggtgggagaatcacttgaacctgtgaggcagaggttgcagtgagccaagatcgcgccactgtactccagcctgggtgacagagtaagaccctgtctcaaaaaaataaaataaaatttttactgttttcaaagactgattagtggtctggaaaatgattatactactgtgttggatcaaagattcagaataccaaatgatatgatgtatataaaatgtaatcccaattttactaggaaaaaaatgtgccaggatgttgacagcagatatccctgggtagcagcattacaggtgaatgctttttgcataaatgtgcctttctgtgttttccaaattttctctaaagaaaaaaaactgagatgattatcaaactatattatttggggattacaaattgtagcaagttcaggagaagcacagattcattagcccttggaacaaagctgtttcagaattcagtatttttcagattttagaaaggtaatacagtgcatacatatgtgcatacatccctggcgaggtctggtgtgtaccaaggaatccagcactgatatttctgcagcaaacatacaaataatcacactagatgggaaaaatacagactatgaatagtctcgtggcagtccacgtcaggttttgccccaaatgagcttacaaaagatacccagaaaggtctgaaaccctgagctgcaaataaagcactgtggacctgtggaaggatcctgaatgaggaatgagtttcaaccgttagaaccaattccagtggcgacgagcccctccctatagttttgctgaagtaagaacacttttatttgtggtgtgaggggtacagaccatatttagagatgagaagacatcagaggcagaagaaggggtaaagagaactcacttcttcagcaaagggtaaggctgagctctcctgtcagagaggagagtgcaggggtcaccagacagcactctgaggatcactatatctcaaccaagcccatcaagtttgtacttctgatatgtctgataatttacttgagttatgtcatttaacaggtcggccaagccttggagatctagtcagaatgcctgcatgcatatttttaaaatttagatgtatacatacttataatggagagtaaagattcaaaacccaaagaattactaggatatttttaaagaacaggtgagatttattaggaatagacatagtgatcaaatggttatagaagacaggaacacaacattaagctccagtgtacttatcccctttataatgttgatacttatgatacagtatgtaaataaaatattacctacccttacattgtagcaataggcttaccttttaacatggctttgctacaaccaacaaggtggtgtccactctaggtagtccacattcagtttccaaccatcccattaaaatcccttcgtctgttttgtgttgccataacagaataccacagactgggtaatttataggaaaagaaatgtatttcttatagttccgtaagctgggaagtccaaggtcaagaggcctgcatctggcagaggccttcttgctgtatcaccccatggcagaagggcaagcaaaggcaggagcgtaagagacagagagggcccaactcacttttagaccaacccactctgtgataatgacctaaatccattcatgagggcagaacccccatagccaaatcaggtcttttttttttttttctttttttctcagatggagtctcactctgtcacccaggctggagtgcagtggcgcgatctcagctcactgcaacctctgcctcctgggcagtgtgttggcaaggttgtggagaaactggaatccttttgccctgttggtgggaatgtgaaaaggtgcagccactttggaaacagtatgggaggctgagttgtgaggatcacttgaactcaggagtttgtggttcctcaaaattaaacacagaattaccatatgatccagtagtgcccttctgggttcctacccaaaagaatcgaaagcagggtcccaaagagatagttgtacacttatattcatagcagccttattcacaagaggcaaaagcaacccaagtgttcatcaacagatgagtggtgtgtgtatttacaatggagtatattgttccaccttaaaaaggaaattgtgacacatgctacaacatggatgagccttaaggccattatagtaagtaaaataagccaatcataaaaagacaaacactgtatgattccacttacatgaggtacctagagcagtcagacttcatagagacagaaagtagaatggtggctgccaggggcttggaagaaggaaaaatggagagttatttaattgctatagagtttcagcattgcatgatgtaaacagccctggaggccaggcacggtggctcacgcctgtaatcccagcactttgggaggccaaggcgggtggatcacgaggccagcagatggagaccatcctagctaacagggtgaaatcccgtctctactaaaaacacaaaaaattagccaggcgtggtggcgggcgcctgtagtccccgctactcaggaggctgaggcaggagaatggcgtgcacctgggaggctgagattgcaccacggcactccagcctgggcgacagagcaagactccgtctcaaaaaaaaaaaaaaaaaaaagagctctggaaattggttgcacaatgtgaatctacttaatgctacagaacagtacacctaaaaatagttaagatggtaattttttttttttttttgagatggagttttgctcttgttacccaggctggagtgcaatggtgcaatcttggctcaccgcaacctctgccagccaggttcaagtgattctcctggctcagcctcctgagtagctgggattacaggcatgcaccaccacgcccggctaattttgtattttcagtagggacagggtttctccatgttggtcaggctggtctcgaactcccgacctcaggtgatccgcccgcctcggcctcccaaagtgctgggattacaggcgtgagcacctggccaagatggtaaattttgttatgtgtatattaccataattttttaaaaaggctccatgaaattatctatgtacataggtatctagcctatatcccacagtcattcactccaatactttattctctaccccattctgggatgcataaagattgctcttaggattacatagtgatttagttaatacagtcatttcaacactcaaaagacatgatccttgtttcaccagagtaaaatgagactctgagaagttacaggacatgctctaagtcacccagccataagtgtcagagctgaattttcaaatgcagttactaatttgataaatgagatatgttaccttgctgttcttaaaaaggcttgtaacttcagtgaggaacttattcctgtcttcattcatgtattcaactaatatagagaaatgaatgggaaagtgaagagaagatgaagactattacggagatggcacagggttagccagccttatttgtgttatgcagatggggaaacagacctaggcaggaatctgcctgattcaacaaatatttactgagtacctactatgtgcaatgtgtatactaggtgctggggatacagcagagaacaaagtccccactctcaatgaaaggggccagtctttttattcatctttagttaattttaagcacacaacagctatctcaaactttcttcacactttccaagcccctgatcccttatgtactcttggcagatgccccaccttatctcttaccagaacctaaggccaactagcataaaatcccttgagcacacttagattggcatgcttttactgtgacatctgttcctacagcacccttactttcttctcttgagctgagggtgaagatctctttctttcccatctgtaatctcacaatatgcacaactacaccagagacaatggaggcacaatacaggccagaggtctgttcctcattccttctgcggggccttcctccagtgaatatctcttctaacattgtcaatcatatccaacagaaaaagagatctctccattggtacaaaaacctacagctcctaagaagattttgactctcactgctcaacttctcaaataaaaattcctccactttagttctaattatcactcaaatgctgttagacctgtgggcaggtcactatatccctgcctaggtctgtttccccatctgcgtaacagagaaataattgtgctttatctgtcctacagaagtgtgaagaggtttgatgtgacagcagtgaaagcaatttaaaaagtacaaagtgctgtataaaagaagacgttttcataattattctgttttcacatgctatctttattccaatgatctcaaagtacctacccaagcacagttctaactctagtatatgtaagcaaacgtgcaagtctgtcaccttccacacaaagagtccccccacccccgccaaacacaccactccctctccctctccttctccctctccctctctccttctcccgctttccacggtctccctctgttgccgaagctggaccgtaccgccgtgatctccgctcgctgcaaccttcctgcctgtttctcctgcctcagcctgccgagtgcctgggattgcaggcgcgcgccgccacgcctgactggtttttgtattttttggagacggggtttcgccatgttggatcggctggtctccagctcctaaccgcgagtgatctgcctgcctcggcttcccgaggtgccgggattgcagacggagtctcgctcactcagtgctcaatgttgcccaggctggagtgcagtggcgtgatcttggctcgctacaacctccacctcccagccacctgccttggcctcctaaagtgccgagattgcagcctctgcctggctgccaccccgtctgggaagtgaggagcgtctctgcctggccgcccattgtctgggatgtgaagagcccctctgcctggccgcccagtctgggaagtgaggagcgtctctgcccagccgcccatcgtctgggatgtggggagcgcctctgccccgccgccccgtctgggatgtgaggagcgcctctacccggccgcgaccccgtctgggaactgaggagcgtctctgcccggccgccaccccatctgggaggtgaggagcgtctctgcccagccgccccgtctgagaagtaaggagcccctccgcccggcagccgccccgtctgggaagtgaggagcgtctccgcccggcagccagcccgtctgggaggtggggggcagcccccgcccggccagccgccccgtccaggaggtggggggcaccccccgcccggcagctgccccgtcggtggggggcgcctccgcccggccgccccgtctgggaagtgaggagcccctctgccgggccgccaccccgtctgggaggtgtgcccggcagctcattgagagcgggccatgatgacaatggcggttttgtcgaatagaggggggaaatgtggggagaggagagagatcagattgttactgtgtctgtgtggagggaggtggacatgggagactccattttgttctgtactgggaaaaattcttccgccttgggatgctgttgatctatgaccttacccccaaccccgtgctctctgaaacatgtgctgtgtccactcagggttaaatggattaagggcagtacaagatgtgctttgttaaacagatgcttgaaggcagcatgctagttaagagtcatcaccactccctaatctcaagtacccagggacacgaacactgaggaaggccgcagggtcctcctctgcctaggaaaaccagagacctttgttcacatgtttatctactgaccttccctccactattgtcctatgaccctgccaaatccccctctccgagaaacacccaagaatgatcaataaatactaaaaaaaaaaaaaaaaaaaaaggaatattttcacgtgcaaatgaaaaagccctaaacaaatcttaaaatatataaagtggttcaaaaaatgtttattgttattattttaatagaggcctatacatggagcatttatttgggaaagttttaaatgaatgttttcccctgttttggttgttatcaatctacactttaccaattttcaataatgatcatgcctaattaattcaaattaaaaggtgtgtaatacaaaaaaaaaaaaaaaactgcaaccaaccctcgaatcagctcaatctctcactgaattatggttatctgtcaccactgtatctgcctatcagtgattagggagagctctctctggagaaaaatgtcacctagagcatcaacaattttcatacacagtatccagcattcacttgaacgttaccaagcatacaaggaaacagaaacgagaaaaaagagacaacatatccacatatccacagtgacccagttactagttactgaagatgatctttaaaatagctgtaattcggccgggcgcagtggctcacgcctgtaatcccagcactttgggaggccgaggctgaggtcaggagttcgagaccagcctagccaacatggtgaaatcccgtctctaaaaatacaaaaattagctgggcgtggtggggcgtgcctgtaatcccagctacttgggaggctgaggcaggagaatcacttgaacctaggaagcagaggttgcagtgagcctagggtgtggtggggcgtgcctgtaatcccagctacttgggaggctgaggcaggagaatcacttgaacctaggaagcagagattgcaccattgcactccagcctgggcgacaaattgcgactgtatcaaaaaaaaaaaaaaaaaaagaggtaactcttggaaaggagaaaatatctgcagcacatgaatctaaaaaaagactcatcaaaatctacaaagaactcctataatttaatgaaacaaaaatctccacagaaaaatttgcaaaataacccttaaatacttcacgagatagccgaatgtcataaacatacaaaaaagagttaaccaccaaaaaagagctaaaatatcagagaaatgcaaacaaaacccacaatgcataccacttcatacccactagagaggctaaaaatgataccaagtgttgttgagaatatgcactggtctgaactctaatacactgctaatggaaatattttaccactttggaaaacagtttggcacatctactaaaatggaatctatgcacagactgacacagtcattctgctactaaatatatacccagcaggacaatgtggctcacgtctataatcagcccaggctggtcttgaactcctgagctcaaagtgatcctctcaccttggcttcctaaagtgttgggattacaggcatgagccaccacatctggccacttttctttatgtatattatacatcaataaaagtaaagaataaaaagggagaagagtctgaaaagaacaattatcacaaaattaaggaacgtactcaactcttaaagatttgagaaggcgtttctaaggtactagcaatgttccattttgcaatctgcacagtgatgacaagtatttaacttattctgtaaacagtaccttttttttttttttttttgagacagagtcttgctctgtcgcccaggatagagcacagtggcgcgatctcagctcacggcagcctctgcctcctggggtgacgtgattctcatgcctcagcctctggagtagctaggattacaggcaggcgccaccacgcccagctaatttttgtatttttagtagagacaagattttgccatgttggccaggctggtcttgaactcctgacctcaagtgatctgcccgccttggccttccaaagtgctaggattacaggcatgagccactgtgcccagccacaaacagtacttatatcttacctatgtttaaatggatattcaaaataagattaaaagaggtaagaaaatacaatactctagtaaatgtaaaaataagtgagaagaataaatgccaagagaaatataattaccaagaagaaattcaaagtaggaacagtcgtataaccatttttaaaataattttgaatcagcttaacatgttttcaacaaaaaaccaaacacataccaaaaccaaaaaaccacccaggtccagacttgtacaggcaagttctaccaaactttgaaggaatcattctaattttacagaaataaaaacagaagaataggaaaagaaacacttgccaattcattttgtaagggtagtctaattttcataccaaaccacatgagaaaaaccctattatttattaacaagccaaatccagcaatatataataataatacatcatgaccaagttgggtttaatcccaggaatgcaaaattgattcaatattagaaaatctattagggtaacatgaaacttaaagaaaaaaaacaagaaaatttctatacatgcaattaaaaagcatctgtagaaattcaatcattcaggattctttttttctttaagtttaaaaaaacttgacaaagaaagctttatgaagccaggtgctgtggcatgtgcctgtaatcccagccattcaggagggtaaagtgggatgatcacttgagcccaggagtttgagaccagtctgagcaacatagcaagaccctgtttccggggagggggtgggtgggaagtaagccttatgaaaaaccagtagcccctatcactcaataaaagctttccttttaacatcagaacaagtcagggatgccctctgtatcaccactgctcttcaactttgtaatggagagtccggccagcacagttaagacaagataaaatatatctaagtcatgaaaagaaacaaaatatcatgattttcagatgatatgtttgtccttaaaaaatttaaagagggattactggaataagagtttgttggacaatctttttattccagtaattcatcagtttacaaaagtcaaatgcatttctataaaccatctacagatatctcttagaatatagccgggcatggtggtgggcgcctgtaatcccagctactagggaggctgaggcaggagaatggcgtgaacccaggaggcggagcttgcaatgagctgagatcgccactgcactccagcctgggccacagagcgagactctgtctcaaaaaaaaaaaaaaaaaaaaaagatatcacttagaatagcaacaacaaacataaagtatcaaggaatcaattaaacacatgatgtgcaataataataacacaaaactttactgggaaaacaacttaggaaaacaatgtggaatacccggtgaatgtacatatgccctaccatccagcaattccactactggggaatctgtctaaagatctgtgaaactcttgtgtatcaggagaaatgtgcaaggttacttgcaggaacactgtaataacaacaaacctaatgtccattaatactagaatggataaattgtggtatatttatacaatggtatataaagcagtgaaaacaagtaactatactatactcaaaaacataatgatgaatgaaaaaagctagttgaagaatacacacagtatgatttcacttatatgaaattcaaaaccaggaaatactaagtactgtattgtttaatagaaagataatagtccagcccgggtgcggcggctcaagcctgtaatcccagcactttgggaggctgaggcgggcggatcacctgaggtcaggagttcgagaccagcctgaccaacatggagaaaccccatctctactaaaaatacaaaactacctgggcgtagtggcacatgcctgtaattccagctacttgggaggctgaggcaggagaatcgcttgaatctgggaggtggaggttgcagtgagtcaagattgcaccattgcactccagcctgggcaacaagagcaaaacttcatctcaaaaaaacaaaaaaaaaaacaacagaaaaacaagaaaaaaacaagaataaacacatcgagccgtgatcatgccactgcactcaagcctgagtgagagagtgacaccctgtctcaaagaaaacaaaagacaaaaatacataacaggctgggctcagtggctcacacctataatcccaggattttgggaggtagaggtgggtggatcacttgaggtcaggagttagagaccaccctggccaaggtgatgaaaccctgtctctactaaaaatacaaaaattagccagatgtggtagcgcacacctgtaatcccagctacttgggaggctgaggctggagaactgcttgaacccgggaggtggaggttggattcaagtgacagcgccactgcagtccagcctgggcgacagtgagactttgtatcaaaacaacaaaacacataacagtcattaattaccacacataaaggtgcttaatggataataagtgctcaaggaaatggcagtcatggtggtggttgcagagaacaactggaggggattaagagtggtggtagaaaccaagcagaaaccagtctaagaaaaccaaaaaaataccaggcaaatagtttcaaaggaaaattataccattttaagataaggtagactggtggctggcgcctgtaatcccagcactttgggaggccgaggtgggtagatcacctgaggtcaggagtttgagaccagtctggccaacatagtgaaaccccatctctactaaaaatataaaaattagttacacgtggtggtgtgcacctgtagtcccaacttcttgggaggctgaggcaggagaatcacttgaacctgggaggaagaggttgcagtcagccgagatcatgccactgcattccagcctgggtgacagagcaagactctgtgtcaaaaaaaaaaaaaaaaagacaaagtagtcttaatgctatttcagaacacagaaaaggaaagaaaacttccacactcattttatgaagcaagtgtaatggtaaccccaacctgacaaagactgcacaaaagatactacagttgaatactacttacgaatatcaacacaaaatctctgaatattagcaaacagaatccaatggcacattataaaaaggaatacaaataaacaagcacagtttattccaggtatgagagattccatataaggaaatctattgacatgatcttcacattaacaatgttaaatgtgatgaaatcatatcatcttcacggaggcagtaaagacatctgacagctgggtgcggtggctcatgcctgtaatcccagcactttgggaggccaaggcgggtggattgcctgagctcaggagttcacgaccagcatgggcaacagggtgaaaccctgtctctactaaaatacaaaaaattacctgggggtggcaatacgcgcttgtagtcccagctacttgggaggctgaggcaggagaattgcttgaaaccaggaggtggaggttgcagtgagctgagatggcaccactgcactccagcctgagagacagagcaagactccatctcaaaaaacaaacaaacaaaaagaaacaaaaaactaaaataggaaatgatggatactgccttaagtaaacaaaatacacctcggtccaaagccagcatctgacttcatgtgaaaacattagagacttccctgctaacatcacacaccacataaggctaaaatattttccaatttacatttttagaggtaagcattaaattctatgatgccagacaaacatttaccagatttttttttttgagatagagtttcactcttgttgctcaggctggagtgtaatggcgcacaatctcggctcgccacaagctccgcctcccaggttcaagcgactctcctgcctcggcctcccgagtagctgggattacaggcatgtgccaccacacccagctaattttgtattttttgtagagacggggtttctccatgttggtcaggctggtctcgaactcctgacctcaggtgatccgcctgcctcggcctcccaaagtgctgggattacaggtgtgagccaccgcgtctggccaaaatttaccagttcttgaatgctgaatcctgctgggataactggaaacactcctaatgttactataaactctcacactgccttgttggcaataattaaatagctctttctagcagttgtgttcaagtggacagataatcacaaatgtcttttctttctagctccctttggacgaaagaaagaaagaatttacaacacgtctaaagattgtcacttttatcatccctttgaatgataagtgatcagggctgtcccaaaagaatgcctgaaaacattacaaaatgttatcataagcagaatggctcactaaggggatgaacattctggcaagtcttaatctagcatcactaccaactgttttttcactggtctaaaacataacatctaatatttttatttgcctatatagccctgcagtaataattaacttgtgaaaggtctacactgatttttttctttataaagtatttgcttcaaccatggaacagaaacaaagttgatttaatgggaaaaatgtaaatttatttgaggataggttcagcactgctaaattgaaaagggaaagaaaatttcaaacaaaccccaaaaagaaacattttcacatctgtagtgaaaaagctaaatagcagtacactaaacttggttactgacaaaataaatccttgtggccaaggtgaggcaaagatattactctctactttgctagcctaccttgtgttcagtgaattcaaacattaattggggcaatgtattgtttttgcttcattttctttagctgtgcagtaaagtctttgctttcatagaaagattgtgccaagttctttctttttcagaattgcttttaaatcagttctatttaagtatttctctctctctcaaacttgacatttttcattacaccttttttttccaatgccaaaatagcagcattaacattcattccagtcactaggtaaaaactctcttcagtcaaacacacatgaataatctaattcgtgaggtaaacgactactgtcatacagtattacgaagttccaaccttacttgcagagcaaaaaataaaaaataaaaatagtcattttcctcaagggtttaattgtgggcttttaatgttgaagtaaatcaatttactagtttttaacctcaagtttttccctatttcattatatctcaataatgattatccagagatttctgaggtaaattacattaaagacagcgctagtaactgggaaacaatccacacatgaatcttaatatattgcatatatgctaatttcatgtaatgttcctgagggcggtgacaatattagagctgtacgagaccctagagaccatcccaatcccttaactccacagatgagaaacacaaaaacttgcagaagcagagtgacgagcacatgcccatgtgacatgtcatcagaagcagggaccaagactcaggtctcttgccttccaggccagtcctcttttggtaggctaaaagctgcctttcacagcttcccacaaatttcaacacatcctcactcaagtacgtttctgaaagggactcaccgacaactctttagagaaaaggaactatatctcaaaccataggaaaagttctatatctagcttatcaaacttttagtctctgaagcatgtgagagtaagtttgccagtatttctttctcattatcccccaatactttagtgactatttccaacaaacaaaactagactattctcccatacaaacaaaatgctaccatcaaaatcgtcaacgctcacctgtcagattatgaccaaaggcctctaagtcagaatcccgcccaggcaaaatgacatggcagccaactgtggagcctcggttggcctcggatagctggtccccccttcattcacaccacatatctgaggaccagatatggaaagcctctcatgctggaaaacttggcacagtagaaaggcggccacacttttgcccgtcacacaatgcacattcacgggggacctgtgctaaaccattcacagacaacctgtttctgggtcagggtttcgtatacagcagagcagtcagctatcgacacaagggtttgtaacaaaaaacaaaaaacaacaaaaaaaaggaaggacaaaccaaaacaaaaaagaaaataccaaaaaaaagaagagttaaaaaaaaaagaagataaaaataaaatcattaacacagatacacgactacaatctaattttcagacattctagttttgccaatcatgccgattcagaatcatgaaccacatggagttgccatgtttctgcacacttctttagtgtggaacaattcctcagtgttttcttggttccatgatcttgacttaattttgaggtttacaggccagttattttgcagaatatccctaaactcgggttaccttgatgttgcctcctgaagatttggattatgcatgaaacacttgactgtccctattctaactatataaagatgctccttgacttactatggacttacatcccaataaacccttcataaatggaaaacctcataaggtgaaatgcttgttttttttgggaaagtttcttgctctgttgccaggcgggaatgcggtgacacgacgacggctcactgtagccttgaccactcaggttcaagcgatcctcagccccaggctcccaagtagctgggactataggcacgtaccaccacacctggctaattttttttttttttaatttttagtacctttagtacagaaaaggcctcactatgttgcctagattggtctcaaactcctaagctcaaggaatcctcatgcctcggtctcccaaagtcctgggattataggcatgagtcctgcacccagcctagctgaaaatacatttaatacacctaacttaccaaacatcacagcttagcttagcctaccttaaacatgttcagagcacttacattagcctacagttgggcaaaatcatctaacgcaaagcccattttataataaaagtgttgagtaactcatatgatgtatgaaatactatactgaaaatgaaaaacagaacagttgcgtgggtactcggaagtaaggtttctactgcatgtgtatcacttccataccattgtaaagtcatctgaccaccaagccaaatatttgtacttctgcacatgctgctttacatagagaccgagacaaagggggattcacatcttgtcaaccctgtttacttcaaaggaataacagagcattaactaggtaccaagtgctcaggacttcaagtatactgttttatttaatactcatgacaatcctttgaccccttacttgtgactggcaagttacccaacttttgtttcattttcctcatctgtaaaaaccggagagtgatacacactccctggagaatgacagggaaaacagtaccaagaactttaacctaacaagtcagaaatcaatgagaccccttttgacaattcccaccttgccctttagacattccgagatatgcagctttatttaataaatgaccccaccttgggcctcagctgactagaccagaggcagacactctcccaggctggaaaggccaggtggagtgagctgttctgtgcagaatgatctccctaacagtgtttttacacattctgttccacttggaattggattcagagtgttctcagcctctggtcatcaaaaaacctgaagacacataccttcagggagctagggtcagctctcctctgctgagtgcatggggaagtgacaaaagagaaaagaggggggaaaatccagctgctgagagatgtagggtacaagaagcttttgtaactgtaaagagggagggaggtagctacgttggtctattttccagttcctggttccaactatacctaaagctttaactgcactttctatccttgcagtaatatgacaaaggcccccagatcttaatcataaacttttcattttctataatgcagtctctacaaagtagtgcctaaaacattccagcactctaccctaccttttacccagctagctctaagtcttccttcaggtcccagcttaaacaccacttcctcccggaaacccttcatgactactcagaatatcttatatcatccagtggcactccacacctcaccatactcagtaaatgttattactgccctgttggactgtaaacaccaaagagtaagaacaacttttgttcactactttgttcctactgcctagcacataatccggtacgtgtttaataatattaaatgaatgaaaatcaagaaactggtagaggtaactagaaggaatgggaagaaatcaatactgcttcctgataaaaattaagttgctagatgacagatcctttggagataaagaaaaaacaaaaacaaaaaacaaagttactttaactctaatcctttctagcctcttcttcaggtctgtctgcaatggcataatcattttatactttagggctaatccattcaggaacccaggctgtaggaagtacgtttctaggtaactcggtataacagagaaaagcctatagtagttaaaagaaaaaaggtcacaggatttggggtctgcataaatctcaatttacatctcagttctgcaatatacttactggctgtgaaccctgaacgagttacctgacacccagttcccttatgtgtaaagtgcaaaatataatacctcaaagacaaggatgacggtcaggcgcggtggctcacacctgtaatcccagcactctgggaggctgaggcgaatggatcacgaggtcaggagttcaagaccagcctgggcaacagggtgaaagcccatctctactaaaaactacaaaaaaaaaaaaaaacttagccaggtacagtggcaggcacctgtaatcctagctactcaggaggctgagacaggagaactgcttgaacctgggggcagaggttgcagtgagccaagatcgcgccactgcactccagcctgggcaacagagtgagactctgtctcaaaaaaaaaaaaaaaaaaaaagacaagaatgagaatgaagcttaaaccagcaaggcaggcttgcaactaacattagtcagttgatcatggcatattatccatgcagacacctgctatccagctcctactggccataggttcaaaccccagggcctgccttgagtctgagaatctgggagggaccttggagaccatctatcctgtgggttgcccaacatcattttcaaagcaatcaaatcctttttccaaatgggatcttgccctgctaaccctaatagttactacctatgtgaactgaagatgataatgactaaaaggaaattaagaaaaagaaaaaagactaagggcagaggaagaagggaaacgggaggggaaggaggtagataagagaagagcaaagaatagaaaaaacagggattaggggagagaatgctgtatgtgaagtttccctatttggggtgaggcctgaagcccctaagagaggaggagatttgaaaaccacagacagagcccagtcctttcatgttatagcaggggaaatagaaacacataaattttgttcagctgcctatagctttctcctcctgtggttctgctcagtttccagaaagcctgggtaacgtctgaatcctcctggaatctctcttcttccttctggtacggtgtgggccatttcaaagctcaggcaggtggcctttcctagagggagcagagacagcgcagctactggatgagctcctaggcacctttcagtgtgggagcctcaagaagtgaaagaaaaaaagcaaatctaaaggggagcaaaatagcatctcaggattaggcaagagggtgggtggagtaggccggaggcaaggagctctagatgtttgttggggaatgaggtgtttttcaattaataggtatataaattgtgagcaaggtgaggaataaattacatacagttttggggaaaagtcaacttgaatttacacaaatcagattatgggaatggtgtaatggttatagctaactaccaggaatacatcattagggatgctattaatataaaaattaattttgttttgacttatccttttactctaaactctgctcagaaacactagattcttctgttactcatgtaagctgctgtccttgcatctttgagctccaaaagtgtagaggagacttcttgattaaaaaagttaagtaaacaatgagcaagcaaaattaagaatctcaatatctctgtctccaggtctagagtttttatatatgatatatgttattgctgttcctgcctttcaaacaggtggtacaaacacccagcagagatccatgaagagagtgcattaacaggaagcaatagggcaaagttcatagagatgagctttagagaaaagcgggacttaaatagagcctgatgtttcttggggcaggctggggtgctgtactatgggcatcttggcaggatgattctccagtggagggagtgtaccgtgcaatccagaccatttagcatgtctgcccttgacatgcctactgacggccaataacaccccctaatcaacgtgacaacacaacaaaaagccgcccccctatacatttccaaatgcctctgtagcagggaggtaaaatcacccccactgagtaccacgagataaagtaggcacaatgcggccaggtgcaatggctcacgcctgtaatcccagcactttgggaggccgaggcaggtggatcacctgaggtcaggagtttgagaccagcctggacaacatggcgaaatcctgtctctactaaaaatacaaaaattagccaggcatggtagcacacacctgtaatcccagccactcaggaggctgaggcagaattgcttgaacccaggaggcaaggttgcagtgagcctccaagcaaaactctgtctcaaaaaaaaagtaagtaagtaggcaaaatgggcagaaagcataagagataaagtgggagtggaactggcagacagaaacagggccatcctttaatgactccgtcacccacaagatcaagtccaaagtccttaccaaataatgcccttcaggatttggccctgcctacccccagctgtctcaactcccaccttcttactaaggcaccctacactccagccttcccaagtaatttgtggttttcctgacctgatgcactgtgttcacggtctgtgcctttacatgcacacttcgctttgcctagaaggcatttctcaaggcaaactcctactcacacatcaacacctagctcagaagtctgggaagccaaagaaagacagccccaagtcactcagctcttctcttcctctcagcacttcacaaactcctgggtaacactggtatcttctctgtattattccccaattccatcccattatttggatgaagagttcaataaacattttctgagtaaataactctacatgaaaggttttaaaggctaaaaagtgatacaagcaaaagcagacaacagatatttcttgttactgaaataatctattttctcaactctgatctttggtggagcactacttaggaaccagaaaaactggggttgcttcatcacttcctagctgtgtgtcattgggcaagttaactaacctctgtgtgcctcaagtttcttcacttgtggggtaaaaaacaaacagaagttaccacttttgctgtacagttatatggcttagcattaatgtatgtaaaatacaaaacaagagtgctgaaaaagtggtagttctactagtctgctataatcacaataaccttaacaagacaggaggacattgtaccatcaggaatgtgatcacaatgaaattttagttgaaaccatccccctcttttttcttttattcattcagctttcccaagttgaacatccccgctttaaaaaaaaaaaaaaaagaggccaggcacagtggttcacactgtaatcctagcactttgggaggctgaagcagggggatcacctgaggtcaggagtttgagaccagcctggccaacatggcaataccccgtctctactaaaaataaaaaaattagccgggtgtggtggcacacacctgtaatcctagctactcgggaggctgaggcaagagaatcacttgaacccaggaggcggaggttgcagtgagccgagattgtgcaactgcactccagcctgggcgacagaacaagactctgtctcaaaaaaaaaaagagctgaaagtcaacaaatataatggcttgtcagctgcattctgtttccctcctatagtactcaataccaatcccttaatgagtaccatctcccttggctcctttgataacgtgcactcccagttctttggtctctctggccacatttcctctgtcctcttccataacttgacctttattgacacagtaaaggcaggcactcctttggcttagttctcagatgtcttatccactcttaaggcttcaattaatatctctatgaagatgaccccatgagctctcttgtcgcattcagaaacagcatttcaaactcaattaaaccaaaatagacacttgctatcttagtctaagatgaccaagcatactaagagtgtttcaatctctcctcctctccctcctccccgtctacactgttcccttatacatctgaccagtcatcagtttcctcttctttgccagagttacctggttggtcctctgttctacttcagtggttcttaatgtttccaggataatggactcatttgaaaatctatcaaatgctatgtattttttaaccaaaaagataaatatagaaaacatataattacaatttcttttttttttttttttgagacccagtcttgctctgtcacccaggctggagtacagtggcgcgatcttggctcactgcaagctctgcctcccgggttcacaccattctcctgcctcagcctccccagcagctgagactacaggcgcacaccgccacggccggctactttttttttttgtatttttagtagagatagggtttcaccatgttagccaggatggtctcgatctcctaacctcgtgatccgcccacctgggcctcccaaagtgctgggattataggcgtgagccaccgcgcctggccatgattgcaatttcacctaaccaatgacccagataagaatctgtgctcatccactcaagattttaactaccatttacacaaattttcatctccagctcctgctcccctcttacaaattttaagatggtttctggatatagcctgaatggcctacaggcattacaaacttaagttcaaaccagaactatttccccctgacaaatctgctctaacagtattcctttacttggataatggcaccaccatctcccaggctcccaacctagaggcctcagaatgaacaaccgcccatagccaatcaaccagcaagccttgttctatctcagaaatccctccaaatccaaatcccacctctcttggtctcttaccctttaaggtctcataatcctttgattccactcagacttgccatgattaaaagtctttttaccactcttcccacaagggtccctgttactatttctgtcaatacaaaactcctcacctccatctgctaccttccgctgccactttattactgcacctctaggtggttaggctttcctaatttattcctccactccggttcttcttccttcattcccactagtgttgatttgtcttcccaaaaaatttcaaaattgaccatgtatgactgcctctttcaaaaaaaggccgggcacggtgactaaagcctgtaatcacagcactttgggaggctgaagtcagggggaccacctgaggtcaggagtttgagaccatcttggccaacatggcaaaacgctgtctctacaaaaatacaaaaaaaaaattagctgagcatggtggcacgcgcctgtagtcccagctactcaggaggctgaggcaggagaatcgcttgaacctaggaggcagaggttgcagtgagccgaggtcatgccactgcactacagcctaggcaacaagagtgagactccacctcaaaaaaaaaaataaacaaataaataaataaataagatgcttcctccactgaacaaatatacagtcaaacttagttttgcctttggagtcctctacagtttgccacctaagtacatttccaagattagattccacagctcaagctgtcacttgttcctattatctgcatatcaaaatcacacccactcttaaaggcccaactcaaatcccactcttcatctttacatcctctacataatcattaggaaaggactctaaacaaaatagtcacaattcctaatgaactgataaggaaacagaagggggtaaatctaaaaaatggctagaaatccataaatccttttggaagcattttttaaaagatcaccattcaaatattagtgaatatttcaacgagccctccataaatccagcactgttagccaatatttattaaatgctaataatgtgcaatggagaaggttaacagcagggtatttcatcaacctgataaaaggctataatctggatcttggattcaaattccaattacatttgtatttcacttaggaaacgacaatcacaaaaaggggacttagcatttcaaatggagagtcagaaggtcaaacaagcctacagcagtgacagaagtagttcccacatctaaacaacttcagactagtaaaaaccttatcagacaggagaaatcttatcagatgggggtatcttttcaattgacatgtcctaaacgtaaaatacttttttcagtccacattttagataagctaatcttgttaaaagggccaaaggatgtgatgggaaattctgagcctctcataatgagacatgttcactggcacacttcccagtgagtgcaacagcaatgcgatgtgtggtggagaaatgatgctactggcaatactttctctccattactttttagggccttatttctttcaggctcgacctaatttaaattctgtcttggctcctaagcctgtgagttcacattaattttcacagttgtattcagcattttgctcctaaacaaagtgaaaacattaaagattcaattaaaatctctttaaaaagaattttaactaatctttctatctagctacaatacttggtaaaacataccttctatggcatttctaaaattatgattgaaatttgaatacatttccgaaacagacttatatttactttataacagtaagatacagaaaattctgcaagtattaattacactaaggaacgcagagtgttttcctaaaaacagctgaaaagagctacagtgtgtctagtagaatctcagtctacaatcttaataactctagttctatgacctcaagaattggcttcacctcgaaatactttctcacctgaaaaaaggaataacaccatcttttcctccctcaatgtggctgctcaaataaaatgaaataatatatgtagcacagtacctgccacgaagggttcaataaattattagtttactttcttcagtcaacacaaaagacacattcacaagattcagatttaaggaaatctatttccacaagtcctcaccagcacaaaatgctatcgctagtttgctctaataaaaactaccatcagccgggcgcggtggctcacgcctgtaatcccagcactttgggaggccgaggcgggcggatcacgagatcaatacatcgataccatcctggccaacatggtgaaaccctgtctctactaaaaaatacaaaaatgggccgggtgtggtgtcgcgcgcctgtagtcccagctactcgggaagctgaggaagaagaatcgcttgaacccaggaggcggaggttgaagtgaaccgaggtcacgccactgcacttcagcctggagacagagcgagaccccgtctcggggggaaaaaaaaaaccgtcactatcatttcacttttctaagggacctgaatcaagatgagggagtctacgtgtgattctgcaagaactccattaaggctgcatacataatgaccactaaatcattaacaggagtccatagcaattgggctaaaacatctgggagcatttatgctggtaaaagagctcacttgggggctaaaaaaaaagtcaaattaggcccaactctaaacggatctttaacaaatcaagagagtaatgttagtttatccttcctgaaacgccagcagtacgatattaaaatccacttagaagtaaaaacttcaagacggaaatatgccaccaacactggcgtcagtaatccattttagaaagcctgcgcggagaccaccattagcaccgctgaggatatttaatgaaagccgttggctgcaaacagaggcgaagagagaaaaacgattatttcggtgttctgcacacacgcggaggcaaaacgctttcaggacctcagcagccaccgccgccaacaccgacaagcatctgatggaattcacagttttacaatcgaaagtccaaaagaaggccatgatactagcaaattgaggggtggggacccttccgttgccttcccgagggtccagactttaaaggccgcgctgcgcccggggccaagggtccactagtaccggcctacgccccccgcgccactccctgagccccttcccgagcgaccgaaggcccgggaaccgcgagcaacaacacctaaacctcaaccggcccggggccgcgcccgagccctggcgcgcggaccgcggtgaagtccgggttcgaggtcgccgcggcgcctgaggccgaggcgcgggcgaggccgaggctgcgtccgctgcggccccgggcggtgggggggccgggcgtggccggtcgcggacactcaccacaccatgccgtaggcgccctcgccgatgtacgagaggttggtgtagcgcggccccacgtcgaacacctgcccgcggaccatctccgggcccgcgcccgccgccgccgccgccgccatgttggctgccgggccgccgccgcctccgccgcgctgagctcgacgctcggcggccgccgctcagctcttgtcgcccctcccgcagggactgcgccgccgccggtgcagccgccgacgctgaccgggaggaggaaggaagacgccgagcgggagagctgaagagccgacagccactcggaccgattgcctgcctgcctgccagactgacgggcgggccggcgggcgggcggagggaggggc

SEQ ID NO: 1860 - DNA, 9205 bp, Homo sapiens
  source 1..9205: mol_type = genomic DNA
tcagccatagacacatctctatatttatatattagacgggtcagggaggtggcaggggcgccgggctctccacgccccccagctccacttctgctcaccacacacagaagcagcgagggcacgcgaagtgacagctttgacagggaggggattcggcccggcctggctcctcagggatgctagcccttgagactaaggaatgttccttcagggaaactagggtggggtttgaatgagatgaggggggcaggcatggccctgagtccctactcagcgccccccaccctccacctctgcccttcagcaggttggggcagccagaacccttccattccagaactgccagagactgggacgctggggaaggtaagggcgcagcagcagcagcgggagattgaactggggccacctgaggtcccgaggccccgtggggagggcgggtggggaggagaaggccttggcctgcctgaagctggaggcctcagcaaaggagagaggtggccaggcccatgctccaccccggcctgggctgccaaggtccgggctgggcacagtgtccattttctaacagtctggcgggagaggggcaggcaggaggcaggtcctaaagagagaagcaggcagaagaggagtcgttagcaccccccgggcagacccactggagccctgacctcaacatctctcatttcaccctcacagctggataggctgggtctcagtttccttatctgtaaatggagataataatagtacctagcttgaggtactgctgtaagattaaaggaattaatacatgtaaacctcttagaacaatgcttagggctttatgctttcattattagaactgtctcggccgggcacagtggctcacgcctataatcccagcactttgagaagctgaggtggtggatcgcttgagcccaggagtttgagactggcctgggcaacatagcaagaccccagctccacaaaaaaaaaaaaaaaaaattagccggttgcaatggctcgtccagctagctgggaggatcccttgcacccaggagttttgaggctgcagtgagctatgattgcaccactgcattccagcctgggtgacagagcgagacactgtctcaaaaaaacaaaaccaaaaaaaaagataaatagattgactccggaaactgaggcgccgagaggtgaggtgccttgcccaatatcacacagcacttactaagtggcacagctggagtttgagcccaggtgcgcatgccttctttctatcaggccacacctggctgaagacaggaagagaccggaggaggcaaggaggcagcgtgggtgggggcaggccagtggggtccccacagctatgtgaactgctgatctggcagcaggtgtgaggaggcctggcaatctgggtcaggctgggcgctgctgggcccctcccaaagcaatcatggccccacctgcttctgccacacccagagctgaagcttggctcaggtcctcacctgggtgacagaggccctcagtgacctcttgcctctttgccagttctgttcctagaaggagattagaatggcttgtggggctggaggatgcaaggtgttgacaggcagagacatttggggctggaggactcggtgggccaccagtctgggcagccttgggcatttttttttttttttttgagatggagtcttgctctgtagtccaggctggagtgcagtggtgcgatctcggctcactgcaacctctgcctcctgggttcaagcaattctcctgcctcagcctcctgagtagctgggattataggcatgtgccaccacacccagctcatttttgtattctttacagtagagaccgggtttcaccatgttggccaggctggtctcaactcttgaccttgtgatccacccacctcggcctcccaaagtgctgggattacaggcatgagccactgtgcccagcccttttttttttttttttgagagagtctcactgttgcccaggctggagtacagtggtgcaacctccgcctcccaggttcaagcagtcctcccaccacagcctcctgagtagctgggactagaagcgcatgcctacgtgcccggctaatttttgtatttttagtagagacagggtttcaccacgttggccaggcaggctggtctcggactcctgacctcaggtgatccacttgcctcagcctcccaaagtgctgggattaccagagtgacccactgtgcccggctaatttttgtatttttagtatagatgggatttcaccatgcaggccaggctggtctcaaactcctgaccctcaggtgatccactcctctcagtctcagtctcccaaagtgctgggattccaggcatgagccaccacacccagccccctgggcacttctgttgtcaccagacacattgaccatgggtgtggggtaagcttgctgctgtatggaggcatgtacagatagatatagatatagatatacagatatagatatttagtatcagggtgtccatgtgtgggccatggagacactcaccaggccccagggtgcagagatgtctgtctgggctagggggcctccagcactccgggctggaagcgtgctgtctcctggaagatgagctccttcagccgctccttaggtaggtcatccagctccatggcgaaggtgaagggctcctcggccactggctggggtggtagagacagcaaggctcaggcctggcatgggggatgcctacgtgcccccctgctcccctgcccccagccccactgctgctggggactggcccacctcatccgtcgggtcatagtactgctccaggtaggggtgagccagcgcttcctccactgtgatccgtttattggggttaaaggttaacatccggtccagcaggtcaagggctatggaagggcaggagtcaggggtcacagggaagactggaggagctccgagaagcattgctttgcctgtctcctccagcggctgctgggctcacacaccctccacgacacccaaggtttatcccacacccaccctcatgtctctcgaacctttggagtctgacttggggaaaagcttggcccaagccaccttggtcttggagggcagagactgtaggtagtttcgggccttcatgttgatgatacaattcaggtcctcctgggatggggagcccaggatgcctgtggataaggaggtgacttggtaaatgatcacctctttctttctgggaacagaataggcaacaaggcaagaacaagaccccccagcccagcaacccatgccaatccctcagtcacctcctagtcattagcatggtggtgcagagcaagggggctgggttcaggcagaccgaggctcaaatcctaggtctggtgcctcctcaggtgtgggacttagccttgcttttcccatctatccaatggggataatatctatacctcattgagataccatgagatgctggaggcaccccacacgtggtggtatccctgacttggactctcgagaaatctcacctcggaaaagctaatcatccccaactcagccagccgggcctccctcacccagaatgtggttgagctgatccaggtagtgcttgccagggaagatgggccggttagagagcatctcagccagaatgcagcccacagaccagatgtcgatggacttggtatagccctgggggagaggaggaagtggtgagctcctgggccagcctcaacagggtcctgttgtctgcgccaggccaccacctccaagttagatccaacaccaggcagaaggcagaggcctggagggctcaatgctcagcttccttgcagagcccaaggcccagagggtagaattcctgtgtcatgggggtcagtgtctggctcagaggtagctccagggcttcctgggaactggtccgttcctttcaggagtgggcagcccctcctaccttggagttcagcatgatctctggggcccggtaccagcgcgtagccacatactccgtcaggaagccggtgtggtcatgctcaggatcggcaatccgggccaggccgaaatcacaaatctggaatcagacctagctgctaagctcggcgctcaaggcctctgcagcctaagcagtcacgcccccttgtctttgcctccactgttccctttgcttgcaatgttctcctgcccaaggcttcttctactggtcactggaagccccagaccctgggggaggaggggacaggtgcccaaccctctgaccttaaggtcgcaggtggtgttgatgagcaggttggagggctttagatctcggtggagcacgttggcggagtggatgtacttgaggccccgcaggatctggtagaggaagtagcagatatggtcattgctcagctgctggcttttcagcaacttgtacaggtcagtctccatcaggtcctgcacaatgtagctgaggatggttccgcagacccccccaggcagggggcagtgggaggcacttggttaaggaaaacaggctctgaaggcgaggctgcacacctcctccagccagggcccctgggactcaatagatctgccaacctgcaccaccagctggggaagctgctgccattacccagcggcagggctctgagcctctgttgcatcacagttgctgatcctgagcaaggggcttcatttctgaggcctcagtttccctaccggggaaacggggataataataaactgtgggaggcaggagaacttcacagttaagagcagcaacttgggccaggagtggtggctcacacctgtaatcccagcactttgggaggctgaggcgggaggactgcttgaggccaggagtttgagaccaccagcctgggcaacatggcaaaaccctgtctctactaaaaatagcaaaattaactgggcacggcggcatgtgcctgtaatcccagctactcaggaggctgcagcacgagaatcacttgaacccaggaggcagatgttgcagtgagccaagattgtgtcactgcactgcagcccggatgacagagtgagactctgtctcaaaaataaataaattaaaaaaaaaaaaaaacctacaaaaagagcagcaactctggagttaacccatggatgtctgaaatctcctctctactactcactggctttaggatctcaacctgtctgtgcctcaactttctcatctggtatgtaggggaaataatgtttttttgtttgtttgtttgttttctttttgtggagatgggctcttgctctgttgcccaggcaggtcttgaactcatgggttcaagtgttccttccacctcggcctcccaaagtgctggaaattacaggtgcaagccatgaaataatggttcttttgagggtggttgtgaagactagatgagatggcgcatgtaaagctgtcagcccagtgcttggcaagttgtgagtgctaggcaaacatgaactattattactaatatgaatgcctgagtcacatggctgttgagggagttaaatgagataatgtatgaacaccatctggcatgcaataaatgtttgcttaaaaataaatgcctgccttatgggaatggtttgtgcaagaaaaatgaggagacactcccaacagcacactcccactcaaaggagagtgcttggccatacctcagaagatggaggagtaaaatgtctttttctatttgaagatacaaaaaagcttatgcgtaaataaataaataaatccacaaatgctgtttggcttgtctctagaaaaataagtcagggctgtcttttagaatctgccttgagaccaggcatggtggctcatgcctgtaatcccagctcttcaggaggccaaggtgggttgatgacctgaggtcaggagtttgacgccagcctggtgaacagggcgaaaccccgcatctactgaaaatacaaaaattagccgggcgtggtggcaggcgcctgtagtcccagctacttggaaggctgaggcaggagaatagcttgaacctgggaggtggaggttgccgtgagctgagattgagccactgcactctagcctgggcaacagagggagactccatctaaaaacaaacaaacaaaaaacaaagaaaacaagaatcagccttgaaagggtcttcagagaatatgtggaccagccctgctgttttagggctggggaggcccagcgagacgcagtgacttgcttcagatcacacagcgagctgggggtgagcacggagatttcctgtccacagtttgtggtgggggttgcagacacctcagtacaaatccccactcttgggtggagggctgggactgagagtgggtgggtggggcagggaagaagtgacaggtgtcataagttgctaaggagagccagacaggaagtggacagcaaactaggaaagcagtattgggggaggacagccaaggctaggctgtccctccctgggcaaggtgcaagtccacaggtgattagggtgtggctctgagtgagaagtcctaagaagaaggacaagttcccatctgggggaggagaggaggagacagcaacagaaacacttgattttaggttttctgagccttagcttcctcatctttttttttttttttttttttgacagggtcacgctctgtcccccaggctagagtgcagtagcacaatcatagctcactgcagcctcgaactcctaagctcaagccatcctcctgcctcagcctcccaagtagctgggactatagtcgtgtaccaccaaacctggataatttttaaattttttgtagaggtggggtctcactatgctgcccaggctggtcttgaactcctggcctccagtgatcctctggtcttagcctcccaaagtgttgggactacagatgtgagccattgcactccacccctcatctttgaaatgaagctgaaaagcccatctcatagggtagttgggaggtgtaatagaaaaaaaaaagcattgggcatgtatagtacctgacacacagcaggccctcaagaaaggcagttttttgtttttgtttagttttgagacagagtctcgctctgtcacccaggctggagtgcagtggcacgatcttggctcactgcaacctccagctcctgggttcaagcgattctcctacctctgcctcccaagtagctgggattacaggcttgcaccaccatgccccgctaatttttttgtatttttagtagagatggggtttaaccatgttggccaggctggtctccaactactgacctcaggtaatctcccacctcagcctcccaaagtgctgggattacaggcgtgagccaccacgcccagctgacagttttctttctccctgtctcccttccggtctgggcaaggaggaaagagaggaaagaatcatccattccttagcaagaagtgactgtgggcagaggccaggtcatgtctcagaactgccgacgtcagaagacaccactcccatagagaccatcctgcctagcccttccccctggggcacagagcagagaacccacttgctcgaggccatactgcctgggccgctgcaggcctgggttcatcagaggtctccaagtcctgttacactgtggcttcccctctgcaggaaagtttattttactgggtttgttttggagggtggtgggtaagatggaaacagaaaccaagcaacgggtccccagcccagctgcgaggccgtgcctgaccagccgactggccaaggtgaaggatacacatctctcatggcttccagggtggacgcccgcagaatgtctcggatgccgatgacattctcatggcggaagcgcagcaggatctggatctcccggagcgtgcgctggcagtaggtctgatgttcgaaggggctgatcttcttgatggccacgcgagtcttgcgcacgtggtcataggccgagctgaggggaccggagagaggctgctgctgtggccttacaaagggggagtccgggcctggtggccccacccaggccttggcagggaggggagagagcaggagctggctctggtcaaatcataaacaatgctggttccttcctgctgtggaggcctgggatctccagagagaaagctggggaccagccaggcggcccttcggtgactttacaaacagaggaagagactgaccgctcactgacttcccctctcctcaatccccttccattctactggccctgaacccttcgcccccattcccaggaaaggctccttaacccaagacaggtccgggggtgcagatgctggggacacaccatggggcaaatactgggaaggtggcagccaggggaggggcaggagagaatggacagggcaggggagggtcccagggtgagggatccgggcagcggggctgtcccagagggatagaggcccagagcacacggtggggccgggggcactcacagacccctcccaaaacatgcaggtggcactcctggccgcctcatctctctctgggcccctggggtggtggggccaaagccctgccccaccctgatctcggctcttctcccccaggctccctggcactgcctcacagggggaatccaagacaccctttcccccaaaacgggccctccactgcctcttcactaaggatgtcgcctccccgagagtactcatcctctgggcctcgccccgtgtcactagggtccccgcgggcccccacatgcactcggatgcccctcccatcattacagaagggtggactcaaagcctccaagcctgctcccctgaggacgtaggcagcgccccctcccccagaaagcactcaggggccccctccctgggacgctcccgatcatcccgagtctcctgcctcctcgggacgctccgcgtctccacgtcccggaaagcgctcggcgcctcctcctcctctcccgcgaagccccctcccctgagggcaccccctcccccggaacgccccctcacctgaccatgccgtacgcgccctcgccgatgtactgcaactgcgtgtagcgcgggcccacgtcgaacggctgccccttcaccatctccacctcccccgggacccccgggccgaccccctcggttctacggggctccccgcccccgcccccctgagccgccgccgccgccatctccactcctcccctcccaccgccctcctccccacggcggccccgcccgaggccccgccccttcccgcctgcctgtcacccgcagggccgcgcgcgccag

SEQ ID NO: 1861 - DNA, 9205 bp, Homo sapiens; identical to SEQ ID NO: 1860
  source 1..9205: mol_type = genomic DNA

SEQ ID NO: 1862 - DNA, 9205 bp, Homo sapiens; identical to SEQ ID NO: 1860
  source 1..9205: mol_type = genomic DNA

SEQ ID NO: 1863 - DNA, 29325 bp, Homo sapiens
  source 1..29325: mol_type = genomic DNA
acatggccaatggccgcgcgctctgcccgccccgcctcctcgctgcgggaagggtcctgggccccgggcggcggtcgccaggtctcagggccgggggtacccgaggtaagatcgcttcccgggcgttgggtcctttcggctcagcacgcacggacgcctttagggaaggtggctgcagcggcaggacggagtccgccgggacgccctgggtctggggtgcgcggggggcccaggaggggacaggacgcgcggggatccggaagagcgggccctgtcgcaagagtttcgggaacactgagggctccaggcgccgcatccagcatccggggaaaagggggtaggtggcgctgggcgtctgctcaggctgggggaaaggtagggccagaaggggacgggcagcggccgctgacctcctcctgccgcccgcgggcccagggtgacgctaaggtggggccgagcctcgaccgggtgcgcctagaggtcgagtgctgccgccctccgctgggtctggacagttctcggcggcgacaccagctcaaaacggcctccccgccctccgcggacctgggtcgcgcccaggaatccgatccaaggctgtgaggcctgtccctttgggaagggtgggtgtttatttccgggatgcactcagagcctctggacagtcaggtcggaaactttgctgtattgggaacactctgtcacctacttccttctcagttgggaaggaagtgccaagaaaacatgaaacaaaccaaaaacacgaaaaagggattctctgtatggaagccgtgaagcctcaaaaatatctaggaggacagccagcgacctgggacctgtggcagccatgtgaaagcagggttaatgtctggactaaatgttgcttccacctaagtgcaccctcagcctccctcccgccaagtgaccttgggtcctctttgggcttgaaggcaggtggctgtgtgggtctcgctgcaggggtctctgtgccctgcaaggtgtatgaccagttgcagtgaggcagcaggttttgggttcaaatcctgtgctagcctctggccagctgtgcaccttggcaacactttccctgtcacgggattggggaaggattaactgaaagaaccttaggatgtgcctgtctacaatgggccctccataaatgtgaacaaatgtgggcttcctttccttttgtttgggccacatcatcccttcccctccatctgtggctgaagctggaatgcagaagagtgcctcatctgactgccttctggtacctggctgatgccatgagaaaggaaggagaaaggggtctttttttttttgaaatggagtctcactctcttgcccaggctggagcgcagtggtccaatcttggctcactgcaacctctgcctcctgggtctagagattctcctgcctcagcctcctgagtagctgggactacaggtgtgtgccaccatgcctggctaatttttgcatttttagtagagacggggtttcaccatgttggccaggctggtctcaaactcctgacctcaagtgatctgcctgcctcggcctcccaaagtgctgggattccaggcgtgagccaccgcgcccggccgagaaagggatctattaactcccatagagttgttctttgctaatttcttgaaggctcagaggacccccgcctcaccttcctgattctcctgacctgtcattagtacttgccccacgaggaatgtagcagggcctgctggctggcaaagcaactcatgcatgtgaggctctgaggccagtgacaggactgcttcccctgtgaggaaggtctggtggcccaacagcttttaggtgctgtctgctctacagcactgcctcctgagagaggtctcatgcctgcctgatgcccacttggtcctctcctgcctccttccctccctgacaacccacttggaatccaatagcatctcaaacttcacttgttccgaactgagttctggagtcccttctgagccactgctcctcccctggcttctctggcctggtaaaagggcaccttccatccacccagtgcccaaggagtcatgcttcttttctctcccttatctcctacaccctcaaaacaccaggaatctggctgcctcctgccatctctgtggttcccatcctgaccatagtcatcctgtctcctgggctgtggcctccttactggtctcccagttttcatcctggcccctccaaagtcctcacaaccaccagagaagtctttaatgtaaatcagatcctcttctttccctgccggaaccttccagtggttccctgtttcactccaactaaaacccagagtcctttcctacagcactctacatgagtggcccctgccacctccttgaccttgacaatctctgcccctttccctagcttgcttgcttttttttttttttttcctatgatggagttttgatcttgtcacccaggctggagtgcaatgggatgatttcagctcactgcaacctctgcctcctgggttcaagcgattctcctgcctcagcctcccgagtagctgggattacaggcgcccaccaccatgctaatttttgtatttttagtagagaaagggtttcaccatgttggcgaggctggtctcaacctcctgagctcaggtgatccacccgcctaggcctcccaaagtgctgggattataggcgtgagtcacgcagccagccatccctagctttcttgacctagaccacactgacctgctttctattcttcaaacatgccaagctcattcttgttttaggacttttgcatttaccatgctctctgcctaaaacaccaatcttctcagagcctgagaacagctcagctgtgttctgcacgctagttcagaaaggcttctttgaccccctagttcaagtagcatgcctgtctccaggggctctgtctcattacctgctttactttctttagagcctttattgctatctggaactcttatttgggtattaatttactgatctgttatttgtcccaccccattagaatataaattggatgtggcatagaccttgtctcttttattccctgcagcactccctgatgggggcggcagaaaagtaacgagcaaatacatctataactgcaaattgtggtaactcctacataaacaactggcagcaattgcttatatttgaggcacttaaaaatttttaagctggctgggcgcggtggctcatgcctgtaatcccagcactttgggaggccgaggcgggcagatcacgaggtcaggagatcgagaccatcctggctaacacggtgaaacctgtctctactaaaaatacaaaaaattagccgagcgtggtagcaggcgcctgtagtcccagctacttgggaggctgaggcaggagaatggtgtgaacccgggaggcggagcttgcagtgagccgagattgcaccactgcactccagcctgggtgaaggagcgagactgtctcaaaaaaaaaaaaaaaaaaaaaaaaagaaatttttttaagctgctgggcgcggtggctcacgcctgtaaatctcagcactttgggaggccgaggtgagcggatcacctgaggtcgggagttcgagaccggaacatggtgaaaccctgtctctactaaaaatacaaaattagcggggcgtggtggctcatgcctgtaatcccagctacttgggaggctgaggcaggagaatcgcttgaacccaggaggcagaggttgcagtgagccgagatcgcgccattgtactccagcctgggcaaaaagagtgaactccatttcaaaaaaaaaaaaaaaggccaggcgcagtggctcacgcctgtaatcccagcactttgggaggccgaggcaggcggatcacgagttcaggagattgagaccatcctggctaacacggtgaaaccctatctctactaaaaatacaaaaaattagccgggtgtggtggcgggcgcctgtggtcccagctactcgggaggctgaggcaggagaatggtgtgaacccaggaggtggagcttgcagtgagccgagattgcaccacagcactccagctttggtgacagagcgaaactccgtctcaaaaaaaaaaaaaaaaaaaatttaagcttagaggccggccacagtggctcagcactgtgcaggccaaggcaagaggatcacttgaggtcaagagttcgagaccagcctggccaacatggtgaaaccctgtctctactaaaaaatacaaaaattggccaggcgcgttggctggcgcctgtaatcctagcaacttgggagaccaaggcaggcagatcacctggggtcaggagttcaggaccggcctggccaacattaaaacatataaaaccccgtctctactaaaaatataaaaattatccaggcatggtggcgtgtacccgtaatcccagctactcgggaggctgaggtaggagaattgcttaaacccgagaagcagaggttgcagtgaaccgagattacgccactgcactccagcctgggcaacagagcgagactctttctcaaaaacaacaacaacaacaaacaaacaaattagccaggcatgatggtgggcacgtgtaatcccagctactcgggaggctgaggcaggagaattgcttgaatgtgggagatggaggctgcagtgagccgagatcacaccactgcactccagcctgggcgacagggagactctgtctcaaaaaaaaaaaaaaaaaaaaaagtttataaggctgaattaccgtactgtcaaaacaagctgctatctgagccgttttaagggtgaggaagtctggaaactgataacttgcccaggacacacagtgagttcaaggcatggaactcagtctcctatcttaagaatgtatgtgggccgggcatggtggctcacgcctgtaatcccagcgctttgggaggccaaggcaggcagatcatctgaggtcaggagttcaagaccagcctgaccaacatggagaaaccctgtctctactaaaaatacaaaattaaccaggtgtggtggtgcatgtctgtaattccagctactcaggaggctgaggcagaagaatcacttgaacccggaaggcagaggttgcgatgagccgagattgtgccattgtactccagcctgggcaacaagagtctggaactctgtctcaaaaaagaaaaaaagaatgtatgtgtagcaggctttttttttttttttttcccccgagacggaatctggctctgtcgcccaggctggagtgcagtggcgcaatcttggctcactgcaagctccgcctcccaggttcacgccattctcctgcctcagcctcccgagtagctgggactacaggcacccgccagtacgccgggctaattttttgtatttttagtagagacggggtttcaccgtgttagccaggatggtcttgatctcctgacctcgtgatccacccgcctcggcctcccaaagtgctgggattacaggcgtgagccaccgtgcccggcctatgtgtagcaggctttaatggtgggcctgcagccatgtcatggaaagaagctgacctgaagatctcagttctttcttcttctactaactagcaagcatacctcagtttcttctttaaagcgggatgatccgattattatcatgttggggttcactttttattttttcagtgtgtcccaaagcagcagcacgtttaggtatagccctcttgctatcagcttgagggccttagagccaggaagggagccaggacatttataggcacagaaactagggtcacatacagatccccccaccgcatgtgctaggggtacatgcagaccttcccagtgctgaccaacctgcagagaagaaatgggccctaggtattctggatctgattctttttggtcttcaattatttttatttttatttttttagagacagggtctcgctgtgttgcccaggctggcctcgaacagctgggctcaagcgatcctcctgccctagcttcttgagtagctggtggtcatcaattcatttttagcaaattctgcagaatttttttttttttttttttttttgagacggagtctcactctgccgcccaggctggagtgcagtggcgtgatctcggctcactacaacctccgcctcttgggttcaagcaattctctgtctcagcttcctgaatagctgggactgcaggcgcccgccaccatgcttggctaatttttttgtattttcagtagagacggggtttcaccatcttggccaagttggtattgaactcctgacctcgtgatccatccgcctcggcctcccaacgtgctggggttacaggcgtgagccaccgcgcccgggttctgcaggaattttggagagactcaggcagtaataaaataggatgtttacagaaattaaagatggcggccgggcgcggtggctcacgcctgtaatcccagcactttgggaggccgaggcgggcgcatcacgaggtcagtaaatcgagaccatcctggctaaccccgtgaaaccccgtctctactaaaatacaaaaaaattagccgggcgtggtggcgggcgcctgtcgtcccagctactcaggaggctgaggcaggagaatggcgtgaacccgagaggcggagcttgcagtgagccgagatcgcgccaccgcactccagcctgggcgacagagaaagactccgtctcaaaaaaaaaaaaaagaaattaaaggtggctggacacattggctggtgcttgtcatccgagctacttgacaggcggaggcagggggatcgcttgaggccaggcgtttgagaccagcctgggcagcatcatgagaccctgtctctagaaaaaataaaaaaattagctgggcatagtggcgcaggtttgtagttccagctaccggggatgctgaggcgggaggattgcttgagcccacgagttcgaggctgcagtgaactattattgcaccactgcacccaacttgggtgacagagaccccatctgtttgtttgtttgtttttgagacagagtttcgctcttgttgcccaggctggagtgcaatggtgcaatcttggctcaccgcaacctctgcccccaggttcaagcaattctcctgcctcaacctcccgagtagctgggattacaggcatgcgccaccatgcccagctattttttttttttttttgtatttttagtagagacgggattttctccatgttggtcagtctggtctccaactcccgacctcagttaatcccccaaattggcctcccaaagtgctgggattataggcgtgaaccactgtgcccagcccgagaccccatctcttaaaaacaaaataaaacaaaacaaaaacggccaggtgtggtggctcacacctgtaatccccaaacttgggaggccgaggcgggtggaccacttgaggtcaggagtctgtgaccagcttgccaacatggtgaaaccccatctctactaaaaatacaaaaattagctgggcatggtggtgcgcacctgtaatcccagctactcagaagggaggctgaggcaagagactcaattgaacccaggaggcggaggttgcagtgagccgagattgccccactgcactccagcctgggtgacaaagtgagactcgctctcaaaaaaaaaaaaaagaagaaattaaagatgaaagaaaacaaacattccaaaaagttgagaaagaattgccttttgtccagccccactcccaaccccccaaccctgttgtaatgtgtgatctgttttcttccagtctcgtttcctctcagtccatccacccttcatggggccagagccctctctccagaatctgagcagcaatgccgtttgctgaagacaagacctataagtatatctgccgcaatttcagcaatttttgcaatgtggatgttgtagagattctgccttacctgccctgcctcacagcaagagaccaggtgagcaagggaagtgacagcccgacactggcctgggggcagggctgtggaattcaaagctcagccccatcctagttcctcacccaagcctgggctggctccttccttcttcctcttgctgtgtcttgctccttgtccttgctgcttttcttttttttttttttttttgagattgagtctcgttctgtcgccaggctggagtgcagtggcacgatcttggctcattgcaacctccgcctcctgggttcaagtgattctcctgcctcagcctcctgagtagctgggattacaggtgcgtgccaccacgcccagctaatttttttgtttttaatagagacggggtttcaccatgttggccaggatggtcttgatctcttgaccttgtgatccgcctgcctcggcctcccaaagtgctgggattacaggcgtgagccaccgcacccttgctgcttttctaacttttggatggagtgtggctcagggtggcgttgctgacttcgccgagctcccccttgtgttgcttttgtgcactgctcaaaaatatggcgctggctctctgagatttcctggctctggtccacttgcccactttttttggaacctcctatttccttcatctctcttgcccttccttgtcctgctcagttttgattccattctccttgtcatggggccctgtcctggcacggagctgggactcaggtttgagagctggcaggatcagggtcgctctagccccaacagaacttgctgcaggcccctggcactcactagctggtgaaacgggcacaacccctccccgttgtagctgctgttctcagattggacccctgtgctccagagggtacctgttggctcttttggggcctcctgtcctcagatttctcaggagccccattgttgtctccgctgtcctcccacacagatcgcattagtatgcaggtctgtttggagtttgctcctccctcttgtattttggggtttatagggatatcttgttttatagtaaatattttctgtgggttttctttattttctttaaaaaatttttttttgagacggagtctcgctgtgttgcccaggctgcagtgcaatggcatgatctcagctcactgcaacctctgcctcctgggttcaagtgattctcgcgcctcagcctcctgagtagctggggttacaggcgcatgccaccacacctggctgattttgtatttgtagtagagatggagtttcaccatgttggccaggctggtctttatttttatttttgagacagagtcttgctctgtcactcaggctggagtgcagtggcacgatttttttttttttttgagacggagtctcactctgtcgcccaggctggagtgcagtggtgtgatctcggctcactgcaagctctgcctcctgggttcacgccattctcctgcctcagcctcttgagtagatgggactacaggcgcctgccaccatgcccggctaattttttgtatttttaatagagacggggtttcactgtgttagccaggattgtctcgatctcctgacctcatgatccacccgcctcggcctcccaaagtgctgggattacaggcgtgagccactgcgcccagcattttttttttttttttttttgagatggagtctcgctgtgtcttccaggctggagttgcagtggtgccatcttgggtcaacctctgcctcctgggttcaagcaattctcctgcttcagcctcctgagtagctgggattacaggtatatgctaccacacccggctaatttttgtgtttttagtagagacggactttcaccatgttggtcaggctggtcttgaactcctgaccttgtgatcctcggccttccaaagtgctgggattacgggtgtgagctaccgcacctggctattttcctttttctaaaaatctagctcctgcaggattctgtgggtttttgtttctgctgtctggttgcttgtttttatgtgagaattcaggtagacataaaaactctagggctgggcacggtggctcacgcctgtaatcccagcgctttgggaggccaaggcgggtggatcacctgaggtcaggagttcgagaccagcctggccaacatggcgaaaccatgtctctactaaaaatacaaaaaaattagccgggtgtggtggtgggctcctgtaatcccagctactcgggaggctgaggcaggagaatcgcttgaactcaggaggcagaggttgcagtaagctgatatcacggcactgcactccagcctgggcgacggagtgggactccgtctgaaaaaaaaaaaaaaaaaagaaacaaaaaaactctgcagccactgtcatctgcccacaatctccccagcattctcagcttccttgtttgttattgtcggccccctctctttccgtcttttgcccctttcatcatacttttgctatctaccttttccttctctcctaatccaaacctttctttttgccctgggggccatattaatccaaggcttttgtatcagattaactgggtttggattcctgccccactgttttaggatctttgctacagtactttgcttctgctaagcctcagtttcctcattagtaaagtggagataataatggcattaaataaagatgatacatgcaaagcccttaatggagagcccaggacatagttaattgccagtttccggcagctgcctttattgatgtggctgctaattgctcttcctcactccatacctggccctgtcctgggctccgatccagtttcacgtggctgccttgcccttgtggctttcttggcacccctccccccgctgtggcttcattctgggtggggaagtggcaggggccacctggcttgagcaggacagtggcattgtgtcttccaggatcgactgcgggccacctgcacactctcagggaaccgggacaccctctggcatctcttcaatacccttcagcggcggcccggctgggtggagtacttcattgcggcactgaggggctgtgagctagttgatctcgcggacgaagtggcctctgtctaccagagctaccagcctcgtgagcgtcctgcccttgccctcctggacccccagcctgctccctggcctccgctctccttttctctctccctgtacttcctgcctttctctgtcatcctctttcttgtcactgtgaagcgatgaataaacctgggtgtagatccaggctgagccacttaccagctgtgtccctttggccaagtcccttaatttccctgagcctcaggcctctcttctgtaaaatgaagctcatggcagcatctgccgcggggagctgcagtgggtgatactgcgggacgatgcgtgttgagtattgagctgggctgggcacttcctgtatgcccagcacatggagtctcccctaactttcacggctgtagcattcgcctcccacccttcctcatttcttctcccccacctactcattcaccctccctctctcctccttctcttcccctcccctggtttaccctgagagccttcgacgccctctatcagctgcccagttattctttaagtccctctcagtgtccctgccactctgagtgctcggaggcgatttgatgagattgagtttgatcctgagtgagatcaagacatgggaggaggctgggcgcggtgtttcacacctgtaatcccagcactttgggaggccgaggcaggcggatcatgaggtcaggagatggagaccaccctggctaaaacagtgaaaccccgtctctactaaaaatacagaaaattagccgggcatgttgtcccagctactcaggaggccgaggcaggagaatcacttgaaccagggaggcagaggttgcagtgagctgagatcgcgccactgcactccagcctgggcgacagagtgggattccatctcaaaaaaaaaaaaaaaaagacatgggaaaaaaaatcaagccagccctatttatatttcaaactagaggtaacccccgagaccctggtcacatttatagctgtgggacatccatgtttttcttttctttctctctcttttttttttttccttttagagacagagtcttgctgcgccacccaggctgcagtgcagtggtgcaatcatagctcactgcagccttgacctcctggactcaagtgatccttctacctcagcctccagagtagctgggactacaggcatggacaactacacctggctaatttttaaattttttgtagagatgacatctcactatgttgcccaggctggtctcaaactcctgggctgaagcgatcggcctcccagagtgctgggatcataggtgtgagccaccgcgtctggctctcatgcttgcttttctctcctttttcccttccttgcttttcctccctccctccctcccttcctctcttccttcctttttttccttccttctttttaaatatgtctcttcatgtgtggagattaatagtgatccctggctgggcacggtggctcacgcctgtaatcccagcactttgggaggccgaggcgggcggatcacaaggtcaggagttcgagaccagcctggccaatatggtgaaaccctgtctgtaccaaaaatacaaaaaaattagctgcgcatggtggtgcaagcctgtaatcccagctacttgggaggctgaggcaggagaattgcttgaaccggggaggtggaggttgcagtgagccgagattgcgccactgcactccagcctggatgacagagtgagactccgtctccaaaaaaaaaaaacccaaaaatagtgatcccctgaatacaatggctgtggtagggcctgatgaggggtgggggcaaaggggaggggctcaggtggcagcatcagggcaggggtcagtgagcaatgatagtcatgtggaggagaaagccactgggtcctaggatgcctggggacagagaagagtgactgctgacacggcgtgggtgactagagacccacgaggcccccccatactccccttcctcccttgctaccttgtcctccatctgctctcaccctcccactcctgcccccttgccaagtgatgcttgtcactccttttttttttgaaatggagtttcgctctgtcgcccaggctggagtgcagtggtgccatctcagctcactgcaagctccgcctcccgggttcacgccattctcctgcctcagcctcccgagtagctgggactacaggcgcctgcaaccatgcccggctaactttttgtattttttagtagagatggggtttcaccgtgttagccaggatggtctcgatctcctgacctcgtgatccacccgcctcggcctcccaaagtgctgggattacaggcgtgagccaccaagcccagccctgcttgtcactcttgaggagtgggcccacatcagaacagcttttggacctatgggtggggcggggggtgtacccaagagcacccaagcctctttaatcatgaggagaacccccaattcctttttttttgagacagagtcttgctcagtcgcccaggctggagtgcagtggcatgacttcggctcaccacaacctctgcctcccgggttcaagtggttctccttcctcagcctccctatagtccctgattccttctattttttttttttttttttgagacggagtctcgctcttgttgcccaggctggagtgcaatggtgcaatctcaggtcatggcaaccttcacttcccaggttcaagcaattctcctgcctcagcctctcgagtagctgggattacaggcatgcgcctccacgcctggctaattttgttatttttagtagagacagggtttctccatgttggtcaggctggtctcgaactcacgacctcaggtgatccacccacttcggcctcccaaagtgctgggattacaggcgtgagccaccacgtctggcttctttttctttttttcccccgagacggagtcttgctctgttgcccaggctggagtgcagtggcgcgatctcagctcactgcaacctccgtctcccaggttcaagcaattcttctgcctcagcctcctgagtagctgggattacaggtgcttgccagcacgcctggctaatttttgtatttttagtagagacggggtttcactatgttggccaggctggtcttgaactcctgacctcctaatccacctgccttggcctccccaaatcctgggattacaggcatgagccatcgtgcccagcccctgattccttctttttttttctttctttttttttttagacggagtctcgctctgtcgcccaggctggagtgcagtggcgcgatcttggcttactgcaagctccgcctcccgggttcacgccattctcctgcctcagcctcctgagtagctgggactacaggggcccgccaccatgcccggctaataataatgttgtatttttagtagagatggggtttcactgtgttagccagggtggtctcgatctgacctcgtgatctgcctgccttggcctcccaaagtgctgagattacaggcatgagccactgtgcccagccctgattccttcttgatatcactacatctttgtcctctagggacctcggaccgtcccccagacccactggagccaccgtcacttcctgctgagaggccagggccccccacacctgctgcggcccacagcatcccctacaacagctgcagagagaaggagccaagttaccccatgcctgtccaggagacccaggcgccagagtccccaggagaggtctgtcctcatagtctaccttgagccaccacttttgtgttcctatctgcccacttctgcccattgagccttccagaaaccctctcccgtcccctataaatcacgcctaatctctgctcagaaccctagggcttcctcagtggggatctgccccagaccagcttccaggctgctgaccaggtcttcaccctgtggcagccctaatcctctgtcagcaaccagctgggagaccacagttttgtgtgtgtgtgtgtgtgtgtgtgtgacagtgtctcattctgtcacccaggctggagtgcagtggagtgatcttggctcactgcaacctctgcctcctgggttcaggtcattctcctgcctcagcctcctgagtagctgggattacaggcacccaccaccacgcccagctaatttttgtatttttagtagagatggggttttgccgtgtcagccaggctggtctcgaactcctgacctcaggtgatctgcccacctttgcctcccaaagtgctgggattacaggcgtgagccaccgcacctggcaatgctgtgtgttttctgtgaggtagacgtaaggacacctgtggacagagggtctgggaattaccagaacccaggcaagggctcccctggctcctgtgctccatggtgtgggctgaggcctataggagatgccccaagagcacaagctgccctttgtgagctcttgggagaggcaactgccttattcatattttccctcattgcagaattcagagcaagccctgcagacgctcagccccagagccatcccaaggaatccagatggtggccccctggagtcctcctctgacctggcagccctcagccctctgacctccagcgggcatcaggagcaggacacagaactgggcagtacccacacagcaggtatgcatggaatctggaattatagggtccttctgatctctcaagtgagggtaagaattagagttgccccatctggcttccttgaacaggagacaaggtgggaataaagggagttcaacccaggaagcaaaccagttccttagtgggtgtatcagttagcatttgctgtgtaacaaatagtccactccagttttccaaattttttttttagtagcttaaaatacagccatttatttagcatatgatcctgtgggtcaggcatttgggctacctacatgggcatttcttctggtcttggctgaatttcctctcaagtactcaccggtatatacataagttctgcctctggctgtttgctgagcaccttggttctcttctatgtagtctctcatcctccagcacacaaacccatcatggcagctgggcagagttctcagagagggctcaaaactggcacagtgtcccctgtgctccattctgtgggcaaaagcaagttataaggccagcctagattcaaggagtagggaaatagactccctccctagacgggaggactgacaggcacagtgcagtggggctgggtggagatgagcgagataagtagggccatttttgcgctctgccaaagggactgtagggaacagccagggcctatagggcagtgggagagggacagtgaagggctgcatcagctgttggcaggggaacctttaggcactgtcttaccgcagagatctccagttcccagtgaatcatgaaaacttctcagtccccagaggaagtaaggtcttcatcatccagtggcctggactcaactccagatgtcagtgctccccctcagaaatatatagttgtccatctggacctctcaggccagcatgtctctttcctacttcccaaactattccacatgacgctggtgcccagtcagccctcagtgccctgggacagccacaagacacatgagcagttagaggctgggagacgtcatcttagtacttttgtcatccccaaactgctccaagcacctgtctgctttgcagtgtcacctggccacgggatgcctttcaggagttgctgtagaccacagaggcagagggcgcttaggtttcagtacgtttgtagacacaggtcccatgagattctgtggtattagattgtggtgggggagctgtacatcagaatcaccctgacttttgccagctgtggggcttggcatgtgcattccgagttccgtggagagtcctgctgcaactgcctttacagaccatcaccacctgctatcctctgcttcccccacccaggtcaggcagcctcccaggggtggctttgtccttgtcccctctcttcccaagcctccgggatggccaggcctctcggctggtgtgagctgttctgcatgagccatcctgccaccccttgccctgatccatggctgctcccactcatggtggtaggagagggacagcagtgggggaagtgtccaggattgcatgaggctaaggtcaaagtagaaaaggtagacacaggagaggggaggtttcccaggtgggagaggaaaaagcggagagaataattaataatggtcttcaggctcctaggtaccatttcactgtgtgccaggacagacctggggctacaggtcaaggactgagggcagctgttgggctttcaggccaggaagcagtgaccaaagggactgtggcatctcctccaagggcaggagatttggaggcctagacacagtagggaccatgagatctgggccagagggacccttctccaggcctcaaggtaatggtctttgggtctgtgtttccacttgtgtttttccaccggcaggtgcgacctccagcctcacaccatcccgtgggcctgtgtctccatctgtctccttccagcccctggcccgttccacccccagggcaagccgcttgcctggacccacagggtcagttgtatctactggcacctccttctcctcctcatcccctggcttggcctctgcaggggctgcagagggtaaacagggtgcagagagtgaccaggccgagcctatcatctgctccagtggggcagaggcacctgccaactctctgccctccaaagtgcctaccaccttgatgcctgtgaacacagtggccctgaaagtgcctgccaacccagcatctgtcagcacagtgccctccaagttgccaactagctcaaagccccctggtgcagtgccttctaatgcgctcaccaatccagcaccatccaaattgcccatcaactcaacccgtgctggcatggtgccatccaaagtgcctactagcatggtgctcaccaaggtgtctgccagcacagtccccactgacgggagcagcagaaatgaggtgagtcctcgcccttcctggcagggatcctggccccttcccccgggacagcttgcccacctggccctggccttggccccttcccagtctgcattctgtgtccagcctgtgctgctctgtggcctctccttgagggcatacagacagttgagaaccagcctcatgcaggccccacaccatgttctccaggaggaacagtcattgagcttctaagtctggacacctcaggagggtcagccacagggggcacccactggtcaggtgtataagttcatttagggctcgtagttcctagtgaagccgagcggtgccgttttgcacataaggaagcagtgacggggacagcacagtggcccatctgcctcttgccttgctcttcaccaggatgcctggtgtgtccctccatggccaggctttacagaacgcagtcccacctggagcagccactcggacccagcagccccccattgttgcctgctccaagcctcacatctaaccctagctgcggctgtctgctgggaagagccaagtccatagggccctttgggcacatggccaggcctctgaccctgtggctgctctctagttctcaggcccaggcaggatgtcagtgcaggatggagccccgccctaccaaaggcttccaggtgggcatgagctcacaggcaggccagggagtagggaaaggctgccctggaggaggccaccattggtgcagattcttggtcccctctacccccactgctccaagaaaaggtggcctaggggcattatagattgggaattgaggggttggagtgttagttcatgccctggcctgggaatgggaccgccctaccaggttcgtctccctgccaaccccagtcccttccagtgctctcctttctttcccaggagaccccagcagctccaacacccgccggcgccactggaggcagctcagcctggctagacagcagctctgagaataggggccttgggtcggagctgagtaagcctggcgtgctggcatcccaggtagacagcccgttctcgggctgcttcgaggatcttgccatcagtgccagcacctccttgggcatggggccctgccatggcccagaggagaatgagtataagtccgagggcacctttgggatccacgtggctgagaaccccagcatccagctcctggagggcaaccctgggccacctgcggacccggatggcggccccaggccacaagccgaccggaagttccaggagagggaggtgccatgccacaggccctcacctggggctctgtggctccaggtggctgtgacaggggtgctggtagtcacactcctggtggtgctgtaccggcggcgtctgcactagtgaagccctgggctcttcccaccacccatctgttccgttcctgcagtacacctggcccctctccgaagccccttgtccctttcttggggattgtggaggctgggtcagaggggagttaagggactgcaggcctggcagcaggacatgccttggctgaaccaagtcctgagagcagcatctctgtccccacggtgccttgtgtgggtccccgtccttggctttctgggtcctgggctgcccccagtgctccagaccttccccactggcaatccaggttatcatccatgtcctccagaggagcttcctcctccaggcctcagccctgttggcccaggtggagcaggagggaccactggaacatgtggtgcttgggaatgcctctcctgttgcattggtccctgaaggcctcagggcaggtatgtggtgtgtgggcgactccacaagacctgcctcccatcctggcagcccagcctgagaccgttgcattgaggcaggcaggagcggcagggtggctgctctccaggagcccaactgccttgagttcctgccccactgggccccctcccctgctgggcaatcctgggaaggtctggaggttcctgtggacctcagggaagccaggggcagctgtcaggcctgaggaagacctgtggagctcctctccagcctcctctttccctcccctctggtctccattctcttcagctccctacatgggctggggaggagacacctggtgggcagagctcaggcagaggtttggatttcagctccctcacttccggggctgtgtggctttggcagatgtcagacttctggtcttgcttctccacgtggacagtgagtatctggctcattcttcactgggttcttctgagattgaacctacaggtgtttgccaagtgcctggcccagagcaagtggccactgcttctcccatctctctcctgcccaacctggtagagctgagggcatgagaggcagagtgcacagtggtcaagggtgcagctctgcagcacaggcagcctaggcctgcgtcccaacctgcctctcaccagctctgtgaccttgggcaagggatttatctgtctgtcccttagttttctcacctgtaaaaggaggataagtatatatatatatttcccagtgttgtgaagattaaaggagtttatcgatgtaggtcttaggatgagtcctggcatttaccaagggttggatatatgttattatcactattaagtgttgagggtccaggcatgctgggcaacagggaccccatctctacaaaaaagtttaaaaaattagccaggcgtggtggtgcacctgtcgtcttagctacttgggaggctgaggtgggaggatcacttgagcccagaagcttgaagctgcagtgagctaggatcgtgccactgcactccaacctgggtgagagagcgagaccctgtctcaagaaaaagaaaaatgcagagaaacaggagtcttggctactcctttagaggcagactcagaccctcctgcctcacagctttatctttgtatttgccccttactttatcttgtgccttgagaaattgctggggagagaggtatgtccactgggcagctgtacaggatggaggatatagggcgtttccactcccagcagccaggttccctcaccccaagctcacccactgttggggagattatctacaataacaccagaaacacattggggtggattgggggtatccttatgggttcttttcagggaaccattgctggacaaggcacaggagccacctccatttctgagctctgcaagggacaagaactagagccatcaggggctgggctcactgtggccccaccccaagccgtcagcctccagggatctacaccctgccttggctgctacagctttttcactccactgccctaggggagttcagcaacctaatgatctctatctctgaacatctcttcatcccatgctccaagtccagcaacctgcaccctggaaccaggagtggaccctacccgagctgtctgtattaatccccatcccccaccaccaatcttaaaaagccctctgtccccctaccctaaaccccagttaggtacccatgctgggcaggtcagttaacaatttatgcacaggtactagttttattgtattaccgttccagggtagctttgaaaaaagtatctcaaaaaggcaacatgggccgagcgcagtggctcacgcctgtaatcccagcactttgggaggccaaggtgggcagatcgcctgaggtctggagttcaagaccagcctggccaacagggtgaaaccccgtctctacaaaaataagaaaattagccaggtgtagtggcagacgtctgtaatcccagctattcaggaggctgaggcacgagaattccatgaacccaggatgcggaggttgcagtgagccgagattgtgccactgcgctccagcctgggcgacagagtggtattctgtttcaaaaaaaaaaaaaaaggcagtatgtagccccgaagactgttgcccaagtggtagaatgttagcacactaccagcctaggtaaaaaatacaaaaagtaactgggcatggcggcgcccatctatagtcccagctacatgggaggctgaggtgggaagataagtcacttgagcccgccaggaggcggaggttgtagtgagctgagatcgcaccactgcactccagcctgggtgaccgagtgatactctgtctcaaagaaaaaaaattataattttagcacagtaaccagccatgatgggagataccctgggtaaggcatgtagaaagggttgagggaccttcccagtcccctagccccgcctcccatcctcccatctttttcttttttcttttttttagagaatcacccagcctggagcgaagtggtgcaatcataactcactgtatccttaaactcccgggcttaagcgatcctcctgcctcagccttctgagtaactaggacttcaggtacctgtcaccatgcctggctaattaaatttttttttcttttttttttttgagatggagtcttgctctgtcacccaggctggagtgcagtggcgcgatctcagctcactgcgacctccacctcctgggttcaggccattctcccgcctcagcctccagagtagctgggactacaggcgcctgccaccacgcctggctaatttttttgcacttttagtagagacggggtttcactgtgttagccaggatggtctcgatctcctgaccttgtgatccgcccgcctcggcctcccaaagtgctgggattacaggcgtgagccaccgcgcccagccaaattaaattttttatagagatgaggtcatgctgttatgttgcccaggttggcctcatgagatcttgccttagcctcccaaagtgctgggattacagatgtgagacactgcacccaaaccccaccacttttttttttcctttttctttttttgagacagtcttactccgttgcccaggctggagtgtagtggcatgatctcagctcactgcaacctccgcctcccgggttcaagcaattctcctgcctcagcctcccgagtagctgggattacagaggcctgccaccacacccgactaattttcgtatttttagtagagacggggtttctccatgttggccaggctgttcttgaactcctgacctcaagtgctccacctgcgttggcttcccaaagtgctgggatacaggagtgagccactgcgcctggctgatcccagcacttttcaaatgatgccgctcaaagccgtgacttggcctactttgaacagcaaacttgttgctgctgttgtcaacctgaaggcctctcaaatgccagcttcaagcagggtgtgaattggccagtgtcagatctcaggagtcctgtgttgagagtgtggctttcagctgcggggagctgcacttggtggggaaagccaggcaggtcaccctcacagccagataatgtggaggtcagaacccaaggaagggagtgagacctccactcccagtgggggacctggccacccatccttggggacctgagaaagcgtacttcaccttggggtgaaggctgggtggggccagagggaccagtgccctcctcagtgcttaggggcagagccacctgcagcaatggtatctgcatattagcccctctccaccttctttctcccgctgaatcatttccctcaaagcccaagagctgtcactgcttctttctccctgggaagaatgcgtggactctgcctggtgatagactgaagccagaacagtgccacaccctcgccttaattccttgctaggtgttctcagatttatgagacttcttagtcaaatatgagggaggttggatgtggtggcttgtgcctgtaatcccagcattttgggaagccgaggtgggaggatcccttgaagccaggagtttgagacaagcctgggcaacaaagcaagaccctatctctaaaaaaaaaaaaaaaaaaaaaaaaaaaaaaaaaaaaaaaaaatctaggagatgctctttaccctgcctggcctcaaactattaatagcttcctttgagcaacattatttattatgaactttcaaacacaaaaaagtagagagagtagaataacaaatccccatgagcccatcacccaacttcagtaattatcaattcatggccatcttgttcacccctgcctgcttccctgcttcccctcattctgcagaggttcttttcttttgagacagagtgttgctctgttgcccaggctggagtgcagtggtgcaacttcggctcactgcaacctccgcctcccaggttcaagtgattctcctgcttcagcctctcaagtagctgggattacagatgcccgccaccacacctggctaattttcgtatttttgttagagatggggtttcaccatgttggccaggctggtctcgaactcctgacctcaagtgatccgcccgccttggcctcccaaaatgctgggattacaggtgtgaaccacggtgcctggccactgtacaggttatttatagaagttggagagtgaagggttgagaaagccaaggggcagatgcgggtctggaggattttgtgcctaaggccctctctttgctcccagacagcatgaagtaacaatgaggcatccacctcttggttttgtggcctctgtggatgacgtctctcaccttgaaccagttcagagttggagtagcgcaggatcctgtcttcagaggaggggccgaagcgggttcctctgttgtcaagctctttggaggtgcctggctgctactactgtcccagagaggtgatgatgaatgatgggtgtgtccagtggcagtttgccccactgaggcaggggcttccactaggccctgacagagcccttccagcaggcagaaatccctgtgctaggcaagattcaaactccgtagcatgtctcctgctcccatctcttaggaatggagtccttcaggccttgagtcccacattttccatgatgctccattaagcagctgatagcacccccacctccagggaaagtgagttcagagtccttggtctaatgcatctgtgttgaaattgaggccttcccctgtgttcacctttctgctctttttcttttagcccaaggctatgaaggcctcattcggtgctgggcatggtcactcctagcattcctcactctgttgctaacagcaacagcaataataataagggttacaacttactccataccttactgtctgccaggcattaagctaagtgctttacatatattaagtcatttaatcctcataatgaccctatgaaagagataccatctcaacccaattgacagctggtttgcaagattaggagggatgaaggacccaggggacaatgcgagggaaaactctgaccccggggccccaggctggatgttctttatgcctgtgaaccacagcttatcacatgtctggagttagggaccccacttaaagtgagattttggctggaggtggtggatcatacctataatcccagcactttgggagaccaaggcagaaggactgcttgaggccaggagttcaaaaccagtgtaggtaacagctagaccctatctctacaaaaaatttaaaaattagctgggtgtggtggtatgtgcctcaagttccagctactcaggaggctgaggtgggaggatcacttgagcacaggagtttgaagttacagtgagctatgatggcaccactgcacttcagcctaggcaacagagggagaccctgtctttaaagtacatagaggtttttcacaccaacacatctctgcccagtgtgccaacatctgccacctgctataatagtactataacactcaatatgtaattaatgtagtctcagggatgttatgacaatatgattacaactatcacgtgtgtgcccagccaggctcaatgccccaggctgggcgaggtggggcaggggacacagcctaaaatgccaggcctcaggaagccatttggtttagcagacattgtttattaaaggagttacctatgccagatcgaaggcctaagatgattaagacactatgagtgccttcaagtggttggggacgttcatgattgtggtacagacaaataggctttcacatcattcttttatgtaatcatacaacagatatttgcacctacatgtgcagagcactgtgataggcctcagtgacacagaataatacggcaaagaccccacccgatgagccccctcccaccacccaccagtacagtagggggtggtttaatggagtgttcctggaatatgaagtgggggcaggcattaggggtggcaaagggacaagtgtttatctgatcagttatgtactgtttataataagtaaatcagcagagggggaataatacttagaacctatagagagtaaatctgacaagatgaaatgctgatgaaaatatggaggaaatgaaactctcatgggttttgcagggaatctaagtcagtgctgtgttgtgaatgtaggtgtaccctttgaattcatatgttgaatcctaacccccaaagcaatggcattaagaggtggggcctttggggctgggtatggtggctcatgactgtaatcccagcactttgggatgctggcagggggcagatcacttgaagccaggagtctgagatcagcctggccaacatggtgaaaccccatctgtactaaaaatacaaaaattagccaggtgtgatggcgtacatctgtaatttcagccactcgggaggctgagacaggagaatagcttgaacccagtaggtggagatttcagtgagccgagatcgtgccactgcactccagcctgggtgacagagcgagactccatctcaaaaaaataataaagatgtggggcctgtgggaggtggttaggtcatgagggtggagatcatgaatggggttagcaccttataaaacaggcttgagggagcccttctgtcccttctaccatgtgtggatgcagtgagaaggcaccgtatctctgaagcagagagcccgccctggacactggatctgctggcaccttgatcttggacttcccagcctctagaactgtgagaaataattttttgttgtttacaaattacccaggctaaggtgtttcattgtaacctgaatggaccaagctggtgtgaccctgttggaaaactggcagtatctaccaaaagccgaacatacgtataaactgatccagcagttccactcctgggtatgtacaccacagaaagctatgtccaccgagacattggcaagaatgtttctaaccacacgctgactgtagccccaaacctgaaacaacccaaatgtccatccaccaacccaaatgtccatccacagttgaagctacagtgaagtcacagggtcgaatactactgcacagcaacgaatatgaatgaaaatatcgctatgcacagcaacatggataaatttcacagacatgaggtcaagcaaaagaggtcagagtcctcatcatcaagagagaattcattgtatgattctcttcctacaaaaagtacagaaataagcaaaactgatccatggtgttagaagccaggggaacagttaacaggggagggatactggggaggggcatcctggagtgctggtctacctcatctgggtgttgatttcacgagtattgtcagtttgtttccagactccctgttggagatgtggaaataaaaaccacctaaacaagagcagagaggccatttggtcaaagtttgcaaaggagtcagccatgattgcttgtatttggcaggggtcaaaggcaggcagggactgtgaaatgttatagtggaaaaaaagggaaggctctgggtgtgctgtgattggagattgttggcatggggacagagcggactaactggaggggcatctttggttggttgggggggtatatttggctttctctggttggtctggagttggaagagggggtgtggtggctggggattgggaagaagctggcagccactaagttcagactgttctgggtccgattgctgctgaggctgtggtttggcttccttggcttcccaggctggtcatgggtttctggccagagtctattgtcatatgtggcctggccattgtccagttgtatgttcagtctcttggaaggaagggtattgactctgagaggggccaccatcgctggaatgggggacacacagtacttcctccagctgcctacacccccctagggtcagtggcgcctgcctgtgagggtgagcccaatggctagagggctctgctccaagtcattgcttactacacccacaaacattcttcgttctttaaggcctaacttaaagcccagatcctacaggaaaccttgattagacccctctctttattaagcttcctaagatcaaaccctgcttttgtgtaaatgctgacctccttgcctacattttaaaaacctagagctgggcatgatggccccagcctgtaatcccagtgattcaggagactgaggtgggaggattgctagaagccaggagttcgagaccagcctgggtaacatagctagaccacatctcttaaaataaaatagttaatttagccaggcatgatgatatatgcctgtagtcccaactacttggaaggctgaggtgtgaggatctttgagcccgggaggtcgaggctacagtaagctatgatctcaccactgtactccagcctgggtgacagagcgagacccagactcaaaaaataaaaataaaaaccctgaatatcttccttctacttcttcagtgctgtttttatttaaaaaaaaaaaaaaccagccaaaaccacaactttttactgaagtgtaatgtaaatgctgtaaaaggcagtgaaaggcacaagggaggtggaggggtaggaagggtggaagtggcgggaggaagtggcagggcaggcaaaatgaagggaagccctgggttcttgtcctgcatccgcagccagctcccactttcctcaccctccaggacctgtaaactgtgaggctggaccagttatgtcaaatctgtcctcccccagagctcagtccctctgcccttgggtgtccttggcacaaggcaggctaggctgcaccagcttcctccatctccgtcctgcctcccccatccccaggtgccattcccacaccatctgaatcactgatttcctcgcaatcagacgctatcttccagttaatcacttcgcttgtatttaacataagaaagaaaaaccctttcattatcacatacagctggaaatcggcttcttgcaggaggcgtatccaaaggaattggagaagagataaactggtaattggtgaaagaattactttaattttttttcctacttgctgtcatgatgatgtccttagaattgtgagcccgtggacacttctgtacaataaatctgctattattacttctagaactaca

SEQ ID NO: 1864 - DNA, 29325 bp, Homo sapiens; identical to SEQ ID NO: 1863
  source 1..29325: mol_type = genomic DNA

SEQ ID NO: 1865 - DNA, 29325 bp, Homo sapiens; identical to SEQ ID NO: 1863
  source 1..29325: mol_type = genomic DNA

SEQ ID NO: 1866 - DNA, 75925 bp, Homo sapiens
  source 1..75925: mol_type = genomic DNA
aaatttataaggcaaactctttatataataaataggttacagggattcagtggggggggggtgtttttgaaacgtatacaggtacattcagacaggtttactgaaatggtacaaatttccttaataaattgccttttgtttttaaatatatcagtgctttcagtcatttggctatacacaaagaaccttttttctgaacactacaaaaaagcaatcaataatttttgtttttaaaacgacctacttattttctaaagtaattgtcccaaaacacaaaaactgaaggtgaatacgatacagggcttttagagacatctccagctaagtgtgtcccggcctctccctgtgccccaagtgcacctctcccaacctcagacaggtttccaggctggagccagctcccttctgcacagggtggcctgtgttactggcaatgctgtccatagctctcggcctctgggctggcacaggggagcatgacttcaactcaggagggggcagacaccctgcctagctcttccagatgctgcacccggcatgcaatggtcactacagtcagcactctccgcctctcagaggagggaggggctgtcaggtgttttgggagcccaaaaccatgcctaatgagggtaatggcttttctaaggagatgttttcgccatggaatgggaaggggttttctcacatctaagttttgctggcgatcgggtgacagccaagagagtgcaagccccctccatggtcattttattgccctgggaaggggagggtggggaatagagatgtcacagtgttgagccctggaggatggggtgggatgtgacggaagtgtcttaaacagtaatgcccacggggcacaccttggagagagaatgcccaccacctggcctgtccaggaagagctgcatctgccaacattagcctgacctgtgcccacagcagagcgtcccagcctcctgcttgggtgggcccagccccattctccccagctcttcagctctgcacacacacatcccctcctggctcccctcaaggaaacatcaatcttgcctttccttaaaagcacgggatggtggtaataatctcggggggaggggaagcaaaacaagaatccactgggcggaacaaaacctggttttgcagtgacttggaaagtggcaacacatcagctattcggcttgctggcttggagtgggactcctgggctccactgctttgggtggcttctggctgatctgggcaggggtcatctgttcagctctcccctctcatctcagtcaccatccccctccctccgaatgcttttgtttgtaaagaaaaagtgtctagaaatatttgtctctggaacaattactttaaacatagttacaatacagacttcagttcaaacacagaagagatttacttagcaaaattcctttcacccaccaaaaattacacaaatataagcctcaacaccacagttaagaggaccagtagagagaacctcatgtttggaacacaaaaggagaaataaaaaccaaaccaaacccaaacagaaaaaccccagaaagacaagtaaagggcaaagaaggaaggggaaggggagcaaacacagcacacgttacagtgtccagatacacgggagcccagcatgggcaagggctcggcacacattgagtaacagtcctggtgatatttggtcatatattcattgactactgactctggagcggctgttattgattgaagcagtgacaaatcaaacggaaaggaggccgtggtagcaagggaaggagcaggcttcaagttctgcaagccttttgcactccactgtccagctccccagaaacactgaaccgggtgggccccgctccatccgggcagggctagaggtcaccgggtgaggctaactcgggcgtcgatttcatgtcagtcagaaaacacgcacgtggacgcacgcagacacccacctgttcacggccaaacatcagcggcaacggcctcctcgcctcctctgcccctatcccaggctgggtgggaaagagcatcatgacccactgctaacactgaacacacgccggagctggccccggatgtgggcccagaggctgccccagccctggtcctccgaagggctcacgggtagcccggccactgaaagggcctatggctgtttttcttttggattcaggcctcagaagaagcaatgacagcagggagggaagcttttggccctggtgattataatgctctctgctttggaagaacaagtttctggatttttttggtgtttctaattattaaaaaaagatgatcaaaaagaactgttacagctaaactctctagcagatattgctcattaagaattacaaaagcaaatgcaattactcgtaggatgggggagaagaaagggacatttctggagtcttcactactcctggaggggaccccttggactgacgcacatgattctggggtccctggcgttctacctggtgcagctcacaggttccgagacaggccaggcctcccgtctccgctccagcccccaggctcgacagagtgggaaggatgaaacacactcggaccctactggcagggaggcctgcgaggctgactccacatgggctcaccctgaccaggtcacgggaaggggactgggggagtcaggccaccccagtggactccagctcccagaggtggaaggcgaccaggctgtgccgactacgttccggacttcagcaggtcaagggagcgctcctgcacccagaaccttgggacctctttcacaagcacgggagaaacaagagtgcaaaacctgggtgctgcctggagcctccttcacctggcacaggaaagcccttgaaagaagcgaggaaaagaccacgaatctgcttggacagaagaagtgaccagcagacagatttgtcgtttttttttcttttttttctttttttattttcccttgtcctatgctatggttatcagaaatattgtaattaagcaacaggtataattttaacaggtctttttttgtgtgtgtggagccacaagcaaaatgagtttataattgtgcaatatacagatatatatataaaaattcaactgctttgtgtgtctagtcggtgcgttaaataaaagggacagaaaaactaaaagcaaaactaaaaagcaaaacaaaagcccaggatagaggagacaaagcaggcctatgcgcacagtctatgtgttactggatataatcagggtcaccaggaagaacagctttgccacttgacacacaaacactgcggggagaggggctatcagtgggcaggagccaaacctcttggccttttcacctcatctgctctcactgctgagcaggacctgattaaaggtaggacagaatgggggtttgggggcaaagagatttccaaattccccaaatgttcttgaattcaaaggtaggatttcctccagggtctgggctctgcctgtgcacaagtcggagcccggagcgggagctgggggttgtgctccctccttgcactgccctcacacctgcttccttctgcctcctgacagggcaggcagggggccttggggaggcagtgagaggccagctcagaaggctcagctgatccgaggcgagcagagcaggagtgggcaaggcaggctgcccctcaggcagaagtgccttcctagttccctgggtgttttcctgacacgtcagcgctggggcaggctctgtcaagatgagaagagtgggaaggagggtggtgctgggccttccaggtcactggtgaacgctccaccttccataccactcccaaaagacaggttcagaagccatgtcctcaggtcggctacctccagattccccttgcctgtaatgctcaccaggcatctcaggccaagtgctaagtatttttagatcagcactgttgtaaaagcttgctcgtattcattcaaaaacatcgaaatgtaattttctgccaaatgttttctaggttttccttctaaattgttgagaactgacttcagtgttcagcttttcccctctaatatgtaattttagaccctgggggaggcagtatcctaacgatttataacaagtagactatgccttttctaaagattgatacaatatctaaaagagaaagacaccaaaatggagagaatcaacaaatcccgtcagagcagagagaagagtaggaagacccggagggagcagggctctgcccccccaccgggcaggtcctccagacccactccatggtaggaactctagaaacagctgactccctgaagtctaggacacaggtcctagaatctgcaggtgtgaacttgaaacaggaatccatttggggcaatgacacaggctaaaaatgtatatgcccaaagatcttcttaaagaactggtacctgtaacctcccctggcccagtcagcccagagagcctgactggaatgctctggaaaaggagctgtggttagacgggggacacagagttctggctgtcaggctccacttgggctaaaccaattccagatggtcccgcgcaggggactccgctcgtatccctctgctccctcctgggcttgagccgcttactaagtgatttaaaattcagagattctgtcagctaaagaaactcctttctccacccaacttggcagtttgtgtctggttattaccctctttcgccatcactgtcacagcaatgaaaagctgggcagagaagcaggtgacaatttggggctgctccctgtcccaggtgcactgttcatgcttcgggcctggaatgatgccacccaacagaagattgtctgcacccgcactggcgctcacgagtagcagcttccgccatccagcgagctgagaagctggggccgttggctagtttggcactgatggattgggggatgtggcgtttctgggtgtcccctgtgtcttttgatatgggaatacagcatcaacagaagggagctgtgctagcgcctggctgtgaccaagtatctccagctcactgagctgtcaagaccggcaatcccactggctatgacaagcccaccagcaggcagggccgggaggggtagacctggggggagctcgacgacatacagtattgtcaggagaggaggtagtaactaacaactggaacaagggtgggggagactgtggatgtggccttaatgacctagccccatgggtactggaaagctgtcggtcaattctgctgttcacaaattcactgaaagaggcccccatcttcataatgttcaagtacagacaaaattgaaattgaggtcacaccccaaaactgggccggacacagctggtgagaatcctgcagcttaaggctttccctccaacctcctgtcaacctgaccccaaggcaggggcagcatgagagctgcagggcccctgcctgccagggcgataaaccgccaaggctgcctgctgaaaggcgactgactcgtgatgcctttgggaaagacgagggaatgaggaagaaagggggaaatagagagaaaaccctaaggagcctcaggccccactggcagctctggaataaactggaagggaaagaggctgggcaactgcctctttgagggagctgcaggtggggcccgaatgaaataaagtgacgcttgaaatgctgtgttcccaaccacgactgccccatcggccctgaatgaactgtcatgggtgacaggggggcctggtgggccacgcactcctcttaccaggaccagatgacgcccaggtgacggggaagcagctctggacaatgattccagaagccacattacatttgactaagtataatacataaaaacccaactgaccaaaataaacatcttctcagtgacaacctggtcggatgctgcgctctcgtggataagtgtcctttggtagtgccaggagttcgaggccactatgggggcaggagccttctgtccttggaggaagagttctggaggactcaccctctcttctgaccccccttcccttcctggggaagagtcagaagtgaagctgggggggtcatcagcagagcaggtggaagggatcagggatcagggattgggctgatgggagtttggttgcaggacttgcttttacagcataaggaaatggacacatatatgctagaaagtccaactatgagactctacaaacagaacggggcaaactccctcacttctaaccattccagaagagacaaacacggttttttcttaagctactgattggaactgtcaactatggttcctgatcactaaagactggcaaggaagtgctagacagtttctatgatgtttcactccttcatgattacaccatagtaaggaagccagggacaataactgaaatacacaagacaacacacacttgacagttcatggcagcagctcacatgggacatgcctgtgggtgtttctggaagcataagactgctgtctcatttgctactttgataaggtacttctcagttggacagatttagatataagagacatctctgtaaacacagaaaaggatataccaatatgatgaagatatgcagctagataaggacttcctgaacagaggttaaaaagatgggatcccacatgaaaactgatcaattaaaaacccacagcaagcccatgcctctaagcccctacaccacagctatggaccagacagacagtgaaatgtgtggtgttctggccccctgtctgcatcgagcaaaagcaaaacattgccattcaagaagaactccgagggaaaagggggagcagaggaagggctggggacccaggtactggtcccagctcgggtcttgggagttctgcattggtaccgctactgccctgctgcactacgctagactctggacttctgagtgaggtcaaggtcggctggcatggagcccctgttgggccactcgatgactggcaggccacaggaggcctctgtgctttcctcaactaccaaatcgggcccagctcctccagtccacttctctagagtagaagggtgaaaaggctcgttgttcagggtgggaaatgccttttgctttttcttaccagggaagagggggctacctaggagagcaagaccttgctgctctcttgctcttcacagacaggccaggtcggactcagcagagcccaaggcctcctcagggctcaaaacagggtggggctggtactggcagcaggaggacaaagggcaggcagagttctggggactggagccgacaagtgtggttgggcaccgcggctgcctggaagagaagggatgaactaggaaggaggaggatggaggaagggaaagaagtgaaaggatgaaatgaacaaaaggcagaaatggaaggggagaagagaaaccaatcaggaagtccttataaaattgcagcaaacacttagagtttcggagcttcgtgggaaccctatgtgctgagcccactttaaaacaagcgcaggtatatatacaaatccaggtagttctcaacactgtcacatctggtggcttgagggactaaatgtcaccaattcaagccagtttgctctcagagcatctgtttgttttgaagtgggaacatgaagactcaatagtgcaaataattctaagctgtccctaaaggagaattggaaagtaactggaagaacattttcttctcctccccctttgccccctcccctgtccactaagtcacagactgctctgagtgattaggaatccctctcaccccgctgtgctctgcccggcctgaccccaggccagcctgcctgcaccttgtcctactgcctccatggcctctagcgccacccgttggaggacgtcccttgagaatggaccatgccacctcaccctgggccatcctctcctgtggttcaggccagtctacacccagtagttcaagggactcccccctcctagccatgccagagctggagcagacaggtgccactttcctgtcctgtgaagcgtccttgccagttttggattggggctggtgtggggccagacttgagccaccacgggtgggatcgcacaggccatagccactggtcatatccatcttctctaaagaatccaactgtctctcctgcctcacacctccctgtcccaacgtggttgggagtgggggaggtggggggagctgggggagctgtagacggggcactgatggcaccgaaaacgggagtgtcctctcaactgctctgtcgctctgtctctaacgaccacatgggggaaaggtttgggcgggaggggaggtgcctggtcaacagcttgtctggtcagtagtatctgcagcaagccttgttgaaggagcctagtttagaaaagtgcaaagctacttctggccctggttaggtcttcaacctgactgtgcttgtcggtaagaaaaacatccccaatgctccaactactcccaccctgaagccacgaaactctaagtttactgaaagaaaaaaaaatattttttatttcagttaatcgggaagctttgtcagagccctacccataaggagaagagacaacagctgcctttattcttgttggtttgctttgcaatccgctccgtgtaaagtcagctaactctctcggtcacgggcgtccggctgtccacaggctcctctctgtttggccttggcatggaggatgaaacaatgtctttgcgctctccctcccctcggtgtttgtacttttctgcggccgtggcggcggtggcaaccgcgggctgagtcttagctggctccttggggcagccgtcgctctccagtgagcctcctctgggcatcttctcctctttgcagacgctgctgctcaagtcctggggctcaggggggctggtggggtcctcggagctctcgggctcaggtggaggtgggggcaggggtgggagcagtggcacgggggcctttggggactctgagtggtggtgatggtggtggtgctccttcttggggggtgaggaggcgctgctgctgcgccccttggggctgctctccttgcttttccgcccagggctcttacaggtcttcagtcctttcccgctcttctcaccgagggtggacaccagcaggggcttcaccacttccttgacctcgatgctgaccgtctcccgggtcttgcgcttcttgatggggagtacggtctcctgcacagatcggatagaagactccttcacggctttctttttggcctcggcggcagcggctgccaccacactccccggctttcggccccgtttcttgggaatggcctgagggtcggcctcagcttttcgcttcctgccggggcgtttgatcaccatgacctgggtggatgtggtggccccacccccctcagccttgccccctggcgaagtttgaaaaggcatcttgacaaggagcttcccaggacttttctccaggacccttttcacctgcacaccctctgacgtggccgccttgggtctcgtggtgccgctccctttggggcgtccccggcctctgccagttcctggagctttgggagatttgggcttcttaggtggtttctgctctcgccgggaggggctccctctcccagttaccgtgaagtcaaaatcattagggtccagggatgtgtcgcctaccttttcgaagtacgcaatcaactccactttagagcgaaaggcttttccctggggactgtggggacaaacagaaagacacaaggaacaattagaggctctccatagcaatgtcagagatagggcagagcggatggtggtgacaacgctctgacaaacgttactattgaacgagagtcacactgcctggctgcccctgaggacctgtcaccaaagccactcactcgtctgcctgccgctgacccccccaggcctctccaaagttcagcaaccaaagagtcaggcctggtacagaagggttgtcaggctgaggcccattctgctggttggtgcctgggcctgagtcaccatctagaacattcccaagtttgaactcaggtacggtgctcagtctctccaggaatcagtttcaacaagataatcctttgctcacccttctcatggaattaaatgaggctgtctgcaaatgtcatttgaaaactgctaacctttttgggatcatttaaaaggcagaactgaaacatgcttcttcacccctctgaacccctagctctgcaagttcctctgcttccgcagctattccatccccagataaagacttgaggtgtggagaggatagagggcctgctaccttgagaacttcccactcagggcagcgacctctgtacacggtcatttcaagcacacctggtctcagtgttcattgtttatgttccccccgaccccaccctgggcacatacattttcctgctccatgagggatccttgtccctgccctccctgccctgtagagataggagttgctcttacttacttgatcaaatacacatcatacttcccagcagagcggccagatttcctttgcttaagcttccgtgtccagccttcaggcagggtggggtcatcatacatgggtccccggtcacggatgatggagcgccgctgtttgggggaggcagaagcttccggcacagccggggcggagcctgacccttctgatgtctctgctttgcctgcctctgcgggctcagcagagtggtgggctgatggctgcacgggctcatgcttgccctctttctcttctttcttatctttcttcacctttttaaacttgaggggtttgtccttgaggccctggaggtcctggtcttctgacttttcttccctgaagtgttaaacaagtatgtaagtatcacagagaacatgccagtctgcagaacaagtgagcagaggcaggcttggacccccaccacatgcaaggccccaggccatcatacactcagatcttgatgtccttccccaggacaacagagactcgggccaagctgggacccaaatatttctttaggaatttgggctgtgggtggtgctggccggtgtgcctgacctgcactgtggccacccacaagtctcctagcactgcaggagaatcagagccctttcctctgagcggaaacactgcggctcctgagcataccaccccagcatgagtcgcacttcaagggactctgggctcgatggctgacaagaggccgtcgactgctggaaagggagccaaatgggggaggggtctcctttgtgaaggccgggccttgggtgtgtttttggttttctagaatgaggctcaatgaggcacacagtacagtgtcatggaaagcacacacaggtttggagccagccaacctgcactgaaatcctttgccgctttccaaacatgaacccagcaaatgacctcagcattctgtgcttcagtttccttatcttgacaacaggtaaccccatctaggcatccttactgtgagcatcacaggagaaaaggcacaatggcactatataaatatcagctaactcaggccacaggaaactaccgcctagggtcctgggggtgataagacaagtggtcccaggtggcgtgagcctctaacacatgttccctgatgaggaatggcctcggccacagcagatgcggagggaagagcaaggaaaaaggtgtggtccaggcagagccatacatccccttcctgccggtggagaagagcaccctacctattctagtgtgggaggcttccccgttcttttctggtgaccgaagcagctccttctctacacatcactttggcccggtggggtctcgtcagaaatggccaccgtgaggccccacaccccagcatcactatctggccatgatgctctagtactctgtcgagtatgccaccgtgaaacctcctaggactccagagcctctgcaacaacaggggcagcttggaaagaagcagcagccacctgcgagtcccttcgttagcagttcattctggaaaagagcatgactactcccaccctccgtgttctcagccccacaactcccctgtcccatgtggttcacatcagtgctagtcaccgccttgcggctggtctaccccaagagacttcccctcttgtctacactgcacagactgtgcaatgagggcaccatggcactcactggcaagcatccttaggaaaccagaactcaaatgatgtagggaagttaccaaaggctgcttagtgctgggactcagaagctgcaaggacgtatctctccagaaccatcaggtcaggtgtagggaggcaagagatgttccaatctagtgacaaggtcttagagtgagggaatgtcttgtccccaccatgactcacccctgagttcctccctatcctgtatcttcctccagaagtttagggcccagagtgtggctgccagagtcacctagagccactgcatacacaaaggcatcctacaacccacagagcagtctttcttgctgtaaagaggggtccctaatctgtcccagcacagagctcgccttgttttgttttttgttttttttttgagatggagtctcgctctgttgccgatggcataatatcggctcatcgcaacctccgcctgccgggttcaagttattctcctgcctcagcctccggagtagctgggatcacaggcgtgtgctaccacgccaggctaatttttgtatgtttagtggagacggggtttcaccatgttgggcaggctggtctcgaactcctgacctcaggtgatcgacccgcctcagcctcccaaagtgctgggattacaggcgtgagccaccgtgcccagccagagcttccttttcatgtctctgagtcttacagctctcaatgggaaatgacgaagaaccctggaaagctaggtgtggcctgttgcccaccagagatcagcctttgagaatggacccctaggcagctccccagctccccataaaggagggagggaaggggagccaccagcagagtgggccaagaaagcagacagatgggaatcgctacttctacacaatccatcatggcactgcctaacgccagggctgctccctagaacccggacggtcctaatgtcagagaaaaacagtgaactaatgggaaagatctggcttcttcgaaactctcatttgcatttcccaaataccttaatcaccatgaggtcaaactataaacctaaacgtgacgtaaggaatgccttctagaaatctatgctaaagagacacctccagaaatctcaaagaacatatgcatgatgttatttgctacaacattatttttaccagccaaaggcttccaatacccccgatccctatcaccagggcacttgctgaataaacttatggtgcgcccacacactggagtactgtgcagatccaaagggactaaacaagagctctaagaactgcgatggagtcatttccaggatccactgtgaagcaaagggagcaaagcgcaaacatatctactgcattctaccaaagaaagaagggggggtattaaggaaggacacaccaggaactaatgaaattgattccctgcatggggtagggggaaaaaggtaagggtacaggcacaggagtgaggcctagctgaacatgcctcagtgtaattctgacttctgaatcatgtaaatgtttatattacccaaaataaaattcaaactaaaagtaacaaaaccttattacacttaatgcaaataaaaacaaatgagttcgggccaggcatggtggcttcagcctacgatcccagcactttgggaggccgaggcgggtcgatcacctgaggtcaggagtatgaggctgcagtgagccatgactacatcactgcactccagcctgagtgacagagcaagaccctgtctctctctctctctttttttttttttgagacagagtcttgctagagtgccatggcgtgatcttggctcactgcaacctccgactcctgagttcaagccttctcctgcctcagcttcccgagtagctgggattacaggtacctgccatcacgcccggctaatttttgtatttttagcagagacggggtttcaccatgctggccaggttggtcttgaattcctgacctcaggcgatccacccaccttggcttcccaaagtgccgggattacaggcatgagacaccacgcctggccaagaccctgtctcttaaaaaaaaaaaaaaagaaaagaaaaaagaaaagaaacaaatttaattctatatcaaattgacaatataccacagagaaaagatttatttcaaatgacttttgactacagtgctctgcaaacctgtagtgggacatattctaaggccaacaataacactccaggggcagtaaacacactagattggctcccaggagagatatgtgattctgcttctggggcatcttgtgccagaaagcccggggagtgcaagagaaaaacagggagggcccatgagaggcctctagcagtggtccaggtgtggcccagggtgggggcagttgaggatttggggctggtctaggtggtgaagcaacagagctcgcaggtggattagtgtgggggtgaggggcaagggtgagtcagggaccatgtccaaagcctgggaagatggtggtgccactgattgagaaggaaaagactgaggggccggctgggtgcagtggctctcacctgtaatcccagcactgtgggaggctgaggcaggtggatcacctgaggtctggagttcgagcccaacctggccaacatggtgaaactccgtctctactaaaaatacaaaaatgagccgggcgtggtggcaggtgcctgtaagtcccagctacatggaaggctgagggagaagaatcgcctgaacccaggaggcagaggtcgcagtgagctgagatcgcaagactccgtctcaaaaaaacaaaaacaaaaacaaaaccactggagcggcaggggagcaacacccacagagacagttataccatcaaggagagaaaacagttcttcagctactcgctagaaaggggggaaaccccgctgtgatcagattctgagttgggcctgaatgaaaatgaactgtctgcttggggttttaaaggctttttattgtggtaaaatatacaaaacaggtcaggtgtggtggcttacacttgtaatcccagcactttgggaggtgaggcaggtggatcgcttgagctcaggagtttgagaccagcctgggcaacatagcaaaaccctgtctctacaaaaaaaaaaaaaaaaaaaaaaaattagctgggcatggtggtgtgtgcctgtaatcctagctactcgggaggctgaggcaggaggatcacttgagcctaggaagttgaggctgcagtgagccgttgatcatgccactgcactcctgcctgggcgaacaaaccagacacatatatgtctcaaaaaaaaatacatatatatatatatatatatatatatatatatatatatatatacacacacacacaaaacaaagtttacctttttaactatttctaagtgtacaatgaatgaacttttttttttttttttttgagacggagtcttgctctgtcacccatgctggggtgtggtggcgcaatctcggcttactgcatacaggctctgcctccctcctgagttcaagcgattctcctgcctcagcctcccgagtagctgagattacagatgcgcaccaccacgcccagctaatttttgtatttttagtagagatggggtttcgccatgttggccaggctggtcttgaactcctgacctcaggtgatccacccacctgggcctctcaaagtgctgggattataggtgtgagccaccatgcctggccctaaatgaacttttaagagcactgaagatgggaaataaagggtctttaactctactgtaatattctagttctttctaatggaaattacttgaagcaaatatagtatgatgattttcaattctgtgcaatgaaaggcacatgggtgtttgttaatttgctggctgctacttttataattaaagacaaatttcaaaaaacccacaaagaagcctggattgtgctgggtgtggagtgcaggtaaaaatgataaaaaacgtggatggagctggagtccattgtcttcagtgacacagctcagacacagaaagtcaaataccgtacgttctcacttagaagcaggagctgaatagcatgtgcacatggacagagtgaggaatggcagacactggagagactgggaagggtgggagggggtgagggatgagacattacttaacgggtacaatgtccactattcaggtgatggttacactgaaagctcagacttcactactatacaatatatccacgcaacaaaactgcacttgtaccctttaaatttaacaaataaaaaacaatgatagaaaacaggtattccaaatgagtttacccttagcccagagggcctgcccagtcccagggtgacctgggcatttgcacaccctcactaagccttcactgcaggacccaagggagggaggctgggctagggtgccaggtgactccccaaggctgtcccccagggggtttatggtgtttgccgaaacacaaactttttcaaagaaacctgccaggtgtggtggctcatgcctataatcccagcactttgggaggccgaggcaggtggatcacctgaggtcaggagttcgagaccagcctggccaacatggcgaaaaccccatctctattaaaaatacaaaaattagctgggcatggtggtgcatgcctgtaatcccagttactcaggaggctgaggcaggagaatcacttgaacccaggaggcagaggttgcagtgaaccgaaatcgtgccactgcactccagcctgggtgacagagtgagactccatctcaaaaacaaacaaacaaacagaaaacaaaacaaaaaaaaccccatacacctctcttcatcctccctctaatcagaaccccccacacacacacaatcttgattatgaggagaactaaatagctagttcacaagttcatacattttacagttgaagtatcctcagaaaaaccacctattcaactcctgagtgttacagatggaaaaaaagaagttcgactagacagaggaacttgtctgagatcaccgtgagtcaaaaacacacgtgtctgttcaccaactgccttcgtcctgagccagatcctgcagcatccttccacctccaagaactcacagtttggaagggaggacaaataggtaactacaacatagttccagcctcccttccccctgaagaaagcttgctccaggcacagcggaagcacaggggtgtggataatgaatcaggagtgagtgggctgtcagggcttatgagttccacaggtgggacagagggctcagggcatgccaggccagatgggcagaggcggcactatcaacatggttatagctcccaccctatcacccgtgtgacgcccctccctcgaggaaaaagtgaccaatgatgcccaccctgtgtcaccagaggctctgggcctaaccctgtcaccccctcccaccttttcatttggagaactttcaggttcatctggagaactttcatctttcaggttcagttaggatggcacttctagaccgggcgcagtggctcatgcctgtaatcccaacaccttaggaggccgaggtgagcagatcacttgaggccaggagtttaagaccagcctggccaacatggcaaaactccgcctctactaaaaatacaaaatatttgccgggtgtggtggtgtgcgcctgtggtcccagctactcggggactgaggcatgagaatcgcttgaacctgggaggcggaggctgcagtgagttgagatagtgccattgcactccagaccaggcgatagaacaagattccacttcccaaaaaaaaaaaaaaaaagatggcacttctgagacaccttccctgctcctgcctccctccctgctctatgagccagggcacccgagccctcagtgtacttagaacaccccactgtgcgtgccaacccccatctccccgctcaatgcataatgccaggcacaggtgcaacccttactcaacacatgctggatgaataaccacaacacggacgcagcgctccacgtgcttcttctgatggctggagaccttcgaccgtaagcttctagcaaggagaggctagctcagtgctgaaaaaaaggtgggctctgaattggtgaataaacaaatgatgagtttgggacatatcagtagtccgttggacactggtggcttggagatggcggaagatgaggtggaggaagtcactgaggagggcctcagtgccccagggacagtagcatggaggatggttacgccagaggatggatcgacttctagccatgtggtggtcaggtatgcagacacctctcctgctgaaacaactacaactgccaaactgagtatcttacagaagctgctagagaagccacccacaagctggcaagaaaggaaggaatacacaggctgaagagcaaataaaagtacggggcccttttctgtggagaaatctggcaggcaccaccttaacacacgaccaaactgagctcaggcccctcagtgctgctgagatgaaccagcatcacgagtaggagactgaagcttaccgtgaggagacagcaggaagagtccagagagggcgtgccatgcaaccacggtctggactcaagatgatgagagaaaacaagggggtgggggaacatttctgataaaggagactgaagggatgacacaatcgaatacaacacacagtcctggactctgcattccaggctcaaaggctctaaaaaaggcatttatggggtatgtggagaaatgtaaggttctgtgttagctcattgctaaacttcctgagtgtcttaactgtactgtctgctcttaggaaaggcatgcttaaacgtttaggagtgaaacagcacgaggactatgactaactctcaagtgatcaatgggctaggggaaatacagtgccaatatggtaacatgtttaaaagaagggagatgacatcaatataatcagaagctatgccaactgacagtaatattttgaagcagtggtaggcaagctttttaacaattaaagagaatgccttcatattacacaaagacattaagaaaaaaagctgaaggctgggcacggaggctcacacctgtaatcccagcactttgggaggctgaggtgggcggatcacgaggtcagttcgaggccatcctgaccaacatggtgaaaccccctctctactaaaaataaaaaattagccaggtgtggtggcgcgcacaaagggaccggggcggtgctggcggcgatgccaacagacctcagtgtactgtggggttctttcagccagaactgttcatggtttcatcagtgagctccagttaccacaccacacaagtttggagtgatccaccccgccccagtttttcctgcacgaactcatgtttttattgtgtgatttacagaacacaagatctttttctaagaatgcacacatcacacgttgaagcagaaaggcctttacaaaatcttaaaatacctacaaaatatgaagtaaggctcttaagaaataaaatattcaatgattttgctgctagaatgcaaacattagatcaaatccttcatttgatctagcaaaggaaaattagagttgcaggaatcttgttttcaggccaaaccatgacatcctgaggggtctgatggcaggaactgcctgcattttcctcatgaatgtgacctgcagtgatcttgtgagaaaggcccggaaggccgtgcaaattacaggggtacaagcaacagctggcaggtgtggccagacaggcaactgcagttaaggaaagactactcaatccctgaggttttcagattttacaaaaaggcaaaaaagccaggtgaacaaggcagatgaaaggtatttttcacttgaattggaatccagccccctccctgtcccctggagtgagctccagagaaacttccagagccccagcaatatcccaacctttcgtaaattcactcatgctcgccactttcaggagatggcatttctcagcacctttcacttccagttatccctcggcacagcacaaagagctaaactaccactcgaggcagttaacctaagggcagggtggtggctacagctccaggtgaacagtctgggaccagaggaaataatgagcccccccttgtactggctgcttccaccctaaagtgtcatccagatggtgtttccaattctttctacttccagtattagctgcagaattacggaatcaaggaggcttctctgcatgaatcaataaaggctatagcactttgagacacaagctttggccctttaaaaatgtgagaaatcaaactggcacaggcagagtgtctcagtggtctccagggagcaagagagaatgaggttcagcttgaaggctacaagggtggagcctgaggttcagctgccctgctctgaattcgcagtccatttcttaatcctccacttttgagaagatgcgagaaaccagttatgttttgctaagcttaaataaaatgcagttcttgccaaccaaaagcagaaccctccccaaatacaggcaaccagtgccatacagcaaatctcatctttatagatgtgtaaaatgaaaaccgaaacacaagcccaccacatacaggttaaaaaattcctgctgtggagaacagtttggcagtttctcaaatgttaaacatggagttaccatatgacctggcaattttactcctagccatacactctcaaaaagccacaactatgccgggtgcggtggctcacgtctgtaatcccagcactttgggaggctgaggtgggtggatcacctgaggtcaggagtttgagaccagcctggccaatatggcgaaaccttgtctctactaaaaatacaaaaaaatttagccgggcatggtggtgagtgctacctgtagtcccagctactcaggagactgaggcaggagaattgcttgaacctgggaggtggaggttgcagtgagcagagatcgtgccactgtaatccagcctgggcgacagagcaagaccttgtctcaaaaaaccaaaacaaacaaacaaaaaaccaaaaccagtaaccaaacagatatccgtacaccagtgttcatggcagcacagtttacaacagccaaatggtgggggcaacccaaatatgcattcccaagggatgggtggataatcaaaacctcattatctataggatataatatcattcagcctcaaaaaggaaagaaattctgacacatgctacaatgcagatgaaccttgaggacattacgctcagtgaaagaggccagacacaaaaggccaaatagtgcataattccatttataggaaatgtccagaataggcaaatccatagagacaggaagtggatgagttgttgccaggggctgcgggtaataagaggtgactgctcctgtgtctggggtttcttttgggtgctgaaagtgttctggaatgacacagaggcgatggttgcacaactctgtgaatgtactaaaagacactgaattgcacattttatttttaaacaattttttctgtgagcctatgaattatactgaagaatgaattgtacactttaaatgagtaaatttcatggtatgtgaattatatctaaattaaaaaaaacaacaacattaaaacagcagctgaccaccaattattctaaatcataaagataggttttgtgatgcctggccagtgctcagagcccacacagctgtctcagagcaagtctatctggctgtggcacagagccccggcagatagatgggctgtccgtctgaggaagaggccaatgtggggacctatagtgatacatgacagactggaccaagccaacctgaatgtgaaactctgaagcccaggacacaataaccatgacaatcagaaaggaatttagttcaagaagtttaatgagtaggcatttagccaagtggaaggttgttggctattctgaggacatttgatcttttttttttaattgtggtaaaatacacataacataaaatttatcattaatagcatttagtacattcacaatgtcatgcgaccatcactactctctagttccaaagacaaccctttacccattaagcagttgctccccactcccactcctctcagcccctggtaaccactaatctatttgtctccacaaatctgcctactgttgacacttcatataagtggaataataccctcccctggaaagcctgtcttttaaaaaatgattttcatttaaaaaagtttttttgcttaacacagtggctcatacctgtaatcttaggaaggcagaggcaggaggattgcttgggcccaggagttcgagatctgcctgggcaacatagtgagatcccgttattcacaaaaagggggaaaaaagaccaggaaaaaaaaaaatcccaaaactaaacaacgaaaaagttttttttagggagatagggtctcgctgtgctgcccaggctgggctcaagcgatcctcctgcctcaggctctcaagtagctgggactacagatgagctaccacgcccaacttagaaacatgtatttttttcagattagctcatcattccctggtaacttctccaatgatttccccttgcatctctgccactatattctagcagggttctcacactgatcctacacacaagtggttagagactcaccaggccaagctcacctccaattccaaatacctagtcctcaaggtccaagtggcctgtttccatagacactgacactgtgcatgacttttctgtcctcagctgctggctttctccatttcttgttgataatgtttttttcttacctttacatacttcatgtaaataagtttcacagacttttaacaaagtgttggctgcttttatcaaagaagagaaaatctgccaaaataaattttcaccatgaaggcaacacattttggggaacaagaaagggcagaaaggagatctcttttactagagaactctgcttaaggactggctcatttgatccaaacatctcatcagtaacttggagtgagtgcccttgttttcgtcatcttgcgtctcactagtgtaggtcagtccacatcagcctgcctgacgtacttggttcgtaatgctgacatctgagcccccatgtttatttcaccctgattctactgaaatgaccaacgaaatgcaaaacaggaggaaatatctctatcaatgccttcagaggaaccgctgtagaatgtggtgtggctgggatccatgcgagagaagcagctctcacacgattccaccacagttaaacacatgggcaaaggagggacctgccggaggtatgaggattccgtagcagagcccaagaaaatctgcaagatcagagaaactgggcctaagagccagactggcagaagtacggtttgccggtggcaaatagaaggacctgaaccaccagtgccctaggtggagaggtcagtgacaggctggccaggttttcctgggcactgctgggacagagagagacaccaatatagaggagattctacctgtctcaagaatctgccagcagcaccctgggtccccaccctgactccagctgctgccacaggggaagcagcagggactgaagctccaccccataaacaactctagggactggggatcaaacaagtaccaacaaattagtaactgtcctgtgtacaaatacaaattaggtggaaactataatgattgaacaccagtcattccagtcaagatcccaactggaggccgggcgcgatggctcaagcctgtaatcccagcactctgggaggctgaggcgggcagaacacgaggtcaggagttcgagaccagcctggccaacacagtgaaaccctgtctctactaaaaatacaaaaaaattttagcctggtgtggtggtgcgcgcctgtagtcccagctacttgggaggctgaggcaggagaatcgcttgaacccaggaggcggaggttacagtgagccgagattgtgccactgcactccagcctgggcaacacagcaagactctcgtctcaaaaaaagaaaaaagatctcaactggattttctttggaatctgacatttacctagaataggcatctgaggacagccagaaggagtgtgtgtgtgtgtgtgtgtgtgtgtgtgtgtgtgtgtgtgtgtgtgcagggggggggatggcttccttctggtagccactgctctagggagtatttctcaccatcatgtcacaaagcacacaacaggagcactctcacatggattagggaattagatgcagacctcctgcacaactgccctcttccagtcctagtaagataagacacaaaagaaaggcagggaaggagagtgtgaagggaagatttcagcacacaaaggaaaggggtgtaattcaaagcagtctgagaaaagactccagaggacaaagcagcagcaaagccaggctcctgccccgtcccccagaaaccaccctagggagcgggcaacgccctgggaatttgcagtcagtaagctggagagaagcaaccaagtgggagtccttcactttttccttttagacccagaaactccagctgggaggtgcaggagaaatggcaaagtgcccagtgagccagcccagctctgtgggaagcaactgctcttaggtatacacagattatggaaccacccagagactgaggtgccccctatccccatggaaatggcacacacatccctcgtgcagctagagtgagccttagtaagacatccaacacagttcttagaacaaagagaagaatccagatagggctgaagactacatggctgcagctccctccagcgtgcaaattctctccggatacaagataacaagcctgcacgcgatagctcagaggggaaaacagcaagagaagatgccaagaaactgggaagagagagccaagaattcctccactgtctcaaagcaaacagaacgactatgcagagccatccaagcctgagccaagacgaaaagaagtgacatggtaactaggcaaacatattatggccagaagaaaaaaaagaggcccagggagggagatggcacgagaaaggcaaagtctcccaccaagaagagaatacacaaggaagggaaaaaaattccccacaacttcataagaacatgttcccaataaaagagttcaaagatgggatgataaaacagaataagatgaaaagacaaatttccaacctagagaaacaaactgcagaccaaaacacatcattatgaaactaataaatacattgaaaaacagccagaaacagaatatacatagctgaaaatcaaattagacaaagtgaatgcagatgaaaaagacaaaagctaaaccaattacggcaaagctaatagcattggaagagagacaaagacaatccaacatgaggaatttgtgtccctgaagtacagaactcaacaaatggaacagaagatgctgtcaaagatccataagagagctgacctgaaacagcaacgactacatctgcagactgaaagaatacaccatgttcccaggacaatttgataaagaatgctcaatagcaagccagactctagtcaacctactcaacttcaaggataaagaaagcattcttcaggcaccttgggattcttccaagggggaaacatcagaagaccagacagaatgtctacaaagttctgaggcagcttagcgcagtggtggtgggggagaggtcagaggtaaattcagagagatggacaggggccaaaagcctctctgagaagacgaaatctgaacacagatctgaaggaagtgagtggtgagggagcaggtcaagtaaagaggggtccagccaatgaggagcagcaagagccaaggctctgactctagcaacattatggcaagttccaggaagagcaagagcagtgggagccaggtgagcaagggagagaatggtagagaatgagctcaaataggcaaggagggatcatgttccatgtggctgctgaggcaggcccagttacacaatttgtggagcctggtgcaaaatgaaaatgcagggcctcttgttcaaaaattaagaattttgagatggtgagagtagagtattaaaccaagcctgggttccagcaagcccatgggcagttacaaaggcccatgaagctggctctgctttcaagtaatggacttcgggttttattctgagagggtttttctcaagggagtaacctgatctaataaacatttttcaaagagcccatctgaggctgggcacactggtacacgcctgtaatcctgcattttgggaggccaaggcgggaggattgcttgagcctgggagttcgagaccagcccgggcaacatagggagaccccagtctctacaaaaaatataaaaattagccaggtgtggtggtgcatacctgtagtctcagctacttgggaggctgaggtgggaggactgcttgagcccaggaggttgaggctgcagtgagtcgtgactgtgccattgcattccagcctgggtgacaaagggagaccttatctcaaaaaaaaaaaaaaaaagcccattctaactatgggaagatatagagtagagggagtggggcaggagggcacaagatgccacaggggggctctgcagaagcagatgttgggtcacggtttgaggtgtaagatgttcatcaggaactgacatccataaagggaggtgggaagaagtcaaagagaaggccctataagggccttgtacccttacctcgctcagtcaccagggtgctgtcctggaaatggcgtgaccttgggtgaggaggctcttgcagctgaggctaaccggagtgtccgcagggcatccagagaggagagtgacctccgggtctgccacgtgagactactgcagagtctaggcagggatgcagggagctggtctaggtgccatccctgaagggcatgggcaccgggacagcgaaagggcgagagatccaggactctggcttccgtttctcatgtttttgatactgaggtatttagctttctagaggcctaaagggcagctggatgtatgaatctggagttcaggggagaggtctgaagagccaggcgagtgcgtgagggcgtgctgaatataagtgtaaacaaccctccccctgctatttggagttgtgatgaggagaaagaatcagcagaggagacagagaaagaggagtcagtgcagagaaggaagatcagacatatctgtcaagattattggtggcaatcaatagaaaccaactctagctgatttatgcagacaaggactgatgaaaagctattgaagatgcatgtggtgatggttgcacaatataaatgtgctcaataccacagaattgtacacttaaaaatggttaaggcagtacattttatcttttgtgtattttactgcaatttttaaaactagggggaaaaggctactgggtgataagagaatccctagagggttggaggaacaggtttgagtccagttggctaggaacaatacttcaaatccttctgccaagccagtccaaacagccagcactgcctgtgcgaccctgcaaggcagcagcactggccactggcactgtggcctaggagctcgtctttcctgcagccccaatgccaggagacacggctctcctgcctggccctgctcctcctagcatgtgagtctgactggcagaggccagggtacatacctacaccctcgtgtagaactcaggtaatttctttctgtaaggggccagatagtattttccaccttgtgggccagacagtatctgtcacaaccagcccacctgctgttgtacaggagagcagtcttggacaatgcacaaaggacggggtggaactgggtcctggtaaagcttcatttacgaaaacaggcagtgggccggacttggcccttgagataccgtttgccaactgctgccctgaccgaaagggaagctaggcaaataagcatctggcatttgcagtgactacaatcagaggtcgccaggcctcccatcaactcgtgaggtgagaattctcccaaacccagagggttcaagatgtgaggtgagatggccacctggagagtatgaggtaccagaagagacacaaggaaagggctgagaaggagtgacagccactgatgactgttaagattatttcatggaatgtggaaaagcaagtgttcatggagcaagctgagcaaggagcagcaggcaaggaagagggcccatgagtggagagaactcttagagagtttggctaaaaggagaaacagagactgagcaggagccaaggaggtatgcgctgaagggagctcagttacgatggtaaattctaaaacaagttcgtctggtgatgggcacagttcacaagaggagggaagaccaatggagtcccaggggcatcaaacagtggttgacactgcaagctgggaagacagtaagtcctcatcataggcagagctaagttagaactccgtgggtggagttccagagatgaccaactccaggatacgaccatgggaatgagtggcagaagagacagggaaggagccaggcactaggagggcggcctacatgcgtgtgtgtgctggagtcaggaactggcacggaatcctcaataagaggactgactggggcagtgagcaagcccacaatcaggggtctgtgggccgagaggctgtgtcacagtccccctatgccatgcctggaggcacatgggatcagagacctctgaggacttggcaggaggcacaggcgtggagaggcagggcctaacccaggtgtgtgtgtcgcgggggggaggggggcggtggttaggcagggctctttggggaagagatacctgacagggtcttcaaggataagcacgacaaggcaaggccacaggggaaggaaaggagaagagaaggggacttgggcaggggagccaatgacaaaggccaggagtgcaagaaacatggtacctgggaggaactacaagcagtcctggactgctgagggctatgtccataagaaaagcagcagcaacagaaggggccacaaagagaagcaggagccacatgaggggccctgatgtcactcaaacacagggtgccactcttgggtttaaagcaggggaatgagattgatgatagggattgtgtggaagatagagaggtggaggaaagatcataagttatcatgggagtcccagagcaagatgagggattgaaccaggacagcggtagaagggatgacagaagacaaaagagggacaaacagttaaaggaacaatttgtgggacttggtggctcccttggatgtgggcagtgaagggcaggggcctgttgggtttccagcttgggtgactggtatggctatcaactgtgacagaaaacagtggacatggcatttgtctatttggtcttctgatctaccttatcttgaaggagacaggggtggtagggcgcccagtgggttgagaagaatggaagggagaaagagggcagaaatctctcaaatgttttgcacagtaaaatctgactaaaatgcacacacgccccacaagcctttttctttttttttccccccaagaagcaaaacaagttttatttccatagtagttccttttagtgctctctgtcgccacctaatggatggcctggtggaagaggctcaagaggtagcagcctagcctattccacggcagaggaatcaaactcacccaggcagggagaacgggactgcacctgggtgggggaggaccaaaagaagcccagctgcttctggaagatcattgggagtctcttctggaagaccaggggctcttggagctaaaatagacgttcgttcattaataatacctacttcaacaacttaagatcatgttcagcggatgcacatcaaccttgacttgtctgtgctccccaaatcaatatgcctcaatattgaggcatattgagggaacaatctgtagatattcatgaaattgtctggtgggacaaaaattgtggggcacttgagcctagctgaactcagttttaagttctagcatttaacacaccacctctaagtttacgtgtactttatgagtgcaggaatgcaacaaaaaaatctagtgtaaagtcctggccctcagggcaaagcaagggaactacaactcttgctgcgaactgccttcctcccacagatgtggcacattcacaaatcacattcattgaacaagaaatggaacaagtgccacaccagaggtgacaagaagaggggaccatacaataataggtaacttccctgtcacacgagactgcttggagacaaggatacagagcccagcataggagatgggacaaaatgatgagggtcaaggaccacacctggtttaactcccagtgaagagttttagccagtaaagagctgcaagaaggaaatcacacaccacgaagaggccactaagataaacgcttgaatctgattaagttttcacctgaaaagtgtgggtaaggacaagcctgccttgttgggtagtacagattcagtgaatgagccctcagatcctgctggatcccgtgatcagataaacagcagcttctcaggaaccactgcatgtgaggttagggtgaggggagggacccgatggagatctaatcccaggggtttggtcacaggggctggcgaatgagaggtggagaccgggaacatacgccactttttttttttttttttttttttttgagacggggtctcactgtgtcacccaggctggagtgcagtggcaccatcttggctcactgcaacctccgccccccaggttcaagcgattctcctgcctcagccacccaagtagctgggattacaggcgcctgccactgcgcctggctagtttttctatttttagtagagacggggtttcaccatctcggccaggctggttttgaactcctgacctcgtgatccacccacctcggcctcccacagtgcggggattacaggcgtgagccactgcgcccggccagccactctttttttttgagatggagtttcgctcttgttggccgggctggaatgcaatggcacgatctcggctcactgcaccctccatctcccaggttcaagtgattctcctggctcagcctcccaagtagctgggattacaggcatgcgccaccacgcccagctaattttgtatttttagtagggacgggatttctccatgttggtcaggctggtcttgaactcctgacctcaggtgatccacctgccttggcctcccaaagtgctgggattacaggcatgagccaccaggcccagcctaagccactcttttggaaagctcagcagagaagatgcatgaggtaatacgacgcgttaggtggcctttaaagggatgtttatagcttttcataacatgggtgtattagtctgctcaagctataacaaaatagtacagactggggggcctattcaactgaaatttctcacagttctggaggctagaagtccaagatcaaggtgtcagcacattcagcccctggtgagggctctctttctgacttggagatggctgccttctcattgcatactcacatggtggagaaagcaagctctctgctgtctcttgttataaggacactaatctcatcatgcgaaacccaccctccctcctgatttcatctaaacctaaccacctctcaaataccccatctccaaataacatcacattggaggtttgagcttcaacactggaattttgggggacacaaacattcagtccataacagtgctgatgtttatgttttaatgttaaatgataacagcacagcacagcagcacacacactgtgtgatgccaatctgtttgtttgtttgtttgtttgtttttttagataggttctcactctgttgcctgggctatagcagtagtgtgatcacacctcactgcaacctcgacctccaggttcaagcaatcctcccacctcagcctctcaaagtgctgggattccaggcatgagccaccatgcctggcctccaatttgtatttaatgccactgaactgtacatttaaaaatggtaaattttaggtgatgtgtattttactacaatttttttaaaagtctaagagaaggcaagaaaggagaaggaaaatttaaaagaacagaaaatatggaaaaatagaatgcacaaatatgctataaatgaatctaaatacatcagaaatcaaatagatgttaaaggacgaaacagacaatggattttttaaaaaatctcgaggccgggtgcggtggctcacgcctgtaatcccagcactttgggaggctgaggcgggcggatcacgaggtcaggagatcgagaccatcctggctgacacggtgaaaccccgtctctactaaaaatacaaaaaaaaaaaaaaaaaaaaaatcagccacgcgtggtggcgggcacctgtagtcccagctactctggaggctgaagcaggagaatggcatgaacccggggggcggagcttgcagtgagccgagatcgcgccaccgcactccagcctgggcgacagagcaagactccgtctcaaaaaaaaaaaaaaaaaaaaaatctagctatcagctgggcatggtggctcacgtctgtaattccaacactttgggaggctgaggcgggtgatcagctgaggtgaggagtttgagaccagcctggccaacatggtgaaaccacatctctactaaaaatacaaaattagccgggtgtggtggcacgtgcctgtagtcccagctactcaggaggctgcggcaggagaattgttttgaacctgggaggtggaggttgcagtgagccgagatcacgccattgcactccagcctgggcaacaagagcaaaactccgtctcaaaaaaaaaaaatctagctatctgacattttcaaaagctccacctcactgatgcataaagacacagaaaggaggaaaataaaaaactgggatggccgggcgtggtggctcacacctgtaatcccaacacttttagaggccaaggctggtgaactgcttgagcccaggagtttgagaccagtctgggcaacatggcaaaaccctgtctctactaaaaatacaaaaacttagccaggcgcgctggtgcaagcctgtaatcccagctactcaggaggctgaggtgggaggaccacttgagcccaggaggcggaggttgcagtgagctgagattgcaccactgcactccagactgggtgacagagggagaccctgtctcaaaaaaaaaaaaaagaaagaaaaataaataaaataaataataatttaaaaaaaaataacatattagtatggtcgcttcataataccaaagggttcaatacaccaggaatgtgaaactgtatctaaaactgaaaatgtggcctcaaaataaataataaaatgaaaatgaccaaactctgtggagaaactgatgtgtccatcaccacagtaggttttaacacgtattccatcagttgataaatcaagtaaacaaaatgacagtaagaagagaaaatactttcacaacaaacggataagacagaggtaatgaatatatgtagaatcctgcacccatgcttggtggtgacatattctgtccactggttgtggataatgtgtcatggagcacttctcaaccaactgcaagaactggtgtcacacagaccaagttctttgatcacagtgccatttagttagaagttgattttttctttttttcttttttttttttgagacggagtattgctcttgttgcccaggctggagtacactggcacaatcttggctcactgtgaccactgcctcccggttcaagtgattctcctgcctcagcctcccgagtagctggaactacaggtgtgtgccaccatgcccggctaattttgtatttttagtagagacgaggttttggcatgttggccaggctggtctcgaactcctgacctcaggtgatctgcccgcctcggcctcccaaagtgctgggattacaggcatgagccacctcatgcagtcaatttttttttctagagcaactaggaaaaaaaaaaaacaaacccaaagccatgtgcttggaaattgaaaaacacattttaaaataatatgtgagtcaaaggaagaaacaaagaaaatttaaaatatctttgggctaacttaaagtgacaatactatcagaacttgctagatacagttgaagtagttccagagggttagccttaaatgtttacatttgaaaaaagggtagaaaaatcaatgaaccaaatttataacttaagaagttagggccaggcgtggtggctcatgcctgtaatcccagcactttgggaggccaaggcgggtggagcacctggcgtcagcagttcgagacccgcctggtcaacatgccaaaaccccatctctactaaaaatacaaaaaatttgccgggtgtggggcaaatgcctgtaaatctcagctactcgggaggttgaggcacgagaatcacttgaacccaggaggtggaggttgcagtgagctgagattgcactactgcactccagcctgggcgacagagcaagactctctctctcaaaacaaaaaacaaacaacaacaacaacaacaacaaaacacagagaatgtactctaagaccatagaaaaaataataaagataaaagcaaaagcagaatttaatgaactagaaaagagacacagagtaatacagggcaataatgcctacatgtctgcttcttgtaagaccaatgaacctaatgagcttttaccaagacaaggaaaaacgggagaaggtacaagtaaacaacaaacactaggaatgaaaaagcagacataattacagatgttgcaaatgtataaactataacatgaacaactttatgctagtcagacaaaatggacaaattcctagaaaaaaaaatttaacagcttacagtagcccaagcaggtgcagggaaaataaaaataggtttagatgtgtctgcgtgtacatagaacacctcaaaagacacagacaagaccctggatgcagccgttccctgaagagaggcctaggcagctgggagaccagggcagcagggacactcagaccttgcatcactctggagtttgcacttcctgaattgtgaagcatgcacatgtctcacttatgcaacagtgaatccaaacgtgcctgtatacaaggaaaggcctcacctggctgcgccgtggaggctggcctggcgtgtggagcaggcagaacattagcaagctaccgagcaggtgcaggtatgaacatcagctgacgctggctctttgctttctttttaatcttgacaaatttggtaggtgaaaaggcatcatttttgttctcgtttgcatctctttgattaccagcaggcagaactcttttcctatcttcattggccatctgtatctcttcttttatgaatttcctgttcatagtctttgttcattagtggtgactagtggtaagttagcaataagaactgtttgcattcaagtctagactgagaaggaaattaaaaaatctgcccatgtattctcacaataaatgactactgactagcctgagataattgtacccactgcccagtcacaggcattaagcctaggatgattcatttcagacttgtccctgaccttcctcataccctttccagaagggccccttgagctgctatgatactcctaaatcactatcccattacccaaatgatggagagccaatcaaaagcttagaccaggacgctttcccaaattatgtcccaataccttcacaatgatcactttatatacaatctcactgaatgctcagcaacacacgagagcaatgtttaactgagggcaacactgaggctcaaggagggcaagtgacttgattgctgaggtcacctgctaggtgcaagagctgagaattaatcccaaggctacctggctcaaaaagcctaagctcatctactatacttgaggcgaaatcatgaaagtgtgtttttaccttgcccagaccctgcacactgcatcaaggtcctgagtttcaagcaacagaaatcaactctggttaaattcaatcacaaaggagttcttgggcagcagatctggaaatggagagagaactagagaactaggctcagaaaagcagcaggaatagaggctgcaccactgcaaacacagccaaggttatactgcagggacctgctggttgggacacccaccctgggcactgttgcatgtcatcactggacattagccaccactgctggttttgtgactcaactgccaccaccatgactaatccctcactgtccctcaagagtcaaagtccctgaaggcagaatgggtttggccaaacctaggcttcatcgccatcccctagtttccagagagcaaggggagggaatatatccattcccctgtggcaggcactgccagttgtcccccaacatccatgttctccatctgccttactaatgagaccctgcgctcagctaaggagagttattccccgcttcccagcagaccatgggactacgttatggctaaggagacagtggccgagtgcactcctgttcatcgttctctttcaagcttgctcttgttctactgactatgggcggagcacacctcccacccactgactctgggcttgctcacgtgttgatgggatgggggaagaagaggctttaagaggcttctgtgactctgctcactcctcttggactcctgacctccgcctacgaagagacttcccctggcagctgcttctccctcctgggtcctggaacgacaggcttgagaacagatctgaatcccatcttgcagctgacccagacccatgtgtgagaaataataattgctgttatagctactgagctgctggtgctgtttgttccctaggacaagatgatgggtgtgaagatggaaatggaaatattgaatgggcctagaagttaagatgtcaagtgccattttgcctttcccctatgacctctttcttcctacctggaggagtggatgcaatgactagagcagcaaccgtcatctcacaaccaagaggcaatcttgagaaatggaagacacccactgaggggccctgggtcctggatccttacaaagccactgcagtggtcatggacagcatgagaaggaagtacaccacaggcccccaaccccatcttcaggttttcttaggtagaaactagggtccacctgcctcttactaagatatacacaatggggagacttttaacacaaaaaaaggtatgaagatggtcagaagccaaaaaagcaacaaaatgttcatgatatgccgtatgtggggtttactcactacactgcttttccaccgagttagcataatcactataactcaacccattgaaaaaatgacaaaacagattctgagattctcttcctatttctgttagctaaaaaagcagcctttgaattgtttataagtgaattcaagagataaaaataaacccagataattcagaatgtactgagtacaacacatatgccttctatgtgataagctcccagcattatttattcaaagaaaacttgccttgttgcaaaaatataaaaaaacttaaaaaaaaaaaacaagtaattacacaacacaccacctcctacaacaccagattccttttctttcctttgtaacctgaccagaagaaaaacaaaacattgttcaaattgctgagacccacaaagttcaattagagcataaaaaatgctctcccaaaatatagctactagcagggaaatgagcaggctaagcctcctggtgaacctggacattgggcacaagtaacaggcacatttagacaccaacgaccagattccacatgactgaatccagaaaccctgccccttcccattcccttggagatccagggggacgccatcaattgctcactccttctccttacacatacagttaggggtgctatactatacaggggaaggcgtgaggaagtcacacatgctttggtgttcaagaagctcataaagccattagggaaagagcaacatgccagaaagcagttgtctcttctggctacagaggttgcaaaagacgtctgcaagggtcagtgagggcccaaaggagtagtaaccaaggccctgaagcctgcctgggagctgaggtgggcagtatcagcctcttctcaataatcagttcctaaggttccatccgagaaagtagaaaaccacagaggccattctcatgggtactttaagcagtacatctgttggcaaaacacaaatgttgttacacaaatactaagccacagattgcaaaggcacctgacagcctttaaaattcatttctcttgtttcgcaaagctgcactgggaaactgtgctgttaaattctacactcataaaggaggtatgttttaaaagaggggcaaatatgtgggtgctatttagactctcattgatttgttccatgttttcagataactacacacccctccgcccccgccaaagtaactcaatctccacatatttgcctttatatgtaccttctaactcatgactatggctttgattatctcataaacaatattgttcctgttagccatggagaagctaaggagccaacagcagagcaggctgcatgttcttctgtccctcttataagacaaaaccttagagcaatgtcccactgcagaatttatttgttaattcactcaataaattaaaatatgcatgattctaggcactggggatatattgaggaagaggcaaaaaaaaaaatctctgtcctcatgggactcagattctataggggtggggagagggagggaggggaagggagtgggagagcacaaacaaaaccaagcagtaacacagcttgtggcagatggtgacaagtcctatgctaggcagggggaactggtggggcagaggcaggctgcctgacttacagacatgggtgtgctcggggaaggccacattgggaaggtgacacttgagcagacatgtgtgatacctgggacagagggcagaggagaggtcaaggccttgaggcaggggcatacttggagggtccagggaggagccaggaggccagtgaggccgcagtgcatgagtggtgggagagtggcaagagaggtgatcctgttgggctgtgactctgagcaagcagggacccactggagggttctgaacagaagagcacaatattgcaggactaaacaaagaaccagggggcaagggcagaggcagggaagctggacacctggaccagggtgggggccatggaggcaggggaactcatgagattttgtatccatcttgcaggtggagtaacagtatttgtgaacaaatgaggtaaccagcgccaggtttctggcctgaggagcaggagttggagttgctgtttactggaaaggagaagaccagggaaagagaaggtctagggaggataaggagttcccgtgacccagtcagcctggagacataaatttgggagccatgaggctggacggaatcacttcgggagtgagggtggagaagaaaagcctgaacctgaggccttccaacatcacatgcgaaacagaaaagaccgaggaggacagacattcacacactcacctaggacttcctgaggacccacagacaccaggcactgttctaggagcttgagctacatctgtgaatcaaggagacaatcctgtcctgtggagcttctgctccagcaggggtgacagctaagataagcacagtcagtcatgtattcagctagaaagagacaaaagctgtggtttgcactgagaaggtgcacatcagtgcagagactcaagggagggaaaggattgtctcgtatgggtattggggttaactgacgacgacagctctgggaaaagaagtgacaagcagctcccagatttaacaacatgaaggtcatcactggagacctcatggagcagcttggcagagctgtggcagcaaaggaacaactggagaaggttgaagagggtgtggagacagggactggagtcttgctggtaaaggaaaacagagatgctagacaggtggggggttgggagcagcttttgtcaaggtgggagaagtagcaacaagtttctagggcaggcgagggaggaatctctgatgggggagagtgcagtagaggactggagagatgccttagaacaggagtgagggcctgggacaggcgctccgtgacagcatgagggaggcagagcgaaggagtagacgctggcctgtagacactctcttgagcttgcttctgtgctctctgggaactaagatatcagctgcaaggaggtgtgacagctgatgaggagggtgggaggggctaggagagaccggggaactgcagtatgcaggtgggcttggcggcaagaagtttacctggggtagacatgaacttaaagggggaatcaatgaaggagtcacattcagcttcaggacggagcaggcatggggcagacatgactgaatttcatgaggctggggctttgtcgactgaatataacaaagcaagaaagtgccgaagggctgaggtagtgtgccagggagtaacgacgtctgactggcactgaagctacaaaggagaggaataaggatacgaaggaggtgaagtctgagaaaagatggagccactgatggattctaagtgcctgtgaggtcaaaggagtattggagttgggtattagaggcagtgaaaaggaaaaggatctccttttgcagatcacaaaaaagataaaatgaccagagctaaacaacttttacagcactatccactgtaaaagttgtttgagaaaaaataaaatgtagccagccttcagagcatatatgcatctttattttattttatttattgagaccaagtctcactctgtcgcccaggctggagtgcagtggcacagtctcaattcactgcaacctccgcctctggggttcaagcgattctcctgcctcagcctcctgagtagctgtgattacaggcacccgccaccacacccggctaatttttatacttttagtagagacggtgtttcaccatgttggccaggctggtcttgaacccctgacctcaggtgatctgcccgccttggcctcccaaagtgctgggattacaggtgtgagccaccacacccagcccagagcatatgcatctttaaaaagttgtcttcggccaggcacggtggctcacacctgtaatcccggcactttgggaggcagaggcaggcggatcacctgaggtcaggagtttgagaccagtctgactagcatggtgaaaccccgtctctactaaaataaaaaaaattagccaggcgtggtggtgcatgcctgtaatcctggctacttgggaggctgaggcaggagaatcgcttgaacccgggaatgcggaggttgcagtgagccgagatcacaccattgcactccagcctgggcaacaagagtgaaactccgtctcaaacaaaacaaacaaacaaaaagttgtcttcaagagcataatcaaagatactttcacttcttaatgttttgtttccatgtctcgtcacagaacatggtacagacaaatattagaatagactcaagggatcacttgattttaactacagaaactttccggtgaatcatgagcactgtcttgtttccagctgctgaagtatatgggcaccagacaagagcacagcgctgtcactcaaagccaggagtaatatggctgttaccatgaggactacttagcagaagataagcatctcattatgtctacagtgaactaaactattgttgccaatggtatatggattaggaccgactgccactgcccatctgcttatagcttagaatctggtgaatgcaaacaactgttttggggggacttctggcccttccttgggctctgctatcctggaaatggacaggcttctacaggggttcgatggtagccccgaatagttaggtgtatgtcttaacccccagaccctgtggctctgaccttatttggaaggtctttgcttctgtaattaagtgaaggatcttgatatgagatcatcctggatttagggtgggcctaatacagtgacaagcatccagagaagaatacggggacacagagaaggccatgtgaagacacaagcagagaatggagcaatgcaactgcaagccaaggaaagtctaggactgccaggcagccaccaaaagctggaagaggcaaggaaggatccatgctagaggctctggggggaatggagccctgcaacatcttgatttcagacccctggcttcctgcactgtgcaagaatacagttaggggtactttattctgactactccataaacttaagctctaattctcgctcagcttctgagctttaacaaagggtccgtgcaacttctaccgttcccgttccccgtctttaccaaagaggaagcatttactcaaagcccacctcctgcaacagctctagatgccgcttcccccctccacacaaggagtctgctcctccaggtccccatttcctccttctcacgctcccctctctcctgggccattcccagaaggatgtaaacatgctctcatattcacccacgtgaaaaacaccctcatccccctctaccccactcctatttttctggtcaccatcacaacaaaacttcttaaagagagttgtctatacccaatctccactccctcaccttccactcactccaatctggcttctgtccccatcacctctaattcagttcaccatgtgacaggtagggtttttgctagttttagacataatggatcttgttattcctgggctttaaagccttcaccagaggatggccaactgcctacatgtaattgccacttgacccttcaaacctcaaagaaaccgaagtacagacatatgaaagggaagaaatttctaacagaggcaatagcaggagaggacctctgaacggataagatacactcagcaaatttctagatgctggaagtaggcaagaacatgttgactaatggaacagagaggaatgtactacaagagagctgtagagcagatgagagcctgtatacctgtcagagccccaaagaagctctcagaccagaccagaccagaccagaccagaccagacgagaggaggggcaagcagtgctgtcatgtgtgcaacacctgggggctgctgactgccagatcccgacccacaagctttggggcagggcaccttcaataagctcccaggtgaggctgatgctgttggggctggtgagcagagcaaacttggagtggcaaggtgccacttcttccctcaggcaagaaatcaatgggtcttttctaaatcaacagctagaaccttcccttccccggcccccaccccacccaccccaaaggctcttgatgtggctggcagcagcccaggtgatgcctaccttttcccagtctctgagggtccatggggcaagagctgacccctgcctcgcctccacagaacttctccaaaccacccttcagagacagaccccgcaggcaacgggccactccaccacagcagagaaggggcagcgcagcagctacccaggtcctccccccatccctggcggctcaagaaccagccccatggaagagagaccaagtctgtccttagaggaaacaaataatattctcagagaaatcttagaatacagaatagtcataaaatcagaacagaaacacccataaacaagaaataaacagatgataaaagaaaagtatcaggcagggcatggtggctcatctctggtgacaccacaccaggcgtggtggcccagcactttggggggcagaggtgggaggatcacttgagcccaggagttcaagaccagcctagacaacacagacacacaccagcccatgtctacaaaaaatttaaaaattagccaggcatagtggcacgtgcttgtagtcctagctacgcaggaggctgaggcaggaagaccacttgagcccaggagttcgagtctgcagtgagctatgtatgatggcaccactgcactccagcctaggtgacacagtgagactctgtctcaaaaaaaaaaaaaaaagtatccattaaaatattttcaccctttaaaaatcaggttgtctttttattaccgagttataggaattcttctgaatacaaatcctttgtcagatatgactttctattttttctatgactggtctcaactgttttcttggtggacttgtcttttcattttctttgagacagggtctcactcagtcacccaggctggggtgcggtggcgcgacctcagctcactgcagccttgacctccttgggatcaagcaatcctcctgcctctgcttcccgagtagctgggactatggactacgggtgcacgccaccatggttggctaattttttgtatcttttgtagagatgggatttcactgttgcccaggctggtcttgaactcctgagctcaagcaatccatctgccttgtactcccaaagtgctgggattacaagcatgagccacagctctcagcctattttcttttgttttttctttttctttttttttttaagagacactgtctcactatattgcctatgttggcctagaactcctgggctcaagtgatcctcctgcctcagcctctcaagtacccagtagtgactacaggcaagcctcaccacgcccagctctgtcttttcattttcttaatggtatcttttgaggaccaaaagttttaaattttaatgaagtccaatttattttttcttttaatagctattgcttcatgtatcctaataaatctttttttggcctggcacggtggctcatacctgtaatcccagcactttgggaggccgaggcaggcagatcacttgaggtcaggagtttgagaccagcctggccaacatggcaaaaccctgcctctactaaaaatacaaaaattagccaggcatggtggcgcacacctgtaatcccagctacttggaaggctgaggcatgggaatcgcttgaactcgggaggcagaggttgcagtgagctgagatcgcaccactgcactccagcctgggcaacagagtgaaattgtgtttaaaaaaaaccttattctttggactgcacagatattctcctatgttttcttgcagaagctttatatttttagcttttaaaacatttaggtctataatctctcatgaattaatttttatgtatggtgtgaagtagtgtcatgggttggactatgtcccccaaaaaagatatgttgaagtcctaaccctcagtacctcacactgagaccttagttggaaacagcgttgttgcaggtgtaattagttaaggtgaggtcacactggagtagggcaggccccaatccaatattactgttgttcttacaagaaggaggccatgtaaagacagagacatacatggagaatgctgtgtgatgaggaagacagatattgaagtaatgcagctgcaaatcaaagaatgccaaaggttgccaaccactggaagctaggaagaggcaaggaaggactcccctacaggtttcacagagaccatggccctgatgacagttgattttggacttctagactctggaattatgagacagcaaatttctgtggttttgttttgagacggagtctcactctgtcacccaggctggagtgcagtggtgcaatcttggctcagtgcaacctcccaggttcatgcaattctcctgcctcagcctcctggctagctgggattatatgtgtgcaccactacacctgactaagttttttgtatttttagtagagacaaagtttcaccacgttggccaggctagtcttgcactcctgacctcaggtgatctgcccgactcggcctcccaaaggccgggattacaggcgtcagccaccgcacccagccaaatttctgtggttttaagccacctagtttgtggcaactctaagaaactaatatttagggtaaggtcaaggttcatttttgtctggtatggatgtcatttgccatcatccggcacgtgctaaaagactttcctttcccgcaccggactgttctggtgcctctgttaaaaatcaaatgactataaagtcacatcacataagccccttaattttgttctctttcaagtttactttggatgttctaggtcctttgcatttccatatacgttttatttatttatttatttgaggcaaagtctcactctgttgcccaggcgggcgtgcagtggcatgatcttggctcactgcaacctccacctccgggttcaagtgattctcatgcctcagcctcccaagtagctgggattacaggtgtgtgccaccatgtctggctaatttttgtattttttgtagagacggggtttcgtcatgttagccaggctggtctcaaattcctgacctcaagtcatctgtctgcctcagcctcccaaagtgctggtttacaggcataagccaccgtgcccagcttccatatacattttacaatcaatttctacaaaaaaaaccctgcagttatgactggggttatgaatctacagttcaatgaagggagaactgacactgtaaagacacttagtctttcagctgatgaacatggtacaacattccatttatttaggtctttaatttctttcagcaacattttcagtttcagcgtgtaaatcttgtacatttcttattaaattattcctaacgatattgcatttgaaatttcatttctgattagtttttgaatgatctcgtaccctgagaccttgctgaattcactttttagttctagcaggttctgatagtttctttcacattttcgacattacctacaaatagaaacagttttacttcctttaaatattaatgcctcttatgttttttcttgcctcattatactggctatgacctctagtataatgttgaatagaagtggttagagtggacatctttgcctttttcctgattttcggggtaacatgttcaatatttcacaattaagtacaatctatctgtagctctttcatacatgcacttcctctatttctaatctgctgaatttttatcatgaaagggcactgaattttgtcagatgcgttttctgtatttattgaatagactatatggtttttctcctttattatcttttttttttttttttttttttttggatactgggtctcactgttgcccaggctagaatgcattggcgtgatctcagcttactgcaacctccgcctcttggtttcaaggattcacctgcctcagcctcccgaatagctgggactaaaggtgcgtgccaccctgcccggctaatttttctatttttagtagagacaggatttcactatgttggccaggctgctctcaaactcctggcctcaagtgatctgtccacctcggcttctgaaagtgctgggattacaggtgtgagccaccgcacccggcctcctttattatcttaatgtggtgaattacaccaactgatttttgaatgttgaagcacactcgtgtttctgcgaaaagcctcttggttgtaatatgcaggcgcacctcatttgattgtgctttgctttactgtacttcgcagatactgagtttttaacaaattgaaggtgtgtggcaaccctgcatcaagcaagtttaccagtgccatttttccaatagcatgtgcttacttcatgtctctgtcacattttggtaattttcacaatgtttcaaatttctcattattatatttgttatggtgatctgtgatcaatgctctctgatgttactactatcatcattttgcggcaccacaaactgcacccataaaagatggcaaacttggccgggcggggtggctcacgcctgtaatcccagcactttgggaggctgagccgggcagatcacctgaggtcaggagttggagaccagcctggccaacatggtgaaaccccgtctctactaaaaatacaaaaaacaagctgggcgtgctggcacatgcctgtagtcccagctactcgggaggctgaggcaggagaatcgcttgaatccaggaggcagagactgcagtgagccgagattgcatcactgcactccagcctgggtgatggagtgagactccatctcaaaaaataaaaaaaataaaaaaggtggcaaacttggccaggcggcagtggcttacgcctgtaatccccgcactttgggaggccaaggcgggtggatcacttgaggtcaggaattcgagaccagcctggccaacatggcaaaccctgtctctactaaaaaatataaaaattagctgggtatggtggcgcacgcttgtaataccagctactcgggaggttgaggcaggagaattgcttgagcccaggaggcagaggttgcagtgaactgagatcatgccactgcatgccagcctgggtgacagagcaagactgtctcaaaaaaaaaaaagaaaaagaaaaagaaaagatggcaaaacttaagtgataaatgtgtatattctgactactccaccaatcagctgttcccccatctctctctctctccttgggcctccctattcccttggacaagacagtactgaaattaggccaattaataaccctacaatggcctctaagcattcaagtaaaaggaagagtcatatgtctttctctttaaaccaaaaaccaaatgatcaggcttagtgagaggcatgttgaaagccgagaagccaaaagctaggcctcttgtaccaaagttagccaagttgtgaatcaaagttcttgaaggaaactaaaagtgctactccagtgaacacacaaatgatatgaaagtgaaatagccttattactaataaacgttaaggaagttttaatggtctggataaaagatcaaatcaaacacaacatttccttaaggcaaagcctaatctagtgcaaggccctaactctcttcaattctatgaaggctgagagaggtgaggaagctgcaaagtgtattgtttaatttttaaatatttggggctttctctggatcttccattatttcttttttttccccccactcactctgttgtccgggtaggagtacagtggcacaaccacagctcactgcagcttcaaactcttaggttcaagcagtccctccacctcagcttcctgagtagctgggactacaggcgagcgccgccatgcccagctatttatcgtaatattggtattataattttgtaattttatgtctattacaagataaagcaaataagtaactatgttaacattagtaagacccaacattttcagtgtaaggaaaagatatatacagatcaaataaaagttggccaggcatggtggctcacacctgtaatcccagcactttgggaaatcgagatgggaggatcacttgaggccaggagttcgagaccagcctgggcaacgcaacgagaccccccatctctacaaaaaatttttaaaaattagctgggcatggtgatatgcacctgtagtcttagctactcgggaggctgagggaggaggattgtttgaagcctaggcatttgaagctgcagtgaattaggattgtaccactgcaccactccagcctgggcaatagagcaagaccctgcctcaaaaaaaagaaaaaaaaaaaaaaaagttaaggaagaaccctgtaatgttaaattgccatagaagacatcattatgtatttatgacttaaaaaaaaaatggagggcacagtggctcacatctgtaatcccagcactttggtttttttatttttcttttgtgaaaatatttaccagcagtttgccctgacagatgtaatcccagcactttgggaggctgaggtgggaggatcgcttgagctcagttcgaaaccagcttgggcaacatagtgagaccttgtctctacaaaaaaattaaaaataaaaaataaaaactgaatatattttctagcgatgtcctctgaaagtgcctagatataatgttaccccagtaagaatcagcacatttagtacccacatgttggattctaaataccgttgccactataaggaaccagagctccttggaatcagttctaggacacgaaaagcacatattgggatggaatatcttgtgccagaaaacaagaaattgctcaaagactaattaatgagggtatgccaggagaatataggaaccaacatgaagggactcttgttgacccaatttgaattgtaaaacatttaataaataaatccctatgagtccatattgacatgaaagagaaaaggaaacacaacagcaaatattttgccaccatttgaggtgattattctaccaactccttactctgaaatgtaataaaggcaaagattaagcatctatactgtctttttaggaggaaatataatgcctccttatttgatgagggaaaattcattacagaggaatgacagtactaaatgtagaagaggtgacaattaaaaaaactatcattttgcaacccccaatgtaataatggtttcaggcaaggatcaatgaatgctaaaataattatgcaaatggctgttgggcaataggatatttgtatggtgccaaagcatcacatcacagattatatatcaattaccacaggaaaactgtatgtctacaatggggagatttggcagtcacctccttctttaatcaagtgttaaaacgtagcatcacaaaccacagggtaaccaaccattaagtgcctggtgagctgatgctatatgaagtacacagtactgcctatgaaatattcttgcccaaaatgtttaacctgaacatgcctgtagacctaacttcttgtctacaagtaatatatatggacaaacaagttaaattatatcacaagaaaagagagacatctaaaatgtgggccagctagtcgtggtggcacaagcctgtagtcccagctacctgggaggctgaggcaggaggattacttgaggccaggagttcaaggccagcctaggcaacatagtgacacgccatctctaaaaatatgtatcttaaaatgtgggcccttctagatgacaattgggctgactgcttcaaaaagtcagtatcacaagtgaaggagaggtgggtaggctgttcttgttaaaagagacaaaggggctgggcatggtggctcacgcctataatcctagaactttgggaggccgaggcgggcagatcacttgaggtcaggagttcaaaaccagcctggccaacatggtttagtagaaaccctgtctctactaaaaatacaaaaaagttagctgggcgtggtggtgcgtacctgtaatcccagctatttgggaggctgaggcaggagaatcgcttgaacctggaaggcggaggttgcagtgagctgagatcacaccactgcactccagcctgggagacagcgagactctgtctcaaaataaaataaataaataaataagagacaaaggaagcatattcaaatgcaatgtataaatcttaattgctttggagcccctcaacagcgataagagacatttggaggaaatctgaatttaaagtgggtgcctgataacattagagaattattgttaacttttaaagatgtgatcggggtattgtgcttatattggaaaatgtccttatttttaggagatgtatactgaagtacttaggggtgaaatgtcgtgacatctgtgagttccttttaaatggtgagcaaaaaggtataaaaatgcaccctatctatacagaccaggaaaatacgccaaaatgttaacaattgtctaatctaggcagtaggcacacaggcttcacagtaagttaaaaaaaaaaaaaaaaaggtttggctgaaataaagaatttaacagaagggatagaaaataaagtcaggaggctgggtgcggtggctcacaccactttgggaggctgaggcgggcggatcacttgaggtcaggagttcgagaccagcctggcaacatggtgaaaccccatctctattaaaaatacaaaaattagccgggcgtggtggtgcaggtctgtaatcccagctacgtgggaggcagaggcagaattgcttgaacctggaaggcagaggttgcagtgagccgagatcaggctactgcactccagcctgggtgacagagcaagactctgcctcaaaaaaaaagaaaaaaggaaaaagaaaataaatgcaggagatcttccaaaattcagagcaccccccaccgcccaataaatgaaaaatatgagagaagacagaagaccaatataagaggtccaaagttaaacagtagtccccatagagaaaatgaaagcatgtaaattagtaatttttttttaaaaaaaagagttgacaaaagtattcagattgaatgaccacagtacaacgagtgaacaagacacaactctagacatattctcatgagatttcaggacactaaaaataaggagacgaaatcctaaaaacttccagggaaggaagagaaaagaagggcacctacaaaagaaccataataagattggcatcaggcatttgttgcatttgttactctgcatactagaagagatgcctccaaagttaggagaaaaaatgattttcaacttggaaccctatactcagccaatcaagtgtaagagtagaagaaaggtatttcaggcatgcagtgactcagaagacctatctgttacaatgcttttggttacaagtaacagaaaagaaaactgaagctggctcattcagtaagaaagtccatcctatctgagtccctagctcaggtaggacaggccccagccacagtgcaatcaccagctaagcaacggcatcaagacccaggttcttcccgtttctctgctccgccttccttggtgagcaggctttatcctcaggctttgtccctcagtctgaggttacagaagagcccccagcaacacctttctcacttactccagtgagagaaaaagagaaagtcttccctgaacgtgccatggaagtccttcccttcagtctgagtgaaccaacttagatcgtatgtccatccttgaccagtaacagttgccaaaggaatgcaatgtgtggaatgacttaaggatcctttctgaagttgggaataaggtagaaaggtgaataatatcaggattctgttaggaatgggcaaagaagaaatggatatggggtaggtgacaacggtatccactacagtttactccccatgcactctatctgagcacattatttaaggatgcagtccagaaaacgagggagtaaaccatgtgaaaggaagatatgggttttaagacacgggctccaacccaagagcccagtgaggagaaggtccaggtacagctgtatatgcaaccttaaatcaaagagcagatacttgcccagattgcagaagggcagaggccttccaagagaaaggtcttcagtggggaaaaagccgaatcgtacgaaataaacagcactgctaatagcattttacaacataatcaaggaggaatagtaaacaaaataaaaaggcaactagaaatggtgggcaaaacaaagagctatataagcaagccaaggtttgaatatgaagtagattaaatcctagcaaggattttaagcaggtgacagagtctaagaaaagggaatccatttgaccttgattggtcattctcctttgagtggtccagatctgtaaagaaggaaatgtaatcctgggcacattcattatttggtctcgccaagaacaatactcacatgtgtaataatgtaaataatgttattttcgactttagaattaagctacaacttggctgtggttgcagggcagaacacacatgttaacaaatgcaagaatgggtatggtcaagtacagcttttaagacgcagaagttaaggagggaaagtggaaggaaaagtagggttattaatatccttatcttaaaaagaggggaactgacatatggactaaaatactgtttaaaatttacagagaaatgtgggcttggcatggtagctcacacctgtaatcccagcactttgggaggccaaggcaggcagatcacctgaggtcaggagtttaagaccagcctggccaacatggtgaaaccccgcctctactaaaaatacaaaaattagcccagtgcactggtgtgcgcctgtagtcccagctactcaggaggctgaggcacgagaattgcttgaacccgggaggcagaggtttcagtgagccgagatcacatcactgcactccagcctgggcgacagagtgagactccatctcaaaaaaaaaattacagagaaatgtgaatatgaatttcaacatggggaggtaacgtaagctaagtcattctctttcatttcagggagttaacacagttccctaaagttggcaaatcaagaaagatgtataagcatatgatttaattttggaggtaaccatcaaaggaactaaaatcagaaacagttaaaagctgtcatgtctgagtcagggaagggaaggggaaggggtagactgctgtttttacgatgacctcttttgttatatctaacttgttgccgagtagttgcaatattttgataaaaattcaaaacccaaaccaccttacccttcatgttttctatcgctctgatgttaacattcaaaatcctgcatgatccagcccctgttgacctctctgatggcccggaccctttgccactctcccctaacccctcgttcagctcctgccacacaggactaagctcttgccagactgagggccttcacacatgctcttctccatctggaaagcctttttcctctctgcaccttgcccacttctgttcaaccctcggttccctgcatcggcgttgcctccttggggaaggcaggctgagctgttcccccattgtacagtcatgagtcgctcaacaacagggatatgttctgagaaatgtgtcattgggcgatttatttgtgctaacatcagagagtgttcttacacaaatctagatggtgtagcatactacacacctaggctatacggtatatagcctattgctcctgggctataaaactgtacagcatggtactatactgaatactgtagatcactggaacacaatggtaagtatttgtatatctaaacatagaaaaggtacagtaaaaatatggcattctaatcttatgggaacaccactgtatgtgtgctctgttgtcggttgaaacgttgttgtgcagcacgtgactgtagaggactggagtggctcccacctccatacttgtccttctgaacacttaagtactggtacaattatctaagatctgtctctgccgctaaagtcaagctccatgaggacaggtaccaaatctgtctaggttaccccatccctgcctaacacagggcctgaggtactatagataccttacttactcaattgtggaatgaattgatggactatagcctgatgtactgcaaatccttcagcatgcagcaggaatggaacttggtgtttaaactaaactataatggctagatgaaaaagagactaaatgtgaaataattccatcattcagaattgagtgttggtataacaaacagacccatgaaatatgtagcgtttcacaaggatatcagtgaggaagttgttcaatatgtcatccgaagtcccgttgcataatgatacttgcacacgcatgcttatagcagcacaattcacaattacaaaaatatagaaccagcccaaatgcccatcaatcagaaagtgaatagagaaattgtggcatatatatacaaaggaatactactcagccataaaaaggaatgacttaatggcattcacagcaacctggatggaactagagactattattctaagtgaagtaactcaggaatggaaaaccaaacaccgtatgttctcactcataagtgggagctaagctatgaggatgcaaaggcatcagaatgatacaatggactttggggacttgagggaaagggtgggagggggtgagggataaaagactacaaattgggttcagtgtacactgctcgggtgatgggtgcaccaaaatctcagaaatcaccattaaagaacttactcatgtcaccaaataccacctgttcccctaaaatctatgggaataaaaaattaagaaaataaataaaattttaaaaggaaggtcatccctacacttcaagttataaaataattctaccgtaaaaaaaaaaaaaacacacacacacacaacaacaacaaagtcctgttgcgtacctctgagaggtgttttgtggcttggactagcatactggcagtgcagatgctgagaagtggttggcctaacaggacttgctgacagatcagggatgatgagagaaagagcagaatcagggcgggtgcagtggctcacgcctgtaatcccagcactttgggaggctgaggtgggcggatcacaaggtcaggagttcaggaccagcctggccaacatggtgaaaccccatctctactaaaaatacaaaaaattagccaggcccagctactcaggaggttggggcagaagaattgcttgaacccgggaggcggaggttgcagtgagccaagattgcaccactgcactccagcctggatgacgagaatgagactccgtatcaaaaaaaaaaaagaggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagatcgcgccactgcagtccgcagtccggcctgggcgacagagcgagactccgtctcaaaaaaaaaaaaaaaaagaaagagcagaatcaaggatgactcctagaattttggactgagtaactgggtggatgttgatattgtttactgaaatagagacaacatgaggaataggtttgaagggggaaaaaaatcaagactgggacttgttaaatttgagacacttatgagcaactcaagtaaatgctgacgaggccatcaaatctggagctcaagagagaggtttgaaatgcagaaacagggttgtagccatcagcaggcagacatatcatcattcagagtcatgaacatgcagaaataatggaaatgcctcttaattaaatgaaggcatagacatacaacgaaatgttatgtgattactaaaaatgatggtagaaaaacattatccagaagttatctttatctgtagatgacagatttatggacaatttttacttttcatctttgcatattttctgaaaattttttgtccattgaacatgtattacttttataataagaaaatgcaggctgggcacagtggctcacgactgtaatcccagcactttgggaggccaaggcaggaagatcacttgaggccagcagtttgaggccagcctgggcaacatagtgaaatcccatttctgcaaaaaatattttaaaaattagccaggcgtcgtgacatgtgcctgtagtcttagctatcttggaggctgaggtaggtggaatacttgaaactggaggtggaggctgtagtgagctgtgacatcactgcactccagcctgagcaacagagcaagagcctgtctcaaaacaaaaacaaaaacaaaaaagaaaatgcaagttaagttattttcattttagggaaaagtgaagatatacgtctatttttatggacatggatatttacaacattttgttgaggaaaggtagcaagttacaaaagtacatatatgatctcattcatctaaaacaatatgtgggccaggcacagaggtgcacacttgtaatcccggcactttgggaggccgaggcggaaggatcgtttgagcaaaggagtttgagaccagtctgggcaacatggtgaaactccgtctctacaaaaaaaatacaaaaattagctgggcatggtagcggacacctgtagtcccacctacttgggaggctgattgggaggatcacttgcacccaagaggtcgaagctgtagtgagctgtgattgcaccactgtgctccagcttgggcgacagaccttgtctcaaaacaacaacaacatgtgtacgtgcttacaggcaaataagaaagactctagaaggatgtttaaaatgccaacagcaggcccagcgtggtggctcatgcctgtaatcctagcactttgggaggccgaggtgggcagatcacaaggtcaagagatgaagaccatcctggccaacatggcgaaaccctatctctactaaaaatacaaaaattagctgggcatggtggcgcgcacctgtagtcccagctagtcaggaggctgaggcgggagaatcgcttgaaccagggaggcagaggttgcagtgagctgagatcgcaccactgcactccagcctggcgacagtgtgactctgtctcaaaataaataaataaataaataaataagtaagtaataaaataaaatgccaacagcaaaagtaacttttaggctattatgcaccaacaaatttatgtgatatcgagaagtgttaaacagttttagttgcattacactttgcataatatacacaaaacactaaacatgttaataaatgtttgatataataagatgacctaagtttaagtgtaattttgactccttttactgtacctgtgttttcccccactaactgactagtcaagtgctgactggtttttaagagatggggtcttgctctgttgcccaggctggcctcaaactcctgggctcaagtgattttcccacctcagcctcccaagtaggtggaactacaggtgtgcatcaccatacccggcttaacgtctgtttttatatttgtagccacatggtacaaagtacagaacaggtgttcttaacctttttctgccatggacccttttggccttctggacccctcctcagaagaatgttttgaaatgtgtaaaatgcacagaaattaacaacatatttcaagagttcgttctcaaataatatgtgcttcttcagtaaatcattaaataaccagatctagagatgggtctaataattaccttaagtttgaagcagtgatggacatatatatttcaaaatatctgtaacaactataatatgatatgaaagtatctttgatctctactggtgacagtcactgctattctaatactaccatgatctgttgcttacaattgtcattgaagaaaatgtggatttttttttttttttttgagacagagtctcgctctgtcgcccaggctggagtgcaatggtgtgatcttggctcactgcaacctctaccttccgggttcaagtgattctcctgcctcagcctccggagtagctgggattacaggcgcccaccaccatgcccggctgatttttgtatttttagtagagacaggatttcaccatgttggtcaggctggtctcaaactcctgacctcaggtgatctgcctgcctcagcctctcaaagtgctgggattacaggcatgagccaccacacccggctggattttttttttttttaaaagacagggtcttgctatgttgcccaggctggtctcaaactcctgggctcaagtgatctgccctccacgggcttccaaagcactgggattacaggcacgagccaccatgcccagctaaaaatctgggttttcagagacattagtgaaaataaagagtgaatgtttttcccatccaaggtcacagacccggctgaattctcaaccaaagttggaggccttggtctagaaagatacataccaaatattaacagcagttttttttttttttggatagtggaatcgccagagtgattctattttgttttatgatatttttgtagagatagggtctcaatatgttgctcaggctggtcttgaactcctgggctcaaaagatcctcccaccttggcctcccaaagtgctgggattacaggcgtgagccatggcatgcctggcctaattttttatctttgtacctatacgcattttcaaagttttgtacaatgatgttttacaattaaaatttataagagcttaataaatactatgtatttgtttgtcttaaacaacctggaaggatgactaggaaattttatacaactgactacagatgttcaaccttctataactacttaagtgttatgatgactctaatcattcccatgttcttacaagccaagaaaaaaactcactagaattatttattctggagttaaaaagaacaaaaaaacaaactgtcacaactgcagacatttgtctatttttttgccaagtgtaattccaaaaacagctgaaaatattagaacaaattagtacttaatatggactaataccttctgctgtttacaaaaacacaaaacccggaagtacacagaaacttgtattttaaaaataagttattgtgtgtagaaagacttaaaatacaacttatctaagtaatgccaaaacttacataccaccagacaaagtgctttaatgctttatttttatttttttgagacagagtctcgctctgtcacctaggctagagtgcagtggctcgatctctgctcactgcaacctccacctcctgggttcaagcaattctcctgcctcagcctcccgagtagctgggattacaggcgcccgccaccatgcccggctaatttttgtatttttagtggagatggggtttcactatattggctaggctggtcttgaactcctgacctcaagtgatctacccgcctcggccttctaaagtgctaggaatataggcgtgagccaccacacccggccgaaaatgctttaatgttttaaaaaatgagtcatacatagaaagtaagcacatgcttgaaagtgctcatgttcaagttttagcagcaatgtggaatgttgcaaaagagacagggacacagggaaatgtgcatatctcagaagcctactttgctttctttcaaatctaaaaataaaacctttggactgccctattaataagtctagaaaatggatgcttttttttgtggaaagctttcgcaaacatggaaataaaaatatcttcttctcggttaacaggactaaaggatgtaaacataaaccagatgccaatccttgtttctctacaatccccttctccctcatggctctggacaggcttctattgtaaaactatttctatggcacaaggagacatatcaaatgaatgaacattggtctgcacggagcaatacagaccaggttcaaaagtcaaatgttgagtgaaaagagtaagttgtaggatgttccacatagtaggatatcatccagtaaatttgcaaaacactttattccatgttgtcatgtgtaatacaacaaaaaccttgcatggggagtatctcggtgacctttagggagcaggctaccttggggaagcagggcagacaaagagtgcaaccacagggctgggaattcagctgaatctgtcctatttgagttccatagtaagagggctgacaggaatacgaccaactgataacatttcctaagtctgggtgaaaagtacccaaacagctactacttgagctgagcgtagaagccaggaaggaagagggcgggggaagacaggaccttagaatgacgccaggaagaatggtggaagagctgacagcatggaggaagagctgggaacagcgcttagggcccacctcctgagcccaggcttggggagttacagcagtgctgtccacaggggctcatcagagtggacctggtacttgacaagacaggagtcagcttgctcacacactgcttcctttaccatcaaagtcttatgtaaaaataaaaaataaaaaatcagtagaactaagcagcgtactttgtaccacagctgactcccattccatgtaagctcctgaccttctcacagcccagcactttcgtgcattagacaatgaactgtgctggagaagatgatgcctgttcccatgagtctcccaggtctcctgggacagaagtgaagggaaagaagggtccatgaagagacctggagtggagtgggagccccaggggcccagtggatagggtggggtggaaaaggacagcatagatgggcagagcacctcacgctgccttctggggcccagggaacatctaagagtgtgacggggcctggaaagaaagccgagcctggccgggcgtgggggctctcacctgtaatcccagcactctgggaggccgagacgggtggatcacctaaggtcaggagtttgaggccaacatggtgaaactccgtctctactaaaaatacaaaaattaaccgggcatggtggcgggtgcctgtaatcctagctgcttgggaggctaaggcagaagaattgcttgaaccctggaagtgggggttgcagtgagccgagatcatgccattgcactccagcctgggtgacagagaaagacgtctcaaaaaaaaaaaaaaaaaaaaaagaaagaaaaaagaaaaaaagaaaaatgctcctctccacatgtcctggctggttgttcatgcctcgtcttcacacagtggactctctgaatgggcctgagagattctctcctgtcagagcctctacacatgctggtccttccaaaagactcatgcatctctccccactgatgctttgtccttgacctagctaatgtttccttgctgttcaggtcttagatgccatttttcaaagaagtctcctccctgacctacctcccaattcttggtaggatctcctctgatttttatgtgctcccttagtggctggaacttctctccatcacagaagttagcctcttgtaaagtcatagcccatttgcctgtctgtacctcccattagaccagaagactgctgagggtaggatagtttccagcagctagcacagtaactgacacataataaatgctcaattagtacagcttaaaaaagtactgctatataaagagttcaacagtcacagaacaacaaagcaaccacagcctgttcctgaatacttctaggacacctcttatgcatattacagcatgaggaggcagaaggtccagcagcagagggagattctccaaccccgagtaccaaggaactaccacaacctagaatggtcccaaaataaaaatgctccactttcttcaaggttcacaaacaagaactggcaagttccccttgtcgagtaaaaaggtccttccctcacatgccctactcagatgaggtcacttttgatgaaatggaagtttccaaagttttgctttctagtgctaactgctaaaaacttcttcctagcctaacagctctgtgatctctacaaacagtattgcagtgataaattcgtatgcttatctacttacacgcaactttttctctaatggtctgcaaataaaaggctactcttgtcgggctccatggctcatggttgtaatctcggcactttgggaggccaaggcaggaggattactcaagcccaaggagttcaagaccagcctgggcaacacagtgaaaccccgtgtctaccaaaaataaaaataaaaataaaaataaaaaatttagccaggcatggcggcacatccctgtagtcccagctacaagagagcctgaggtgggaggatcacatcagccccggagttcaaggctgcagtaagctatgatcatgctgttgcactccagtctgggtgatggagtgggatcctgtctctaaaaaaacattaaaaaaaataagtaaaaaatttaaaaactggttaaataaattgtggtacatccataacagactatttaaacccaacccttaaaaggaatgatacggctctgtatgaaccgattctaaataatctacaggatacattaaaataaacaaatgtgcacaatattttatagtatgtgtaaaaacacaacgcccacatacccttgtgtatttatacacacatgtaaaatatatacacaaacctaaacacacaaaaatatgtccaatagagacaaagagtagaatagtagttgccagagggtggggtgggggaaaggggagaagtgggagttagtgtttaataggtatgaaatttcagttttgcaagacgaaaggttgtagagatggatggtagtaatggctgtacaacaatgtgaatgtactcagtgccactgaactgtacagttaagatgattaaaactgtaaattgttatatatatcgatatatattttttgagacggagtctcggtctgtcgcccaggctggagtgcagtgacgcgatctcggctcactgcaagctccgcctcctgggttcacgccattctcctgcctcaggctctcagagtagctgggactacaggcgcccgccaccatgcccggctaattttttgtatttttagtaaagacgaggtttcaccgtgctcgccaggatggtctcgatctcctgacctcgtgatcagcctgcctcggcctcccaaagtgctgggattacaggcgtgagccaccacgcccagcctgttatatatattttataataaaaatttaacacacgggtacacacacgcttttttttttgagatggagtctcattctgttgccaggctggagtgcagcggcgtgatctcagttcactgcaacctctgcctcccaggttcaagcgattctcctgcctcagcctcccgagtagctgggactacaggtgcccgccaccatgcccggctaattttttgtatttttagtagagatggggttttaccatgttggccaagatggtctcgatctcttgacctcatgatccacccacctccacctcccaaagtgctaggattacaggcgtgagccaccgtgcccggccacaatttttttttttttttaaagaaacaggtaatagtggctgcctccagggaaagaaatgaatgtttggggcagggtagcagagatactttacaatataactcttttttttttttttttgagacggagttccgctcttgtcgtccaggctggagtgcaacggcatgatcttggctcactgcaacctctgcctcccaggttcaggcgattctcctgcctcagcttcccaagtagctgggactacaggcacgcaccaccacgcttggctaatttttgtatttttagtggagacggagtttcaccatgttggccaggctagtctcgaattcctgacctcaagtgatcaagctgcctcagcctcccaaactgctgggattacaggcatgagccaccatgcccagccccatataacttttttctattattatttttctgagatggagtctcactctgtcgcccaggctggagtgcaatggcacgatcttggctcactgcaacctctgcctcctgggttcaaacgattcttctgcctcagcctcccgagtagctggattacaggtgcataccaccaagcccagctaatttttgtatttttagtagaaatgatgtttcgtcatgttggctaggctggtctcgaactcctgacctcaggtgatccacccacctcggcctcccaaagtactgggattgcaggcgtgagtcactgtgcccagccccgtataactttttacaccacctttttaattccgtattgtccatctaactattcaaaaaatcatttaaaaaaccccggccttatacaagaagtcttttccttaatcgtgtcatttattctatccctcttcctttaagtaaaaaatattttcaatcaaaatcagaattcgacttcagctttgagggtatttattagattcaaataatgcaatttataaaaattacacttgctaccctaaaaatatattcactaaaagccttttctttttttcttttttctttttttttttttttaaagagacagtgtcttactctaaagaacgaggctgcccaggctagagtacaggagtacagtggtgtgatgatggctcactgtagcctaaaactcctgggctcatgggatcctctcacctcatcctcccgagtagctgggactacaggcatgagccaccatgcctggcccctctatttttatcaggtgttacagaaaagcttcaaaatcatcatggaagaaaattatcatttttaccagtacaaaacttttattgcatcccaaccaagctaagatgaatacagaattgtttcaacagaagttaccattatcataattcaagacaaaaatcagccggcaattacatgagttggaaaacaaactactcttatgtcacagtctaccctaaagctccaacttatgtcagaatttaaaatacacacacatatacacaaccctgtggattcctcctcatttatgtaaaacctacttttgtgatgatctgctattttcttgagtcttctggaatgaacactgtagccccactcccggataaggagaagataccacttccagggcttagcactgcccctggcttgaagcagatactcaaatatttgttgggtgaatgaatgattgtctgctgatagggctgcccatcaagcctcataaagaaaaaattcagaaaaaagcaactttatagagaaaataggaaaaagtttaagagatattttgctcacttgaagaaatcagcatttgttaaaggtgaagactggattgactggttcatcaagtggcttagacacaactgactaagtgggctataccttatcccaccccaaagttaaatacaaaacaggtatttttttttttaatcacaggaaaaacacagggcaacttaactataaaattattatttttattttttatttttgagacagagcctcactctatcgcccaggcaggagtgcagtggcgtgatcttggctcaccgaaacttctgcctcctgggttcaagcgattctcctgcctcagtcaccccagtagttgagattacaggtgcccgccaccacgcctggctaatttttgtatttttagtagagacgggatttcaccatcttggccaggctggtcttgaactcttgacctcaggtgatccacccgcctcagcctcccaaagtgctgggattacaggcatgagccaccgcatctggcccttttgtatgtattaaatacgtatgtatgaatataatacatcatcaggttttttaggaagaaaatatagatgactattgatctgttgttaagagtaggaaaggatttcctggcggggcgcggtggctcacgcctgtaatcccagcactttgggaggcagagacgggcggatcacaaggtcaggagatcgagaccagcctggctaacatggtgaaaccctgtctctactaaaaatacaaaaaaattagccaggcgtggtggcgggcgcctgtagtcccagctactcgggaggctgaggcaggagaatggaatgaacccgggagatggagcttgcagtgagccaagatcacgccattgcactccaacctgggcgacagagcgagactccgtctcaaaaaaaaaaaaaaaaaaaaaaaaaaagagtaaaaaaggatttcctaagtatgaaagcaaaagaataaatcataacataaattttatatatcagaaagacaagaatcaagacgtaagacaaaacaggaaaatatctgcatgacaaagagttaacatctttaatacattaagagctatgacaatgattattgaggtttagcctcagtaataatccaagcggcaccaatttaaaagatgtatatccaattctgggacgatatgggaaaatggcactttctcagactgttgtgggaactgggatagccattttggacagtgatgtggtggtatccaccagaaattccaagtctaggcagccattcttcaaaatgactggcacatgaggaatttcaatcctgtagcatttttaataacatagagagacaacgaaatgcatgacggtaagtcagccctggactacactgctatttaaaagaaatgaggcagagatgaatatatgagatggaaaaatgcagaatatgtatatataacaccatcctgaggccaggcacggtggctcacgcctgtaatcccagcactttgggaggccaaggcaggtggatcgcctgaggtcaggagttcgacaccagcctggccaacatggtgaaacccatctctactaaaaatacaaaaattagctgggtgtggtggcaggcgcctgtaatcccagctactcaggaggctgaggcaggagaatcacttgaacccaggaggtggaggttgcagtgagccaagattgtgccactgtactccagcctggatgacagagcaagactccatctcaaaaaaagaaaaaacaaaacaaaacaaaaaccctcctgttaattacaacacaaaaagtacacagtttagtcttagaagacttagaaggatctacattaagctattaacagcagttattctgggtagtgggagcagagattaagcggggagctttcatttttttacctgatacttttttttttttttttttttgagaccgagtctcactctgtcacccaggcaggagtgcagtggtgtgatcttggctcactgcaacctccgcctcccaggttcaagtgattctcctgcctcagccttccgagtagctgggactacacgctcaagccaccatggccagctaatttttgtatttttaatagagatggggtttcgccgtgttagccaggctggtctcgaactcctgacttcaggtgatccacccgcctaggcctcccaaagcgctgtgattacaggcatgagccaccttgcccagccacctgatcaatttttaagtggtttgatttttctataaatccatgtattattttagtaattctttaaaaagtaaaagaagaaaaatagatatcaagcatttatctactaaagacgggtactgtcctttgagaattccctcaaaagttctttgaagctcaaatggctacatctttcccattcataagatactttttaaatttcctctttctacatttctttttaaaagtttattttcaattagcttcctcaggttgaactctctgtacatttcttaggagaaactgtatggtgtcaacactgcctgttttataacatccattcgtaatctgtaatctgagaaaaagactcgtaaaaacccaaaccaccctccaggcctaacatcttccagaagaaacccattcactgcccatattacatttagtccacacaatttctgagacaaagcacaaagcactagccatacaactcccaccagcataaatacgtggagtacaaagaatgtcctgtcagctgggcccagagcacaccccacagcagtaaaagagaatgacaatttgagtcacaggatcaggagcagaatcaaatttgggacttgaggcagtgtgatgctcttctggtcttccgcttccttccacaccttctattctccttcagccaaaccttgccctcacataatccctaagcaggctatttcttatggatgtctacaacagcttcacactgaggtgtcagaaaccactagagagacaacaaagaacgacttagggtctcagtcggaatcacaatggccgcataagtgaaaactcacatttttgcttaggggaaaaaaaatgggaaaattcaattggaacattctgctttaccacacagaagttctgaaatccacatgtcaaaacatcaaatgcggagtgaccactaatcaaaaagacaaaacaaaacaacaacaacaacaacaacaacaaacagcttgagatgttgagcctgaaggttgagaaattaaggaaccattcatttttacaaaactaaagtccacacaatggtgccaagtagttcaaactgcagctgatacagcacctgagtgtcagacctagaatgactggggcccccaggtttttacaaagtactcatcctcctctagagtcccaagaaccagatgtatatctgggtactctctttagttaccatgggaggagtgtagcaagcacatgacattagccatggcccccggtgttctgagacagctttcaggagggtgtccttctagggaaccaaccacataccagttcccatatctgaaaatgcattaccactgctcactaatgttgaccactaagccatttaccccaaaccaaagcaaacacatgctgaagaccgctaaggcaacagcagcagcgcaaaagggctcagtgcaagcgctctcagctcagctgacctgcttcaaggtgaactgaagttgcagatcaccagttccggctctaatctgacgcccgcccccagatcacgctgtggcgaccaagtaaccctacacacactgacctttcagggctcagggaagtgacttttttttattatatggcacagtttggcacagttatgtctttagtctttggggtacttttatactgtccaagagtagtatatttttttcctcttttccttttttttttttttttaaaaaaaaaaaaaacagatggccaaaccaggacatatactaaaaaaaaaaaaaggaaggttacttacctgagccctaacatcccagctaccatggaatcctgttggagctggtctacagaagcaaggtgtattctggggagtcacatgtcacatcaaagcaggaactggtgagtctgtatttttatggagcctaaaacaaagaaaattgtaagttgaaagcccccattgagctgcacgacctttttcccagggctatttgggacattttgaagataaacacatagacaaagtactaggctatttcccagcttacctagctagaaacaaaggataagctgcaaattactggcacgtaacacacagtgctaaaataaaggaaagattcatgcttgttagaatcaacactatcacaagccttgtcacctctaggggacacttcgacactacaaaagcataccatgagtggcgatttctggcaagtatttcttctaccacggcacacagaaattctcagggaagaatacatgttcaagagaatacgcaacatcaaaataccatccctgaaagaacacatggaacctagaggcagtctcccttctttttcaagcagctgaatgaagttgcaataagctgctgtaacaacatcacataaaggggctttaatcctgagagaaaaaatcagcaccaagggaaaccaagtgctctgggagacccaaagccatcatccaaaacatgcaagtctatttcagggcaatcagttttaagcctctcagatcagtcaatctcgatgttcaacaaactcagttattagtttgatagtttctctttttcttttgaacacatgttcaaaaaaggacttttgtcagtaccttttttgtcattaagataaccatcatttcctagttaaagcctaaactgccccatatgaattagctaatttctgatactatgctggcccaagagtagcacttttataagctaaaaacgaaagctcagagcatacaacttagagactattcacacaattactcatgtaatcaaacccagaagaagggcaacaccaaccaagtcttttactggtctgttgctgctctacagctaccaggatggtacctaaaattatcttttgaggttcagtgaggcctcataattcccttaaacagtcaagtcatagaatactttgaaatcccagaagtcaagttaatagtattactcggctagctatataataaaaaccaaactggtatcctggctaggaggccctggaaaagtcacaacttctcagggacacaagttttttttgtttgtaaactgatggtgctggactaagaatccttctagttcttaaagtttaagataattaacttaagatttcatgtcaaaaagaaaagagccagaggctgggtgcggtggctcacgcctgtaatccctgcactttgggaggctgaagcgggtggatcacgaggtcaggagttcaagaccagcgtggccaagatggtgaaaccccgtctcgactaaaaaaaaaaaaaaaaaaaaaaaaaaaatacaaaaattagccaggcgtggtggcaggtgcctgtaatcccagctacttgggaggctgaggcagagaactgcttgagcccgggaggcagaggttgcagtgagctgagatcgtgccactgcactccagcatgggtgacagagtgagactgtctcaaaaaaaaaaaaaaaaaaagaaagaaagaaaagagaaaatgagagcagtttatgaaatctaaaaaagaaagttaatatatatataaaacacccctagctcttgggctaggaagacaagtgcatccttactaaggcttggtcctgtcaacttcagaggcaataatgagagcccagactacagtgtctacagtaactgcaaaacagccacacagcacagcgggaacacattcacacgccaggagacccagcatacatgtgcttgaagaagttataagactcaggctttattctctaacgaaatggtcattccccctttgatgtgggggtgggggtggggatgccctgcccaccccccaattccggctcccactcagttatcccacataccatacataccatcaaagtatttaagcaatggcatgcaaagcaagctttcgacaggtttcttgcaagagaaaggcagaagagaacaggtaaaagcagaagagcacacaggtaaaagcagaagagcacaacttctacttaagcccaaagaagagggacctgttcacatcttgtcctacccggaatgatgcacacgcacaggggcttgccgggacagcagtagtttcactggaaagggctggtatggaggcaccgaggacaaggtccttccatcgcagcggtgataatgctctacccaagaaaaaaagattgcgtctgccagccacgcaagactggtctgcaaggatgtcaccatagcagagggcagggaaaacaagcaggtgtcctgccacactctttgggactggccagtctaggagtgtgctttaccccacgcactgaaaacactggttactagaaatatcaaacatttcctgtgattctctcctccaagataactcgggcagcttgagaacaagctgctcttagctaattaaaagatttctgctgatattaacctttataaaagatttcaggttccaggacacgtcatttatcatgcagagtcccaagcaggtacattagcaatggaaaccaggctccaataaggaactaacaattttatctctgttgttctttattttaggttaaagaaatgaacttctcgtttcatctccacatgggaggaatgttctggagggggtaacagcctattaaactcatctagctttttttttttttttcaaactccacagcttgcctccctaccctactagactagattgcacagaggcagggcaggcacgggaaacgactctggttggaaattacaaacatatacacacagaatgcaagcaccataaccctttgaatacacagtggtttgtgccttgccccagacctacctaaggatttaaacagcacagaagtcggagttcggctgactgcatgacactctcctatcaatcgggtgaaacaaagacccagtactctaagcttaaagcattccaggcaaaattttagttaacaggcaataggaaggtgtgataggccagtgctaacaagaaagccacagatgggtttctttgagctgttaagacactggaaagggctggtatggaagcccagtggagccattaggacaatggaaaaggaggtacccctccaccaggcactttgcagagaaaactatactctggaagctgcctgcactgttgatagggctagacgtatgataaacagctaaccggaggggcacccgaggagacaaactgccaactatgaagaacaaagcagagacctcaacttgtcacgtctcaagctcagatgtacaaactttgggatcgtcaagtgaggctcgtgtgtatgcctggggatatgactgtattccagtgatcagccacctagctgacctgccacgaatgggtgacctgtggtgacttactttaatcaactgtagtacttctagattgattgggtgatttaaggttctgacatattcaggcaagaaaataaaagcaagtgtttcctagacttcctcattgggatttgaaatagaaatcctgaaaagcccataaaagcctatttccctaaatccttggtggaaattcccaaaagattaaaaaatccagaccctgtcttattatagggacccagcagatttcaaaagactcaagaggtcagcttaatctggttattaactgaaattgctgagatactgatgaacattccagccatggaacccaaaattctctagagtaataattacctattagtgcaatgttactactgaggccgtatatgcttcatttttacagtataacaaaatgtctaaaacttatgagagtcctacaacgtctaggccactcagtatcacatccaagtaggtatggttcctggatcaccaaccaacccctgaattcgatcctgttatctcacagtctggggtactgatcccgcacagcagagacacaacgtgtgaaaggctcggcagagcccattcctgttcctggaaaaataaccagaagcacacatctgcctgaccatgagtcaggaatatcaattttgtggtggagcccatttctgctgtgaccaacccacacccgaacacactcgcaacagaagcaaccgccacagagcaattccagaatgagctttttccccctcggggtccatacttagcaatgtcataaacggtctcccctgcgacagcaatccttttacactcttcataatgaccttaagtctttagtgcaaaaccacagaaacattgccactgccatataaaagtcatctgagtttcagtttgggtgattcggtcatgaccaaactgaacagaggataacctttcaggcacaattaacaggagccacagcgtcgcgatgaacttgccccatctggtaccggtgatcccgagcgctccagggcgatgagagcccgttacctactatgtcccactccacttatgtaactggaagatcgccggcgaaggggagggtaggatgggagggtgctcacattccgaggccacagcactccaaagaacctctgagcaccctggggacacgctcgcaccttagagcctctggcgccgaagagcctcgggtgctgctggacgcacagtcccctacccacggctcctgatgggaactataaccacctctttatgatgagttgtgggacccagaacacaatgtctagtcccttttgtggataataatccccacctacttgttcctgctagatggggaaaggagccggtggacctactcgctcgcgggggggtagcggggggcagaaattcatggaatgggcgagaaggagggggaggcaaagcccagagatgggggtgagagctcaggagcccttgtggcgcactctcccgacgggaggcgaagtgcgcacgcgcgccggtgggggggccgagtaacgggagagggggcgcgcgagggagggagggggagagcgcgatccagggagaggccggggccgcgggcgcgcgacggcgccgcggcccaaagccccgagaagggcaggagcgcgcgcagccccgacaggcgaaccccggcgacaggggcgcccgcggggccgggggccgggatgcgcgtcgagggcgggaggaagaggggcgtcaggcgaaggcggctccagggaggccgcgccgaggacggtcacccgcgagcacgggtgacgggccgaggggagagtcgccaccggcggcggcgggagggggagggtagagaggagggacgccatccgccagccgtgtcgtccgaccccgcgggcccctcccgcgccacgtcccgcccctgacccccgccccccggcaagggtccccgcccgcggccacggcggtcccactcacagtctctcctcctcgcctcctcctcctcctccgctcggcgcggcggcggcggcggcggccattttccggacggcttttaccacagccctctctccgagaggagggagcgcgcgcgccgccgacgccgg

SEQ ID NO: 1867 - DNA, 67503 bp, Homo sapiens
  source 1..67503: mol_type = genomic DNA
ttactgaaagaaaaaaaaatattttttatttcagttaatcgggaagctttgtcagagccctacccataaggagaagagacaacagctgcctttattcttgttggtttgctttgcaatccgctccgtgtaaagtcagctaactctctcggtcacgggcgtccggctgtccacaggctcctctctgtttggccttggcatggaggatgaaacaatgtctttgcgctctccctcccctcggtgtttgtacttttctgcggccgtggcggcggtggcaaccgcgggctgagtcttagctggctccttggggcagccgtcgctctccagtgagcctcctctgggcatcttctcctctttgcagacgctgctgctcaagtcctggggctcaggggggctggtggggtcctcggagctctcgggctcaggtggaggtgggggcaggggtgggagcagtggcacgggggcctttggggactctgagtggtggtgatggtggtggtgctccttcttggggggtgaggaggcgctgctgctgcgccccttggggctgctctccttgcttttccgcccagggctcttacaggtcttcagtcctttcccgctcttctcaccgagggtggacaccagcaggggcttcaccacttccttgacctcgatgctgaccgtctcccgggtcttgcgcttcttgatggggagtacggtctcctgcacagatcggatagaagactccttcacggctttctttttggcctcggcggcagcggctgccaccacactccccggctttcggccccgtttcttgggaatggcctgagggtcggcctcagcttttcgcttcctgccggggcgtttgatcaccatgacctgggtggatgtggtggccccacccccctcagccttgccccctggcgaagtttgaaaaggcatcttgacaaggagcttcccaggacttttctccaggacccttttcacctgcacaccctctgacgtggccgccttgggtctcgtggtgccgctccctttggggcgtccccggcctctgccagttcctggagctttgggagatttgggcttcttaggtggtttctgctctcgccgggaggggctccctctcccagttaccgtgaagtcaaaatcattagggtccagggatgtgtcgcctaccttttcgaagtacgcaatcaactccactttagagcgaaaggcttttccctggggactgtggggacaaacagaaagacacaaggaacaattagaggctctccatagcaatgtcagagatagggcagagcggatggtggtgacaacgctctgacaaacgttactattgaacgagagtcacactgcctggctgcccctgaggacctgtcaccaaagccactcactcgtctgcctgccgctgacccccccaggcctctccaaagttcagcaaccaaagagtcaggcctggtacagaagggttgtcaggctgaggcccattctgctggttggtgcctgggcctgagtcaccatctagaacattcccaagtttgaactcaggtacggtgctcagtctctccaggaatcagtttcaacaagataatcctttgctcacccttctcatggaattaaatgaggctgtctgcaaatgtcatttgaaaactgctaacctttttgggatcatttaaaaggcagaactgaaacatgcttcttcacccctctgaacccctagctctgcaagttcctctgcttccgcagctattccatccccagataaagacttgaggtgtggagaggatagagggcctgctaccttgagaacttcccactcagggcagcgacctctgtacacggtcatttcaagcacacctggtctcagtgttcattgtttatgttccccccgaccccaccctgggcacatacattttcctgctccatgagggatccttgtccctgccctccctgccctgtagagataggagttgctcttacttacttgatcaaatacacatcatacttcccagcagagcggccagatttcctttgcttaagcttccgtgtccagccttcaggcagggtggggtcatcatacatgggtccccggtcacggatgatggagcgccgctgtttgggggaggcagaagcttccggcacagccggggcggagcctgacccttctgatgtctctgctttgcctgcctctgcgggctcagcagagtggtgggctgatggctgcacgggctcatgcttgccctctttctcttctttcttatctttcttcacctttttaaacttgaggggtttgtccttgaggccctggaggtcctggtcttctgacttttcttccctgaagtgttaaacaagtatgtaagtatcacagagaacatgccagtctgcagaacaagtgagcagaggcaggcttggacccccaccacatgcaaggccccaggccatcatacactcagatcttgatgtccttccccaggacaacagagactcgggccaagctgggacccaaatatttctttaggaatttgggctgtgggtggtgctggccggtgtgcctgacctgcactgtggccacccacaagtctcctagcactgcaggagaatcagagccctttcctctgagcggaaacactgcggctcctgagcataccaccccagcatgagtcgcacttcaagggactctgggctcgatggctgacaagaggccgtcgactgctggaaagggagccaaatgggggaggggtctcctttgtgaaggccgggccttgggtgtgtttttggttttctagaatgaggctcaatgaggcacacagtacagtgtcatggaaagcacacacaggtttggagccagccaacctgcactgaaatcctttgccgctttccaaacatgaacccagcaaatgacctcagcattctgtgcttcagtttccttatcttgacaacaggtaaccccatctaggcatccttactgtgagcatcacaggagaaaaggcacaatggcactatataaatatcagctaactcaggccacaggaaactaccgcctagggtcctgggggtgataagacaagtggtcccaggtggcgtgagcctctaacacatgttccctgatgaggaatggcctcggccacagcagatgcggagggaagagcaaggaaaaaggtgtggtccaggcagagccatacatccccttcctgccggtggagaagagcaccctacctattctagtgtgggaggcttccccgttcttttctggtgaccgaagcagctccttctctacacatcactttggcccggtggggtctcgtcagaaatggccaccgtgaggccccacaccccagcatcactatctggccatgatgctctagtactctgtcgagtatgccaccgtgaaacctcctaggactccagagcctctgcaacaacaggggcagcttggaaagaagcagcagccacctgcgagtcccttcgttagcagttcattctggaaaagagcatgactactcccaccctccgtgttctcagccccacaactcccctgtcccatgtggttcacatcagtgctagtcaccgccttgcggctggtctaccccaagagacttcccctcttgtctacactgcacagactgtgcaatgagggcaccatggcactcactggcaagcatccttaggaaaccagaactcaaatgatgtagggaagttaccaaaggctgcttagtgctgggactcagaagctgcaaggacgtatctctccagaaccatcaggtcaggtgtagggaggcaagagatgttccaatctagtgacaaggtcttagagtgagggaatgtcttgtccccaccatgactcacccctgagttcctccctatcctgtatcttcctccagaagtttagggcccagagtgtggctgccagagtcacctagagccactgcatacacaaaggcatcctacaacccacagagcagtctttcttgctgtaaagaggggtccctaatctgtcccagcacagagctcgccttgttttgttttttgttttttttttgagatggagtctcgctctgttgccgatggcataatatcggctcatcgcaacctccgcctgccgggttcaagttattctcctgcctcagcctccggagtagctgggatcacaggcgtgtgctaccacgccaggctaatttttgtatgtttagtggagacggggtttcaccatgttgggcaggctggtctcgaactcctgacctcaggtgatcgacccgcctcagcctcccaaagtgctgggattacaggcgtgagccaccgtgcccagccagagcttccttttcatgtctctgagtcttacagctctcaatgggaaatgacgaagaaccctggaaagctaggtgtggcctgttgcccaccagagatcagcctttgagaatggacccctaggcagctccccagctccccataaaggagggagggaaggggagccaccagcagagtgggccaagaaagcagacagatgggaatcgctacttctacacaatccatcatggcactgcctaacgccagggctgctccctagaacccggacggtcctaatgtcagagaaaaacagtgaactaatgggaaagatctggcttcttcgaaactctcatttgcatttcccaaataccttaatcaccatgaggtcaaactataaacctaaacgtgacgtaaggaatgccttctagaaatctatgctaaagagacacctccagaaatctcaaagaacatatgcatgatgttatttgctacaacattatttttaccagccaaaggcttccaatacccccgatccctatcaccagggcacttgctgaataaacttatggtgcgcccacacactggagtactgtgcagatccaaagggactaaacaagagctctaagaactgcgatggagtcatttccaggatccactgtgaagcaaagggagcaaagcgcaaacatatctactgcattctaccaaagaaagaagggggggtattaaggaaggacacaccaggaactaatgaaattgattccctgcatggggtagggggaaaaaggtaagggtacaggcacaggagtgaggcctagctgaacatgcctcagtgtaattctgacttctgaatcatgtaaatgtttatattacccaaaataaaattcaaactaaaagtaacaaaaccttattacacttaatgcaaataaaaacaaatgagttcgggccaggcatggtggcttcagcctacgatcccagcactttgggaggccgaggcgggtcgatcacctgaggtcaggagtatgaggctgcagtgagccatgactacatcactgcactccagcctgagtgacagagcaagaccctgtctctctctctctctttttttttttttgagacagagtcttgctagagtgccatggcgtgatcttggctcactgcaacctccgactcctgagttcaagccttctcctgcctcagcttcccgagtagctgggattacaggtacctgccatcacgcccggctaatttttgtatttttagcagagacggggtttcaccatgctggccaggttggtcttgaattcctgacctcaggcgatccacccaccttggcttcccaaagtgccgggattacaggcatgagacaccacgcctggccaagaccctgtctcttaaaaaaaaaaaaaaagaaaagaaaaaagaaaagaaacaaatttaattctatatcaaattgacaatataccacagagaaaagatttatttcaaatgacttttgactacagtgctctgcaaacctgtagtgggacatattctaaggccaacaataacactccaggggcagtaaacacactagattggctcccaggagagatatgtgattctgcttctggggcatcttgtgccagaaagcccggggagtgcaagagaaaaacagggagggcccatgagaggcctctagcagtggtccaggtgtggcccagggtgggggcagttgaggatttggggctggtctaggtggtgaagcaacagagctcgcaggtggattagtgtgggggtgaggggcaagggtgagtcagggaccatgtccaaagcctgggaagatggtggtgccactgattgagaaggaaaagactgaggggccggctgggtgcagtggctctcacctgtaatcccagcactgtgggaggctgaggcaggtggatcacctgaggtctggagttcgagcccaacctggccaacatggtgaaactccgtctctactaaaaatacaaaaatgagccgggcgtggtggcaggtgcctgtaagtcccagctacatggaaggctgagggagaagaatcgcctgaacccaggaggcagaggtcgcagtgagctgagatcgcaagactccgtctcaaaaaaacaaaaacaaaaacaaaaccactggagcggcaggggagcaacacccacagagacagttataccatcaaggagagaaaacagttcttcagctactcgctagaaaggggggaaaccccgctgtgatcagattctgagttgggcctgaatgaaaatgaactgtctgcttggggttttaaaggctttttattgtggtaaaatatacaaaacaggtcaggtgtggtggcttacacttgtaatcccagcactttgggaggtgaggcaggtggatcgcttgagctcaggagtttgagaccagcctgggcaacatagcaaaaccctgtctctacaaaaaaaaaaaaaaaaaaaaaaaattagctgggcatggtggtgtgtgcctgtaatcctagctactcgggaggctgaggcaggaggatcacttgagcctaggaagttgaggctgcagtgagccgttgatcatgccactgcactcctgcctgggcgaacaaaccagacacatatatgtctcaaaaaaaaatacatatatatatatatatatatatatatatatatatatatatatacacacacacacaaaacaaagtttacctttttaactatttctaagtgtacaatgaatgaacttttttttttttttttttgagacggagtcttgctctgtcacccatgctggggtgtggtggcgcaatctcggcttactgcatacaggctctgcctccctcctgagttcaagcgattctcctgcctcagcctcccgagtagctgagattacagatgcgcaccaccacgcccagctaatttttgtatttttagtagagatggggtttcgccatgttggccaggctggtcttgaactcctgacctcaggtgatccacccacctgggcctctcaaagtgctgggattataggtgtgagccaccatgcctggccctaaatgaacttttaagagcactgaagatgggaaataaagggtctttaactctactgtaatattctagttctttctaatggaaattacttgaagcaaatatagtatgatgattttcaattctgtgcaatgaaaggcacatgggtgtttgttaatttgctggctgctacttttataattaaagacaaatttcaaaaaacccacaaagaagcctggattgtgctgggtgtggagtgcaggtaaaaatgataaaaaacgtggatggagctggagtccattgtcttcagtgacacagctcagacacagaaagtcaaataccgtacgttctcacttagaagcaggagctgaatagcatgtgcacatggacagagtgaggaatggcagacactggagagactgggaagggtgggagggggtgagggatgagacattacttaacgggtacaatgtccactattcaggtgatggttacactgaaagctcagacttcactactatacaatatatccacgcaacaaaactgcacttgtaccctttaaatttaacaaataaaaaacaatgatagaaaacaggtattccaaatgagtttacccttagcccagagggcctgcccagtcccagggtgacctgggcatttgcacaccctcactaagccttcactgcaggacccaagggagggaggctgggctagggtgccaggtgactccccaaggctgtcccccagggggtttatggtgtttgccgaaacacaaactttttcaaagaaacctgccaggtgtggtggctcatgcctataatcccagcactttgggaggccgaggcaggtggatcacctgaggtcaggagttcgagaccagcctggccaacatggcgaaaaccccatctctattaaaaatacaaaaattagctgggcatggtggtgcatgcctgtaatcccagttactcaggaggctgaggcaggagaatcacttgaacccaggaggcagaggttgcagtgaaccgaaatcgtgccactgcactccagcctgggtgacagagtgagactccatctcaaaaacaaacaaacaaacagaaaacaaaacaaaaaaaaccccatacacctctcttcatcctccctctaatcagaaccccccacacacacacaatcttgattatgaggagaactaaatagctagttcacaagttcatacattttacagttgaagtatcctcagaaaaaccacctattcaactcctgagtgttacagatggaaaaaaagaagttcgactagacagaggaacttgtctgagatcaccgtgagtcaaaaacacacgtgtctgttcaccaactgccttcgtcctgagccagatcctgcagcatccttccacctccaagaactcacagtttggaagggaggacaaataggtaactacaacatagttccagcctcccttccccctgaagaaagcttgctccaggcacagcggaagcacaggggtgtggataatgaatcaggagtgagtgggctgtcagggcttatgagttccacaggtgggacagagggctcagggcatgccaggccagatgggcagaggcggcactatcaacatggttatagctcccaccctatcacccgtgtgacgcccctccctcgaggaaaaagtgaccaatgatgcccaccctgtgtcaccagaggctctgggcctaaccctgtcaccccctcccaccttttcatttggagaactttcaggttcatctggagaactttcatctttcaggttcagttaggatggcacttctagaccgggcgcagtggctcatgcctgtaatcccaacaccttaggaggccgaggtgagcagatcacttgaggccaggagtttaagaccagcctggccaacatggcaaaactccgcctctactaaaaatacaaaatatttgccgggtgtggtggtgtgcgcctgtggtcccagctactcggggactgaggcatgagaatcgcttgaacctgggaggcggaggctgcagtgagttgagatagtgccattgcactccagaccaggcgatagaacaagattccacttcccaaaaaaaaaaaaaaaaagatggcacttctgagacaccttccctgctcctgcctccctccctgctctatgagccagggcacccgagccctcagtgtacttagaacaccccactgtgcgtgccaacccccatctccccgctcaatgcataatgccaggcacaggtgcaacccttactcaacacatgctggatgaataaccacaacacggacgcagcgctccacgtgcttcttctgatggctggagaccttcgaccgtaagcttctagcaaggagaggctagctcagtgctgaaaaaaaggtgggctctgaattggtgaataaacaaatgatgagtttgggacatatcagtagtccgttggacactggtggcttggagatggcggaagatgaggtggaggaagtcactgaggagggcctcagtgccccagggacagtagcatggaggatggttacgccagaggatggatcgacttctagccatgtggtggtcaggtatgcagacacctctcctgctgaaacaactacaactgccaaactgagtatcttacagaagctgctagagaagccacccacaagctggcaagaaaggaaggaatacacaggctgaagagcaaataaaagtacggggcccttttctgtggagaaatctggcaggcaccaccttaacacacgaccaaactgagctcaggcccctcagtgctgctgagatgaaccagcatcacgagtaggagactgaagcttaccgtgaggagacagcaggaagagtccagagagggcgtgccatgcaaccacggtctggactcaagatgatgagagaaaacaagggggtgggggaacatttctgataaaggagactgaagggatgacacaatcgaatacaacacacagtcctggactctgcattccaggctcaaaggctctaaaaaaggcatttatggggtatgtggagaaatgtaaggttctgtgttagctcattgctaaacttcctgagtgtcttaactgtactgtctgctcttaggaaaggcatgcttaaacgtttaggagtgaaacagcacgaggactatgactaactctcaagtgatcaatgggctaggggaaatacagtgccaatatggtaacatgtttaaaagaagggagatgacatcaatataatcagaagctatgccaactgacagtaatattttgaagcagtggtaggcaagctttttaacaattaaagagaatgccttcatattacacaaagacattaagaaaaaaagctgaaggctgggcacggaggctcacacctgtaatcccagcactttgggaggctgaggtgggcggatcacgaggtcagttcgaggccatcctgaccaacatggtgaaaccccctctctactaaaaataaaaaattagccaggtgtggtggcgcgcacaaagggaccggggcggtgctggcggcgatgccaacagacctcagtgtactgtggggttctttcagccagaactgttcatggtttcatcagtgagctccagttaccacaccacacaagtttggagtgatccaccccgccccagtttttcctgcacgaactcatgtttttattgtgtgatttacagaacacaagatctttttctaagaatgcacacatcacacgttgaagcagaaaggcctttacaaaatcttaaaatacctacaaaatatgaagtaaggctcttaagaaataaaatattcaatgattttgctgctagaatgcaaacattagatcaaatccttcatttgatctagcaaaggaaaattagagttgcaggaatcttgttttcaggccaaaccatgacatcctgaggggtctgatggcaggaactgcctgcattttcctcatgaatgtgacctgcagtgatcttgtgagaaaggcccggaaggccgtgcaaattacaggggtacaagcaacagctggcaggtgtggccagacaggcaactgcagttaaggaaagactactcaatccctgaggttttcagattttacaaaaaggcaaaaaagccaggtgaacaaggcagatgaaaggtatttttcacttgaattggaatccagccccctccctgtcccctggagtgagctccagagaaacttccagagccccagcaatatcccaacctttcgtaaattcactcatgctcgccactttcaggagatggcatttctcagcacctttcacttccagttatccctcggcacagcacaaagagctaaactaccactcgaggcagttaacctaagggcagggtggtggctacagctccaggtgaacagtctgggaccagaggaaataatgagcccccccttgtactggctgcttccaccctaaagtgtcatccagatggtgtttccaattctttctacttccagtattagctgcagaattacggaatcaaggaggcttctctgcatgaatcaataaaggctatagcactttgagacacaagctttggccctttaaaaatgtgagaaatcaaactggcacaggcagagtgtctcagtggtctccagggagcaagagagaatgaggttcagcttgaaggctacaagggtggagcctgaggttcagctgccctgctctgaattcgcagtccatttcttaatcctccacttttgagaagatgcgagaaaccagttatgttttgctaagcttaaataaaatgcagttcttgccaaccaaaagcagaaccctccccaaatacaggcaaccagtgccatacagcaaatctcatctttatagatgtgtaaaatgaaaaccgaaacacaagcccaccacatacaggttaaaaaattcctgctgtggagaacagtttggcagtttctcaaatgttaaacatggagttaccatatgacctggcaattttactcctagccatacactctcaaaaagccacaactatgccgggtgcggtggctcacgtctgtaatcccagcactttgggaggctgaggtgggtggatcacctgaggtcaggagtttgagaccagcctggccaatatggcgaaaccttgtctctactaaaaatacaaaaaaatttagccgggcatggtggtgagtgctacctgtagtcccagctactcaggagactgaggcaggagaattgcttgaacctgggaggtggaggttgcagtgagcagagatcgtgccactgtaatccagcctgggcgacagagcaagaccttgtctcaaaaaaccaaaacaaacaaacaaaaaaccaaaaccagtaaccaaacagatatccgtacaccagtgttcatggcagcacagtttacaacagccaaatggtgggggcaacccaaatatgcattcccaagggatgggtggataatcaaaacctcattatctataggatataatatcattcagcctcaaaaaggaaagaaattctgacacatgctacaatgcagatgaaccttgaggacattacgctcagtgaaagaggccagacacaaaaggccaaatagtgcataattccatttataggaaatgtccagaataggcaaatccatagagacaggaagtggatgagttgttgccaggggctgcgggtaataagaggtgactgctcctgtgtctggggtttcttttgggtgctgaaagtgttctggaatgacacagaggcgatggttgcacaactctgtgaatgtactaaaagacactgaattgcacattttatttttaaacaattttttctgtgagcctatgaattatactgaagaatgaattgtacactttaaatgagtaaatttcatggtatgtgaattatatctaaattaaaaaaaacaacaacattaaaacagcagctgaccaccaattattctaaatcataaagataggttttgtgatgcctggccagtgctcagagcccacacagctgtctcagagcaagtctatctggctgtggcacagagccccggcagatagatgggctgtccgtctgaggaagaggccaatgtggggacctatagtgatacatgacagactggaccaagccaacctgaatgtgaaactctgaagcccaggacacaataaccatgacaatcagaaaggaatttagttcaagaagtttaatgagtaggcatttagccaagtggaaggttgttggctattctgaggacatttgatcttttttttttaattgtggtaaaatacacataacataaaatttatcattaatagcatttagtacattcacaatgtcatgcgaccatcactactctctagttccaaagacaaccctttacccattaagcagttgctccccactcccactcctctcagcccctggtaaccactaatctatttgtctccacaaatctgcctactgttgacacttcatataagtggaataataccctcccctggaaagcctgtcttttaaaaaatgattttcatttaaaaaagtttttttgcttaacacagtggctcatacctgtaatcttaggaaggcagaggcaggaggattgcttgggcccaggagttcgagatctgcctgggcaacatagtgagatcccgttattcacaaaaagggggaaaaaagaccaggaaaaaaaaaaatcccaaaactaaacaacgaaaaagttttttttagggagatagggtctcgctgtgctgcccaggctgggctcaagcgatcctcctgcctcaggctctcaagtagctgggactacagatgagctaccacgcccaacttagaaacatgtatttttttcagattagctcatcattccctggtaacttctccaatgatttccccttgcatctctgccactatattctagcagggttctcacactgatcctacacacaagtggttagagactcaccaggccaagctcacctccaattccaaatacctagtcctcaaggtccaagtggcctgtttccatagacactgacactgtgcatgacttttctgtcctcagctgctggctttctccatttcttgttgataatgtttttttcttacctttacatacttcatgtaaataagtttcacagacttttaacaaagtgttggctgcttttatcaaagaagagaaaatctgccaaaataaattttcaccatgaaggcaacacattttggggaacaagaaagggcagaaaggagatctcttttactagagaactctgcttaaggactggctcatttgatccaaacatctcatcagtaacttggagtgagtgcccttgttttcgtcatcttgcgtctcactagtgtaggtcagtccacatcagcctgcctgacgtacttggttcgtaatgctgacatctgagcccccatgtttatttcaccctgattctactgaaatgaccaacgaaatgcaaaacaggaggaaatatctctatcaatgccttcagaggaaccgctgtagaatgtggtgtggctgggatccatgcgagagaagcagctctcacacgattccaccacagttaaacacatgggcaaaggagggacctgccggaggtatgaggattccgtagcagagcccaagaaaatctgcaagatcagagaaactgggcctaagagccagactggcagaagtacggtttgccggtggcaaatagaaggacctgaaccaccagtgccctaggtggagaggtcagtgacaggctggccaggttttcctgggcactgctgggacagagagagacaccaatatagaggagattctacctgtctcaagaatctgccagcagcaccctgggtccccaccctgactccagctgctgccacaggggaagcagcagggactgaagctccaccccataaacaactctagggactggggatcaaacaagtaccaacaaattagtaactgtcctgtgtacaaatacaaattaggtggaaactataatgattgaacaccagtcattccagtcaagatcccaactggaggccgggcgcgatggctcaagcctgtaatcccagcactctgggaggctgaggcgggcagaacacgaggtcaggagttcgagaccagcctggccaacacagtgaaaccctgtctctactaaaaatacaaaaaaattttagcctggtgtggtggtgcgcgcctgtagtcccagctacttgggaggctgaggcaggagaatcgcttgaacccaggaggcggaggttacagtgagccgagattgtgccactgcactccagcctgggcaacacagcaagactctcgtctcaaaaaaagaaaaaagatctcaactggattttctttggaatctgacatttacctagaataggcatctgaggacagccagaaggagtgtgtgtgtgtgtgtgtgtgtgtgtgtgtgtgtgtgtgtgtgtgtgcagggggggggatggcttccttctggtagccactgctctagggagtatttctcaccatcatgtcacaaagcacacaacaggagcactctcacatggattagggaattagatgcagacctcctgcacaactgccctcttccagtcctagtaagataagacacaaaagaaaggcagggaaggagagtgtgaagggaagatttcagcacacaaaggaaaggggtgtaattcaaagcagtctgagaaaagactccagaggacaaagcagcagcaaagccaggctcctgccccgtcccccagaaaccaccctagggagcgggcaacgccctgggaatttgcagtcagtaagctggagagaagcaaccaagtgggagtccttcactttttccttttagacccagaaactccagctgggaggtgcaggagaaatggcaaagtgcccagtgagccagcccagctctgtgggaagcaactgctcttaggtatacacagattatggaaccacccagagactgaggtgccccctatccccatggaaatggcacacacatccctcgtgcagctagagtgagccttagtaagacatccaacacagttcttagaacaaagagaagaatccagatagggctgaagactacatggctgcagctccctccagcgtgcaaattctctccggatacaagataacaagcctgcacgcgatagctcagaggggaaaacagcaagagaagatgccaagaaactgggaagagagagccaagaattcctccactgtctcaaagcaaacagaacgactatgcagagccatccaagcctgagccaagacgaaaagaagtgacatggtaactaggcaaacatattatggccagaagaaaaaaaagaggcccagggagggagatggcacgagaaaggcaaagtctcccaccaagaagagaatacacaaggaagggaaaaaaattccccacaacttcataagaacatgttcccaataaaagagttcaaagatgggatgataaaacagaataagatgaaaagacaaatttccaacctagagaaacaaactgcagaccaaaacacatcattatgaaactaataaatacattgaaaaacagccagaaacagaatatacatagctgaaaatcaaattagacaaagtgaatgcagatgaaaaagacaaaagctaaaccaattacggcaaagctaatagcattggaagagagacaaagacaatccaacatgaggaatttgtgtccctgaagtacagaactcaacaaatggaacagaagatgctgtcaaagatccataagagagctgacctgaaacagcaacgactacatctgcagactgaaagaatacaccatgttcccaggacaatttgataaagaatgctcaatagcaagccagactctagtcaacctactcaacttcaaggataaagaaagcattcttcaggcaccttgggattcttccaagggggaaacatcagaagaccagacagaatgtctacaaagttctgaggcagcttagcgcagtggtggtgggggagaggtcagaggtaaattcagagagatggacaggggccaaaagcctctctgagaagacgaaatctgaacacagatctgaaggaagtgagtggtgagggagcaggtcaagtaaagaggggtccagccaatgaggagcagcaagagccaaggctctgactctagcaacattatggcaagttccaggaagagcaagagcagtgggagccaggtgagcaagggagagaatggtagagaatgagctcaaataggcaaggagggatcatgttccatgtggctgctgaggcaggcccagttacacaatttgtggagcctggtgcaaaatgaaaatgcagggcctcttgttcaaaaattaagaattttgagatggtgagagtagagtattaaaccaagcctgggttccagcaagcccatgggcagttacaaaggcccatgaagctggctctgctttcaagtaatggacttcgggttttattctgagagggtttttctcaagggagtaacctgatctaataaacatttttcaaagagcccatctgaggctgggcacactggtacacgcctgtaatcctgcattttgggaggccaaggcgggaggattgcttgagcctgggagttcgagaccagcccgggcaacatagggagaccccagtctctacaaaaaatataaaaattagccaggtgtggtggtgcatacctgtagtctcagctacttgggaggctgaggtgggaggactgcttgagcccaggaggttgaggctgcagtgagtcgtgactgtgccattgcattccagcctgggtgacaaagggagaccttatctcaaaaaaaaaaaaaaaaagcccattctaactatgggaagatatagagtagagggagtggggcaggagggcacaagatgccacaggggggctctgcagaagcagatgttgggtcacggtttgaggtgtaagatgttcatcaggaactgacatccataaagggaggtgggaagaagtcaaagagaaggccctataagggccttgtacccttacctcgctcagtcaccagggtgctgtcctggaaatggcgtgaccttgggtgaggaggctcttgcagctgaggctaaccggagtgtccgcagggcatccagagaggagagtgacctccgggtctgccacgtgagactactgcagagtctaggcagggatgcagggagctggtctaggtgccatccctgaagggcatgggcaccgggacagcgaaagggcgagagatccaggactctggcttccgtttctcatgtttttgatactgaggtatttagctttctagaggcctaaagggcagctggatgtatgaatctggagttcaggggagaggtctgaagagccaggcgagtgcgtgagggcgtgctgaatataagtgtaaacaaccctccccctgctatttggagttgtgatgaggagaaagaatcagcagaggagacagagaaagaggagtcagtgcagagaaggaagatcagacatatctgtcaagattattggtggcaatcaatagaaaccaactctagctgatttatgcagacaaggactgatgaaaagctattgaagatgcatgtggtgatggttgcacaatataaatgtgctcaataccacagaattgtacacttaaaaatggttaaggcagtacattttatcttttgtgtattttactgcaatttttaaaactagggggaaaaggctactgggtgataagagaatccctagagggttggaggaacaggtttgagtccagttggctaggaacaatacttcaaatccttctgccaagccagtccaaacagccagcactgcctgtgcgaccctgcaaggcagcagcactggccactggcactgtggcctaggagctcgtctttcctgcagccccaatgccaggagacacggctctcctgcctggccctgctcctcctagcatgtgagtctgactggcagaggccagggtacatacctacaccctcgtgtagaactcaggtaatttctttctgtaaggggccagatagtattttccaccttgtgggccagacagtatctgtcacaaccagcccacctgctgttgtacaggagagcagtcttggacaatgcacaaaggacggggtggaactgggtcctggtaaagcttcatttacgaaaacaggcagtgggccggacttggcccttgagataccgtttgccaactgctgccctgaccgaaagggaagctaggcaaataagcatctggcatttgcagtgactacaatcagaggtcgccaggcctcccatcaactcgtgaggtgagaattctcccaaacccagagggttcaagatgtgaggtgagatggccacctggagagtatgaggtaccagaagagacacaaggaaagggctgagaaggagtgacagccactgatgactgttaagattatttcatggaatgtggaaaagcaagtgttcatggagcaagctgagcaaggagcagcaggcaaggaagagggcccatgagtggagagaactcttagagagtttggctaaaaggagaaacagagactgagcaggagccaaggaggtatgcgctgaagggagctcagttacgatggtaaattctaaaacaagttcgtctggtgatgggcacagttcacaagaggagggaagaccaatggagtcccaggggcatcaaacagtggttgacactgcaagctgggaagacagtaagtcctcatcataggcagagctaagttagaactccgtgggtggagttccagagatgaccaactccaggatacgaccatgggaatgagtggcagaagagacagggaaggagccaggcactaggagggcggcctacatgcgtgtgtgtgctggagtcaggaactggcacggaatcctcaataagaggactgactggggcagtgagcaagcccacaatcaggggtctgtgggccgagaggctgtgtcacagtccccctatgccatgcctggaggcacatgggatcagagacctctgaggacttggcaggaggcacaggcgtggagaggcagggcctaacccaggtgtgtgtgtcgcgggggggaggggggcggtggttaggcagggctctttggggaagagatacctgacagggtcttcaaggataagcacgacaaggcaaggccacaggggaaggaaaggagaagagaaggggacttgggcaggggagccaatgacaaaggccaggagtgcaagaaacatggtacctgggaggaactacaagcagtcctggactgctgagggctatgtccataagaaaagcagcagcaacagaaggggccacaaagagaagcaggagccacatgaggggccctgatgtcactcaaacacagggtgccactcttgggtttaaagcaggggaatgagattgatgatagggattgtgtggaagatagagaggtggaggaaagatcataagttatcatgggagtcccagagcaagatgagggattgaaccaggacagcggtagaagggatgacagaagacaaaagagggacaaacagttaaaggaacaatttgtgggacttggtggctcccttggatgtgggcagtgaagggcaggggcctgttgggtttccagcttgggtgactggtatggctatcaactgtgacagaaaacagtggacatggcatttgtctatttggtcttctgatctaccttatcttgaaggagacaggggtggtagggcgcccagtgggttgagaagaatggaagggagaaagagggcagaaatctctcaaatgttttgcacagtaaaatctgactaaaatgcacacacgccccacaagcctttttctttttttttccccccaagaagcaaaacaagttttatttccatagtagttccttttagtgctctctgtcgccacctaatggatggcctggtggaagaggctcaagaggtagcagcctagcctattccacggcagaggaatcaaactcacccaggcagggagaacgggactgcacctgggtgggggaggaccaaaagaagcccagctgcttctggaagatcattgggagtctcttctggaagaccaggggctcttggagctaaaatagacgttcgttcattaataatacctacttcaacaacttaagatcatgttcagcggatgcacatcaaccttgacttgtctgtgctccccaaatcaatatgcctcaatattgaggcatattgagggaacaatctgtagatattcatgaaattgtctggtgggacaaaaattgtggggcacttgagcctagctgaactcagttttaagttctagcatttaacacaccacctctaagtttacgtgtactttatgagtgcaggaatgcaacaaaaaaatctagtgtaaagtcctggccctcagggcaaagcaagggaactacaactcttgctgcgaactgccttcctcccacagatgtggcacattcacaaatcacattcattgaacaagaaatggaacaagtgccacaccagaggtgacaagaagaggggaccatacaataataggtaacttccctgtcacacgagactgcttggagacaaggatacagagcccagcataggagatgggacaaaatgatgagggtcaaggaccacacctggtttaactcccagtgaagagttttagccagtaaagagctgcaagaaggaaatcacacaccacgaagaggccactaagataaacgcttgaatctgattaagttttcacctgaaaagtgtgggtaaggacaagcctgccttgttgggtagtacagattcagtgaatgagccctcagatcctgctggatcccgtgatcagataaacagcagcttctcaggaaccactgcatgtgaggttagggtgaggggagggacccgatggagatctaatcccaggggtttggtcacaggggctggcgaatgagaggtggagaccgggaacatacgccactttttttttttttttttttttttttgagacggggtctcactgtgtcacccaggctggagtgcagtggcaccatcttggctcactgcaacctccgccccccaggttcaagcgattctcctgcctcagccacccaagtagctgggattacaggcgcctgccactgcgcctggctagtttttctatttttagtagagacggggtttcaccatctcggccaggctggttttgaactcctgacctcgtgatccacccacctcggcctcccacagtgcggggattacaggcgtgagccactgcgcccggccagccactctttttttttgagatggagtttcgctcttgttggccgggctggaatgcaatggcacgatctcggctcactgcaccctccatctcccaggttcaagtgattctcctggctcagcctcccaagtagctgggattacaggcatgcgccaccacgcccagctaattttgtatttttagtagggacgggatttctccatgttggtcaggctggtcttgaactcctgacctcaggtgatccacctgccttggcctcccaaagtgctgggattacaggcatgagccaccaggcccagcctaagccactcttttggaaagctcagcagagaagatgcatgaggtaatacgacgcgttaggtggcctttaaagggatgtttatagcttttcataacatgggtgtattagtctgctcaagctataacaaaatagtacagactggggggcctattcaactgaaatttctcacagttctggaggctagaagtccaagatcaaggtgtcagcacattcagcccctggtgagggctctctttctgacttggagatggctgccttctcattgcatactcacatggtggagaaagcaagctctctgctgtctcttgttataaggacactaatctcatcatgcgaaacccaccctccctcctgatttcatctaaacctaaccacctctcaaataccccatctccaaataacatcacattggaggtttgagcttcaacactggaattttgggggacacaaacattcagtccataacagtgctgatgtttatgttttaatgttaaatgataacagcacagcacagcagcacacacactgtgtgatgccaatctgtttgtttgtttgtttgtttgtttttttagataggttctcactctgttgcctgggctatagcagtagtgtgatcacacctcactgcaacctcgacctccaggttcaagcaatcctcccacctcagcctctcaaagtgctgggattccaggcatgagccaccatgcctggcctccaatttgtatttaatgccactgaactgtacatttaaaaatggtaaattttaggtgatgtgtattttactacaatttttttaaaagtctaagagaaggcaagaaaggagaaggaaaatttaaaagaacagaaaatatggaaaaatagaatgcacaaatatgctataaatgaatctaaatacatcagaaatcaaatagatgttaaaggacgaaacagacaatggattttttaaaaaatctcgaggccgggtgcggtggctcacgcctgtaatcccagcactttgggaggctgaggcgggcggatcacgaggtcaggagatcgagaccatcctggctgacacggtgaaaccccgtctctactaaaaatacaaaaaaaaaaaaaaaaaaaaaatcagccacgcgtggtggcgggcacctgtagtcccagctactctggaggctgaagcaggagaatggcatgaacccggggggcggagcttgcagtgagccgagatcgcgccaccgcactccagcctgggcgacagagcaagactccgtctcaaaaaaaaaaaaaaaaaaaaaatctagctatcagctgggcatggtggctcacgtctgtaattccaacactttgggaggctgaggcgggtgatcagctgaggtgaggagtttgagaccagcctggccaacatggtgaaaccacatctctactaaaaatacaaaattagccgggtgtggtggcacgtgcctgtagtcccagctactcaggaggctgcggcaggagaattgttttgaacctgggaggtggaggttgcagtgagccgagatcacgccattgcactccagcctgggcaacaagagcaaaactccgtctcaaaaaaaaaaaatctagctatctgacattttcaaaagctccacctcactgatgcataaagacacagaaaggaggaaaataaaaaactgggatggccgggcgtggtggctcacacctgtaatcccaacacttttagaggccaaggctggtgaactgcttgagcccaggagtttgagaccagtctgggcaacatggcaaaaccctgtctctactaaaaatacaaaaacttagccaggcgcgctggtgcaagcctgtaatcccagctactcaggaggctgaggtgggaggaccacttgagcccaggaggcggaggttgcagtgagctgagattgcaccactgcactccagactgggtgacagagggagaccctgtctcaaaaaaaaaaaaaagaaagaaaaataaataaaataaataataatttaaaaaaaaataacatattagtatggtcgcttcataataccaaagggttcaatacaccaggaatgtgaaactgtatctaaaactgaaaatgtggcctcaaaataaataataaaatgaaaatgaccaaactctgtggagaaactgatgtgtccatcaccacagtaggttttaacacgtattccatcagttgataaatcaagtaaacaaaatgacagtaagaagagaaaatactttcacaacaaacggataagacagaggtaatgaatatatgtagaatcctgcacccatgcttggtggtgacatattctgtccactggttgtggataatgtgtcatggagcacttctcaaccaactgcaagaactggtgtcacacagaccaagttctttgatcacagtgccatttagttagaagttgattttttctttttttcttttttttttttgagacggagtattgctcttgttgcccaggctggagtacactggcacaatcttggctcactgtgaccactgcctcccggttcaagtgattctcctgcctcagcctcccgagtagctggaactacaggtgtgtgccaccatgcccggctaattttgtatttttagtagagacgaggttttggcatgttggccaggctggtctcgaactcctgacctcaggtgatctgcccgcctcggcctcccaaagtgctgggattacaggcatgagccacctcatgcagtcaatttttttttctagagcaactaggaaaaaaaaaaaacaaacccaaagccatgtgcttggaaattgaaaaacacattttaaaataatatgtgagtcaaaggaagaaacaaagaaaatttaaaatatctttgggctaacttaaagtgacaatactatcagaacttgctagatacagttgaagtagttccagagggttagccttaaatgtttacatttgaaaaaagggtagaaaaatcaatgaaccaaatttataacttaagaagttagggccaggcgtggtggctcatgcctgtaatcccagcactttgggaggccaaggcgggtggagcacctggcgtcagcagttcgagacccgcctggtcaacatgccaaaaccccatctctactaaaaatacaaaaaatttgccgggtgtggggcaaatgcctgtaaatctcagctactcgggaggttgaggcacgagaatcacttgaacccaggaggtggaggttgcagtgagctgagattgcactactgcactccagcctgggcgacagagcaagactctctctctcaaaacaaaaaacaaacaacaacaacaacaacaacaaaacacagagaatgtactctaagaccatagaaaaaataataaagataaaagcaaaagcagaatttaatgaactagaaaagagacacagagtaatacagggcaataatgcctacatgtctgcttcttgtaagaccaatgaacctaatgagcttttaccaagacaaggaaaaacgggagaaggtacaagtaaacaacaaacactaggaatgaaaaagcagacataattacagatgttgcaaatgtataaactataacatgaacaactttatgctagtcagacaaaatggacaaattcctagaaaaaaaaatttaacagcttacagtagcccaagcaggtgcagggaaaataaaaataggtttagatgtgtctgcgtgtacatagaacacctcaaaagacacagacaagaccctggatgcagccgttccctgaagagaggcctaggcagctgggagaccagggcagcagggacactcagaccttgcatcactctggagtttgcacttcctgaattgtgaagcatgcacatgtctcacttatgcaacagtgaatccaaacgtgcctgtatacaaggaaaggcctcacctggctgcgccgtggaggctggcctggcgtgtggagcaggcagaacattagcaagctaccgagcaggtgcaggtatgaacatcagctgacgctggctctttgctttctttttaatcttgacaaatttggtaggtgaaaaggcatcatttttgttctcgtttgcatctctttgattaccagcaggcagaactcttttcctatcttcattggccatctgtatctcttcttttatgaatttcctgttcatagtctttgttcattagtggtgactagtggtaagttagcaataagaactgtttgcattcaagtctagactgagaaggaaattaaaaaatctgcccatgtattctcacaataaatgactactgactagcctgagataattgtacccactgcccagtcacaggcattaagcctaggatgattcatttcagacttgtccctgaccttcctcataccctttccagaagggccccttgagctgctatgatactcctaaatcactatcccattacccaaatgatggagagccaatcaaaagcttagaccaggacgctttcccaaattatgtcccaataccttcacaatgatcactttatatacaatctcactgaatgctcagcaacacacgagagcaatgtttaactgagggcaacactgaggctcaaggagggcaagtgacttgattgctgaggtcacctgctaggtgcaagagctgagaattaatcccaaggctacctggctcaaaaagcctaagctcatctactatacttgaggcgaaatcatgaaagtgtgtttttaccttgcccagaccctgcacactgcatcaaggtcctgagtttcaagcaacagaaatcaactctggttaaattcaatcacaaaggagttcttgggcagcagatctggaaatggagagagaactagagaactaggctcagaaaagcagcaggaatagaggctgcaccactgcaaacacagccaaggttatactgcagggacctgctggttgggacacccaccctgggcactgttgcatgtcatcactggacattagccaccactgctggttttgtgactcaactgccaccaccatgactaatccctcactgtccctcaagagtcaaagtccctgaaggcagaatgggtttggccaaacctaggcttcatcgccatcccctagtttccagagagcaaggggagggaatatatccattcccctgtggcaggcactgccagttgtcccccaacatccatgttctccatctgccttactaatgagaccctgcgctcagctaaggagagttattccccgcttcccagcagaccatgggactacgttatggctaaggagacagtggccgagtgcactcctgttcatcgttctctttcaagcttgctcttgttctactgactatgggcggagcacacctcccacccactgactctgggcttgctcacgtgttgatgggatgggggaagaagaggctttaagaggcttctgtgactctgctcactcctcttggactcctgacctccgcctacgaagagacttcccctggcagctgcttctccctcctgggtcctggaacgacaggcttgagaacagatctgaatcccatcttgcagctgacccagacccatgtgtgagaaataataattgctgttatagctactgagctgctggtgctgtttgttccctaggacaagatgatgggtgtgaagatggaaatggaaatattgaatgggcctagaagttaagatgtcaagtgccattttgcctttcccctatgacctctttcttcctacctggaggagtggatgcaatgactagagcagcaaccgtcatctcacaaccaagaggcaatcttgagaaatggaagacacccactgaggggccctgggtcctggatccttacaaagccactgcagtggtcatggacagcatgagaaggaagtacaccacaggcccccaaccccatcttcaggttttcttaggtagaaactagggtccacctgcctcttactaagatatacacaatggggagacttttaacacaaaaaaaggtatgaagatggtcagaagccaaaaaagcaacaaaatgttcatgatatgccgtatgtggggtttactcactacactgcttttccaccgagttagcataatcactataactcaacccattgaaaaaatgacaaaacagattctgagattctcttcctatttctgttagctaaaaaagcagcctttgaattgtttataagtgaattcaagagataaaaataaacccagataattcagaatgtactgagtacaacacatatgccttctatgtgataagctcccagcattatttattcaaagaaaacttgccttgttgcaaaaatataaaaaaacttaaaaaaaaaaaacaagtaattacacaacacaccacctcctacaacaccagattccttttctttcctttgtaacctgaccagaagaaaaacaaaacattgttcaaattgctgagacccacaaagttcaattagagcataaaaaatgctctcccaaaatatagctactagcagggaaatgagcaggctaagcctcctggtgaacctggacattgggcacaagtaacaggcacatttagacaccaacgaccagattccacatgactgaatccagaaaccctgccccttcccattcccttggagatccagggggacgccatcaattgctcactccttctccttacacatacagttaggggtgctatactatacaggggaaggcgtgaggaagtcacacatgctttggtgttcaagaagctcataaagccattagggaaagagcaacatgccagaaagcagttgtctcttctggctacagaggttgcaaaagacgtctgcaagggtcagtgagggcccaaaggagtagtaaccaaggccctgaagcctgcctgggagctgaggtgggcagtatcagcctcttctcaataatcagttcctaaggttccatccgagaaagtagaaaaccacagaggccattctcatgggtactttaagcagtacatctgttggcaaaacacaaatgttgttacacaaatactaagccacagattgcaaaggcacctgacagcctttaaaattcatttctcttgtttcgcaaagctgcactgggaaactgtgctgttaaattctacactcataaaggaggtatgttttaaaagaggggcaaatatgtgggtgctatttagactctcattgatttgttccatgttttcagataactacacacccctccgcccccgccaaagtaactcaatctccacatatttgcctttatatgtaccttctaactcatgactatggctttgattatctcataaacaatattgttcctgttagccatggagaagctaaggagccaacagcagagcaggctgcatgttcttctgtccctcttataagacaaaaccttagagcaatgtcccactgcagaatttatttgttaattcactcaataaattaaaatatgcatgattctaggcactggggatatattgaggaagaggcaaaaaaaaaaatctctgtcctcatgggactcagattctataggggtggggagagggagggaggggaagggagtgggagagcacaaacaaaaccaagcagtaacacagcttgtggcagatggtgacaagtcctatgctaggcagggggaactggtggggcagaggcaggctgcctgacttacagacatgggtgtgctcggggaaggccacattgggaaggtgacacttgagcagacatgtgtgatacctgggacagagggcagaggagaggtcaaggccttgaggcaggggcatacttggagggtccagggaggagccaggaggccagtgaggccgcagtgcatgagtggtgggagagtggcaagagaggtgatcctgttgggctgtgactctgagcaagcagggacccactggagggttctgaacagaagagcacaatattgcaggactaaacaaagaaccagggggcaagggcagaggcagggaagctggacacctggaccagggtgggggccatggaggcaggggaactcatgagattttgtatccatcttgcaggtggagtaacagtatttgtgaacaaatgaggtaaccagcgccaggtttctggcctgaggagcaggagttggagttgctgtttactggaaaggagaagaccagggaaagagaaggtctagggaggataaggagttcccgtgacccagtcagcctggagacataaatttgggagccatgaggctggacggaatcacttcgggagtgagggtggagaagaaaagcctgaacctgaggccttccaacatcacatgcgaaacagaaaagaccgaggaggacagacattcacacactcacctaggacttcctgaggacccacagacaccaggcactgttctaggagcttgagctacatctgtgaatcaaggagacaatcctgtcctgtggagcttctgctccagcaggggtgacagctaagataagcacagtcagtcatgtattcagctagaaagagacaaaagctgtggtttgcactgagaaggtgcacatcagtgcagagactcaagggagggaaaggattgtctcgtatgggtattggggttaactgacgacgacagctctgggaaaagaagtgacaagcagctcccagatttaacaacatgaaggtcatcactggagacctcatggagcagcttggcagagctgtggcagcaaaggaacaactggagaaggttgaagagggtgtggagacagggactggagtcttgctggtaaaggaaaacagagatgctagacaggtggggggttgggagcagcttttgtcaaggtgggagaagtagcaacaagtttctagggcaggcgagggaggaatctctgatgggggagagtgcagtagaggactggagagatgccttagaacaggagtgagggcctgggacaggcgctccgtgacagcatgagggaggcagagcgaaggagtagacgctggcctgtagacactctcttgagcttgcttctgtgctctctgggaactaagatatcagctgcaaggaggtgtgacagctgatgaggagggtgggaggggctaggagagaccggggaactgcagtatgcaggtgggcttggcggcaagaagtttacctggggtagacatgaacttaaagggggaatcaatgaaggagtcacattcagcttcaggacggagcaggcatggggcagacatgactgaatttcatgaggctggggctttgtcgactgaatataacaaagcaagaaagtgccgaagggctgaggtagtgtgccagggagtaacgacgtctgactggcactgaagctacaaaggagaggaataaggatacgaaggaggtgaagtctgagaaaagatggagccactgatggattctaagtgcctgtgaggtcaaaggagtattggagttgggtattagaggcagtgaaaaggaaaaggatctccttttgcagatcacaaaaaagataaaatgaccagagctaaacaacttttacagcactatccactgtaaaagttgtttgagaaaaaataaaatgtagccagccttcagagcatatatgcatctttattttattttatttattgagaccaagtctcactctgtcgcccaggctggagtgcagtggcacagtctcaattcactgcaacctccgcctctggggttcaagcgattctcctgcctcagcctcctgagtagctgtgattacaggcacccgccaccacacccggctaatttttatacttttagtagagacggtgtttcaccatgttggccaggctggtcttgaacccctgacctcaggtgatctgcccgccttggcctcccaaagtgctgggattacaggtgtgagccaccacacccagcccagagcatatgcatctttaaaaagttgtcttcggccaggcacggtggctcacacctgtaatcccggcactttgggaggcagaggcaggcggatcacctgaggtcaggagtttgagaccagtctgactagcatggtgaaaccccgtctctactaaaataaaaaaaattagccaggcgtggtggtgcatgcctgtaatcctggctacttgggaggctgaggcaggagaatcgcttgaacccgggaatgcggaggttgcagtgagccgagatcacaccattgcactccagcctgggcaacaagagtgaaactccgtctcaaacaaaacaaacaaacaaaaagttgtcttcaagagcataatcaaagatactttcacttcttaatgttttgtttccatgtctcgtcacagaacatggtacagacaaatattagaatagactcaagggatcacttgattttaactacagaaactttccggtgaatcatgagcactgtcttgtttccagctgctgaagtatatgggcaccagacaagagcacagcgctgtcactcaaagccaggagtaatatggctgttaccatgaggactacttagcagaagataagcatctcattatgtctacagtgaactaaactattgttgccaatggtatatggattaggaccgactgccactgcccatctgcttatagcttagaatctggtgaatgcaaacaactgttttggggggacttctggcccttccttgggctctgctatcctggaaatggacaggcttctacaggggttcgatggtagccccgaatagttaggtgtatgtcttaacccccagaccctgtggctctgaccttatttggaaggtctttgcttctgtaattaagtgaaggatcttgatatgagatcatcctggatttagggtgggcctaatacagtgacaagcatccagagaagaatacggggacacagagaaggccatgtgaagacacaagcagagaatggagcaatgcaactgcaagccaaggaaagtctaggactgccaggcagccaccaaaagctggaagaggcaaggaaggatccatgctagaggctctggggggaatggagccctgcaacatcttgatttcagacccctggcttcctgcactgtgcaagaatacagttaggggtactttattctgactactccataaacttaagctctaattctcgctcagcttctgagctttaacaaagggtccgtgcaacttctaccgttcccgttccccgtctttaccaaagaggaagcatttactcaaagcccacctcctgcaacagctctagatgccgcttcccccctccacacaaggagtctgctcctccaggtccccatttcctccttctcacgctcccctctctcctgggccattcccagaaggatgtaaacatgctctcatattcacccacgtgaaaaacaccctcatccccctctaccccactcctatttttctggtcaccatcacaacaaaacttcttaaagagagttgtctatacccaatctccactccctcaccttccactcactccaatctggcttctgtccccatcacctctaattcagttcaccatgtgacaggtagggtttttgctagttttagacataatggatcttgttattcctgggctttaaagccttcaccagaggatggccaactgcctacatgtaattgccacttgacccttcaaacctcaaagaaaccgaagtacagacatatgaaagggaagaaatttctaacagaggcaatagcaggagaggacctctgaacggataagatacactcagcaaatttctagatgctggaagtaggcaagaacatgttgactaatggaacagagaggaatgtactacaagagagctgtagagcagatgagagcctgtatacctgtcagagccccaaagaagctctcagaccagaccagaccagaccagaccagaccagacgagaggaggggcaagcagtgctgtcatgtgtgcaacacctgggggctgctgactgccagatcccgacccacaagctttggggcagggcaccttcaataagctcccaggtgaggctgatgctgttggggctggtgagcagagcaaacttggagtggcaaggtgccacttcttccctcaggcaagaaatcaatgggtcttttctaaatcaacagctagaaccttcccttccccggcccccaccccacccaccccaaaggctcttgatgtggctggcagcagcccaggtgatgcctaccttttcccagtctctgagggtccatggggcaagagctgacccctgcctcgcctccacagaacttctccaaaccacccttcagagacagaccccgcaggcaacgggccactccaccacagcagagaaggggcagcgcagcagctacccaggtcctccccccatccctggcggctcaagaaccagccccatggaagagagaccaagtctgtccttagaggaaacaaataatattctcagagaaatcttagaatacagaatagtcataaaatcagaacagaaacacccataaacaagaaataaacagatgataaaagaaaagtatcaggcagggcatggtggctcatctctggtgacaccacaccaggcgtggtggcccagcactttggggggcagaggtgggaggatcacttgagcccaggagttcaagaccagcctagacaacacagacacacaccagcccatgtctacaaaaaatttaaaaattagccaggcatagtggcacgtgcttgtagtcctagctacgcaggaggctgaggcaggaagaccacttgagcccaggagttcgagtctgcagtgagctatgtatgatggcaccactgcactccagcctaggtgacacagtgagactctgtctcaaaaaaaaaaaaaaaagtatccattaaaatattttcaccctttaaaaatcaggttgtctttttattaccgagttataggaattcttctgaatacaaatcctttgtcagatatgactttctattttttctatgactggtctcaactgttttcttggtggacttgtcttttcattttctttgagacagggtctcactcagtcacccaggctggggtgcggtggcgcgacctcagctcactgcagccttgacctccttgggatcaagcaatcctcctgcctctgcttcccgagtagctgggactatggactacgggtgcacgccaccatggttggctaattttttgtatcttttgtagagatgggatttcactgttgcccaggctggtcttgaactcctgagctcaagcaatccatctgccttgtactcccaaagtgctgggattacaagcatgagccacagctctcagcctattttcttttgttttttctttttctttttttttttaagagacactgtctcactatattgcctatgttggcctagaactcctgggctcaagtgatcctcctgcctcagcctctcaagtacccagtagtgactacaggcaagcctcaccacgcccagctctgtcttttcattttcttaatggtatcttttgaggaccaaaagttttaaattttaatgaagtccaatttattttttcttttaatagctattgcttcatgtatcctaataaatctttttttggcctggcacggtggctcatacctgtaatcccagcactttgggaggccgaggcaggcagatcacttgaggtcaggagtttgagaccagcctggccaacatggcaaaaccctgcctctactaaaaatacaaaaattagccaggcatggtggcgcacacctgtaatcccagctacttggaaggctgaggcatgggaatcgcttgaactcgggaggcagaggttgcagtgagctgagatcgcaccactgcactccagcctgggcaacagagtgaaattgtgtttaaaaaaaaccttattctttggactgcacagatattctcctatgttttcttgcagaagctttatatttttagcttttaaaacatttaggtctataatctctcatgaattaatttttatgtatggtgtgaagtagtgtcatgggttggactatgtcccccaaaaaagatatgttgaagtcctaaccctcagtacctcacactgagaccttagttggaaacagcgttgttgcaggtgtaattagttaaggtgaggtcacactggagtagggcaggccccaatccaatattactgttgttcttacaagaaggaggccatgtaaagacagagacatacatggagaatgctgtgtgatgaggaagacagatattgaagtaatgcagctgcaaatcaaagaatgccaaaggttgccaaccactggaagctaggaagaggcaaggaaggactcccctacaggtttcacagagaccatggccctgatgacagttgattttggacttctagactctggaattatgagacagcaaatttctgtggttttgttttgagacggagtctcactctgtcacccaggctggagtgcagtggtgcaatcttggctcagtgcaacctcccaggttcatgcaattctcctgcctcagcctcctggctagctgggattatatgtgtgcaccactacacctgactaagttttttgtatttttagtagagacaaagtttcaccacgttggccaggctagtcttgcactcctgacctcaggtgatctgcccgactcggcctcccaaaggccgggattacaggcgtcagccaccgcacccagccaaatttctgtggttttaagccacctagtttgtggcaactctaagaaactaatatttagggtaaggtcaaggttcatttttgtctggtatggatgtcatttgccatcatccggcacgtgctaaaagactttcctttcccgcaccggactgttctggtgcctctgttaaaaatcaaatgactataaagtcacatcacataagccccttaattttgttctctttcaagtttactttggatgttctaggtcctttgcatttccatatacgttttatttatttatttatttgaggcaaagtctcactctgttgcccaggcgggcgtgcagtggcatgatcttggctcactgcaacctccacctccgggttcaagtgattctcatgcctcagcctcccaagtagctgggattacaggtgtgtgccaccatgtctggctaatttttgtattttttgtagagacggggtttcgtcatgttagccaggctggtctcaaattcctgacctcaagtcatctgtctgcctcagcctcccaaagtgctggtttacaggcataagccaccgtgcccagcttccatatacattttacaatcaatttctacaaaaaaaaccctgcagttatgactggggttatgaatctacagttcaatgaagggagaactgacactgtaaagacacttagtctttcagctgatgaacatggtacaacattccatttatttaggtctttaatttctttcagcaacattttcagtttcagcgtgtaaatcttgtacatttcttattaaattattcctaacgatattgcatttgaaatttcatttctgattagtttttgaatgatctcgtaccctgagaccttgctgaattcactttttagttctagcaggttctgatagtttctttcacattttcgacattacctacaaatagaaacagttttacttcctttaaatattaatgcctcttatgttttttcttgcctcattatactggctatgacctctagtataatgttgaatagaagtggttagagtggacatctttgcctttttcctgattttcggggtaacatgttcaatatttcacaattaagtacaatctatctgtagctctttcatacatgcacttcctctatttctaatctgctgaatttttatcatgaaagggcactgaattttgtcagatgcgttttctgtatttattgaatagactatatggtttttctcctttattatcttttttttttttttttttttttttggatactgggtctcactgttgcccaggctagaatgcattggcgtgatctcagcttactgcaacctccgcctcttggtttcaaggattcacctgcctcagcctcccgaatagctgggactaaaggtgcgtgccaccctgcccggctaatttttctatttttagtagagacaggatttcactatgttggccaggctgctctcaaactcctggcctcaagtgatctgtccacctcggcttctgaaagtgctgggattacaggtgtgagccaccgcacccggcctcctttattatcttaatgtggtgaattacaccaactgatttttgaatgttgaagcacactcgtgtttctgcgaaaagcctcttggttgtaatatgcaggcgcacctcatttgattgtgctttgctttactgtacttcgcagatactgagtttttaacaaattgaaggtgtgtggcaaccctgcatcaagcaagtttaccagtgccatttttccaatagcatgtgcttacttcatgtctctgtcacattttggtaattttcacaatgtttcaaatttctcattattatatttgttatggtgatctgtgatcaatgctctctgatgttactactatcatcattttgcggcaccacaaactgcacccataaaagatggcaaacttggccgggcggggtggctcacgcctgtaatcccagcactttgggaggctgagccgggcagatcacctgaggtcaggagttggagaccagcctggccaacatggtgaaaccccgtctctactaaaaatacaaaaaacaagctgggcgtgctggcacatgcctgtagtcccagctactcgggaggctgaggcaggagaatcgcttgaatccaggaggcagagactgcagtgagccgagattgcatcactgcactccagcctgggtgatggagtgagactccatctcaaaaaataaaaaaaataaaaaaggtggcaaacttggccaggcggcagtggcttacgcctgtaatccccgcactttgggaggccaaggcgggtggatcacttgaggtcaggaattcgagaccagcctggccaacatggcaaaccctgtctctactaaaaaatataaaaattagctgggtatggtggcgcacgcttgtaataccagctactcgggaggttgaggcaggagaattgcttgagcccaggaggcagaggttgcagtgaactgagatcatgccactgcatgccagcctgggtgacagagcaagactgtctcaaaaaaaaaaaagaaaaagaaaaagaaaagatggcaaaacttaagtgataaatgtgtatattctgactactccaccaatcagctgttcccccatctctctctctctccttgggcctccctattcccttggacaagacagtactgaaattaggccaattaataaccctacaatggcctctaagcattcaagtaaaaggaagagtcatatgtctttctctttaaaccaaaaaccaaatgatcaggcttagtgagaggcatgttgaaagccgagaagccaaaagctaggcctcttgtaccaaagttagccaagttgtgaatcaaagttcttgaaggaaactaaaagtgctactccagtgaacacacaaatgatatgaaagtgaaatagccttattactaataaacgttaaggaagttttaatggtctggataaaagatcaaatcaaacacaacatttccttaaggcaaagcctaatctagtgcaaggccctaactctcttcaattctatgaaggctgagagaggtgaggaagctgcaaagtgtattgtttaatttttaaatatttggggctttctctggatcttccattatttcttttttttccccccactcactctgttgtccgggtaggagtacagtggcacaaccacagctcactgcagcttcaaactcttaggttcaagcagtccctccacctcagcttcctgagtagctgggactacaggcgagcgccgccatgcccagctatttatcgtaatattggtattataattttgtaattttatgtctattacaagataaagcaaataagtaactatgttaacattagtaagacccaacattttcagtgtaaggaaaagatatatacagatcaaataaaagttggccaggcatggtggctcacacctgtaatcccagcactttgggaaatcgagatgggaggatcacttgaggccaggagttcgagaccagcctgggcaacgcaacgagaccccccatctctacaaaaaatttttaaaaattagctgggcatggtgatatgcacctgtagtcttagctactcgggaggctgagggaggaggattgtttgaagcctaggcatttgaagctgcagtgaattaggattgtaccactgcaccactccagcctgggcaatagagcaagaccctgcctcaaaaaaaagaaaaaaaaaaaaaaaagttaaggaagaaccctgtaatgttaaattgccatagaagacatcattatgtatttatgacttaaaaaaaaaatggagggcacagtggctcacatctgtaatcccagcactttggtttttttatttttcttttgtgaaaatatttaccagcagtttgccctgacagatgtaatcccagcactttgggaggctgaggtgggaggatcgcttgagctcagttcgaaaccagcttgggcaacatagtgagaccttgtctctacaaaaaaattaaaaataaaaaataaaaactgaatatattttctagcgatgtcctctgaaagtgcctagatataatgttaccccagtaagaatcagcacatttagtacccacatgttggattctaaataccgttgccactataaggaaccagagctccttggaatcagttctaggacacgaaaagcacatattgggatggaatatcttgtgccagaaaacaagaaattgctcaaagactaattaatgagggtatgccaggagaatataggaaccaacatgaagggactcttgttgacccaatttgaattgtaaaacatttaataaataaatccctatgagtccatattgacatgaaagagaaaaggaaacacaacagcaaatattttgccaccatttgaggtgattattctaccaactccttactctgaaatgtaataaaggcaaagattaagcatctatactgtctttttaggaggaaatataatgcctccttatttgatgagggaaaattcattacagaggaatgacagtactaaatgtagaagaggtgacaattaaaaaaactatcattttgcaacccccaatgtaataatggtttcaggcaaggatcaatgaatgctaaaataattatgcaaatggctgttgggcaataggatatttgtatggtgccaaagcatcacatcacagattatatatcaattaccacaggaaaactgtatgtctacaatggggagatttggcagtcacctccttctttaatcaagtgttaaaacgtagcatcacaaaccacagggtaaccaaccattaagtgcctggtgagctgatgctatatgaagtacacagtactgcctatgaaatattcttgcccaaaatgtttaacctgaacatgcctgtagacctaacttcttgtctacaagtaatatatatggacaaacaagttaaattatatcacaagaaaagagagacatctaaaatgtgggccagctagtcgtggtggcacaagcctgtagtcccagctacctgggaggctgaggcaggaggattacttgaggccaggagttcaaggccagcctaggcaacatagtgacacgccatctctaaaaatatgtatcttaaaatgtgggcccttctagatgacaattgggctgactgcttcaaaaagtcagtatcacaagtgaaggagaggtgggtaggctgttcttgttaaaagagacaaaggggctgggcatggtggctcacgcctataatcctagaactttgggaggccgaggcgggcagatcacttgaggtcaggagttcaaaaccagcctggccaacatggtttagtagaaaccctgtctctactaaaaatacaaaaaagttagctgggcgtggtggtgcgtacctgtaatcccagctatttgggaggctgaggcaggagaatcgcttgaacctggaaggcggaggttgcagtgagctgagatcacaccactgcactccagcctgggagacagcgagactctgtctcaaaataaaataaataaataaataagagacaaaggaagcatattcaaatgcaatgtataaatcttaattgctttggagcccctcaacagcgataagagacatttggaggaaatctgaatttaaagtgggtgcctgataacattagagaattattgttaacttttaaagatgtgatcggggtattgtgcttatattggaaaatgtccttatttttaggagatgtatactgaagtacttaggggtgaaatgtcgtgacatctgtgagttccttttaaatggtgagcaaaaaggtataaaaatgcaccctatctatacagaccaggaaaatacgccaaaatgttaacaattgtctaatctaggcagtaggcacacaggcttcacagtaagttaaaaaaaaaaaaaaaaaggtttggctgaaataaagaatttaacagaagggatagaaaataaagtcaggaggctgggtgcggtggctcacaccactttgggaggctgaggcgggcggatcacttgaggtcaggagttcgagaccagcctggcaacatggtgaaaccccatctctattaaaaatacaaaaattagccgggcgtggtggtgcaggtctgtaatcccagctacgtgggaggcagaggcagaattgcttgaacctggaaggcagaggttgcagtgagccgagatcaggctactgcactccagcctgggtgacagagcaagactctgcctcaaaaaaaaagaaaaaaggaaaaagaaaataaatgcaggagatcttccaaaattcagagcaccccccaccgcccaataaatgaaaaatatgagagaagacagaagaccaatataagaggtccaaagttaaacagtagtccccatagagaaaatgaaagcatgtaaattagtaatttttttttaaaaaaaagagttgacaaaagtattcagattgaatgaccacagtacaacgagtgaacaagacacaactctagacatattctcatgagatttcaggacactaaaaataaggagacgaaatcctaaaaacttccagggaaggaagagaaaagaagggcacctacaaaagaaccataataagattggcatcaggcatttgttgcatttgttactctgcatactagaagagatgcctccaaagttaggagaaaaaatgattttcaacttggaaccctatactcagccaatcaagtgtaagagtagaagaaaggtatttcaggcatgcagtgactcagaagacctatctgttacaatgcttttggttacaagtaacagaaaagaaaactgaagctggctcattcagtaagaaagtccatcctatctgagtccctagctcaggtaggacaggccccagccacagtgcaatcaccagctaagcaacggcatcaagacccaggttcttcccgtttctctgctccgccttccttggtgagcaggctttatcctcaggctttgtccctcagtctgaggttacagaagagcccccagcaacacctttctcacttactccagtgagagaaaaagagaaagtcttccctgaacgtgccatggaagtccttcccttcagtctgagtgaaccaacttagatcgtatgtccatccttgaccagtaacagttgccaaaggaatgcaatgtgtggaatgacttaaggatcctttctgaagttgggaataaggtagaaaggtgaataatatcaggattctgttaggaatgggcaaagaagaaatggatatggggtaggtgacaacggtatccactacagtttactccccatgcactctatctgagcacattatttaaggatgcagtccagaaaacgagggagtaaaccatgtgaaaggaagatatgggttttaagacacgggctccaacccaagagcccagtgaggagaaggtccaggtacagctgtatatgcaaccttaaatcaaagagcagatacttgcccagattgcagaagggcagaggccttccaagagaaaggtcttcagtggggaaaaagccgaatcgtacgaaataaacagcactgctaatagcattttacaacataatcaaggaggaatagtaaacaaaataaaaaggcaactagaaatggtgggcaaaacaaagagctatataagcaagccaaggtttgaatatgaagtagattaaatcctagcaaggattttaagcaggtgacagagtctaagaaaagggaatccatttgaccttgattggtcattctcctttgagtggtccagatctgtaaagaaggaaatgtaatcctgggcacattcattatttggtctcgccaagaacaatactcacatgtgtaataatgtaaataatgttattttcgactttagaattaagctacaacttggctgtggttgcagggcagaacacacatgttaacaaatgcaagaatgggtatggtcaagtacagcttttaagacgcagaagttaaggagggaaagtggaaggaaaagtagggttattaatatccttatcttaaaaagaggggaactgacatatggactaaaatactgtttaaaatttacagagaaatgtgggcttggcatggtagctcacacctgtaatcccagcactttgggaggccaaggcaggcagatcacctgaggtcaggagtttaagaccagcctggccaacatggtgaaaccccgcctctactaaaaatacaaaaattagcccagtgcactggtgtgcgcctgtagtcccagctactcaggaggctgaggcacgagaattgcttgaacccgggaggcagaggtttcagtgagccgagatcacatcactgcactccagcctgggcgacagagtgagactccatctcaaaaaaaaaattacagagaaatgtgaatatgaatttcaacatggggaggtaacgtaagctaagtcattctctttcatttcagggagttaacacagttccctaaagttggcaaatcaagaaagatgtataagcatatgatttaattttggaggtaaccatcaaaggaactaaaatcagaaacagttaaaagctgtcatgtctgagtcagggaagggaaggggaaggggtagactgctgtttttacgatgacctcttttgttatatctaacttgttgccgagtagttgcaatattttgataaaaattcaaaacccaaaccaccttacccttcatgttttctatcgctctgatgttaacattcaaaatcctgcatgatccagcccctgttgacctctctgatggcccggaccctttgccactctcccctaacccctcgttcagctcctgccacacaggactaagctcttgccagactgagggccttcacacatgctcttctccatctggaaagcctttttcctctctgcaccttgcccacttctgttcaaccctcggttccctgcatcggcgttgcctccttggggaaggcaggctgagctgttcccccattgtacagtcatgagtcgctcaacaacagggatatgttctgagaaatgtgtcattgggcgatttatttgtgctaacatcagagagtgttcttacacaaatctagatggtgtagcatactacacacctaggctatacggtatatagcctattgctcctgggctataaaactgtacagcatggtactatactgaatactgtagatcactggaacacaatggtaagtatttgtatatctaaacatagaaaaggtacagtaaaaatatggcattctaatcttatgggaacaccactgtatgtgtgctctgttgtcggttgaaacgttgttgtgcagcacgtgactgtagaggactggagtggctcccacctccatacttgtccttctgaacacttaagtactggtacaattatctaagatctgtctctgccgctaaagtcaagctccatgaggacaggtaccaaatctgtctaggttaccccatccctgcctaacacagggcctgaggtactatagataccttacttactcaattgtggaatgaattgatggactatagcctgatgtactgcaaatccttcagcatgcagcaggaatggaacttggtgtttaaactaaactataatggctagatgaaaaagagactaaatgtgaaataattccatcattcagaattgagtgttggtataacaaacagacccatgaaatatgtagcgtttcacaaggatatcagtgaggaagttgttcaatatgtcatccgaagtcccgttgcataatgatacttgcacacgcatgcttatagcagcacaattcacaattacaaaaatatagaaccagcccaaatgcccatcaatcagaaagtgaatagagaaattgtggcatatatatacaaaggaatactactcagccataaaaaggaatgacttaatggcattcacagcaacctggatggaactagagactattattctaagtgaagtaactcaggaatggaaaaccaaacaccgtatgttctcactcataagtgggagctaagctatgaggatgcaaaggcatcagaatgatacaatggactttggggacttgagggaaagggtgggagggggtgagggataaaagactacaaattgggttcagtgtacactgctcgggtgatgggtgcaccaaaatctcagaaatcaccattaaagaacttactcatgtcaccaaataccacctgttcccctaaaatctatgggaataaaaaattaagaaaataaataaaattttaaaaggaaggtcatccctacacttcaagttataaaataattctaccgtaaaaaaaaaaaaaacacacacacacacaacaacaacaaagtcctgttgcgtacctctgagaggtgttttgtggcttggactagcatactggcagtgcagatgctgagaagtggttggcctaacaggacttgctgacagatcagggatgatgagagaaagagcagaatcagggcgggtgcagtggctcacgcctgtaatcccagcactttgggaggctgaggtgggcggatcacaaggtcaggagttcaggaccagcctggccaacatggtgaaaccccatctctactaaaaatacaaaaaattagccaggcccagctactcaggaggttggggcagaagaattgcttgaacccgggaggcggaggttgcagtgagccaagattgcaccactgcactccagcctggatgacgagaatgagactccgtatcaaaaaaaaaaaagaggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagatcgcgccactgcagtccgcagtccggcctgggcgacagagcgagactccgtctcaaaaaaaaaaaaaaaaagaaagagcagaatcaaggatgactcctagaattttggactgagtaactgggtggatgttgatattgtttactgaaatagagacaacatgaggaataggtttgaagggggaaaaaaatcaagactgggacttgttaaatttgagacacttatgagcaactcaagtaaatgctgacgaggccatcaaatctggagctcaagagagaggtttgaaatgcagaaacagggttgtagccatcagcaggcagacatatcatcattcagagtcatgaacatgcagaaataatggaaatgcctcttaattaaatgaaggcatagacatacaacgaaatgttatgtgattactaaaaatgatggtagaaaaacattatccagaagttatctttatctgtagatgacagatttatggacaatttttacttttcatctttgcatattttctgaaaattttttgtccattgaacatgtattacttttataataagaaaatgcaggctgggcacagtggctcacgactgtaatcccagcactttgggaggccaaggcaggaagatcacttgaggccagcagtttgaggccagcctgggcaacatagtgaaatcccatttctgcaaaaaatattttaaaaattagccaggcgtcgtgacatgtgcctgtagtcttagctatcttggaggctgaggtaggtggaatacttgaaactggaggtggaggctgtagtgagctgtgacatcactgcactccagcctgagcaacagagcaagagcctgtctcaaaacaaaaacaaaaacaaaaaagaaaatgcaagttaagttattttcattttagggaaaagtgaagatatacgtctatttttatggacatggatatttacaacattttgttgaggaaaggtagcaagttacaaaagtacatatatgatctcattcatctaaaacaatatgtgggccaggcacagaggtgcacacttgtaatcccggcactttgggaggccgaggcggaaggatcgtttgagcaaaggagtttgagaccagtctgggcaacatggtgaaactccgtctctacaaaaaaaatacaaaaattagctgggcatggtagcggacacctgtagtcccacctacttgggaggctgattgggaggatcacttgcacccaagaggtcgaagctgtagtgagctgtgattgcaccactgtgctccagcttgggcgacagaccttgtctcaaaacaacaacaacatgtgtacgtgcttacaggcaaataagaaagactctagaaggatgtttaaaatgccaacagcaggcccagcgtggtggctcatgcctgtaatcctagcactttgggaggccgaggtgggcagatcacaaggtcaagagatgaagaccatcctggccaacatggcgaaaccctatctctactaaaaatacaaaaattagctgggcatggtggcgcgcacctgtagtcccagctagtcaggaggctgaggcgggagaatcgcttgaaccagggaggcagaggttgcagtgagctgagatcgcaccactgcactccagcctggcgacagtgtgactctgtctcaaaataaataaataaataaataaataagtaagtaataaaataaaatgccaacagcaaaagtaacttttaggctattatgcaccaacaaatttatgtgatatcgagaagtgttaaacagttttagttgcattacactttgcataatatacacaaaacactaaacatgttaataaatgtttgatataataagatgacctaagtttaagtgtaattttgactccttttactgtacctgtgttttcccccactaactgactagtcaagtgctgactggtttttaagagatggggtcttgctctgttgcccaggctggcctcaaactcctgggctcaagtgattttcccacctcagcctcccaagtaggtggaactacaggtgtgcatcaccatacccggcttaacgtctgtttttatatttgtagccacatggtacaaagtacagaacaggtgttcttaacctttttctgccatggacccttttggccttctggacccctcctcagaagaatgttttgaaatgtgtaaaatgcacagaaattaacaacatatttcaagagttcgttctcaaataatatgtgcttcttcagtaaatcattaaataaccagatctagagatgggtctaataattaccttaagtttgaagcagtgatggacatatatatttcaaaatatctgtaacaactataatatgatatgaaagtatctttgatctctactggtgacagtcactgctattctaatactaccatgatctgttgcttacaattgtcattgaagaaaatgtggatttttttttttttttttgagacagagtctcgctctgtcgcccaggctggagtgcaatggtgtgatcttggctcactgcaacctctaccttccgggttcaagtgattctcctgcctcagcctccggagtagctgggattacaggcgcccaccaccatgcccggctgatttttgtatttttagtagagacaggatttcaccatgttggtcaggctggtctcaaactcctgacctcaggtgatctgcctgcctcagcctctcaaagtgctgggattacaggcatgagccaccacacccggctggattttttttttttttaaaagacagggtcttgctatgttgcccaggctggtctcaaactcctgggctcaagtgatctgccctccacgggcttccaaagcactgggattacaggcacgagccaccatgcccagctaaaaatctgggttttcagagacattagtgaaaataaagagtgaatgtttttcccatccaaggtcacagacccggctgaattctcaaccaaagttggaggccttggtctagaaagatacataccaaatattaacagcagttttttttttttttggatagtggaatcgccagagtgattctattttgttttatgatatttttgtagagatagggtctcaatatgttgctcaggctggtcttgaactcctgggctcaaaagatcctcccaccttggcctcccaaagtgctgggattacaggcgtgagccatggcatgcctggcctaattttttatctttgtacctatacgcattttcaaagttttgtacaatgatgttttacaattaaaatttataagagcttaataaatactatgtatttgtttgtcttaaacaacctggaaggatgactaggaaattttatacaactgactacagatgttcaaccttctataactacttaagtgttatgatgactctaatcattcccatgttcttacaagccaagaaaaaaactcactagaattatttattctggagttaaaaagaacaaaaaaacaaactgtcacaactgcagacatttgtctatttttttgccaagtgtaattccaaaaacagctgaaaatattagaacaaattagtacttaatatggactaataccttctgctgtttacaaaaacacaaaacccggaagtacacagaaacttgtattttaaaaataagttattgtgtgtagaaagacttaaaatacaacttatctaagtaatgccaaaacttacataccaccagacaaagtgctttaatgctttatttttatttttttgagacagagtctcgctctgtcacctaggctagagtgcagtggctcgatctctgctcactgcaacctccacctcctgggttcaagcaattctcctgcctcagcctcccgagtagctgggattacaggcgcccgccaccatgcccggctaatttttgtatttttagtggagatggggtttcactatattggctaggctggtcttgaactcctgacctcaagtgatctacccgcctcggccttctaaagtgctaggaatataggcgtgagccaccacacccggccgaaaatgctttaatgttttaaaaaatgagtcatacatagaaagtaagcacatgcttgaaagtgctcatgttcaagttttagcagcaatgtggaatgttgcaaaagagacagggacacagggaaatgtgcatatctcagaagcctactttgctttctttcaaatctaaaaataaaacctttggactgccctattaataagtctagaaaatggatgcttttttttgtggaaagctttcgcaaacatggaaataaaaatatcttcttctcggttaacaggactaaaggatgtaaacataaaccagatgccaatccttgtttctctacaatccccttctccctcatggctctggacaggcttctattgtaaaactatttctatggcacaaggagacatatcaaatgaatgaacattggtctgcacggagcaatacagaccaggttcaaaagtcaaatgttgagtgaaaagagtaagttgtaggatgttccacatagtaggatatcatccagtaaatttgcaaaacactttattccatgttgtcatgtgtaatacaacaaaaaccttgcatggggagtatctcggtgacctttagggagcaggctaccttggggaagcagggcagacaaagagtgcaaccacagggctgggaattcagctgaatctgtcctatttgagttccatagtaagagggctgacaggaatacgaccaactgataacatttcctaagtctgggtgaaaagtacccaaacagctactacttgagctgagcgtagaagccaggaaggaagagggcgggggaagacaggaccttagaatgacgccaggaagaatggtggaagagctgacagcatggaggaagagctgggaacagcgcttagggcccacctcctgagcccaggcttggggagttacagcagtgctgtccacaggggctcatcagagtggacctggtacttgacaagacaggagtcagcttgctcacacactgcttcctttaccatcaaagtcttatgtaaaaataaaaaataaaaaatcagtagaactaagcagcgtactttgtaccacagctgactcccattccatgtaagctcctgaccttctcacagcccagcactttcgtgcattagacaatgaactgtgctggagaagatgatgcctgttcccatgagtctcccaggtctcctgggacagaagtgaagggaaagaagggtccatgaagagacctggagtggagtgggagccccaggggcccagtggatagggtggggtggaaaaggacagcatagatgggcagagcacctcacgctgccttctggggcccagggaacatctaagagtgtgacggggcctggaaagaaagccgagcctggccgggcgtgggggctctcacctgtaatcccagcactctgggaggccgagacgggtggatcacctaaggtcaggagtttgaggccaacatggtgaaactccgtctctactaaaaatacaaaaattaaccgggcatggtggcgggtgcctgtaatcctagctgcttgggaggctaaggcagaagaattgcttgaaccctggaagtgggggttgcagtgagccgagatcatgccattgcactccagcctgggtgacagagaaagacgtctcaaaaaaaaaaaaaaaaaaaaaagaaagaaaaaagaaaaaaagaaaaatgctcctctccacatgtcctggctggttgttcatgcctcgtcttcacacagtggactctctgaatgggcctgagagattctctcctgtcagagcctctacacatgctggtccttccaaaagactcatgcatctctccccactgatgctttgtccttgacctagctaatgtttccttgctgttcaggtcttagatgccatttttcaaagaagtctcctccctgacctacctcccaattcttggtaggatctcctctgatttttatgtgctcccttagtggctggaacttctctccatcacagaagttagcctcttgtaaagtcatagcccatttgcctgtctgtacctcccattagaccagaagactgctgagggtaggatagtttccagcagctagcacagtaactgacacataataaatgctcaattagtacagcttaaaaaagtactgctatataaagagttcaacagtcacagaacaacaaagcaaccacagcctgttcctgaatacttctaggacacctcttatgcatattacagcatgaggaggcagaaggtccagcagcagagggagattctccaaccccgagtaccaaggaactaccacaacctagaatggtcccaaaataaaaatgctccactttcttcaaggttcacaaacaagaactggcaagttccccttgtcgagtaaaaaggtccttccctcacatgccctactcagatgaggtcacttttgatgaaatggaagtttccaaagttttgctttctagtgctaactgctaaaaacttcttcctagcctaacagctctgtgatctctacaaacagtattgcagtgataaattcgtatgcttatctacttacacgcaactttttctctaatggtctgcaaataaaaggctactcttgtcgggctccatggctcatggttgtaatctcggcactttgggaggccaaggcaggaggattactcaagcccaaggagttcaagaccagcctgggcaacacagtgaaaccccgtgtctaccaaaaataaaaataaaaataaaaataaaaaatttagccaggcatggcggcacatccctgtagtcccagctacaagagagcctgaggtgggaggatcacatcagccccggagttcaaggctgcagtaagctatgatcatgctgttgcactccagtctgggtgatggagtgggatcctgtctctaaaaaaacattaaaaaaaataagtaaaaaatttaaaaactggttaaataaattgtggtacatccataacagactatttaaacccaacccttaaaaggaatgatacggctctgtatgaaccgattctaaataatctacaggatacattaaaataaacaaatgtgcacaatattttatagtatgtgtaaaaacacaacgcccacatacccttgtgtatttatacacacatgtaaaatatatacacaaacctaaacacacaaaaatatgtccaatagagacaaagagtagaatagtagttgccagagggtggggtgggggaaaggggagaagtgggagttagtgtttaataggtatgaaatttcagttttgcaagacgaaaggttgtagagatggatggtagtaatggctgtacaacaatgtgaatgtactcagtgccactgaactgtacagttaagatgattaaaactgtaaattgttatatatatcgatatatattttttgagacggagtctcggtctgtcgcccaggctggagtgcagtgacgcgatctcggctcactgcaagctccgcctcctgggttcacgccattctcctgcctcaggctctcagagtagctgggactacaggcgcccgccaccatgcccggctaattttttgtatttttagtaaagacgaggtttcaccgtgctcgccaggatggtctcgatctcctgacctcgtgatcagcctgcctcggcctcccaaagtgctgggattacaggcgtgagccaccacgcccagcctgttatatatattttataataaaaatttaacacacgggtacacacacgcttttttttttgagatggagtctcattctgttgccaggctggagtgcagcggcgtgatctcagttcactgcaacctctgcctcccaggttcaagcgattctcctgcctcagcctcccgagtagctgggactacaggtgcccgccaccatgcccggctaattttttgtatttttagtagagatggggttttaccatgttggccaagatggtctcgatctcttgacctcatgatccacccacctccacctcccaaagtgctaggattacaggcgtgagccaccgtgcccggccacaatttttttttttttttaaagaaacaggtaatagtggctgcctccagggaaagaaatgaatgtttggggcagggtagcagagatactttacaatataactcttttttttttttttttgagacggagttccgctcttgtcgtccaggctggagtgcaacggcatgatcttggctcactgcaacctctgcctcccaggttcaggcgattctcctgcctcagcttcccaagtagctgggactacaggcacgcaccaccacgcttggctaatttttgtatttttagtggagacggagtttcaccatgttggccaggctagtctcgaattcctgacctcaagtgatcaagctgcctcagcctcccaaactgctgggattacaggcatgagccaccatgcccagccccatataacttttttctattattatttttctgagatggagtctcactctgtcgcccaggctggagtgcaatggcacgatcttggctcactgcaacctctgcctcctgggttcaaacgattcttctgcctcagcctcccgagtagctggattacaggtgcataccaccaagcccagctaatttttgtatttttagtagaaatgatgtttcgtcatgttggctaggctggtctcgaactcctgacctcaggtgatccacccacctcggcctcccaaagtactgggattgcaggcgtgagtcactgtgcccagccccgtataactttttacaccacctttttaattccgtattgtccatctaactattcaaaaaatcatttaaaaaaccccggccttatacaagaagtcttttccttaatcgtgtcatttattctatccctcttcctttaagtaaaaaatattttcaatcaaaatcagaattcgacttcagctttgagggtatttattagattcaaataatgcaatttataaaaattacacttgctaccctaaaaatatattcactaaaagccttttctttttttcttttttctttttttttttttttaaagagacagtgtcttactctaaagaacgaggctgcccaggctagagtacaggagtacagtggtgtgatgatggctcactgtagcctaaaactcctgggctcatgggatcctctcacctcatcctcccgagtagctgggactacaggcatgagccaccatgcctggcccctctatttttatcaggtgttacagaaaagcttcaaaatcatcatggaagaaaattatcatttttaccagtacaaaacttttattgcatcccaaccaagctaagatgaatacagaattgtttcaacagaagttaccattatcataattcaagacaaaaatcagccggcaattacatgagttggaaaacaaactactcttatgtcacagtctaccctaaagctccaacttatgtcagaatttaaaatacacacacatatacacaaccctgtggattcctcctcatttatgtaaaacctacttttgtgatgatctgctattttcttgagtcttctggaatgaacactgtagccccactcccggataaggagaagataccacttccagggcttagcactgcccctggcttgaagcagatactcaaatatttgttgggtgaatgaatgattgtctgctgatagggctgcccatcaagcctcataaagaaaaaattcagaaaaaagcaactttatagagaaaataggaaaaagtttaagagatattttgctcacttgaagaaatcagcatttgttaaaggtgaagactggattgactggttcatcaagtggcttagacacaactgactaagtgggctataccttatcccaccccaaagttaaatacaaaacaggtatttttttttttaatcacaggaaaaacacagggcaacttaactataaaattattatttttattttttatttttgagacagagcctcactctatcgcccaggcaggagtgcagtggcgtgatcttggctcaccgaaacttctgcctcctgggttcaagcgattctcctgcctcagtcaccccagtagttgagattacaggtgcccgccaccacgcctggctaatttttgtatttttagtagagacgggatttcaccatcttggccaggctggtcttgaactcttgacctcaggtgatccacccgcctcagcctcccaaagtgctgggattacaggcatgagccaccgcatctggcccttttgtatgtattaaatacgtatgtatgaatataatacatcatcaggttttttaggaagaaaatatagatgactattgatctgttgttaagagtaggaaaggatttcctggcggggcgcggtggctcacgcctgtaatcccagcactttgggaggcagagacgggcggatcacaaggtcaggagatcgagaccagcctggctaacatggtgaaaccctgtctctactaaaaatacaaaaaaattagccaggcgtggtggcgggcgcctgtagtcccagctactcgggaggctgaggcaggagaatggaatgaacccgggagatggagcttgcagtgagccaagatcacgccattgcactccaacctgggcgacagagcgagactccgtctcaaaaaaaaaaaaaaaaaaaaaaaaaaagagtaaaaaaggatttcctaagtatgaaagcaaaagaataaatcataacataaattttatatatcagaaagacaagaatcaagacgtaagacaaaacaggaaaatatctgcatgacaaagagttaacatctttaatacattaagagctatgacaatgattattgaggtttagcctcagtaataatccaagcggcaccaatttaaaagatgtatatccaattctgggacgatatgggaaaatggcactttctcagactgttgtgggaactgggatagccattttggacagtgatgtggtggtatccaccagaaattccaagtctaggcagccattcttcaaaatgactggcacatgaggaatttcaatcctgtagcatttttaataacatagagagacaacgaaatgcatgacggtaagtcagccctggactacactgctatttaaaagaaatgaggcagagatgaatatatgagatggaaaaatgcagaatatgtatatataacaccatcctgaggccaggcacggtggctcacgcctgtaatcccagcactttgggaggccaaggcaggtggatcgcctgaggtcaggagttcgacaccagcctggccaacatggtgaaacccatctctactaaaaatacaaaaattagctgggtgtggtggcaggcgcctgtaatcccagctactcaggaggctgaggcaggagaatcacttgaacccaggaggtggaggttgcagtgagccaagattgtgccactgtactccagcctggatgacagagcaagactccatctcaaaaaaagaaaaaacaaaacaaaacaaaaaccctcctgttaattacaacacaaaaagtacacagtttagtcttagaagacttagaaggatctacattaagctattaacagcagttattctgggtagtgggagcagagattaagcggggagctttcatttttttacctgatacttttttttttttttttttttgagaccgagtctcactctgtcacccaggcaggagtgcagtggtgtgatcttggctcactgcaacctccgcctcccaggttcaagtgattctcctgcctcagccttccgagtagctgggactacacgctcaagccaccatggccagctaatttttgtatttttaatagagatggggtttcgccgtgttagccaggctggtctcgaactcctgacttcaggtgatccacccgcctaggcctcccaaagcgctgtgattacaggcatgagccaccttgcccagccacctgatcaatttttaagtggtttgatttttctataaatccatgtattattttagtaattctttaaaaagtaaaagaagaaaaatagatatcaagcatttatctactaaagacgggtactgtcctttgagaattccctcaaaagttctttgaagctcaaatggctacatctttcccattcataagatactttttaaatttcctctttctacatttctttttaaaagtttattttcaattagcttcctcaggttgaactctctgtacatttcttaggagaaactgtatggtgtcaacactgcctgttttataacatccattcgtaatctgtaatctgagaaaaagactcgtaaaaacccaaaccaccctccaggcctaacatcttccagaagaaacccattcactgcccatattacatttagtccacacaatttctgagacaaagcacaaagcactagccatacaactcccaccagcataaatacgtggagtacaaagaatgtcctgtcagctgggcccagagcacaccccacagcagtaaaagagaatgacaatttgagtcacaggatcaggagcagaatcaaatttgggacttgaggcagtgtgatgctcttctggtcttccgcttccttccacaccttctattctccttcagccaaaccttgccctcacataatccctaagcaggctatttcttatggatgtctacaacagcttcacactgaggtgtcagaaaccactagagagacaacaaagaacgacttagggtctcagtcggaatcacaatggccgcataagtgaaaactcacatttttgcttaggggaaaaaaaatgggaaaattcaattggaacattctgctttaccacacagaagttctgaaatccacatgtcaaaacatcaaatgcggagtgaccactaatcaaaaagacaaaacaaaacaacaacaacaacaacaacaacaaacagcttgagatgttgagcctgaaggttgagaaattaaggaaccattcatttttacaaaactaaagtccacacaatggtgccaagtagttcaaactgcagctgatacagcacctgagtgtcagacctagaatgactggggcccccaggtttttacaaagtactcatcctcctctagagtcccaagaaccagatgtatatctgggtactctctttagttaccatgggaggagtgtagcaagcacatgacattagccatggcccccggtgttctgagacagctttcaggagggtgtccttctagggaaccaaccacataccagttcccatatctgaaaatgcattaccactgctcactaatgttgaccactaagccatttaccccaaaccaaagcaaacacatgctgaagaccgctaaggcaacagcagcagcgcaaaagggctcagtgcaagcgctctcagctcagctgacctgcttcaaggtgaactgaagttgcagatcaccagttccggctctaatctgacgcccgcccccagatcacgctgtggcgaccaagtaaccctacacacactgacctttcagggctcagggaagtgacttttttttattatatggcacagtttggcacagttatgtctttagtctttggggtacttttatactgtccaagagtagtatatttttttcctcttttccttttttttttttttttaaaaaaaaaaaaaacagatggccaaaccaggacatatactaaaaaaaaaaaaaggaaggttacttacctgagccctaacatcccagctaccatggaatcctgttggagctggtctacagaagcaaggtgtattctggggagtcacatgtcacatcaaagcaggaactggtgagtctgtatttttatggagcctaaaacaaagaaaattgtaagttgaaagcccccattgagctgcacgacctttttcccagggctatttgggacattttgaagataaacacatagacaaagtactaggctatttcccagcttacctagctagaaacaaaggataagctgcaaattactggcacgtaacacacagtgctaaaataaaggaaagattcatgcttgttagaatcaacactatcacaagccttgtcacctctaggggacacttcgacactacaaaagcataccatgagtggcgatttctggcaagtatttcttctaccacggcacacagaaattctcagggaagaatacatgttcaagagaatacgcaacatcaaaataccatccctgaaagaacacatggaacctagaggcagtctcccttctttttcaagcagctgaatgaagttgcaataagctgctgtaacaacatcacataaaggggctttaatcctgagagaaaaaatcagcaccaagggaaaccaagtgctctgggagacccaaagccatcatccaaaacatgcaagtctatttcagggcaatcagttttaagcctctcagatcagtcaatctcgatgttcaacaaactcagttattagtttgatagtttctctttttcttttgaacacatgttcaaaaaaggacttttgtcagtaccttttttgtcattaagataaccatcatttcctagttaaagcctaaactgccccatatgaattagctaatttctgatactatgctggcccaagagtagcacttttataagctaaaaacgaaagctcagagcatacaacttagagactattcacacaattactcatgtaatcaaacccagaagaagggcaacaccaaccaagtcttttactggtctgttgctgctctacagctaccaggatggtacctaaaattatcttttgaggttcagtgaggcctcataattcccttaaacagtcaagtcatagaatactttgaaatcccagaagtcaagttaatagtattactcggctagctatataataaaaaccaaactggtatcctggctaggaggccctggaaaagtcacaacttctcagggacacaagttttttttgtttgtaaactgatggtgctggactaagaatccttctagttcttaaagtttaagataattaacttaagatttcatgtcaaaaagaaaagagccagaggctgggtgcggtggctcacgcctgtaatccctgcactttgggaggctgaagcgggtggatcacgaggtcaggagttcaagaccagcgtggccaagatggtgaaaccccgtctcgactaaaaaaaaaaaaaaaaaaaaaaaaaaaatacaaaaattagccaggcgtggtggcaggtgcctgtaatcccagctacttgggaggctgaggcagagaactgcttgagcccgggaggcagaggttgcagtgagctgagatcgtgccactgcactccagcatgggtgacagagtgagactgtctcaaaaaaaaaaaaaaaaaaagaaagaaagaaaagagaaaatgagagcagtttatgaaatctaaaaaagaaagttaatatatatataaaacacccctagctcttgggctaggaagacaagtgcatccttactaaggcttggtcctgtcaacttcagaggcaataatgagagcccagactacagtgtctacagtaactgcaaaacagccacacagcacagcgggaacacattcacacgccaggagacccagcatacatgtgcttgaagaagttataagactcaggctttattctctaacgaaatggtcattccccctttgatgtgggggtgggggtggggatgccctgcccaccccccaattccggctcccactcagttatcccacataccatacataccatcaaagtatttaagcaatggcatgcaaagcaagctttcgacaggtttcttgcaagagaaaggcagaagagaacaggtaaaagcagaagagcacacaggtaaaagcagaagagcacaacttctacttaagcccaaagaagagggacctgttcacatcttgtcctacccggaatgatgcacacgcacaggggcttgccgggacagcagtagtttcactggaaagggctggtatggaggcaccgaggacaaggtccttccatcgcagcggtgataatgctctacccaagaaaaaaagattgcgtctgccagccacgcaagactggtctgcaaggatgtcaccatagcagagggcagggaaaacaagcaggtgtcctgccacactctttgggactggccagtctaggagtgtgctttaccccacgcactgaaaacactggttactagaaatatcaaacatttcctgtgattctctcctccaagataactcgggcagcttgagaacaagctgctcttagctaattaaaagatttctgctgatattaacctttataaaagatttcaggttccaggacacgtcatttatcatgcagagtcccaagcaggtacattagcaatggaaaccaggctccaataaggaactaacaattttatctctgttgttctttattttaggttaaagaaatgaacttctcgtttcatctccacatgggaggaatgttctggagggggtaacagcctattaaactcatctagctttttttttttttttcaaactccacagcttgcctccctaccctactagactagattgcacagaggcagggcaggcacgggaaacgactctggttggaaattacaaacatatacacacagaatgcaagcaccataaccctttgaatacacagtggtttgtgccttgccccagacctacctaaggatttaaacagcacagaagtcggagttcggctgactgcatgacactctcctatcaatcgggtgaaacaaagacccagtactctaagcttaaagcattccaggcaaaattttagttaacaggcaataggaaggtgtgataggccagtgctaacaagaaagccacagatgggtttctttgagctgttaagacactggaaagggctggtatggaagcccagtggagccattaggacaatggaaaaggaggtacccctccaccaggcactttgcagagaaaactatactctggaagctgcctgcactgttgatagggctagacgtatgataaacagctaaccggaggggcacccgaggagacaaactgccaactatgaagaacaaagcagagacctcaacttgtcacgtctcaagctcagatgtacaaactttgggatcgtcaagtgaggctcgtgtgtatgcctggggatatgactgtattccagtgatcagccacctagctgacctgccacgaatgggtgacctgtggtgacttactttaatcaactgtagtacttctagattgattgggtgatttaaggttctgacatattcaggcaagaaaataaaagcaagtgtttcctagacttcctcattgggatttgaaatagaaatcctgaaaagcccataaaagcctatttccctaaatccttggtggaaattcccaaaagattaaaaaatccagaccctgtcttattatagggacccagcagatttcaaaagactcaagaggtcagcttaatctggttattaactgaaattgctgagatactgatgaacattccagccatggaacccaaaattctctagagtaataattacctattagtgcaatgttactactgaggccgtatatgcttcatttttacagtataacaaaatgtctaaaacttatgagagtcctacaacgtctaggccactcagtatcacatccaagtaggtatggttcctggatcaccaaccaacccctgaattcgatcctgttatctcacagtctggggtactgatcccgcacagcagagacacaacgtgtgaaaggctcggcagagcccattcctgttcctggaaaaataaccagaagcacacatctgcctgaccatgagtcaggaatatcaattttgtggtggagcccatttctgctgtgaccaacccacacccgaacacactcgcaacagaagcaaccgccacagagcaattccagaatgagctttttccccctcggggtccatacttagcaatgtcataaacggtctcccctgcgacagcaatccttttacactcttcataatgaccttaagtctttagtgcaaaaccacagaaacattgccactgccatataaaagtcatctgagtttcagtttgggtgattcggtcatgaccaaactgaacagaggataacctttcaggcacaattaacaggagccacagcgtcgcgatgaacttgccccatctggtaccggtgatcccgagcgctccagggcgatgagagcccgttacctactatgtcccactccacttatgtaactggaagatcgccggcgaaggggagggtaggatgggagggtgctcacattccgaggccacagcactccaaagaacctctgagcaccctggggacacgctcgcaccttagagcctctggcgccgaagagcctcgggtgctgctggacgcacagtcccctacccacggctcctgatgggaactataaccacctctttatgatgagttgtgggacccagaacacaatgtctagtcccttttgtggataataatccccacctacttgttcctgctagatggggaaaggagccggtggacctactcgctcgcgggggggtagcggggggcagaaattcatggaatgggcgagaaggagggggaggcaaagcccagagatgggggtgagagctcaggagcccttgtggcgcactctcccgacgggaggcgaagtgcgcacgcgcgccggtgggggggccgagtaacgggagagggggcgcgcgagggagggagggggagagcgcgatccagggagaggccggggccgcgggcgcgcgacggcgccgcggcccaaagccccgagaagggcaggagcgcgcgcagccccgacaggcgaaccccggcgacaggggcgcccgcggggccgggggccgggatgcgcgtcgagggcgggaggaagaggggcgtcaggcgaaggcggctccagggaggccgcgccgaggacggtcacccgcgagcacgggtgacgggccgaggggagagtcgccaccggcggcggcgggagggggagggtagagaggagggacgccatccgccagccgtgtcgtccgaccccgcgggcccctcccgcgccacgtcccgcccctgacccccgccccccggcaagggtccccgcccgcggccacggcggtcccactcacagtctctcctcctcgcctcctcctcctcctccgctcggcgcggcggcggcggcggcggccattttccggacggcttttaccacagccctctctccgagaggagggagcgcgcgcgccgccgacgccgg

SEQ ID NO: 1868 - DNA, 23132 bp, Homo sapiens
  source 1..23132: mol_type = genomic DNA
ttcaagttaatggaaacaagtctttattaagtaacttttaatatcagaaaaataaaactcttataattctctttacagcaaatatataatatcagtgctttggccatcttaagttaaaggccctttatcataaaatatatggttttaaattttactcaaattgaatttataatccctatgacttccctacatatacataacaaaagagtgtagtaaaattagcaaatactaaactatattgataatttatcattcttagtttgtggtttttagaaacagtacacgcacctaatatatgtcgattccttggcttattagttgcagtgtacaatgcaacaaaatacaaaatacatgcttggtgaacattcgttcatatctacaagacggcagctagagattaggtttcaatactgaccatttactatcctacaagcaattagcattacatcataatatgccatcaaggcaactttttttatactgaaaaaatcaaaataaaaaccgttatttgtaaacttttatacgaaatgtaactcttcaagtggaaataaaaaataaaatttgtctatttactattgaatacacataggatttcaattttcattataccgagaaaaaagctcttttgtgttgggaaaataatgcttcaaaaaataattagtagaaaaacccactagtataatgttttgtcctttcaatgccagcacagatttgggaacatactgaggatgaagttatagacatccacaggtgaaatgtacgagtatattttaaataaatctttccttgtgattggaaatagttttgaaatgaagtaaactgattggaggttgtcacagctgcttttgtgaattatgccaagggcatcattatccctttctccctcctccctcccctaaattactaaaaaataaaaatatatttataatgtgcaagacaaatatggattgaacataaaatgtttcacattttgatctatagtctaaaaattaacagctcgatcacactaatgaatggaatgtttgcatcctcaattatcagccaatataggtgccatcccaaagcccttcctgatatgggaaaacccaggtggccatttccacattcaccaagagaggcaatgggcaggaattcacaattgcattcctgatccactgatcataccagccttgagcactctgggcgagatgaaagttgatgtagcagtttttgtcccaaattataaccagtgatctagtaaactgccatcagccctatcattaccaataagtaatcacaatgcattaaaaagttacttgcaatcctgcagaattaggcatatgttgttgtaaaataaaaaacaaacctgttttgtcaaaactggcagtgtaaagaaggcagcactggaagtgtatgaatcgtctgtaatgccaagtaccctccataaactcttaaagtggttaggctttgggacccattgttttgaaatcttagacgtatacactttttcataggctcacacaacctatgattatcttcactcagccaagttgaacttcagctttagcaattcttatataaactatgtctctgggtctacaggatagtactaataattcaaaccaaactaatagacaagagaccacttaggtttagtgttaccatagcagccttttataagtttactaacaactttagcctaatcccaataaagcctgataacagtcataagaaatcattaggaagtttactggggggtaccattatacccatgcctttacgagtccatatagagatatagtatttatgtatatatatatagttaagagtgaatttggattgcctgagtaacagctgtctggcaaactggacatgatggcgttctcttttcacagatcttgttggcacattccatgcagaagaggttgtggccacatggaactagggcagcaataacctcattctcaaagcaaatcacacagtcgtgctttcgtcttgattctggaggtgagctagaggtggaaccaccattggaagaggagtaactattggtaccattagaaaaagcagggatatatattggaaggccaacatggttgcctgtactaggtgggtcgctcctaaccctccgagcaagtggatgttctatgctctcaggaaatgtaggagacagacgaggagtagatggctgacttcctctgcgctgagtcttcatgttaccagaaggatcactcccaaagccagagagtgggttaactggttcaaatggagtccagatagtttgagcagatgttggtaaagagtcaaaggcaggagagtcaactgctaggtcttctgagcctacagatggtagtgtatctccaaaccagaagtttcctgtgctaaatgggcttgttggactaaagtcagccagcctattgcttccaaagtaggaatctgtagagccacttcctagagaactggaactatcatttcgataattggatatcattcttgcgcggctaggaggaacaggattggaggagagccacgcagagccaagagtgccaccttcaaagcttacatcggtaccattgtaatggaaatcattctcttcattgagctctatatagtttcctgtacgcatggcaatatgcatttctatttcttcccgtgctcggtcaacattttcaggcatccctgtcacttcaaagacaggttccttatctctgctcggagttactatgtaggtgtgggtctgctgctgaattcttttaatagttgctcctttgggtccaaccactaatcctaccacacgataagggaccctgacttggacggtggtttgaccgggcagattaggactacatgataatcctcccagggcaggcccatttttgtttcgagatgcacgaatcatggagaagtgctctgcagctgagaggatctctcttttggccatggcaacatcttctttccttccagtgacaacaaaaatgggctcttcaccacgaacaggagtcttgatatacgtgtttgtcttggctctcagtgctttaattttacaacctgttagaaagaaaacatttcataagaatcaacatctacttcaatgatatatataaagacaaatcacagaatgcaccttttaagctaaatatctggttatgggttaagttttagagtttttcacatagctaggaagtggcagagccagaagtaaacctagtttgacttaaaatctgtggtctttttgctagtccaagaacctcgattttcacaattatctgacagaagttattaaactgacttccacctaattatcttaccactttaacttaacattactctttcctctgtaaaactcaattgatgacaaaaacaccgtgctcatggctagtaggtcatctcacttctgctcccaccagttaaattctaggcctgctatgattcagttttgtttattcccatgttgtttgtggtaggtgtactcacgctagtaactaaattatctaaattactgcataaactagtgaaacatgaatgcaaaaaagatgagtatcttaaagaaaaagctgctactgaattatgaataggtgagacagctgtaaagggctggaataaaaaaaaaagtaatatagaatgattttgtaatcattgtaaagtcctgctccatttaaaagaaacagatactgcagattgtatggaatgtgggtgctgggtgtggttttattcaaggactgctctgattgacagacacaatttcaaataaaaggccatgaccccaaatcctaagtatatttaagttaaaataaaacatctaagacacatatgtataactttacgtaattctccactttaaccaacttttttttttttttttgagtaatcacagattactagtgccaactatgtgaagattagagggcttcaaactgtaacttaaaatgtcaagtacacaaccaaggaataaaactctggggttatacttttcaaagaccctaacttgagcttgccagcatagatgtgttctcatgaatatatcatactattcttagtttgtcaaaataaagaagctaggtgctgtaatcccagcactttgggagggtgaggcaggtggataacctgaggtcaggagttcaagaccaggctgactaacatggtgaacatggtgaaaccccgtctttactaaatacacaaaaattagctgggcgtggtggtgcatgcctgtaatcccagctccttgagaggctgaggcagaagaattgctcgaacccgggggacagaggttgcagtgagccgagattgtcccactgcactccagcctgggcaacaagagtgaaactccatctcaaaaaaaaaaaaaccaaacaaacaaacaaaaaaagaagctaggtgctactgaagtgtcacaatctgagcatgtctttttcttaaatgctcccttccttttttgtcctcaataaattaatattcctatatcactttagtcagatgatgctttttttctttttgagacagagtctcgctctgtcacccaggctggagtgcagtgatgtgttctcggctgaccgcaacctccacctcccgggttccagtgattctcctgccccagccacccgagtagctgggactacaggcatgcacaaccacacctggataattttttgtatttttagtagagatggggtttcaccacgttggtcaggctggtcttgaactcctgacctagtaatctgcctgcctcggcctcccaaagtgctggattacaggcgggagccaccgcacctggccgatgctttctaataaagcacatgacctgatcacttttttgcacaaagtggaacttgtttgtttgcccttccaaagcattcccaagccactaggtgttgactacacaggttgagttatcccctatccaaaaacacatgggaccaggaatgtttgagattttggagtatttgcatcatacctgccagttgggcatccctactctgaaaatctgaaatgctccagtgagtattttctttgagcattatgctggtgctcaaaaagcctcagattttggagctctaaaacaaaatcggaggctttttgagcatttaggatttcacattttcggattagaagtgttcagcctgtatgtgcttttgttctacaacagaaaatcagttagaagaacagagagtacaatgaaacttccacatctacgtatcatttatacaggctaaatgtccaggagattccctcatttagtgcagcaggtgcagtttggtgtgcagaattgagatcactttctattgatgcttaagaaattctgaaaggggtgtataaacacagaactggtcatattctatactcaggggagttactatttggatatgtaagttcacagtgggctacaacttgacaaggtggcaagaaggcagtcagccacagttacattcctaacaagagacagacaatattctgcagaaaaacactgggcaaattgcattaaggacaaagggagaattagtctaagggtctagggttggtccctttcatcccttactaatattgaccattagaaaactgaaaataaataaaagaaaaaaaaggaaaacagaaataaaagagaaaaaagaaaactatgtaaaaatcccttaatcaaatacttttgatactataagcaactgtcagtcacacccttagtagaatattttctgttaaatacctaacaggtatattattaactgaggaaatatgcttgagggtccacagaacactatctagcctatggttggtattaataaataggtgtttaatgtatggttcattgggtacagagaagacaaatggtttgagcatgggccactcttgagacaggggagaaagacaggcctggtctacacccaaaagggtcatgtgtttattaggttttgcagatcagggaaaaaagtaaaaggaagacagcaaagccaaccctggtttttttttgttgttgttttttgagatggagtctctgtcgcccaggttggagtgcagtggcaccatatcggctcactgcaacttccgtctcctgggttcaagcaattctcctgcctcagcctcccgagtagctgggattacaggtgcccaccaccacacccgggtaatttttaaaatatattcttagtagagacgggttttcaccatgttggccaggctagtctcaaactcctgaactcaggtgatctgcccgcgttggcctcccaaagtgctgggattacgggcgtgagccatcgtgcctggccaccaacccagtttaagccactgccaataaagacagaggaaactatttcttcacttccctaaatcttttgattatagtatcctaaactcagattagggattatagggaagctcaccaatcataccactgtttctgtaggaacacatattctgagttccaaacaactaacatgatttctcaactacaaatacattctaatgttggggactactcgaatagatactttttaaaaggtgacacaaactaaaggagaaaaacaatcttgttttgtaattttgcaggtgacgaaggtattagcttttttgagtactttgagtttttatttgaaaactcgaagatatttttaaaaataatagaatttataatctcagagtgaaataaaattcagaagccgtattatgatatattagcctgtattttttaagttgctacatggcacaagtcaccaaaaacaaagtaaaaaaacctaaaatatttataacattattagaaatggctaatttctcactttcttacacacacacaaacacacacatacacgcatgcacacacacatctctcccctacaaatcaaaacaacaaaaacccaataaaagggtgaaagaaacagctaacatcaaagtaaatatacaaatggctctgaagatggaaattcccattttcaagggaactgacctattattttctacctataagattgtcaaataacaaaaaccttacaacaatgctagtaaagagtggggaaaagaactctcatatttagctgtgagagtataaactgccctctaagagctatcacagttataagcccatatattcttacgcttctacaatcttcttgtacaattgatcctgtagaaatatgtgcacaagtgcaaaataacttctgtattttataattattgtttgaattagcatgaggctggtacagctatataatggaatgctatacactcataaaagtggttgacctagggggacagggaaggagggaggcagttttcactgtatattcttatttattttttttaataaattttgagtcatacatacacattactttttcaaataaatatgattaagttagaaaagaaaaacaaattaaatatacagaaatgatacactttactagtcttagcatattgattagacgtttggttagtgctactgatattattttaaattacagtagcccccctcccttatctgcagtttcactttctatcatttcagctcctttcagtcaaccatagtccaaatgcaggtgggtacagtacagaataaaaagatatttgagagtgagtaagaccacgttcaccaacttttattacagtatattgttataagtcttctattttattattgttaatctcttactctgtcttgtttataaatcaaatgttatcacaggtatgtacatataggaaaaaacatagtatgtatatatagggtttggtactctgcggtttcaagcatccacttaaggtcttgggaaggcatccctgttggataagggggggactactgtacaaacagcagggtaaatgatttcgtagcctcaaagttgaacaaagttttgaaatttaaaaatgtgaggactacacttcttatagctacagataaaaatccacatatggcaagttgtattcaaggtaatcaatgggcagaagtctagactagactgtttagaggtcaagaactaattttatcttgatttggaagtaaattccctaaaaaaagagtctccaacttaacctcactggtgtaggaacccattttcctttcctacatcactgttgctggggctatgtttcaccttaaaaccctttagctgcagctagaactctggtcctctcactccctaatacagcaaaggattctgccttgcttctccagggtaaataaagagagcttttcctagccttagaaattaagacggggaggtcctctgccgctgggaaaggggttgaaagaaaagaaattaaaatgaaggtaatcttcagtgtttttcaaaccatgggttgcagtatcaattcagtaggtgcagtcagcatttaaaaaaagaactcaatatgttccaaatgtttcagtgaaatatataatgggctgcaaaataaaatgttctttttcctgtcagaaaagtttaaaaccactagacaacatcacctttaaggccactttctagttccattaacacatgtgaaatgatgtacttacaactaagaaccagtacagtgatagtgaaaaggagggagtgtggcattattgagaaaacctgggtttaagatctgactttacagatgaaatttccatacagttgaaaatggtaatactatagttctgctctatggtcacctaaagtagcttgtggaggccagacagctcagacatatttgtaacaccaaatttttaaaaacccattatttattttctagccaccagcaacatatcttggatactcagagcaggatttttcaagttttgtttttgtttttaaaccacggttcatttagatggcagcaaaaagaccacatggcctatccataccatttgttcccacttcccaacagaaaaagcaccatgtgataaagaattgagttaatatttaggtcaccagtagtgtacaattaagcagaaaatgaaagtccatggagctgttcatcattcaccactaaatcctttaaaaagctatagtagacagtatgataggcagaatcctaagatggctcctcaagattcctgggcctagtatgtacacatactttcagttaaacaaacactaacctaggtggcccctgtgaagggactttgcaaatataattacaatccaaatcagttcagcttaaaatagtaaaattatccagattatctgggtgggcctgacctaatcataagttttttaaaagcagaggttttggctgattgtggtggctcatgcctgtaatcctagcactttggaggctgaggccagaggactgcttgaagccaagagttaatgacaggctgagcaacatagcaggacgctgtttctacaaaaaaacaaacaaaaataaaaacaacaaaaaaaattagccatgtatggtggtgtgtccctggagtcctagctatatgggaggctaataaggtgaagaattgcttgtgtccaggaggtcatggctgcagtgggttatgatcacaccaatgcactccagcctgggcaacagagtgagaccctgtctcttaaaaaaatttttttttttcctagcatgactcagaagagaagtcagagagatgtgctctggctaacctggaagaagaaagcaaacaatgtatgttgtaaattgcctatggtgaccccaaggcaaggaacttcaggtgtcttctaggagctgtgagctagaaggaaaatggaggtagaggtcatcatcctgcaacacccacctcccactccctactcaaaatgaattttatcaaaaaccagcaagcttgggtgaggacatgagccgcagataagcactgcagtcctgcccaataccttgatttgaacacagtgagaccctgaacagacacaccatgcctagacttctgacctacagaaatggagataataaatttgtgttgttgtaagctgctaaattagcagtaactgttacaaagtaataaaaactactagagattctcagagcccttaaaaactccacaatcactgccccaagagaggagagactaaaatgttagatatattacattcttattcaataccctacaagacattctggaagtctctcaagaattattgtaagaagtagcttttggctgtgtgtgatgcctcaagcctgtaatctcaacgctttggggagctgaggtgggaggatcacttgagttcaggagtttgaaaccagcctaggcaacatggcaaaaccccatctctacaaaaaatataaaaaactatctgggcgtggtggtgcacacctgtggtcctagctacttgggaggctgaggttgggaggatcacctaagcctaggatgtcaaggctgcagagatccgagatcgtgccactgcattcaagcctgggcaacagagtgagaccctgacccaaagaaaagaaaaaaaaaaattaagaagcagttttcaacataaaatactgtattaaggtgttacagtaaatatggaattgccaatagttcaattaaagtccaaaaatatttctgtcctttaattccctattacctgctttagtttcctaatgctgccttaacaagttaccacagtggctttaatgacaaaaatttattgtttttacatatatttgttattttacagtttggtgggtcagacatctgatatgggtctcaacagggctaaaatcaaggtgtttgcaagggctatgttccttgcaagaagcttgagggatccagttccttgcacatgcaggttgttggcagaatttgattgcttgcagtgaaaggactgagtgtccttgctggctgtcagctgagggtcattcccagcttctagaggccacctacattccctggcttgtgactcatcttcagagcgagcaatggaggctgagtccttctcatgcttcacatcttctttttcagatctcagacccaactgggaaaggttttctgcttttagggtctcatgtgattatacccagatgatcatccagatgatctcaagctccccaaagcaaggtccataccctcaatcacgtctgcataaacacctgcaacatcccttttgccaaatgaggtgacatattcagagttcctggggaattcggatatggacttgttgggtgggtgggattactctgcctatgacattacctttctcctttccttcaattattttccttttcttccaagtacctagcttttaaatcccaattcaggaatagtaacccaaaggccagggcagcgaatagacataaggtagggtcaggaaaggtttgaggaatcacgggcattggaataggtgaagggataaatctaaaaatcaagtaagggctgagtgtggtggctcatgtccgtaatcccaacactttgggaggcagaggtgggaggattgcttgaggccagaagttcgagaccagcctgggcaacatagtgagacccccccctctctataataaacaaataatattaaaataaaaatatcaaatagggagaaaatatagaagccaagtgtttacaatgacttttactaggagattatgtttatgttgggagattagtggtttggtacgtgatacacagtaaaagtggcttccacttatcctaggcgttcccagcaaaatcactgcttgggtgaactctaagagcattttatcaattgtgagataaagtgcagcctaatacctgaacttacccattcacatgttaaattccctataaagatgctagtgctacttccaggtggtataaatgaaccagcatcatttctgctctcaagcttagtctagagggaaaaaagtaaagcaacactgaatacagtaaccggtttaaaggtacctacaaagcagtaggtacatacaaaaggagatgactttactacttacagtaaataaaagaaagctttaaaggcatctgaactgaggcttaaagaaaatggttttgccagatgggaaggagagcagagggaactgcaagtgcaaaagcaaggaatcaagagtacaggatggcacagtcagacaactgggttcagcagtgtgagagcttcacgtcactggaggatagaatggcagggataaagctggatggggagacagaagtctctgatgtcaggcaagggaatttcgactttatcgtgtagtagaaaaaactggagatagacagtaacataaacagatatgcatgttaagactagtgggtgcataaaagatgcaaaagagacaagacgggggactcaccacaaggcctatcacaataatgaacagaaaaatgctgagaacaaaggacagaatgcaaggctggggctatgtatgaccactgttatgaacatcaagtacttgtgttgtagattttgcaaaaaggaacttgttttctagaaactaaacgcattatgttttccattcatttcatacattagctacaaatacaaggtgactaaagaaagctcaaacccttacaagcaaacatcacaactgcattatgtgtatattttcacttttggcagtccttggggtttttcttcaaaaatttcccaagaggttttgttttgaagggtaaagagagaggggagttaaacatcttgagtagctcttcttaccttcaagaaaaataaaactctttggcctgaaattaagtccccaccccttctgcatattaagtggccacaacccaccttctcccagacttcatcccccaaacatgtcttgttcctcttctatctctgctcgggtatttccttacataatctggaaaaccctcctagtattccttttcctccctgagttatctgaataacaaacatggccatttggaaaagataaaactgtatgtgtgaaaggctccacgaacttaagaataatacaaacataggcacaactcattattatagctatcatgtatgaatccattaaggtccagttcaagggaaacaatataagcagcaaaaaactgactatctgcaggactcggaacctgctgtttcaacgttagggcaaactatgattaaagatacttccttcgtttgttttttgcaaagattaaatgaaataatgtattaaaaatgcttactacaatgcctgttattaagtgcttagcccaagttgtcttaagtccacactcctttcatcacactattttcccctaaaaacacatcattttgggaggctgagacagaagaatcgctcgaacccgggaggcggaggttgaggtcagcagagatcacactactgcactccagcctgggcaataagagcgaaactccgtctcaaaaaaaacaaaaacaaaaacaaacaaaaaccctaaatcatctcacgtttcatgatatataagaatgaatgaaggggttgtattaataattttatacaaaataaggtccctttccccttggaatagtctagacagaatattcaaaagctcctttcattttatagaaacacataaaatactgtattaaggtgttacagtaaatatggaattgccattagttctattaatcaattctagtattctatcttcaaagactaatgagtatcaactaaatcccagtaagaatgtttcatgtacacaacattaattcaacattttaagtaataatttaagaatgcaatgtattcctaaatgcataatataaaactaatagctttcctttctagggttcaagtggcctccttgtagctattttaaggcaagaatactgtttgtctcactttagggattactatgacaatacttcaaacaccttcatttatgtgattttagtttcattatcagtattcatataaacatttaatgccttcaatcaagtagcatctactgtacttcaaacaaaagtgccaaacaacttgaggttgactgggtccttacataaaaagctgtttggccagttgtggtgacttatgcctgtaatcccagcactttgggaggccgaggtgggtggactgcttgagctcagcttcagctcagaagttcaagaccagcctgggcaacatagtaaaaccccgtctctaccaaaaatacaaaaaactagccaggcgtggtggtgtgcacttaccgtcccagctactggggatcacttgagcctgggaggcggaggttgcaatgagctgagattgctctactgcactccagcctgggcgacagagtgagaccctgtctcaaaaaaaaaaaaaattaaaaaaaatgctgggaataaaggcaagagggaagaaaaccccaattaaaacaatatggaaagtacaatgatataaacaataaaatggcaagtttataagaaaaaaatttagttcaataaaataaaaaggaagtattccactttgttttaggtactttaaccaatattaataatgcaaagatgactaagattcagttctaccttcactgacttgtattaacttcaagcactgaaagtatttagtgatacatgttcatgtacacatagtgacctattttcttttcttatactgttggttggtgacagtagtcagatcttctacaatatccttgctgatttttgtctacttgttctaccacttactgagataggcacgttgaagtctcaaacaataatggcttgagaccttggataagttgtttgtaactccatagacttgtttatctgttcggtggaattaagaatggattaaatgagatgacacatgtagtttttgcacagtgcctgacacaagtttgttgttattaaaagacaagtgaactgatttttatagggagttaaaaacatttaaagaaactcctaaagataaaacatatcataaactttgcaaaattgagaagattttgcaaagtcaatctaactggtaatatgaaatctggtttacttttacctcattttagggactctctttggacaaaaatcagaatataagaaatgtgacagaccacctagttaaatctcattttagacatgaggaaaaccgaagcctaaaattgtccagttataaactagtgacccctaaaccaatgttctctcaagctgccttattttcctaaatcccaataagaatatttctagtgtatttttaggagtggagaagaattccctgcatgtacaaggtattttaaaaaacagaagttaaattaaatctaaaacccctcttttttcacttattttagacaagacaataaaaaatatttaatgaaaagttttattatttggcctttcagtaaacctgaaagaaaaaaccagaagagggtgtaaattagagatgaaaggcagaagttttcctaactggggagcttgaaattatgttcatgctctttggagaatgttaacagaaaccttagaattatctgtctgggtaccatacaatggaattagattcatttgtaaatgattctcttccagacttgcttagttctttgccaggaaatacatttccaaagctctgattttaaataaattttaagacatattataaatttaaaaaatataacttacataatttattggtatagcctacgaaaaacttactaaaatgacattttttggctttaactagcatttgttcagagtataaaagaaatttagcagtaaaaatttaccttatctgatatataatttatcatctctgtactttcaattgtactgtcaatttctactaatgctatcttctcagacttgatcctcacaacaaatgagggagaggggagagagaaacctggaagaacaagtagatgaagtaggttttttccagaagagaaaacaggctcagagaggttaagtgatttatccaaggtcacaggcagcaagtgcaaaacacaaggtttctaactccaagtccaatgtcctttcctgcattatactaaatggcactggtagaaaggcagaagagaaggcaaagggaaagggaggcacagagaagggaaataataataaaaaggtcagccccaaatgcaaatatatacttttacattggtaaccattttgggagatcttttctagttgtttgaagccattccctccccacttccccttcaatcatgttcaagaccaaattacttatgcttaccttcaactacatctgcagttttcattaaaggattttcttttattattttaaggcttagtcttattattccatgatagactttacttgtgaccaaaccaggcttctctgcatgcaatgaggaattgtagtccgtacttaccggacaagggcaacaaacacttgaagtgtccttacatctcaaacactggcatggaagaggtcctatagttagtgtaacttaaaattctcaaagtcagttatagaataaagacttgaactactcaaacagtattagactatgcatacattcaatttagtatatctgggtttggtaatcctaacattagaaaattattttcaaggcttaaatatcagatttaatctttgtaagtctctatatagtaactaatggtagcatggggaaaatgttaaaagtaaatccacaaattatggcatataagctacttgggaagcattaagaatgcagtttaataaaaaaggtatcacttaaggatcacctgaatatcaatggagatttaaacataactatccatgatctacttggagcttcttaaaaagctttttttatttttaagtgcaaatacactcctttagtatcttatgaacattatctactttctcatcttgagtttggttacaaattctacatggcaggaatgacactgtttagaattctataacaatcctataaattataaaatagtactgtagtagtcatcatggctctccttgtgggcacatagttgtcatatactttctcagccttttgaagttaggtgtggccagatgatttgctttaatgaaatatgagcagatgtgataagcattacttccggatctaacattttaagaccagtatgtgctatgctgtagtctttcatcttctggcacaacagaagatcagtaacactggagatggtggctgctgttggcctgtgtccctgaatgactaaaatgagcagagcccctatgaacaagaaataaaccatagttgttttaacactgaggtgtcagagttctttgttaaccacagcataacaagcccatcttgacagaagtgccaagtatctaaaaggcattcagatatccgttggttctagttctattacattggaagaatataatgagtcaaactatctgctaaagccaaaaaaggtggacatgattaaacggtggttccaaattaatttcagatttaccttaacaaaagtaatgtgcttagcacttacagtttcatatatgtcgatttctttatcttccagagtctctacaggaattgtagatatgattatgcccaggtgcaaaagaggaatctgaagcctagggagtttaagtgacttgttcaagattacacagtgagttattggcacaggaatatctatttctgatttggttctttccaatataccacagctgaacagagactgtcacaggcagtttggtgtagctacaataggtatttttacatattgtataagctacgatattaaaatacacatactaaaacatttttatgtttaaggcaaaagtattcaaaaccaaatcagcaatatattaagcattcccttataactaaatgctacctttccttaaaaacttacgctgtaaagaaccacctagaattccaacctataaacattgtttgaaaattttctagatagaaatctctaacagactaacacaaatacttggttccctggatcattttcaggttgttggtaaccaaggggtacaaaatacacccttgaattaccacttcatttcccatttcctccctagtgaatcagaatagttcattagctgaataaggcaggaagaaaggcagtagattccccacccatttgcaaaaacaattacagtaactgaacccttctcaagggtcccagaactaatacaaaccattattaacgaaatttaaattttaaagcctagaaaaattgtaatatttaatttttaaagctagtgtctatatatatacgcaaattaactttctgtactacaaatgacagtaaatttttagctggacacattagaactatattacaattaaaactgtgccttgtgggtagtacagacaccaaaattttatcaagtaaactaatttggatagtggtattttaaattatgcatattagaaattcagtatcctacgattagggcacaagttaatccaaaatactaaccttccagagcagaatgcttcaatactgaagtggcaatgtagagtacaaagaattttatttctgatgtcaaactatgctaaatccaatctcaactatttgagcaagttagctctcagaacctctgtttctacctctctaaacggcagtaaccacctagcagggttaaacggcactggtgaagcacctaacatagtactaagcaaagagaagtccaacaatgcaccctcatccccataaaagaaaaagacactgtgctgtagcatcattctgaaactatttattctcatgaaatatgtacttctccttgaagagaaaatttatgtacagcaagaccaagctttctctttttctcctggtcacagacgtataaaccctatttcagttgtgttagagcttgaagggtggttccaccctaagaaattgggaagacaaattgaaacagtgtaaagtattaattgttaataaagaattttgttttataatgtgtaatatattaagcacacttactattcatacataaatatccagatattgggagtatgcacattttttttggacagggtgtacaataaaaagaagctagagacgacttttctagactatgtggctagagaacacacatagaccattaattaaagtctaatgaaagatacacatttatcctaatagtaatacaaaatcttgggttacaagtctctaaacaactgaatttatgacatttagtattaatttataatgtattaagaatgggtatacagttctattttaattcactttttagtctaaatggatataaatgactgtacaaattggaacaaaacctgctgactaaaattagacctgttaatcactgttaatatgtcttgcaggtactatacttaaaaacagagacgttctaagtttataaaattaggtcttaaaatctgttgtcaggtttatttttgatgtccatattctaaaacttctttgattatatcaacaagcctcttcagttcctggctttattttacagtattgttgtttcacaacagatgcaatgctttaaaaaacaaggccaatttaacatttacaaatgaccatatgctactggggagtataaattcgaggtcaaacactctgccaactttcatcagtatcaaaagcggtagtttgtgttttagaaaaacactggaactcagaggccatctacatgagttgctagtctatgtgactcagaattccatttgtcctgctctttgcttcagagctgaagtcataaatgtctccatctgtgacataattatttccaaaatcaattaagagatgtcaaatagaaaattatggcttcaggtaatacataaaatggcagaaatggataatttaatcttaaggatgaaagtttagctccttcaaagcaaacaagaaaatgaaatgatttgccctgttttacttacttaggacagattctctcccgtggggaaatataatactgtaaaagaatgtgaacattagaagtcacttcgttctccatacgagtgagcaaacactttacaggtttattactatgctgctgggacatgggggtggcaaaggggtcaatgatccacaagttgtatggttcagaacagcaaaaggaccagattttctgcttttaagatagaggatgatgacatacttttaacagtattgtcaactctgggaaaatacaaggtttaaatggaagagccagcaatttgtctccatgatctaagacataattaaattcaacatttccttattaaccaaataaacacagccctcaaaagaaaaactaaggctttatctcatttcctatcacgtaatagctggtacaaaataaaaacttggaattcactttacttttaaaaaactgatttctataaagattaacaacatacacaagtaagggccatttagcagtgctttaaggggtgtctactataatgaaggactaaagtttgtattaaactaaatctataaaatatgttatcttgtccttcagtaaaactggcacgtaaatgttttcttcctttgttaccctagactgttaccataagcacacggaagcaacttgtcctgagaagtggcatcttcatatggcattcaggcttcttcacattctggtgtgaacgcctgccttcccccttttccaccactcccctttacagacctcaagtatcaaaacaacactacttggcaattatacctaggctagtcctccacacccctcctcacattgttcctccacagtttttcaatctccatttgttagactccttcctacccattttccaaggccctctccatagatgttctcttacctgagactttgtcatactaaatacactatagttagtgccattctactgtttattagactgttatcttcttaagggcagaaagtctgaattaacttcacattctcaataccacaaactcaaaacctggcaaaatacaagcttggtacatagcgattcctcagtgttcttacatgaatggtcaactcattctgatccaaattgagatgttgtaattttatcccatgtaaacaaaagttttctcctggattattactctaagtatcgccaaaaccaaacaatccaggaatctgaaactcattaaccagaagaacgacaagcataagctacctttcaattgaaaggtccagctttgaacagtgtctgtaagtgccaatcatcaggcagtctgaactaagctatctcctttatccagatttcagatgagtttttattaaaatcctacagataggaaagaaataagccaagtctgatatgtgaaaccaccatttcgacagagctcttatttatgtgtactttagaccacctgggaaagatgagatcatttaagcggcagcgccatcatctctctttatttgaccccaacaatgctctcaacctaacagtaaagaggcatgcaacaaccaggctaaaccacattgtcatgcggtggcagcaggtaacatctgcccctttcataaaggggaaatgctaccataaagaacttaggaccttccctaaaaatgtcggatacagaggtaccccaggcatccccttcccccaccttcacaaatctactcctggaatctgagacacaggtcctttgtctgaacaatgtgggaggagtctgtctgcagtactggtgtgctggcaagtgaagaggagaattaactgaaaactgtataaaccgatgaagtttcttaattaccttagtgtccattttttcttcatcctgcacactgaacagttttaaaagacagccagtgtgtcagtgtgtctttccgagagttgaaacgtaccgagagaaatacagttaagataggcggcagtgagttgggctgcttttccaaagctaagtttctcaacagcggaggggcaggggatggcggtgataccgaccatttgaacaccccttccctccccagtgagctctgtctacaggcctccatttctgttcttttctccatctgaacaagttcttgtaagggaggctgaacgcttttagaagacactcggcggcgcaaacttgcaatctcgaagctttccgtacccaacagcgaacccacaactcctcgagcccgaccttttaccacctcactgaggtttctggtgccacgccagcctggtgttccacgaatacagcccaagtaacgtgaacaccaccggactgggtcgcccgagaaacttcacactttttaccaggcaagacgggcggaaaagcgtgggttttcgcaaggtgacccatcttcacatctggtcgaccctcggctcctcccagaccccttcgcggtggacttgggggcctcgccgggttcgccttttccgtcccacgctcctttctctcgtctccccacccacgcccggggccatgcccagctggacctccccacccctgcactcaccctggcggccgacgatctcggcgacgtgctcggagctgggcaccgggacgcactcggtggtgttgacgctctttctccggagcagggccgcctgctccccgttcagggcggccgccgccgccccacaaccgccggggccgtaggcgtgggacagcatcgccgccatcatgccctgggcatcgtcccctccgtacagcacccccgccgccgccgccgcggccgccgcctcccgggcatcgaacctggcggctggcagcagcacagaccccagggacccgcccgggatctgctgggtctgagaggcggtggccgcgggcggcgacagcagcagcagcgacgaccggtcctcctcctctgcttcctccagctcctcctcctccagcaggtctccgtccagctccgcttcctccccctcctcctcgtcctcttccagctccagctcggccgcctccggggccccgggccggccgggcggagcccgctcctctggagacagctccgccgcccgccgggcctggccctgcgccgccgctgccggggcccgaagcgccggggcgccgggctccgccgggctggggtcgtcgaggcctagcgcggccaagcgctccctcagcaggagcccgtccccctcgagctccgggccgcccgagggcggcggcagaggcggcggtggcggcggcggcggcgggggcggctgcggcaggggggccggggccgccgccagggccagggccgcggagctgccgctgggcatcgcggcggcgcgctgtcaatggcggcggcggcggccgggtcaggcgcggcaggcggcgagccccatggcggacagggccagggccctgctcagctcgcaaacacctttcctctggggaggcggcggggctggggacccgggccgaggagcgccagggccgcccggagaccggagagggcggggtggaggggcaggggaaggaggcagaggtaggtaactaggtgggtgggtggggacggcggcggggcgggctggtggaggtggcagcggctcccctctcagtgtttcttttgtttcatggccttaaccagcccccggcgcgcgcggcggcggcggctacgccccacgccgctctccgaat

SEQ ID NO: 1869 - DNA, 76574 bp, Homo sapiens
  source 1..76574: mol_type = genomic DNA
ttttttctaagaatggattttcctctttatgaaaacaaaatattccttttctttataaaactttataggcaaatttatcaagctggtaaattccataacaggctgaaccaaatgaaatacctaagtaaagcaaattacatgattagaaggctaattatggtattactgcataggtttagtattaatgcatatgttctaagtttattgcaactacactaacttcgtaattttagatttgcagttgcatcctcctaactgcgtctaatggcagaagcaccaccttgtggcaaaagtaggagcttttaaattacagaagttagggcttgttacccagaaaggagaaaacaatataatgggcatccaggacactgcgctatttcttgacctgtagagggattccatcagtgctcaatttataattatttattcaaccatatgacttttctgtatttattgtatttcctacttttaaaagtttgggaaaaaagtcttttacatacctgaattaaaggtcacattcctaaatgcttgaattttctaagcaccacttatattttcaagaatttcctagaacttcgaggaatctttaaccttgtaaatgcactgttgtatttttatgataggaaataaaacaccagaaagacacttattctttggtaagtaacagaagaattccctacagatgtcttcctctgaatgttttcattcctgctctcccaaagcctccaagagcaaatgcagctgctttcaaatcatctgaaagacttctacattcctataccaacaggtctgaaaattgttagaaacaaaaaacaaaactcccctaaaaccaacagattttgcaggatcaatataaaatattaaggatatatagcacatttaactatgtaacaatattcaatcaaaaaaaggtttccctgtcacgttttatttaccatattttcagggcttgatacatagtattcacaaaatgacctgaattagctggagagatttatcaccctctgtaactgctatgtcatcactttccttagcggtgaactgaatcgcatttagtacctcttttcacagccaagagcaatttttttttttttaaggaaaaaaactttattccttttttcctaggaacttgtcaggatactttagtgaccattccctcactataactctcacccagacccacctaactgatgcatgagaagagccactagctgatgtggcccacagctcagactgagccagcatggcttgtgcaggggtaggtagcacagcatcatccagacactgcctcccctggtagcttccattacatcatggacagcactgctcttccctgacttaaccttctgctttgttcaaatactagaaatattagatttcaagttcaataaagatgtgggcagatctgcctaagaatatttcacaggacaatgccttccactgagttaatgttacttgctcaaataacccttatgctcaagttaggtacagaaaaaatatttttaagaaagtcaatagaatgttatattgcaagttttgacttaggcctcttcaaaagtgctatatgaggcagccactaaccaagtgtctgtctcttataatttgacacattccaggtatgactattctaatggtcatgagtatcactgagtcaagtatttgtttctacctatgaagaaatgtcgggccattgtactcccaagatgtataacttgaattttaaagtaaagctgtcgcataaaactagaagaaggaataatctcagggatctttttacagaggattataaagaatgggattatttaacttaaatctgaagatgtctaattcttatttctccccgaaaacaagtaaaaaatagaagcttaacatgggctactaagatttctggaattgcccattcagaaatgtatcacaggaaccaaagttgagataaaatattgttaatgagaaatcctggcattgacattccacattaaatatatttctatactttactgtaaggttcaactgaccactctacctaaaacaaattcttcaatattttcaagatgtagtttaaaacaatttttaacccgtttcctcctagaactaggcacgcatatatgtatgaaagagaagaaaaagcaaaggagaaaggaagagtggggaacgggggggagagggagagagagagagagagagagagagagagaacaccattaaggatacagaataataaaggaaattactaccacttaatgggaacacaatcttttgaaatctttgctacaactggaataaaaaactcagtaattctgaaaggttattctactcttttaaataaaaacatatctgttcaaactattaggtacttctaatcatttagtcttataagaagcattggaaaaaaacatacatagtaacaaacagtgaatttagacataggttcgcataaattgttttactttcagaaaacccagaacctctaggaaattactaaaattatgaagaagttaaattttataagctctttccctcaactttggctaaatgtaaccatattaaaatactgacatagtttttcattatgaaatagaaatgtaaaatggtagctttattttaatctttactcaagagtgatattgaaacaaagctcttactacaacaaccaggttaaaaaaacaaggtgaatcaatgctattgtatgtctgtgaactagaaatttcttacttatggagttatgctcaggaaacaatacttaaaatcttaaactgtaaactcttagcttgtaacattttcatttttcctgtatcttgcatgtttctcagtgccattaaatatattatcttctatttcttcttaaagaactagtgttcataaaaggatcatcatcatcatcctgaaatgagatacaaatgttgtattagtgattgttccctgcttcactgaaacaagacagaagttcttatgggcaaaacaataccagtgagagtcatttcacatgggatagactttatttttctatttcctttataactgcaaaatatattaagtacaattaaattcttaatgagcattaaaatgaaaatttatcctgctgtgtgtgcatgtatctacaatataaaccacacacatttcccttactaaccttaataaagataaatgaagtataggtaagccagaaaaataattcaagtcattttatatttggtttttgaatatattttctcatttacattttattacagttgtatctactcttctggaaattcacagcgaaaaaataatgaagccacatggagatccaactcagaaacagctgtaattttatttcccattaccatttaatactagaaatagctagctactctcacacttatgcaaaaaacaacctagcaaagcaagctttcaaatagttttttggataaaaaaagaaatacatgcagttatttcaagagttcccatgctggccgggcgcggtggctcacgcctgtaatcccagcactttggaaggccgaggcgggtggatcacgaggtcaggagatcgagaccatcctggctagcacggtgaaaccccgtctctactagaaatacaaaaaattggccgggtgtggtggcgggcgcctgtagtcccagctactcgggaggctgaggcaggagaatggcgtgaaactgggaggcagagcttacagtgagctgagatcgtgccactgcactccagcctcggcgacagagcgagagactccatctcaaaaaaaaaaaagagttcccatgctattgggctatagattgtatgcatggtaagaataaataggaatatcagatattaactaataatttaattaaagagaatgaaaacaaacctcagataagcccaattatataattttatgaagataaaaccaattcttacgtattctataaatattcagaaaataaagcaaatttgtttataagttttttatttgtgtttaagacattaaaagaaattaaaagaaattatttgatgctaggctttgttggtggtatcagcacttccaaatgttagctaaattaactatctctgatgagtaatggatgccttaagaaatataaattcattttcatttattgattcattttctgctgctatcaaagacaaaacttaaataaaccagagacaaatccaaatgaagtctaatagataatttgctaatagtttgtctttgcagttaacatgaactagtatacaaatttttaactgtaacatataaccgcatatatatccagatgttttggaataaacaataattgctcacttccctcctggaagcaacatgttagtatttaataggtagaatgagctcttgctgccatttttcttggcagcctgagttgagtcctctcaagctgttttaaaccacagcttaaatacagggaacatggcagcagcagccaaagctaaaaatgaaaggtgtaagtcacaggctacaacgtagataaaccttcaggtacttacgctatgtgaaataagccagtcacaaaaaggcaaatactatatgattctacttctatgaagtacctagagtagttgaattcatagaaagagaaagtggaatggtagttaccaggggatgaagaaggggaaacagagacttgttatttcagggatatagattttcagttttgcaaaatgaaaaagtgctgaagatctgtttaatatggatctatttaacactactgaactgtacacttaataatggttagttttatgttatgcttttgctacaattaacaattttttaaataaaaaaataaatgaaaggggtcatgggcctaagagaaacactttcaagcaaatcaacaaaaactagcaaaggcccttcaaatggcagccttgaaggaaaggggaagggcagtatccttcagtcatgtagttttatttaaacttaattgaaacagcaaattaataaaggcaagaggtaagtcctgacttataactcttcctcttcctcctcctcctcattcatggtggggagatttcatggttgcagacgcgatctggaactggagttttttccagacatcctcccagagaacatttcggacaatgcctgaatacctgtatgtcatgaaatcaccaccatgcgccaccctctacatgacacatgtagagcatatagtgagtacttaataaatattcattaaagtaatattaaaagctcttgggatatcatcatcatcatcatcatttctccaaatataagtaaatggtagaagctaaaaaaaattccgatcccactgttaactgggcaaataagaactgagtgaatatcatattttaaaaatctacaggacttttatatctgaggtattacactgatgggcactcaacatatgttacttgttaactcttaacattaactatagttcaaaggaaggttatcaatgaaactattttttttttttgagatggagtttcgctcgtgttgcccaggctggagtgcaatggtgcaatcttggctcactgcaacctccacttcccaggttcaagcgattctcctgcctcagcctcctgagtaggtgggattacaggcatgtgccaccatgtccggctaattttgtattttcagtagagacggggtttctccatgttggtcaggctggtcatgaactcccgacctcaggtgatccgcctgcctcagccttccaaagtgctgggattacaggcatgagctaccgcgcccagcctgaaactatttttaaaaataatttttagtggaagaaggacaagatggccaactagacagggccaagaagcaccactgccactaataaagaccaaaatatcgagtaagccaacatattttgagcagatctttggagaaaaagcaccaagagctgatagagaggtgatacaaactggaagctgaagagggaggaagctggtaaccttgtgggggttgcccaatgccagggctggttcttggccttgaaaggctcctagaaaggggtgagtgaatggatgatggggcagcacactctcactatggacctcagagatcctagctacaagattccatgccccctggagacgtttcaactggcagggggattggcccaaacagtaggcagagacagagctccagaatacatggagcccaggggttttcatatctaaggcagctgcagcagaaggtggccataggcgcccatcccctaagacttcttatttcccctggagtaggactagccccacctgaatgctggggcaggccagcctggggccagcttccctgtgggacagaggaacatctgttctgcaggccctcctcccctacagccccttccagggcccctgccaagctgccctgcaggaatgtgtgcacagggcagcctctgctgcctagccttgttttttgctggtggttccacctgagtaccttcctggcagcctgggagcatttcagattccccagcacagctggtgcctgaccctgagggtccagacgatggagccacaggctggtcccagtgctacagggctacagcacacagctggggctgtcgagctaagagctggggctggcactcaagtaggggagaaatcccactttcagaacactgaaaggagtgagacacgtgggttcgtgggccagtgcaggaatgggacatgccttcctccacagtgctggtctgggaagggtgtggcctgtctggcagccatggcctctgtctaagggagccctgcaacccaagacaccaaacaacagtaatgcaggtacagtgccagtgataggagggacctcacccatggtccaggagtggcccttatgagtggtcatctctctccccaaccccaccacagagcacggctgtgaacacacagaaatacaaaagaactatgcagctgagtaagagcctatccactggacactaatgttaaatgccagctactggatcacagccaaaattacaacaccaaaataattctgccaatatacatctctgtgacacccagggcaagaatctaggcacagtaaagatctatatagagctgtggccctctgaaagcacccagaaacaaggccagttgactatactcgacttacactgcagttaaaggaacaatagccctctaacatgagaaagaatcagtgcaagaattctggcaattcaaaaagccagaatgtccccttacctccaaatgagcctgctagctcaccaacaatagttcttaaccagattgaagttactgaaagacagacatacaatttagaatctggatggcagggaagctcatcaagattcaggagaaagttaaaacccaatccaatgaatccagtaaaacaattttacaaaggtaaaatagccattttaagaaagaaccatactgaacttctggaattgaaaatttcactacaaggatttcataatacaactgaaagtattaacaacataacagaccaaactgaggaaagaatctcagagcttcaaaaccagttcttcaaatctacttggtcagagaaaaataaaggaaaaagaatgaagaagaatggaaaaaaaaaacctctgagaaatatgagattatgtaaagaggcaaaacctatgactcattggcattcctgagagagaagagagaataagcaatatggaaaacatattcgaggatacagtccagaaaaatttctccaatcgtgctagaaaggttgacatgcaaattaagaaatacagagaattcctatcagacattatataagatgaccatccccaaggcacagtcatgagattcaccaaggtcaacatgaaagaaaagatcttaaaggcagctagacagaagggtcaggtcacttacaaagggaaccccatcaggctaccagcggacatctcggcagaaaccttacaagccagaagagactggggacctattttctgcatccttaaagaaaaaagaaattctaaccaagaatttcatatcccaccaaactaagcttcataagcaaaggagaaataaaatccttctcaggcaagcaaatgctgaggaattcattacaactagatcagccttacaagaggtccttaatagagtgctaaacatggaaacaaaaaaccaccacctactaccacaaaaacacacttaaggacatagcttagagacactataaagcaactacataatcaagtctacaaaacaaccagctaacaatacgatggcaggatcgaaatctcatatatcaatactaactctgaatataaattgtctaaatgtcactacttaaaaggaatacagtggcaagttggataaaaggacaagacctgactgctgtcatcaagagacccatttcacatgtaatgacacacacaggctcaaagtaaagggatggagaaagatctaacatgcaaatgaaaaacaaaaaagggcaggagtcacaattcttttatcagatatagccgattttaaaccaaccaacagtaaaaagggacaaagaaaggtattatataatgataaacggtttgattcaacaggaagacctaactatgccaaatatatacatgcccagattcataaatcaagttctgcttaacctaaaaaaagactcagacagcaacagagtaatagtgggaggcttcaacaccccactgacagtgttagaaagaacatccaggcagaaaactaacaaattcaggacttaaacttgacacttgaccaatcagacctaattgaaagctacaaaatacttcatccagtaactgcaggatacaaattcttcccatctacacacagaacatattctaagatagatcacgtgttcagtcaaagtaagtctaaataaattcaaaaaaatcaaaatcataccaagtatactcttggactacagtgcaataaaaagagatatcaatattaagaagatctctcaaaactacacaaatacatggaacttaaacaatttattcctggataactcctgggtcaataatgaaattaaggcagaaataaaaaaattctttgaaattaataaaaattcattcattaattaatgaaattaatttcattaatgaaaataaaaatagaatcacaacttacaaaatcttagggatgcagctaaaactgttaaaaggaaagcttacagaactaaatgtcttcattaagagaatcaaattaacaatttgttaatttaaatcaaattaacaatttgttaatttaaatcaaattaacaatttaacattgtacctggaggaactagaaataaaagaacaaaccagcccccaaattagcagaagaaaagaaataaattagagaagaactgaacaaaactgagatgcaaaaatccataccaaagatcaatgaaatcaagaattggttctttaaaataataaacaaaattgataggctgctagctagattaacaaaggaaaaagagaagatccaactaagtacaatcagaaatgacaaagatgacattacaattgaccccacagaaatacaaaagatctttagagactactatgaataactattcacacacattagaaaatctagaggaaatggataaatccctctaaacacacaacctcccaagattgaaccaggaagaaagtgaaaacctgaacagaccaataataaattctgaaattaatcagtaataaaaaactgaccaaccaaaaaagccctagactacatggattcacagccatattctatcagacatacaaagaactggtaccaatcctacagaaattattccaaaaaaatcaagggaggctcctccctaactcattctacgaagccagcatcagcctgataccaaaatctggcagagacacaacaaaacaaagaaaacttcagtccaatatccctgatgaacacagatgtaaaaatcctcaagaaactagcaaaccaaatctagcagcacatcaaaaagttaatataccatgatcaagtatgctttattcttgggatacaaggttgattcaacatatgcaaatccataaatgtgactcaccacaaaagcagaattaaaaacaaaaacgatatgatcacttcaacagacacagagaaagcttttgataaaatccaacatcccttcatgataaaaaccctcaacagactaggcactgaaggaatatacctcaaaataataagagccagctatgaaaatccacaaccaacatcatgctgaacaagcaaaagctagaaccattctccctgagaactggaaaaagataagaatgcccactctcaccactcctattcaacatagtactggaagtcctagccagagcaatcaggcaagagaaagaaagaaaagacatccaaacaggaaaagaagtcaaactctctctttgctgacgatatgattctgtacctggaaaaccctaaagaccctgcccaaaggctcctagaactgataaacgacttcagcaaagtttcagaataaaaaaaaaaagtgtacaaaagtcagtagcatttctatacaccaataacgttcaagctgagagtcaaatcaagaacaacacaatcccatttacaatagctacaaagaaaattaaatacatagctatatagctaaccaaggaggtgaaagatctctacaaggagaactatgaaacactgctgaaagaaatcacagataacacaaacgcaaaaacattccatgcttaggaactggaagaatcagtatcattaaaatgaccatactgcccagtgctacctacagattcaacgctatccctatcaaactaccaacgtcatttttcacagaaattagaagaaaactattctaaaattcacatggaaccaaagaagaacccaaatagacaaagcaaccctaagcaaaaagaacaaagccagaagtataacactacccaactttgaactatattataaggctacagtaaccaaaacaatatggtactggtacaaggacagacacacagaccaatggaacagaacagagaactcagaaataaagctgcacatctacagccatctgatctttgacaatgctgacaaaaacaagcaatggagaaaggactccctattcaataaatggtgctaggataaccggctagcaatgtgcagaagaaaatggatccctacctttcaccatatacaaaaattaactcaagatgaattaaagatttaatagtaagacctcatactataataatcctagaagaaaaccaagaaaatacccttctcaacactggccttggcaaataatttttggctaagtccccaaaagcaactgcaagaaaaatacaaatggacaagtaggacctcattaaactaaagagcttctgcacagtaaaactatcaggctgggcacagtggctcacacctgtaatcccagcactttgggaggccgaggcaggtggatcataaggtcaggagtttgagaccagcctggccaacatggtgaaaccctgtctgtactaaagattcaaaaaattagctaggcgtggtgatgcgcacctgtaatcccagctactcgggaggctgaggcaggagaatcgcttgaacccgggaggcggagattgcagtgagctgaggtcacaccattgcactccagcccaggcaacaagagcgaaactccatgtcaaaaaaaaaagagaaaagaaactatcaacagagtaaacaaaaagcctacagaatgggagaaaatattcacaaaatacgtatccaacaaaggtctaatatcaagactctaaaaggaatgtaaataaatcagtaaggaaaaatcaaataactgcatcagaaaatgggcaaaggacatgaacaggcacattacaaagaagaagacacacaaagcagccaacaaacaaaaagtgcttatcatcactaatcatcggagaaatgtaaatcaaaaccacaatgataccatttcataccagtcagaatggctattactaaaaagtcaaaagacaacagatgctagtgaggttgtcagaaaagggaatgcttatacattgttggaatgtaaattcattcagccattataagccatttggaaatttctcaaagaacttaaaacagagctacgatttgacccagcaatcccattactggctatataaccaaaggaaaagaaatcattctaccaaaaagacacatacactcatgtttactgcagcacttactcacagtagcaaagacatggaatcaacttaagtgcccatcaatacggattggataaagaaaatggtggtacatatgtaacatggaacactatgcagccataaaaagaacaaaattatgtcctttgcagctggaggccactatcctaagcaaattaacaggaacagaaaaccaaataccacatgtcctcacttacaagtgggagctaaacactgagttcacatggacatgaagatgggaacaacagacactgtggactactagagagtggaggctgagagtaggatgtgtgttggaaaactgcctactgctcactacctgggtgatgggatctgtaccaaacctcagcatcacgcaattcccatgtaacaaacctgcacatgtactccctgaacataaaagatgaagttatttatcaaagaaaaaaaagttcagcaactagctggcagtctctatttaaattttataaagttaaaaattaattaaaatttaacaatattacttatttacctcacttgattcaaaatcaacccctttcgatacttgactctgggacatgattttgctggatgatgtgctggaccacctgaggcaaaacaaaaacaaaaacaaacacaatgaactacataattcatcaagtgtgcctttctggctaagtttttcaatccagcagctgccacgaatataaataacacacaattcccttaaaatctacattagcggcaataaaacttaactgtaaggaaaaggactctggggccgaggtttgaactctggttttgccctttactacctatgtggctttgagcaagttacttaacctctctgtgcttcaatttcctcatctgtaaaacggggataatggttttataaagactaaatgtgttaatatgcttaaacacttagaacagtgcctgacacatattaagtactacaacaatacttacttatattattatagtacttatcatgtaccaaaatgtatacattaccatcttccacttctgaaaaccatgggaacattgaaatattttctattcaaatctcagttaataagaaaatcataattcctactctttttactcttttttttttttttgagatggagtctcgctctgtcaccaggctggaatgcagtagcaccatctcggctcactgcaacctccacctcccagttcaagcgattctcctgcatcagccccctcagcatgccaccatgcccagctaatttttgtatttttagtagagacggggtttcaccaggttggccaggatggtctctatctcctctatctcttgacctcgtgatccgcccacctcggcctcccaaatgctaggattacaggcgtgagccaccacgcccagccgattcctactcttacaaagcttaacttgcagtaaattcctatgtcttttaattaataagaaatttaagtcactttagatcggggccagtaagcaaatctagcccaccaccaggttttgttttttttatggcctataagctaagaatggttttcacattttgaaatggttacattttaaatggttatacaagtgtctacctacataatatccccggttttgcctcttgacctgccgagcctaaaatactccttatctggcctgttaagaaaaagtctgctgattcccgtcttcaataaaagtagtgtttataaattcttagtctacaattttattaacatgctttgggatgtcattatagcaaaagaaatatgtccaaaggttttatctggaaaaaagaatgagaatcacgagatcttatgtcagaagtaaatagaaaaattcacaggtcctttgcactaaaggaaaggacagaaggatttatcaggcaaacttgaagagcaactaaggttcagaggtagcagattagcacaattatcaaggtccactctggtaagtggcagagcttaaatagtttaaattataaataaaacaccatgcataacctgcaattactaaaacattctgcaaaaacagtctaaattatcatttagatgctgtaattagaaacaccaatctgccaaagctgatttctgatgtgtttccaaaatgtcaattttggaaattgcctctaaaatgttaaacagcctctcaaaacttaaatgattcttattgcttgcacaatggtcagagaagttagttaccataccaagaagcaacaacagagatgagtttggggtcagaatgcctggactgtatgactagttgggtgaccttaggtaagttacttagccactgtgcttcacacttcatctgtaaaatggggatgataaagttataactataatctatctcctggggaagttgtgagcaccacgcaagctaattcacatgtaaaatgctcagagaagtgcctggcacataggaagtaccaaacaactgtgagttatattactatttcatgtctaaagaaatcggcagacatttatacagctgaaaagtaaacaatctactgtgatatcaaaagcaaactattttttctttaatatccttaagcatatatcaaaaatatcagaatagcattttgatccatttctggaaaaaaaaaaacttagaaagctagatctgatttgtgtgtgcttcaatttacaaagacaagaacaaccaaacaaggactcagaaaggggcccttacttccttccaaaacctgaggtatcccgataatcttccaataaatctccttttctgtaagagaatctgagttaggtttctatcagctggaaccaaaggagtcctgttaaatacacataaatgagcctgagaaattcaagtaaaccttcgtgagctaaaataagtccctccactacttaccatagacatataaactgatttgcatctgcgcccatcttggtattttttactcctataaaggccagtacggccttctgcaactctatactctcccggatttttctcatgtctttattgtttttttctactctacccaaaggctgagtaaggttaaaactgcaggctaggaaaacaaacactcttctgctctgccttcttttttgaggtgatcctatccatcccaatggttttaagtaccatctgcacgctgtccagaggtaaatgtaagtaccatttcaaaccccttatctgggacgagcacggtggctcatgcctgtaatcccagcacttgggaggccgaggcgggcggatcacgaggtcaggagatccagaccatcctggctaacacggtgaaaccccatctctactaaaaatacaaaaaattagccgggcatggtggcagggcctgtagtcccagctattcgggaggctgaggcaggagaatggcgtgaacccaggaggcggagcttgcagtgagccgagatcgcgccactgcactccagcctgggagacagagcgagactccgtctcaaaaaacaaaacaaaacaaaacgaaacaaaacaaaacaaaaacccttatctgagttctgaattcacacattcaattgcctataacttcccttcatgtaagtttctaggcatctcaaacttttcacatctaaagtggaacttttaattatatgcctatcattccctacaacacatctgtcctttcttttgtccccttctcaatatatggcacaatgtaaatgctccagcaagaaaccagaaaatcagtcttgattccttattctcccttactccaaatgtttaatccatcttcaagttttgtcatgtctatcttcaaaatatatcctgaaaccatctgtttcctccatttcacctaccaccagcctgtgcaagcctccatcgtctctcttagctcagactacctgcagcaccctcctttcagataagcttgtttacacttgttctgcaaccacagtgatcctttgtaaatgtaaatcacaaggtgccactcctctcttaaaatctttctgtggattcccactgcatttataacaacatccaatacctttgtagtgctcacctgttcctgcagcatgatttaccctgtgtctcttttctattctcatctcaaacaacctccttttccaccacacattagtcattggctcctaaataacattattaaacttgcttcttcaatagactgtgatatggtttggctgtgtccctaccaaatctcatcttgaattgtagctctcgtaactcctaagtattctgggagggacctggtgggagataattgaatcacgggggcagttcccccatactaatctcgtggtagtgaataggtctcacaagatctttcacttggctctttttctcttcttttgtctgctgccatgtgagacatgcctttcaccttctgccatgattatgaggcctccccagctatgtagaaatttgagtccattaaacctctttgttttgtaattgcccagtctcgggtatgtgtttatcagcagtgagaaaatggactaatacaggctgcatgcacttgtccctctgctttttgcaaggccacatttcccttattaaaatttccgcttaaatgtagcttcctcagaggctttccatgaccatccttcaaagtagatgcccgtcctgtgccactgtttcttctctctacaccagatcatttcctttaatgcatgctaactgatcggctgatcaccagctcaaatgtcacctatcttctttgtaaaaccttcaatgacctttcccaggaagatactggcacgtcccttaggtttcattacacctgaagaaaacatttatcttggtggattagcagtgccctgtaattagcataccactaaagtgtaaattccttgaaggaagaaacatttatctttctatccccagaacctagcatgatgtttgaaggatctaataagtgaacgtggaactatacttacacttgctctaacattaacctttaagtcacatacagcttatattctcagtggggtcagtatcataaagaacaaaaattggctccaggggatagagtgggatgaaaaagctacggtttttggccctctcagactcaaccatacccaaaaaaatttcattctttaagtatttaatttctaacgttagggagaaattgacttacatctaagttacttaattcttctccttggataatcaagaaatggctgagataatggaaaaaaagcttgagaaacactgatataaggctttttcctcaatcacccttctttctggagttcctgctcatgcccttattctcagctgggaccaccgttttccaccctactaagccaaatcttatctttgaaacctcaggtcaattttattccctccatgaagctgcttcttctagcccacattccttgttccttttttcaccagcccataagcactcacacttatgggtctgtaatataaaattctacacctaattatgtactaattcattctttgatgaattcaaatatgttcatttctcttttccactataattgaagttacctgaaggcagaggccatattaaaacattcgttatgcccctccctcatcagacctaatataatgctcaaacagaaaataagtacaaaataaggcagttgattactttattaagtagaaattctcattattcgagctttagttaagcagtattcaaccaaaatgttaacgtataaaagcaaatggtaatagtgaatcaagtcaagcttaacagcaataggcaaaaaatcccaaaacacacaggaagagcatgcaagtcctctgaaggcagactgagtctacgtgatccccttttaagtgtttagtacagtaccatgtgtagttaagaatataaaaataagacaatgacaaaaagctgaaatcaaatgatagcaaaatacaaaattattttctgttatttggagagaacacagtcttccattaagaaaagcactgaggccaagcgcactggctcacatctgtaatccaggcactttgggaggtcgaggtgggtggatcgcctgagctcaggagttcaagaccagcttgggcaacatggcaaaaccctgtgtctaccaaaaatacaaaaaattagccacgtgtggtggtgcacgtctgtaatcccaactattcaggaggctgaggtgggagaattgcttgagcccagaaagtggaggttgcagtgagccaagatcgcactactgcactccagtctaggcgacagaatgaggcactgtctcaaaaaataaataaataaataaaaagaaagaaaagcactaataaagtcaaaaggaaaaaaattacaggctatttcaattttcactgaaaatccttgtactaatgctgcatcaactctataaactagcccttggtctgttttcattcctctacatactttactagttgaaaataagtctgttaaacttacatggcatagaaaaatgtgtaactttggaattctggataatttttaatttttttcagatgtttcttttgcagaaaatcactgcacctacctttgatctgtctttgaagtggtaggaaaaatgtcttcttccacatctgattcatctacctcaatcacctggcaaggaaacaaagcaacaaacagtttttgtgagaatagactctgaataaaaatgaaaatgaagaaatgaattacacgattaaatcttaagttatatatgagccacaaaaaaggagacagaaagccataaccattaaaactaacactcagtctgacctccctccaatgtccctcttcattcacaaatgttactttttgctcacctctctcctggccatcccaggagcctgagcacctaagggaacacagttacactggtgaatgacttgcataggctcatatgcagaccttatgactttcctcttagtttcttatgagaggtgagaccatcagtgttccatctccaactttaaatgaggtatcagaccatgtgggaaatactagatatctttctgttaaatctgtccctcttaaataccatttgttagtgttaagacccaataaagatatttctgactgttgattctaccacccaaaatactatttctctacattttgttatcttgacatttgatacatacatttgccatatcttcatctaacttaagtacagatgaggatgaagccaaagaccaaatactgaacgaacagcccctgaggctaaggatgctgttaaatatcctacaatgcataggacaacccttcacaacaaagaattatctagtccaaaatgtcaacagtgctactatggagaaaccctgatgtaaagggaagagtattggctcgggagttaagacacacagttttgaaagtgaagtaataagagaatcaagcccatattggactcttcttggaatcgaaaggaagagcagaaggcccaggctaaacctagggcaaaccacatggatcgctggactccagccttttcattcatcttaagtctagcaacagctgttaaggcacagctagtattttgggaagataagtaacaaaaggaaatccagcatagaaaaaacctctataaccattgaactcaccttcaatattagtattccatgtatgagctcttttggttcaacactgttatccttgaaaacattactgtatacataacatttatggatttctataataaccattatttaaaaaaagagagcaaccaagaaaaaaaaaatcaaatcctagaagccctagagataattggtaaagctccttccagctttaatgttccataatttttcttcttttatttactttgtaaatcagagagttgacaattcataatgcagaaaacataaattattaatacacaaccataaaactttttttcttacctctgaataattcttagtagtgacatttcgggaaggctgctgtcttgtagatttaaaggctagaatgaaaaagatgaaatgtgcattatgttattcttaaaataacttagaaaaacttgcatacttctttagctaaagattttctgagtcctatctgcaaaactgaatgatgcctaattataaaactatttgatatttttaaaaatctaaagggagatagaattataggtacgcataactcaatgcccaactgtcagtctcattatttcccagcttattgagatactgtagtgtttataaatacacacactaaaaatatttcatagaaaaacacctgaaggataaaatctaatcacctaaccaaatgaactacaaatgtattgaaggaaagcctcctaatcccttctttgttgttgacgatacctttatccctgttgctacattaggagccatggggttccagtagtttctcattttcctctaccttagtagccatattcaatatctaagaaatattccagaggagaattctagaaaacagcattctatgataaaaattcctttgtatccataccttttttccttttaaacttggttagatacttgaagtttagctagctctttatctttccctttctttttccttgacatcgaaacctacaataaggccaggcgcagtggctcacgcctgtaatcccagtgctttgggaggctgaggcgggcggatcacttaaggtccagagttcaagacaagcctggccaacatggtgaaaccccaactctactaaaaaatatataaaaattagccaggcatggtggcaggtgcctgtaatcccagctacttgggaggctgaggcaggagaatcgcttgaacccaggaggcagaggttgcagtgagccgagatcgtgccactgtgctccagcctgggcaacagagcgaaactccgtctcaaaaaacaaaacaaaacaaaacaaaacaaaacctacaataaatttcaaacgtctaatttaggtttattttctcctatgccttaccagtttgctaatatcaaaaatatcttccccaagataactcacaaactaaatagggcacagaaaaacaaacaaatactcaaaaaatcctgcaaagtccaaaattctcctagtcagaaaactaacgaatctttctatctaacctaaatttattgtgtttgcacatgtttcctattctaggttctgtccccaaacttgtaatatctaagaggagaaacgagaggcagaaacagtgttcttatctgctttactcagttacttttttcacatcctactctactcaaaaggctagacagagcaactgaataaaaaatccagtgatcatgatgatttcaaagaatatttctgttcagtatttattcactgactcctttaactctgagatcctagaaaacaagatacctttctttttatcccactggaaggcaaaagatgagtgatgttgtgaaataattttatcagaaaactaagcaatatgttctgttaggaagacaataaagtgtggtggttaaaagctctggttttggagttagactcattttgacttactagcttgactatggccaagctccttggcttctttaaaactcaatttcctcgcctgtaaaacagtgttaatacttcatgcagaaaactgctgagagggtaagaggaagtgtctagcagatagaaagcattcaaatacatgtagctgtttgggtagcaaacatagtagcagcagtggtacccatagtggtataaatgaaatgtaaaggccgtgacttcagaggtacttttattcacctagccactatcctctgctgactaacttcaatggaaaaatctgggctgtcaactcctatttacaactcccgtggctacaagtgtaatttttatcttttccaataaaattgcagcacaataataaatttccatactccatggaccttgttataagagaatttgacctttatttatctcttcactcctccatttaaaacagagatctagaagttacagtcttaatttgttgcttctgtcccaaagtgatgacaagtatagttactacttcacaggtattctgtcagagacttaaaaaaaaacccaccaaatccaacctgataaaaatgtttcacaaatttatacttaaaaaatcagttcatttttcaaaaaaaggcctagtactggaggtaatcagttaagttagcgaaaccattatatcaaatcaattagataaaagacaaatttagaccaatgattcacataatattcatcttcataatcttattgcaaaacactaccactaatattaataacagctatcatctgtcgcatttttaccaggtgctgtgatcagtactgtaaatacttaagctcatttaataaaattactctgaagtcagtacaacattgtcaaattttatagctaagggatctgatgcttgtagaataacaccagtttgcacttactgagggcttaatatgcatagacactgcctgatacttcacatgcattttctcattaatcctcaaaataacgcaatgaggtggacgcaatcattgtcccatcctacagatgagaacactcattcctaaagatgaaaaacttaacatatttgctggaggacacacaactagtaaaattgagaagtcaggatccaaaccaagatcttcctcactttagaaccatggtcttcacccttacgctacacaatctccaagtaatttttactcagtcattgtcaagtatttaacaagcatctactatgttatgtgccaaatatagtggatacagtgatgaggaggaatgatgcagacccctttctcacagcacttacagtgcaagggtgctaagccagcagtaaagagctggctgtgactgacccaatggacctgactccagagcctgcattcttaaccatcatgctctgctgcaaaaggtaccataataagatttttgcttacaacataattcaggaaatctgacgtttcgtatttagtttatttacatagcctcttttcatagatgaatactgtttccttaaaaaaattagtcaagccattctgtaaaacttttaaggcatcataactggtctccagtctttctacacaaatagaagctttattctatgttgtcaatgggtaacagtcattgcaggctaggttattcagacaaaatgacctctcattgtcttcaaactcacttctgctgacaacaatccaaattagtacctcaaacatttaaaaaaaaaaaaaaattctcaatggcattgaagagctgatcacataccaaggaattaccaggccaaaactgaagaaaagctagaactcagagaggtaagcagagtcctttccctgagttcacttttcaattgggaaaatgttaacattggttttgagaatcctgaagaaaaatagagagggctaccacagcccacggctgcccaaagtgaaaaccccgatgcatttcccttcctaaggtggagccccagtggttgaagagagaagcagaggtaaacaggatttcataagcatgtaactgagtaccctcatttttctaagaggtagttcattactttttctctctcttcttttctcctttcccccactttctacttagttctttagaaatgcaactatagtcttttacttcctcttcatcagagactccctaaaaggggagttcatctaactatgtgcttggaagctccagagttgaactatcacccaccagggggttgcctctagagataacagtcaattcacaatccaaagtcctgctatgaaactctcgccaacctagagagtattcggccacctttatagcctatttctacccatgaagatgccaattcaactgcctggtagataagacaccaaactagaatgcaaaccccccacttgctcgcttcctcccctgcatgccactcctgataggtcccctttaaaagagtccactttctgctgcaaagggggaagcagtacccttaaggtaggaagcctgtatttcttcccctaagttcgctttggaataaaaagtcactttctttataccacaccttgctcttgttaattggactttgcaagcagcaagtgactgaacctgcattttagttacaagtacgtatcaaatgactggtccaagaaaccctcaaatttagcttaaagtggtctatgacttgtggtgccctacaaacctagagaaacaaacgtgaatcttctctgaaggaagatggcttcatccaaggtctcaaattattcctgttgataattttctagggacagtaagtaacaaagcatggaaggaaataagtcaccataaataagaacccacagaaacagacaacagaaagaggccaaagacattcagacactaggttattagatacaaaataaaagaagtccttactgtgtacacacgaaaaattaaaacaggcctaaaaatatcttcagaaaacttctaaaaactattaaaagtgacagagcatattttaaaggaagcaaataggctgggcaaggtggctcatgcctgtaatcccagcactttgggaggccgaggcaggaggatcacatgaagccaggagtttaagaccagactagccaacacagtaaaaccgtgtctctactaaaaatacaaaaattagccaggtgtggtagtgcacatctgtaatcccagcgactcgggaggctaagacaggaaaattgtttgaaccccgggaggcagaggttgcagtgagccaagatgatgccactgcattccagcctaggcgacagagagagactctgtctcaaaaaaaaaaaaaaaaaaaaaaagtgatcagaaataattattcagaatgtagcacagaaagagaaaacagaaaatacaagagtcatgtgaggagagagtaaagaggtcttatcattatttaactgaagactcagaaggagaataagaatagcatagaggtaacatctgaagggataatagctaaggattttctagaagtgacggaagatagcagttcagagattcatgaagcccaataattgctaagcaggctaaacaagagtaccatctttagattcatcacagtgaaactgcagaacaccaaaaacagcaagctgagagaaaaacaggttattttttaaaaaacaaaaaccaacaagcttaactgatatctgatttcttaattacagtggaaactcaaagacgactcattttaagtgatgaattctacccactggagtcaaggaaagcttaacataaaacaagccaggacactggattccacaggacacaaaaacacaaaaacaaaaaagaaaaataaaacaagacaggacaaaaaaagacgatttgggctaaggtaaaggtgggtaatctacatctatgactctgtcgattgcatgctaaccaattttggtggtttaacatggaagtgttcattattttattcactctttttctatgttcctgttttctcatttttaaaagaacacttgataaatgcctactgtgccaggctttttgatcatttaatcttcagaataacccaatacaatagagattattatttccaatcatatctaaacaaactaggagagtgactgatttgtctcaagtcacaaagctgtcatttgttgaatgcaaggttgaactcagcatgaatcctttacaattttccaggctgccttttctctctttcttcctctctgcttttatattaaacctaccaagaatggaacagcatctttccagataccactccctaaatggcaataaagacaacatgtttgtgaagcaaaaagctaaggatcttagctagctcttctgaagtactaaataatacttgagtaaaaatatagcaatggaattttttgtaaggtttaagagtcatttaatcaacctgattttgtatcttttcttcaatgtcagctgtcatttgataaatgttgaaaattcctttaatggagtgatacttacttccaaggcaaattagtccatctttatattaattacataggttattctgcataatgcaaaaattattctatggagaactagtagctaggtctctaatcttaccttgctctggaaactagtacagtggtcaactactggttgtagagtgcagagaatgtgagatcattcccagatctggtactgacaagttatgagatctaggataagctacctatctttttaaagcctgtttccttttctgtaaaacagaaataatatagtaagtacctaccccacagacctgttaagaggcatgcagtttcataaatattagctattattgctactattagtggttttatcaactcagggcaaaactgcttggcttagttccctcacatataaaacaggggaacaaagttgttcttaaatcttccaggtccattctatcagatgagaaacttaaatcagtatgtttctagctattcccatccatccccattgggccaggagttcttaagctggaaaacacgaatgcgcctcatgggagtggctgaaccctttgaaattgggtgcaattgcatgtgagtacttatttaaggagagaagacatagctttcatcagatttttagagaatccataagccaaaatagattaaaaagcattgcctttgggactaaacagatcaaatctattcattccacattttacacgatagaacataatctacataaagatctgaatgtttcccaggttagatatcctaaatcctaagttccttcaaccaatttttttttttttttttttttggagacgctccgtcacccagttcagtggcatgatctcggctcactgcaacctccaccttctcggttcaagtattctcctgcctcagcctcccaagtagctgggactacaggtgcacgccgccctgcctggataattttttgtattttcagtaggggacagggtttcaccttgttgcccagactggtttcgatctcctgagctcaggcaatccgcccgcctcagcctcccaaagtggtaggattataggcatgagccactgcgcctggccaaccattttttatattatttggtatctcttctgaatgatcatatatagttgacagtctccttgaaatataattccaaagaggagtacagtatccttggcatgttatggccaatttagtacacagagagaacttccttgctgtgcaagcttgtccaacccacctcattttgttattgtttttgttctgttttcgttctgttttcttttgttttaggcttttagcagctgaagccatggtttttagtttctgtcgctagtgatatgaggaaaagaaggatgagaaaagggctttactggcccaaccagaaacagaaactaagaatccatgactgtattctctcccttggacacctctgcaagactcattaaatgctgtttaaaatatcaatagatttggacagttgggtatgcctgcataactcttactgacctaagtctttttcacctgggttgctgttaaactcacatacctctcacaactctacttgtgcagctgtccttttggacataaatgtggtttatattacccttgataaacttcatcttctgagaattagttcagctccccagtgtgtcaacaattaatcctagctataagattataaatattacaattataatatttaaaaaatatttataattataaaagtgaaacaataacctcaaataactgataatataaataatatacatatgaatatattctaaatgctaggtagaaaaaagtatcaccacctatcttaatgcatactttttgtaaatatgactaacattttaggctgatctcatcatctataatattaaaaatagttaaacagatccccttgaggccaatttttagaccataggatatacacaaattaattccaagggcctagccataatttctcttaaatataggtcacatgacttctctatatggaaagcagagactgacagggcagtatgggggaagcaaggaaacagtagagacagttcctctctctttcgaccactgtccatatagtgaccaactacttcactttcctgtttccagggtctctctgccaaacagaaacagcatttgtctgaaagtaagaaattataaaacataatttttgttttgttttgttttgtttttgagacggagtctctctctgttgctagggtagagtccaatggcatgatcttggctcactgcaacctccagttcctgggttcaagtgattctcctgcctcagcctcccaagtagctgggactacaggcatgtgccaccacgcctggctgatttttgtatttttagtagagaccgggtttcaccatgttggccaggctggtctcgatctcctgacctcgtgatctgcctgtctcggcctcccaaagtgctgggattacaggtgtgatccactgtgcctggcctataaaacatgattttaaaagcttaccctcttcagtaactctaatgcatagcaaagatcttttaaaaaataatttatcctgtgatcctaattgcccttataacttcccaatgattgcaacacaaataagggctaccaatggtgattaccttggtctttctaatgttggaatttataaataatcacttgcagtctatactcaccatctataatagacatatttctagatgctgacacagcagtctttgagttcctgctacgggtagaagtctccagaccagtgtctgctgttagaaaaatgaacagtcaatgtacaagcctatcagcagctaaggtttatttcatacaacactaaaaaatgaaagctaaataaacttatgtcaaatagtttgtctgtaaaaagccagacatatatataagaacaaacatctagagtctgaccaattttcagagactattcttttaggccacacttcagtttatccaatttaatttatccaattaaaatgtaaggaaataggctggacgtggtagctcacgcctgtaatcccagcactttgggagacagaggcgggaggatcacttgaggtcaagagttcaagactagcctggccaacatggtgaaaccccacctctactaaaaatacaaaaattaactggcatgatgatgggcccctgtaatcccagctacctgggaggctgaggcaggagaattgcttgaacctgggaggcggaagttgcagtgagctgaaatcgcaccattgcactccagcctgggcaacagagcaaagacaagactccatctcaagaaaaattaaaaaacaaaaataaaaatttttaaggaaaaattttgtaaatgtaagaatagtgaaaataatcatcattaaaagatgaggatttctctccctggagattttaaaccaaattaatattcatttcaccagcttaaaattcctatggatgcatatttaataaaaacaattttaaaaaatctttagagatgaactgacataatgtgtgagaaagtcactgagtgaccaatttctattggcgtgaactattcaatgacaatagtctcacagtaaatacaatgttgactatgttaatgactagttttaggaatcaaattggggggcagttttctttcttaaactgactttataaagactacttgataagcatatgtgtatttgtatcttatgacagtaacaaaaataataattgtatgatctggagttttcctcctgttgccaaaggcttttagctattttctttaacaactcatatttgcctattactttgcacatgtgaaaatacatatgacattaaatgtatccaaaaggtactacgtgacaaacacagtgaagcttttataaggtatgtgctaagaacaattaaaaccctaagtgcatgtggccattcaaaatttatttaagtaaaaggcacatgtcagaactgccttaaagactgtctttatatattataaaaatagatttttaaagaaccgtgttttagaaataaaacttataattcaactctgacaagatctaattctgtattttccactcaactgccaagtgtgaatgtgcacaggactgaactcagtgctcacctcttcctctttgagaccctcctctcgatgctgaattctgccctcttccacctcttcgacctcttcctcggcctcttcctttgttggttgctgctgagatgctatcatcagagtcattagccatctgttctgctaaatctatactcataaggtcatcagcactaaaggcagaagcagactcctctgactgagatctgagtgctctggccctggtcatagcctaagagggagaagaaggagaaagtacacacaatgagataacgtaccatcctaaaaatcattaatttaggcattgacatgaactaatcatactataaaaacataaaggaggctgacacagtggctcacgcctgtaatctcagcactttgggaggccgaggcgggaggatcacttgcacccaagagtttgagacaagcctgggcaacacagcgaaaccccgtctctacaaaaaaaaaaaaaaaaaaaaaaaattaggcatggtggcatgcacctgtagtcccgagctacacaggaggctgaggcaggaggatcacttgagcctaggagatacaggctgcagtgagctatgatcacaccactgcactccagcctgggtgacaaagagagaccctgtctcaaaaataaaaataaaaacaaaaaatatttatatatgtgtaaaggagaacctccccaccaatcaaatttaatacttattatctgtcagaccaatctaccatactacctataaaatgagaccctttgaaaaggtttaccaagaaaaataaaattttacagaatcaaaattttcagaactagaaggaatactggcaatcatccctaattcaatgccacatttgacagtaacagactgtcatcatttgagctactttttagaatcggctcctaggaaataataagaaaaaaacttacaaaaaatagccgttatctctgggcactaatattttagggtgcttttgttttttgttcttgaatattacatattttctatattacactttttctaaaaaattagttttataatcagaaaaaaacatgagtaacaatctctcacaaatatatggtaaagagaattaagggctgggcgcagtggctcacacctgtaatcccagcactttgggaggcctaggtggatggactgcttgagatcaggagttagggaccagcctgggcaacatggcgagaccctgcctccaccaaaaatacaaaaaaaaaacacaaaagaacaaaattagccaggtgtgatggcatgcacctgtagtcccagctacttgagaggctgaggtaggaggatcgctcaagcctgggggaagcagtggggaggggagttgttgcagtgagctgagattgcaccactgcacttcagcctaggtgacacagtgagaccttgcctaaaaaaaaaatgaaaagaaacggaagaattaaggagaatatatcaactgaaagcctaagcctaagaaggaataaacaccttaggaccaagaacatgccacgcatttttaatttggtaagaatccatttagaaaagacatcgtgccactgcactccagcctggcaacagagcgagaccctgtcaccaaaaaataaaataaaatataaataaaagcaattttgccttgatcttcccttaaaccaatcaaaaggtagtaagagaacaaaaacaaaatacattttccataaaattaaaaaatagttccaaacccccaaacacacaaactataaagaagagttaatgaatatgataaatatttgacctagctaagggagaaaggtgagaagagtttcaggtattatacagctctccaaaactgatgtataaatcccaagaagacatgataacagtctctcttgcttggaatggcagttctgggtctaagaatagctgaccagaacatttctaagctctgtgataccataaagtaaggagacccagggctaaatgaggagatgtgaacaaggcaggcagcataaagtgggactgaagtggcaacttcatgatgagatgatctcagctgaggtgaaatcacagctaactcactgcatgcagggttcaatacagcattacaatgcaaaaagaaaacacttcaggaaatacaacaaaaaatataagaaacaacagtgatttcaattcatctttcctgtcccacatgaaatacagttaatcctcattattcattaatcctatatttgcaaattcaccgacttgccaaaatttctctgtaaccctaaaaatcaacactcacgatacttttggcatcatttatggagacgcagagtggtaaatattttgaattgcctgacacacatattcccagctgaggctgaacaatgagccactctgccttcttgtttccacttgtgtactttaaagtgtcctttctgtgatagtcatgcattgcttaatgatggatgcctcatgagaaatgtgtcatcaggtgatttcattattgtgcaaacatcatagtgtgtacttacacaaagctaaatggtacagtctactacaaacccagactataggagatagcctattgctccttggctacaaacctgtacaacatgttactgtactgaatactgcaggcaattataacaccatagctatgtatttgggtatctaagcatatcttaatagaaaagatatagtaaaaatatggtattataatctcatgggaccaccactggatatgcagtctgacatcgatcaaaatgttgtatgtggcacatgactacatatttattgcattttctgcatttttgtacttttgctttggtaatgtggtgttttcaaatgaccccctcaacatgtttagtgttcattcctacatgcaaaaaggctgcaatatgacttttggagaaaaaatgtatattagataaacttaattcaagtataagttaaagtgctactggctatgagttcaatgctaatgaatcaaatgttaaatacagtatctttaaacagaaacacattaaaaagattacgtattgatcagctgacaaaaacgttatcagtggctcatagaaagctaattttgtatttcccctaggagcaatgattcaccatttgctaattctgtgctggaagtgattttatacgacataactaccacaaataaaaggaaccagctgtatgcttttagaaagcagacttaagagaaaaaagatgatctaaatcacataattaataagatagatctaattgataaatgttgaattctatacactgaaaattaataatatacttcaagaccccatgaaactttttagctgatacataacagggtgcaaacaaaaatctcaatacatttttgataggagaaataaatttatcacactgtctaatcatcatgcaataaaataaaaaattaataataaagcaaaaacctgcctcctgaaaacaaaccagagtcaaaactataaaacaaaacgaaagttgcagaacatctagaaaatcataacaagaatactgaacatcacaacatatgagagagctaaagcaatgcttataagaaagcctatagcctgctaagaataaatgtaaataagttaattctgtatccaaaaagctaggagaaacaaaataaagcctatccaagtattagaatgaagatgaaaccatatattaatagattttaaacaaaaacacattagaatgaataaatataagcactggtcctttgggacaaaacaataacattaataaaaatcacaaagctttaaagaaaggaagaaaacacaaatatacatcattagaaataagagggacgggcgtagaggctcacatctctaatactagcactacaggtgtagaagctcacatctatactttgggaggccaagtcaggaagatcacttgagccctggagttagagaccagcctgggcaacataacgagactccgtctatataaaaaaaaaaattaaaaattagctgggagtggtagcacactacagagcaagaccctgtctcgaaaaaaagaaagaaggaagaatgggagggaagacccaagacttatgagagaatgctcaattctaaataatctggaaaatgaataacttaatctgatccaaggtgggaaaaaaacaggttcaacaaaccaattatcaaagaaaattttgagaaaattattaaaagaaaaatactcccaaaaaaggaccacaatcagaaagtttcgtaggtaaattctaccaaactttcaaaaaacagataagcccactgctatttcaatagtgccagagcatacagaaagacagcttccaaactgttttcacaatgccagtatgacacagtactgacaaagaactgcgtgcacaaaaagaaaattacagaatcttatttataattatgaaagcaaatagagactccagaagcttatggaaagaccaatatatccattaccagggggtaatggatatattaccaggatgggtcaataagctatgtacataataatataactcactatattaatggaacaaagaaagaaaaaacccaaatgtatatcttcataaaatcagaaccatgtaatcaccaatcattcctgatttaaacaaataagctgatgaataagtggatactttatgtgtcaaaaaaccctaaatatgctatattactatgtgtatatatccagagagagaaagagagggcacacacacacaaatgtgttcaagtgagtgctcttacaaatcaattagagaaagaccaatacccggccaggcgcggttgctcatgcctgtcatcccagcactttgggaggccgaggcgggtggatcacctaaggtaaggagtttgagaccagcctgaccaccatggtgaaaccctgtctctactaaaaatacaaaaattagctgggcatggtagcgcgcgctagctactcgggaggctgaagcacgagaatcacctgaacccaggaggcagaggttgcagtgagctgagatcacaccactgcactccagcctgggtgacagagtgagactttgcctcaaaaaaaaaaaaaaaaaagagaaagaccaataccctactcgaaagagaaaatgtggccaaacaaaatgaccatgtgtttcatataaatacaaatgatttataaacataaaaattaggcagactcattagtaaaaaaaagtagtatgaactgaaaacaacagtaggaaataatttcttaccccttagacttgtaaagatcaaaagatacagtaatacatcacgatggtaaagatgtgaggaaacaagcactcccaaatactaatggtgagaatataaactagttaagacatctttggactaatgtggcagtatgtagcaaaatttaaaataaatatgccctattatgattacttcttggaatcaattactaaccatcatttctaaactttgtattttccctttgtctaaatactgtatcttcatttttatcatctcaaattgtatattcaaattgtattttaactctacctttcctatgaaaaacagagtttactgttatctttggaatgtattacttctaagagcttaactcatgagtgcaggtctagagccaatggcaaaaatgtttccatatacattttgtgagatttgaaaacatactatcctactgttaaacactttttttttgtggtgaaatatacataacataaacttactctttttaccacttttaggtatagtagagtgacattatgtacattcacatggttatgcaatcatccccccatccatctatagaactttctcatcatcccaaactgaaactccatacctattcaacagtaacttcacattcctccctctccccagtaaccactattctaccttctgtttctatgaatctgattactctaggtacctcatataagtagagtcatataatatttgtccttttgcaactgtttttttttcactcataatgttttcagagtttcatccatattgtagcatgtatcagaatgtcattccttttcaagactgaataatattccattacatgcacataccacattttgtttatccatctatctgttgatgaccaactgggttgtttccacttttcggctattgtgaatcatgctgctacgaacactgatgtacaaataagttcctgctttcaattcttttggttatgtacctagaagtgaaattgctatattacatgataattctatgtttaactactttaggaactgctatcgttttcctcagtagctgacccatttttcatccccaccaccaatgtatatggttctaatttctccacattcttgccgaaacttgttattttatggtgttttaataacagccatcctaatgggtgtgaagtggtatctcactgtggttttgatttgcatttctctaatgtctggtgatcttgagtgtcttttcatgtgctataatttgtaaagcttctttggagaaatgtctattcaagtcctttgcccattgtaaaaattgggtttttttgttattgttactgttgagctttagaagttttaaaaatatattctgcttattaatcccttatcagatgtatgatttgcaaatattttctctcattctgtgggtcacttcttcactattgatagtgcctggtattatattttgaaagagggtatcaacccacctcaaattgaggtagaacataagaaatcagaggccaggtaaactaacgactgtgggtaagactaagaatagtttttatatttttaaagggccattaataaaaaaacaaacaaacaaaaaaacacaagaatatgtgatagagaccacacatgtcccgcaaagcctaatggttactgtttgctcttttattcaaatatgaatttatcattaaagaaaagatttgagagtttttctatgtgaacaaaagattttttttttttttttttgagacagggtcttgctctgtcatccaggttggagtgcagtggcgtcatctcggctcattgcaacctctgcctcctgggctcaagcgatcctcccagttaagtctcctgagtagctgggactacaggtgggagctaccatgcctggctaatttttgtattttttgtagagatggggttttgccatgttgcccaggctggtctcaaactcctgagctcaagagatccacctgcctcggcctcccaaagtgctgaaattacaggtaagtcacaatgcccagcctgaaagactttaaagcatactgttttttctccaaatagaagagctaatagtcttgtttgtcagtataagtaatttaagcatggcgctgggattcatattctaagccaaatgattctgcaaagctgtgaattacagcttggcagagtttcagactccattacctaagttctaaatagtatgctgaaaatgaaaaaatatataatatcttatgatatgctgaaaaattacctaggaagccccaattacattttagtcttaaaatatagctgaatatctgaacttgtaagttatttcttctgtaaaactcccatatgaaatttgtcacagcctctcccaccttccttgtataagacgttcactcttaactcttttaaaagcttaatgaaaaattgaggtttgtcgcttcaaacatgaagaactcactcaaacgtaaagaaatatttctgtaccctgttaaattgaaagggttaatcaattttaagctagatatttaagaatcaggaatcatttcttcctagcattattcttgcaatttggcaaactatttctattttaaatgcaccttataagataaatagaaatataataaacgtgttaagccatttctaatctatagcttcttttccttagcttccaaaaaacaacctgtaaaagatacagtggttgcaactatgtgtatttcaacagtgattctgatgtgttgcatgacacttttagaagtttttcatttttagaaaaccatccatttgcaatgcaccgaattaatattataataatctaaaattttgataggacacaggatgatagaaaagtctacacttggagtcagaaatatgttcaaattctagcgccactccatgaccttgagtctggtctgtctcctcatttataaaatgggcacctaggaaaaataattcaataaatatcttccttacacaaatgtctcttatctactaaattgagaaaatcttgtggctacagacctcagcttttttatatgtacagtcctaatataaagcagaatatctaacccataacagggacaatataaaatgtttgctgaatgaaagcaatcaagacaaaactaacagtacatagtttataacttttaaatactagatagcaatcataaaacactaagggcaatcagaaaataagaaaatacatttcaatcataaattcaacaagtaccaggtagaggccccaaatttaagtaaatggttgctaacttgtagattcaaacctgcaatgagactgagaagacagtgatgatggtgcttaagctaattttaatattttagaatagataatagaaattgtctatttgcccatgcttgcttacttatggttaacattgctaaccaaaacactttaagtttcttttttgcccaaaataatatcagctcagtaagataagattttatctataagatgctctgctaacaaagagatattattttgagtaataggggcttttgttgtatatatccccacacacatacaattaaatgggttttatttatttttatttatttattttagagacagggtctcactctgttgcccaggctagagtgtggtggtgcagccatagttcactgcagccttgaactcctgggctcacgcaatcccctccaaccttagcctctcaagtagccaagactacaggtgtgagtcactgcacttgctaaacaggttttagacaagaacaaaatggaaaaaaagagcaatgagcagaatatttgtaggctgaactgaaatcaaccaaaagcagccatcctaagccaaccccagctcactcctatcccctagacctatggactgactattctaactaaacctactggttattctagtttaagaaagtgatatataaacacaagaatttgcagcagaataattacctcacggacttcatcatcttcttcattagtatttttttgtctggtttctctgaaacgacgtacctagatcataacagagtaaatcacaaacatgttgcctattccagttatgtaaatataaaacaaggggctacaattaagaaatgctttatgttataaaacttgcaaatttaacaatgtctcacaaaagtaaatcatatttttccaattattaacgttaaaattgcacaatgtactcttaaaaaaaaaaactcatattgacccgaagcaaaattatattacctgctgccaaaatgtttcacatcactgaaaaagtctttcagactgtacaggaaaaattctaataccctatgggtattacacttcagtaaactagttaaaaacaaaaatatctccttgacaaggcttgaaatatttattacattgcaaatcactcttgtgcaccttgctgcaagacatccaggaggctctgtgaaatgggatctgaagtgggtggcccctgaagatccatttttattaagagtcaactcatgaaggtttgctgagcatggtcctggtatcaagaaggagactacaggtttcttttttaatggttcctgctcacaaggctcttattatacagctatgtatatgttctttaagcccatttatttaataatctactcagcacatatttactgagcaccttcaatgtgccatatattatcgtagaaactgagaatacagttattaacaaaacagacaaaaagctgctctcatggaatctataatcaattgatgatatgggagagggaacagcaaataagactccaatgtaagaggctggagcaattagaggaatcaacaaaagacactgaaaatatgcagccagtgaggcaggaagataacaagagtctggtatcctgaaatccaataaaaaacatgtttcaaagaaggtcaagtgagatgtaagatagaaaactgacagtggatttagcaatggcagtcactggtgatcttgacaagtgcagcttcactagaatgatgggatcaggagcctgagtggatagatttaatagaaaatggagagagaagaatgagtcagcaaatacagaaaactctttgaagcgattctgctctagaagaggaacagagagcagtagctaaaggaaaatgggatcgagagttttgtttgtttcttaagctgaaagaaataacagcatgtttgttatgattcagtagaggaaaaatacaagaataacaatattttaaaagatgagacagtatgtaatcgtgccctaggtgataagtagcataccaaaggtgctaagccattcacagaagagaaatgagagtcagagtgggaacactgaacaggcactatgtgtcagacagtattctaaggattttacatggattaattcttctaatccttacaacaaccttgaaggagggcctattatcatcaccattttatcctcagatgaggatactgagggataggtgggtttagataactcaatgatgggtacacagctaataagggttttgattttgaacacgggtgtctggtcagagccaccatgactcacacacactctttctctttctctctctccctctctctctctctcacacacacacacacacacacacacaccccacacagactttgctgctcaggagtcatgatgtcactccaggtggggatggttatgttttatttctggtatgtacctgagaaatctatttatgctataaattagcaaacccaacacatccagagtcatagagtgaatggttttagagggtgaactgcctgtcctacctctggaagtacttggtattaaataatattagttacacattgacaccataaggctttaagagaaccatgttaaccaaaagcactaaaataagggaatgagttttttttttttttttaaataacattgttttgttcttctgcttagggagaatctgggaaatagagaaagtgatcccctgtaatataactaccttgacataactgttgataatatatctgggatattttctttatttacataaacatacacaattacatataaaataaaaataattgagattatactacgcagttttttatctttgaaatctttcccaattaacattagattagaaatatcttctcatgttcttcttccaaaatgtcatttttaagctgtgtaaaattttatatggtatatgtaccaacatttattgtatcaaaacatttccaattattccccactatgaacaacactaagatgaatcactccatacacaaatctctacctcactattttcatagggaaatttcccaggctgagttaaagggtaaatcttaagcctcttaatatactctgccaaactgcttttcagtaaagctattcaaacgtaatactactaccagcagtgtgctagatactatttttctcaaattgctgccaatttgacaaacaaaagatgtatttgagtttctttgattatcctaggctaaacaccattttcatatgcttattagctatttatatttcttttatgaaccacctattcatgtcctttgttcattattctatcaaatgtttaattatttttaagatttctaagagctcattaatattaagaatattaaacttttttctgcccacatacaaatattttcatgtcaatatcttttaattttgttttttgacaatgtgatatgcaaacatttataatttctatgtagtcaagtctagacagcttttcctgtaatttttccactgcttcttgcttagcagaaattttctaaatgaaattcaagatctcaatcaaaacttactaaaaaaattaaaatgaacaaaaattaccatcctacaaggttcactttaaagccctttcaaaggatctttaagagaagatactatccatggggaacaaaacactttagtaccaaccatatgcaagactctgttctaggcattttctacattttctaatttaaccttcattttatcatttcaattttatagatgagaaaaactaaacaaatcagagaggttaaatagtgatttaccagaaaaaaatctcagagctactcttaaagacagactatttaaatagacctagacactcaaattagttacttacctcctcatcgattttgtcttcgagggcatcaatatgacgttctttaagaaatcgctgtgttttttccaactggtatttcactaattcctcaatggcatctttctcctccttgtccacaaattcttgtactgcttcacccatccctctttctgttagcagtgagagctgcacattctgtaagatacaaatcactggatgcagaaatagtttttattccttacaaaataattatagatgagcaaggaaaattaccaaatatgttaccagagaaaaaatatagtgaacagctgtagttaagcctactaatatcaggaaccagaaaaagcaaagtcaaaaccagaaatgggggaggagtacaggacacgtgaaatgtagaggcctgatggctaggatatggagtccaaaaatggcagctatgattaatagagatgaaattaaccagtgtcataggcaaaataagagccccctaaagatgtccacgtcttaaactctgggacctgtgaatacatggcaaagaggaacaaaggttgctaatcagctgtctgtaaaatagggagagtatcagagactatccaggtgggcccagtgtaatcataagggtcctgaaaagcacaagagggaggcagatgggagctggaaggaaaaataactctggggaaatggttagagagatacaacattgcaggatttgaagataaaaggagagcaagagccaaggaacatagtaggcacctctagaagctggaaaaggtaagaaaatggattctcccttagagcctccaaaaaggaagacagccatgccaaaaccttgattccagtcctgtgtacgatttctgacctacacgactgtaagataataaatttgtgttgttttaaaccactaagtttgtggaaatttgtttcagcacccataggaaactaatacaaccggaggatcttagagtggcatatacttatgacgtaagtttcagtggcttcaccatcatttggctgtctttgtttgtagaataattctgaaattacatccaaatgtgagaaaactaaatctggattgagatctttgtaacagagatacaaataaagtaagaaaataacaacaacaataacagttatgttaataatggtattcacaattaacattaattaaacactaattttctttgatgtgcagcaactacaaatgaatgtaaatgtcaccctagttacttctaagtttcacttaagaatgtccctgatttaagttaaaattattcagtttaataattgcaacagagatacaaagaaagagaataacaacatcaacaataacagctatattaataacagtactaataactaacattaattaaacactaattttccctgctgtgcagcaactgcaaatgaatgtaattaattgtcaccctacttacttcatagaaacattttgaggattcattttgtttaaactatcaactaaacatatcctaaattaaaatctgttactataaggtagccattattcaaaatgtgaactgtaagaaattaccttctctgcggtttgaaagtactgttttacaagatcttctacccttaaagttgttccttctgaaggctttgtgataagtttcccaaagttgatctcttctcctagaaaaaaagaagtatatcaaaaaatagcttctatcataatgttaaaatgtgcatactcattgcaagttgtcagtggagaaggtaaggccaaactttagcaactgccagcttgctcaacatggtaaattttgaggcaaaacaagccatttttgttaatagccacggtcttttccccacagtcagtatttctcgttcatacctccaggataggtgtcttgtagctgttctcactgggtgaagcacagacttctggaggtcctcaagacccattcagggagtaataacgtcaaaaatactttcataataatcctaagatgttatttgccattttgccatctgccatcattgctacactgacgatgcaaaagcaatcatgggtactgctggtgccttgtgacgtcaaggtagttcggtattgatggaacatatctcaaaataataagagctatttatgacaaacccacaaccaatatcatactgaatggacaaaaactggaagcattccctttgaaaactggcacaagacagggatgccctctctcatcactcctattcaacacagtgttggaagttccggccagggcaatcaggcaggagaaataaagggtattcaattaggaaaagaggaagtcaaattgtccctgtttgcagatgacatgattgtatatttagaaaaccccatcgtctcagcccaaaatctccttaagctgataagcaacttcagcaaagtctcaggatacaaaatcaatgtgcagaccaggcgcggtggctcacgcctgtaatcccagcactttgagaggccgaggtgggcggatcacaaggtcaggagatcgagaccaacctggataatacggtgaaaccccgtctctactaaaaatacaaaaattagcaggggcgtggtgacaggtgcctgtagtcccagcgactcgggaggctgaggcaggagaatggcgtgaacctgggaggcggagcttacagtgagctgagatcacgccactgcactccagcctgggtaacagatcatgactctgtctcaaaaaaatgaaaataaaaacaaaatcaatgtgcaaaaatcacagcattcctacaccaataacagacaaacagagagccaaatcatgagtgaactcccattcacaattgcttcaaagagaataaaatacctaggaatccaatttacaaggatatgaaggtcctcttcaaggagaactacaaaccactgctcaacgaaataaaagaggacacaaacaaatggcagaacgttccatgctcatggataggaagaatcaatatcgtgaaaatggccatactgcccaaggtaatttatagattcaatgccatccccatcaagctaccaatgactttcttcacagaattggaaaaaactactttaaagttcatatggaaccaaaacagagcccacattgccaagacaatcctaagcaaaaagatcaaagctcgaggcatcaccctacctgacttcaaactgcacaacaaggctacagtaaccaaaacagcatggtgctggttccaaaataagagatatagaccaacggaacagaacagaggcctcagaaataacaatgcacatctacaaccatctgatctttgacaaacctgacaaaaacaagcaatggggaaaggattccctatttagtaaatggtgctgggaaaactggctagccatatgtagaaagctgaaactggatcccttccttacacctcacacaaaaattaattcaagatggattaaagacttaaatgttacacctaaaaccacaaaaaccctagaagaaaacctaggcaataccattcaggacagaggcatgagcaaggacttcatgactaaaacaccaaaagcaatgacaacaaaagccaaaattgacaaatgggatctaagtaaactaaagagcttctgcaaagcaaaagaaactaccatcagagtggacaggcaacctacagaatgggagaacatttttgcaatctacccttctgacaaagggctaatatccagaatctataaagaacttaaacaaatttataagaaaaaatcaaacaaccccttcaaaaagtgggtgaaggatatgaacagacacttctcaaaagaagacatttatgcagccaacagacacatgaaaaaatgctcatcatcactgcccgtcagagaaatacaattcaaaaccacaatgaaataccatctcataccagttagaatggcgatcattaaaaagtcaggaaacaacaggtgctggagaggatgtggagaaataggagcacttttacactgttggtgggactgtacactagttcaaccattgtggaagacagtgtggtgattcctcaaggacctagaactagaaataccatttgacccagccatcccattactgggtatatacccaaaggattataaatcatgctgctataaagacacatgcacacatgtgtttattgtggcactattcacaatagcaaagacttggaaccaacccaaatttccatcaatgatagactggattaagaaaatgtggcacatatacactatggaatactatgcagccataaaaaatgatgagttcatgtcctttgtagggacatggatgaaggtggaaaccatcattctgagcaaactaccgcaaggacagaaaaccgaaccccgcatattctcactcataggtgggaattgaacaatgagaacacttggacacagggcagggaacatcacacaccggggcctgtcatggggttgggggaggggggagggatagcattaagagcaatacctaatgtaaatgacgagttaatgggtgcagcacaccaacatggcacatgtatacatatgcaacaaacctgcacgttgtgcacatgtaccctagaacttaaggtataataataataaaaaagattgctatctaatttttagaagacaagagaattattcccactgtcaatttgtttaagacattacaatcatattaaaacatcttccattattatgttacagtttttaataaagattccttcacaaatcctataagaacatttttttacctcataaaaataactagcttacctgttttttccttttgttctctatgcctgaaaaaatggataatgtcttttggattagctacccgatccacaaatttctggctaaagcgaagaacactgaaaggttcaaaacctccactatagtccacctgaaaacacagaataatctatgaacgctaggaaacaacaatttgccaatttttaaaacacacactaatccttcagtattcacagtgtttatgcttgatactttgaaatttatgaattaattttctacagtagatcatgatggagctatatcatttatcctactgagaaactaatgtttgaaaagtttataagcataagcaaaatactttgttcgatggaatcaaggtattgcaataatttccacaatgcagaatgattacatctccccctgataacactaatagtctaggtacctaccaagcaaaccatctgaaaacaattttctgaactttcaaaacaaacaaacaaacaaacacacaccaaaataaaatactagccttaaatgcattagtaaattggtctatcatcttagagatgtgcctcaagagaaagatgaatgctaggaacatccaggtaataaagaatcaaatctgtgagccttgagaaatgattacctccaaaacatggtatctcactgaaactgagaacttctctcaaggtagactctttctacagaagtctgtagtggtaaacagacctttacaaagacaaataccacctttctttctcagagatatgttcttctcaactagctgttcccaaagtacgctatggggaccagcactgcaccacctcacagcttatccagaatgctccctaactaaagtgctcccactttcactcatcatcactatctgctaaggttttttgttcatttatttgatatttgtgtatcatgtctctctttgcacctccacctcctgtaagctcgacgaattcaaaacctcatctgttttatcatccctatatcctgcagcatccataatagcaggtactcagtaagatttagtcaatgaattaatgaatgtcttttagtcagtacaatgtagttttgtaatattacttatatgacaatatgtgctgttttatgaatgaattcgtaatttactgtgcttaggaaaagaaatgccaattttctattaaagtctggttagttttaatgctgtgaggcagacacagatgagaaaattgggatcttttgccataatgaagagaactatgtgattcccttaaagtaattatttttgtattacccagaccatctctctctctctcttttttttttttttttttttgagatggcgtctcactgtcacccaggctggaatgcagaggcacaatctcagctcactgcaacctctgcctcccgggttcaagcgattctcacgcttcagcctcccaagtagttgggattacaggcatgcaccaccatacctggctaatttttttatttttagtagagacagggttttgccatgttgcccaggctggtctcgaactcctgacgtcagatgattcagccacttcggcctcccaaagtgctgggattacaggcgtgagccaccatgcccagccttacccagatcatctctacagctaccatgttataaaagacaaaatactaaatgctaaagctattaggtctctccttcaaacttctcatttataaatgtttggtcataacaaattttattggatgtcctcaatgttctaagtatgctgttcagggccagggatacaaccataaataaatacaatcttggctgtcaagaaattcacaaactgactgggaagaaaaacatgtaaacagatcactggaagcagactgtgagtggtgctataagaggtatgtacaaagttggatgaggacacaaaggaagaagcatgttctctgtgggcaggtcaagaaaggcttctttgaagacagaggctttaggtgggtgctgaagaaggtatagagaaaggaggagagaagtatgtcccacgcaacaggatcaacatggacaaaggttccagtgaaataaactccactgcacccaggggacggcagcttttttggtttagaccacatcatgtagacccctgaatgctaacctaaaaaagtttagactttttcctgttagtgctggggaataattaagttatttttagcagaaaagacatgcaaaactgtgttttacaaagatcattttggcattagtgtggagagagaaggaaactggaggcagagtcctggtaggaggctgcagcaataggccaggaagtattaataagggcttcactatgccagcgacagtgggataaagaaacgggaacagattacctactgtgcaacagacactatttaatccatttagatctcataaatctacgaagcatttggttggtgcacaagtaactgcagtttttgccattactttctacgacaaaacccgcaaatacttttgcaccaacctaatacaaaccaagggataagggatgcggttgctcaaggtcatacaactagtggttgggccagaatgaagctcaggaagtctggctctacactgtactctttacctccacagtctacatcccagtacttctcaaattttcatgaacatatacatttcttggagatttttgttaaaatacagtgggttctgatgcagggtctgaggctctgcatttttaacaatttcccaggcaacaacaacactgctggtttaaagactacactcctcagtaccaggcctcaggggactcctggagatacagaacaagaaggaggtctacgtaaagattttgaagtcatcactctattggtggtcattaaagctgtatgcctacactgaaaagagggctaactatgagacgggacggatacaaataactcagagaatgcccaagagtaattcagcaagatgagacacgatctattggattgaacaattaaaggtcatcttttccactggttatggtgaagtcagagccttggttatagtgaactgaagaagagaaagttaagagagatataggttatatacttttaggggcttttaaagagagtaagcaacatggggtaggagtttggaaaagggaaaagcatagtggtaaagaagaagtctgttgttgtttctttgtttataacacgatagaaaggataagcagatttataggcacaggaaacaatcctaataataaccaaaacaaataaaccgtacatagattagaaggatgtgttacggggaaaaaaataagaagaaaagaggaagcagaagaaggtaagtgaaatcagggcactggagagaaggtaggggctgcaatcttgatgatagggctgcagtgaggtgacacgggagcagactaaagggagataagagcacatcccacatgcccaagaaactgcgagaaggccaagatgcctggaatgaagtgagtagaggaggtagttaaagatgaagccagagagctcagccaatctattaaatataacaacaaattatttagaaaatgagaaaaataagttaccaaacctatcacttaaactgtgattaactcaaatccttatatctttgtttttgcctccgatggtgattgctcttcttattactatgagcactctcctcactacttttcaaagaaaccatgtaaactgtacattactatgctttgaaaattaataatattcaatctatataaataggacttactcgcagtcgtacaagaggcttctctggctggtgagaattacccagacgttcccgttcagcattttcaagcatttcttcaatctcaaaatttttaaaaagattaaaaaacaacgtagtaaactgagtttaacttggctgaatagcagcttattaccacaggaattttcctgaactacataatcatctttatttcctaggtcatttatgacaccttttcaaatataccttcttgtaatgctcctttaatactattccttaatgttttcctttcatgaaagttcttcataatttttcaatctctaaaataattcttttagaataaaacttaaaatattactactcatgtttcaataaggctttcctcagcttaccaacttaaaaccaagtaagtctagtttttgcagtcatatgatccatgggagactcaccagaagatttagggatcaataagcaaggactttagattatttatcttggaagagttcaaggtaaaagaaaataagactgatgttttcaaatatgtggagttgtctcatactctgagaggataagattataacatcttagacttgaaagagttctgaagacaaaagcacttgttctatattgttcttaagggtaaaaccaagttacaaggagacagcactagattattttcataaatggctgtgtgcacagtgattagatatctccagatggccaacttcatagctgaacaattctagttcttagaaagttcttgtattggaacaaaaactgccttcctataacttggtcctgatctcaagaacaatacagaacaagtgtttttgtcctcagatttctttcacatctaagactttataatcttgtcctttaaactgtctgtaacaatgaagtccaaaagagttttctgcaataattttttctatgtgcatattcaatatggttgccaaaaccatatgtggatatagagtacttgaaatgtggctagtacaagtgagaaactgaattttaaatttaaatgtaaataattaaatgtaaacgccacatgtgctagtgaatacatatcagacagcacagagaaaatctataagaatatgatctcctaggtcaattatttcaatccaacaagcatttatagagcatcattttgccaggtactaggtcaagtgctgagacagaaaagtaagatatgggtcctgtcctcaaagagttcagaagacactcacatgcttataaaaaataatataacttaactaagtacaataacagaaatgtacataaaatacagagataacagaaagttatgtgcacacctggtgtttaaaatgaacctctattactttgtgtcaccagcgtctactttcctctctggattcatgtcaccaaagcccacaggatttaggtgaagttcatacagtagacctcaaccagaggtgactttgcttctctaaggacatttggcaaggtctgtaaacatttttgatcatcacgaccagttagaaggggtactactggcatctagtgggtacaaaccagggagaatactgctaaacatcccagagtgcacagaactgcctcccacaacaaagaattattagtacaaaatgtcaactaagccaaagttgaaaaacccaggtctgactccagggaagggcacatgactcaggcctggatcaatcaatgcaaaagcaattaatgcattttctatctctttggcttgagagattggatttagggatgccagaatcttaatctatgtttgagtttctagagtcaatcatcttgaaacaagcgtacacttttggttacgtgagctacacactgctcaaaaagctgtgacactgaatgagtcaccttatctaaggttcagttcctctaaactatagatggtagaaactactcacatatagtattgttggctagattaaatgctgtcaacagtgcacatcacatacagtaaatcagtaagtatcactggtcataattattatcattgttactatgttacctgatttttcatgaaaagaaaacatagtaggacagctgacacagagttaagaactgagcgtcagcaagtgatgctaattaagctgtcaaaccacatattattaaatgcattaatccacccaaccttagtagtggctgaaattttctagagatttaggggtggcaatgtgcatagagagggaggtttgggacttacattgcagcaatagggtggatagcaaacacatttttcacatttcatttggggtagctttcagggtgaaagggacgcctaatacagattattagaagctaaggcttttctcacacacgatagtctcccattcctcaatcaaagttactgcctgctttcataaataaaatgaacaaatcatcaaatcaggattaaaaaggagaaaagattatgtattatgtttttgaaaaggaagaaagaaactaggagagagatttaattttttttaacatccagtattcctctctctcaatgacttaaaaaaaaaaatcttggacacaattaaacacattcactgaagaacagtgtccttacaggcttcatgagaatgtaatcaacataaaggcttccctctactctattaaattacttaattgaaggtgaataattcttcaactaaagtagatctcattgactttatcaaaaagaattaccttctccaaacagaagctttgtatggcttgggttactttaggattatctgggttaaaaatgtctggatgattagctagaacaatatcctccatgaaaaactgccgcactgtgtgaagaggaattttatgcatattcatcttcctccctttaatacgcagcaaaccaacatgtctgaagtggagagaaatgaacaccgagtcacagtgtaaatttcctcagggtgatgtgcaaacgaaagctttcatatttcttagtttctaaaaatgcttctttataaaatcatactcttaaaaataaatgtttctgctaatttaaccttaatgttatcatcacaggaaaagatggtagacattttccttccccagagtaaaatcaactcatccattattatccctgtctgatcagtcttgtaagatagacataataagcataaaaaaatgttaacaggactatgatggtagcatatgtagactatagtattacatctatatacctatgtatatgtacatacatgtacacatatagacaaaatgattttgcagtggactcatgaagaaaaaaaaccaaccaacatagattctactaccatattctttaaccctattatcattgtaacaatcagaactcaagtgattcaaaagataaaacccataataaaaattgagtttaatcactgttaactacttcttacaatcatatcattcccccaaaaatgttttaaaaatgagatctattatactgcacttataatcagaaaattttcaattaaatggttttaggataattttttataatgaactttgtgaaattagtaatcatcaacctaaaacatctaccttgaaatataataaaaatgtgcatcttgaatttgcctaatgagcagcaaaataacaccaattggatgctctctttttgaaaatggcttaaaatctggaaaaacaataagactacacagaatgatcaattttcaaaaataaagctatcatataaatgacaatactgccagttagcggtaaccttaacataggccttaaacctatgagatgattagttattatagcaaagatttcttaaaaattggctcaaaatatataacactcacttctttacagcttctcctggggaaagagaagtaaccactgagcttccaggttgtgagatataaaacagctgttgttcatttttggttggagctattttacactcatgttcatggccccagataacaagatcaatgaagtcatccaaaaattgttctggaatgaagttagtacttccatgtttactcctgtatcaagattttgaaaaatataaattcggtgattagaaaaatttcatattattgaagtctatacagatctttctttctccattcactaaagattttattgcatccttctatgtaccagaaagtgtgcacaggattgggaatgtaaagatcatcaatgctaactcctgaccttgagagctttacaaacttattggacacagacaagtggaaacccgaaaagagaaagcagtcaattctatatttggaggaagatcatgaaaggttttacataggaaggatttcccctttggtcaatcagaaaagcatgaattctatcaatagtagaaatctataaatcagtctaactatatactagagaaaacacacagaaaatgcaagtaagtataaatatgtccagtaatttcttaacattatctttttactaataaatataatgggagtaaaaacatcaatctcacataagtgctaagagttttcaatatcaaatattaaataaacaagtgatatgcaaactatggtattatacctatatcagttattatttaaagatacatgaaatgcaaggtgatagaagacaagaaggaatagttttccctaatattaacttacatcattggagattcaagtaaaagtgttcacatagtttaaccaagcattcatttaatccaaaccaatattcttccattcacccaacaaatactgttacccaaacactgtctactttatgtcagatgtcccaggcttcttctagatatggaagacacagcagtgaacaaagtccttgttctagtgtgggaaacaagcaatgcaggttgagtccctaatctgaaaatccaaaatccaaaatattttaagtgccaacatggcaccacaagtggtaaattccacacataaatacttaacacaaactttgtttcatgcacaaaattattttaaaacatgtataaaattaacttaaggccatgtgtataaggtatatataaaatgtaaacaaatttcatgtttagacttgggttccatccccaacatatgtgcaaatattccaaaatccaaaaaatccaaaatcttaaacacttctggtcccaagcatttcagataagggatactcaatctctaatacaagatgtatatgcatgtgtgtaagtatgcacatgtataacttgtcagttagtgataggtgctgtaaagaaaaataaagggaaaagtgacatagaagtgccatactcctctctacatacacagggtagtcaggaagacctctctgactagcatcaaatgagcagagaactgagatgaagcatcagtacgcggagagagaaagtcctaagcagtagaagagcagatggtgctaaagtgggaatgtgttcagtgaattcaaggaacagcaaggagaacagaagggctaagcagaataaatgcagggaagacagaatatacaggcttgtgtatccaggaatgtttttatgtaaaaaacatacatctaaggtatgagattatcacaactactaaagaaaagcagaataattcccaaatacaacatgatgccattgtgccttcattgagtgctggttctttcccggaagaagaagggaggatgatgctggtaggctgactgtaatttgtgacctagaagtgatcacaatatccttgttgaaagattttgcatgaccaagtcatctccaaattcagattctttcttctttgaaacaagagaaaaaaacagttgatgtagagaaacaaatgggaaataaggcaaaatgcagaaggctcaagattctcacccaatctgtgaaaaccttctttgttttaaatatgaaagcagaagtatcttgagaatgcacagggtgacaaatgaatctaacagcattaccaaagaaccacataaccacagtgaagggggtggggagaaaatgagctaagtaagtttgaaaaattaggtttcaactagatacagaaaggctaaagactaaaataacttacacaaacattgtaacctagttgggaaagttgttttgcacaggggtatgagttagcaattttgaaattactttataatttcaaattataccaggattggaaatataattaaaccaagattgaaaaaataagtaaacatatatatttataatatgatccaggcttctgttagacaaagaagtcacaagtaaggaaagggagaagacaaaaatggaccttgtagggctggattagaatcagtctgaacttatcattggttttttaagcacatatatagacatgtatgtatgcatgggttactatatacacatatatctattcccataactctgttcattcagagtgctgagcaagccctggtagcagtaagcacacctagtacgcatttgtggatttctgaataccactctccaataaaaagaatcagagcaccttggagaaatggttgattccagggctaggtaggaaaatatcaggttggtgcaaaagtaattgtgatttttgccattacaagagccaagagcctagaccatcttgaggtgccaaaaagctaactaaggtcatgacctcaaaacagatgggaagacattgaaaggacacagaggccaacataaaagagaatgcaatggtcaaagctgcaacaatcagaggaacagtagcaaccaaaaaactgatagtactggatcttcaagtccataatgacataaataagtaagtaaatagagaagaagggacaaattttccttacagaagaattccattaataaatatagaaagaatgaaggaaatcaaaacttacaattaaaataccacagtattaattactggaaataagatcacccatggatgctaaaattagcgagtaaaagtttaaggtgaaacaggatatttgcatagtctcaaagtattttcccaaaaatatttattaattgaaaagtagaaaatgggaactttacagcagagaaagctgttacacattcccttaatcaaatgatgaggggggcaatgagaaaaatcaacatcatatggtgactacccattccccttaccaatgctgctattctacctttcatttggcttaaattcttagaattacttatgagttttcctttcaactcatcatccctactttggcatagtacaaaaaaatggtagacctgggaagctctatggaagagaaggaacaaatcccagtggtgcaaagttatatgaagaccacacacatatctaaactctggcctgcccctcctttgaaactcacagtttattcaagaactcacacataaggtaacacaagtcagcctcttaaaccctttcttttaccgagtatttaacctaagtctgcattcactgaatgcacagagtagtctgcattcaataaatgtgttcaataaatatagctggccctctgtattggcagattcgtggattcaaccaactaaagatcgaaatattcaggaaaaaaacaataaaaaataacaacgaaaaatataaatttttaaagcaatacagtataacaactatttaaacagtatttacattgtatcaggtattacaagtaatctagagatgatttaaagtacataggaggatatatgtaggttatatgcaaatgctataccattttattcaagggatttcagcatcccaggattttaggtcctggaccgaacaccccccgtggataccaagggacaactgtaataaattatataatcaggccccaaatcctttgagttcttccctgacaacttctccggtgtgtccctcccatttctgtttcattgccatcactgtcaccacctcacatttttactgcagtgatcagataataaatcttgcttcttcaagtctgtcttcttttcaatcaatcctataccctgccaacagattaaatttcttaaaactactaacaaaagaaaggtaatctagctatatttgtatatcctggaagaacacttgcatatatgtagcaggaaacatgtctaagaatgttcataacagcaaggtttataaaagcaaaaaactcctgttcactgacaggaggcaaagcataactgtacacatcagtaaaaataaattacacatccaagcatcaaaatggatctcagtaatgtaatgctgaacataagttggctgtaaatatagcataatatgagtatacatgtgattaaacagcaaagaaaagcaatgaaataattaattcaaaattaataatgcttccctttgggatagggggaagcaggtgggatcagggaaaaggaatgggataaaggaatggataatccaacaaaaagattctacctttttgttgaattgaggagtattcatgtgtatgccttatccttatgttacaaatattcttgtaggtattaatatatactaaaaacaatttcaaaatgaaatcacacaaagcaaatctatgttttgtctgatcttgcattgacaaccttgaaagattaagggcatttcactaaaataggtaagctcagaaacagatttgggaagcctcagcacttggctcaaactttttcagagaaaagttttacctgttctgatgaatcacaaataagttaaaccaagagttctcatcttcctttggtctcaacattgttacttttttattgacaaacattcgatagagcctttcatctggaatggatcctgaaatggacattacattatttttaaattgttttcttacttcggcttaaaaaatgaatctattttgcttctaaattatgtccttctcaaagtatttcactttactgttgggagatatatttgaattctggaataatttataagtgggtatgttgcaggttctttttttatcttttttttttaactgagacagggtcttgctatgttgtccaggctggtctcaaactcctgggctcaagcaatcctctcgcctcagcctcccaaagtgctgggattacaagcataagccaccatgcctagctgtttcagggttttttttcttttcttttcttttctaaacacagtcttgctccattgcccaggctggagtgcagtggtgtgatctcagctcactgcaaccttcacctcctgggttcaagggattcttgtgcctcagcctcctgagttgctgggattacagcatgcaccaccacgtctggctaatttttgcacttttagtagagatggggttttgccacgttggacaggctggtcttgaactccggacctcaagtgatctacctgccttggcctcccaaagtgctgaaattacaggcgtgtgccagcacgcctggcctgttccaggttcttgataacagtagttagttgcatttgaaaaacattttccatttcagacatatacatgttcaaaaccagcaaaatgtagaataaaaatgtgagttttctatggtaaaattcttattaaaacttctagtaatactatttttcaccatccctttgttataaattatatatacttttgatctaatatatacattataacatgtgcagaaataaatattaaaagggatgataaaagtgtatttaaaaacaatattcttacattgttttaatatattgtgctttttaaataactcaatgactttcaaacaattctcatactccacaggttcaccttgatctagtgaaagaaactaacaaaaacaagtcaacaaaatagttacaaatattaaatattataaaaggagaaaaagccaggatgctaagatggcgaattaacactatggaattaaaagggtggacaacactgctactttatatacggattagagagggtctcagaagaaaagccaacaatgtagaagtctagaagttagaagtggcctagctcccaaggagaatgctacaggagtggccaatggaatacatggctgaggtggaatgtagaacatgtaactggagacaaaaaagtcaaggcacacaaagcccaaggcattagaagattaatctacttgagtgttgaaacactaaaaacactggcaaaattgaaggtaggtaagtaggtaaaaagtctgagagaaaaagcaatgcggtttagccagatggcagaagcttaaagggaacagtgtgtttgcaggcagaaaaggaagcagtgggtggagcaaggagaacagtgatccccgcttctttccaaaagcccaggggtaagagaactgcatgggacacaggaacctcaggggacagctgggcttcactgaaggttagaaagtggaggtaacattcagagaagagactgataataatgaggaatctgataattataaaaagagttctagagtttataatgaagagctgggggacagggaggggtgcagggtggagacagagtccagttaaggaaggtataatagaacaggataagataagagtttgggagaaaatggatgactggagagatgtgcttctggtggtgactgaggcataatggaatctgtccttagtctgaatggaggaggaaaggcaattttctggagatatgatccctaataacactgcagtgattaaaacaactgttaatagcttttttaagaaaagtatatttcacttcctgctctttcacttgcagaatcagatataacatccagatttcattttccttatctctaaaatataaataaccatgatgcttttctacttgccagaggtattatgaaagctgcacaaaattataagctagcggtattgtacagtgaagcattagacctttcaaagacttccaagatatcaaagtgcagttttgctaattattctataattctaacattcaggattctacacctgagtctaaaaaaaacccaaaataataaatagtaacgaaaagacattttttcaccaaaaatttttaccaaaaccatccatcattttttatagtcaccaataaagaataaggtttgccccattttttccaaacagatacaaacttatctccaaatttctcaattgtttaaagaatcacacatggacataaacagtaaaataaaactgtcttacctaaaccatatagcgcaatctttgtgcttcctttttgaagcaaaaccggactaatgtctatcttctccacagacattgaacgtccaaagtgatttacaaatccagcacaacttaaaatgtccaaggcacaaagtgcatctgcctatgcaaaataatttcaaagaatgttagtgtgtatgtaaaagtaggtatctgcatgaatatcgtatcacctgttaaaagcatactccatattctacttacaaaaacatagatgaggatagtgtcttctcaaaacaaaattacaatagtaaaagtatttgctacatttttgtactacaaatcacctacagcaactggaatcacatgccaaaggcaaggttaatatctcatcaaaacttatgatgtcttggccacaaaaaaataaaaattagccatgagataaatgctttgtaatattaagcaaccgtcttaaagcctggggaaaaaagaccatagataatcagtgattcataatattaatgaccagataaaatgaaaaaatacttgtaggatctctagtcttacttccatatcaaacaggtaataagataatctaatttagatttaaagatggtcttgaacaatcatttcctaaaagtgagattttataagatagttataaaaacactgacaaactgtaaaccactatacagatgttaggtgttcactcctactcctggcttcttattgttaacatcagtattaatgaaataaaagcatagctcatacaccaattcttatttcagatttttaaaaaatctaaaaagcagtataaaagcttgtatgaatgtgaaaagtcaacttgacttttgactcaatttgactacacaatgagaaaaagggaaggcatgctttccacagacaaactaaactgatcatttccaaaattccaacaaactctaagaaaacaataattacccctgtgggatcgtcatgattgccatgaatactaaacactggaattgaaatgttgaggttgccatcttgatagttcacccatggaaaccttaaaaaaaaaaagttacttaaaatttccatacgggacaaaagctgttttccctaagattctcctccaaaatattaatgcaatcataggcaaactgcataatctacattggcatatgaccactagtttagagctttaaaaaataaaatcataggcgacaattcatttcaattagtttgaaaatatctcaaagcactacattttaaagaaaccccaactataataaacagtgcttgtggtatgtatgagtagtatatctaattaatgaaaagttaataagccttcaaaattttaaaaacttagcatatggtttttattcgtagtggggggagggaagaaaatccatatactttagaatcccaaagaggtagattaaaactcccagctctatcacttattgcctgttcaaattaaagtctcctgtcagcccctgcccccagccatccagctcctcttctcagaggcaaataatgttagcaatttctagtgcatctttcaaaaggatcctatacctatccacacaaataaacagatttttctttctccttacataaatgatagaaaaatatacatttctgcatcctgcttttatcactcaacatattttagaaatcattccacatcagtacatgaagacctttcttctgctctgtcagccacacagtactccattgcatggatcaccacaatgtgtttgagcagttccctaccaatggacatttagattcttggcagtcttgttttacaaacaatgctacagtcagtaatcttgtacaaagtaatcttctacagcgagtaatcttgttgccctggtgagtcgacctgtaaaggaatacctggaagggaattgttaggtcaaagagtacatgtatttgtaattttgataggtgctgccaatttcccaccatagagatttacacataatgcaatggcagtgcacaagagggacagttttcccctacctcactaacacagtaggtcatccagctcttaaatctatgctagcagttcttaatgctagcagcatgttggaattatcttggggatctttcaagaaatgccaatgcccatgacatacttggagagactctaagttagttggcctggagagggggccatccatattttcaaaggttcttaggtaactgtactgtgcactcaggattgagagtcacagacctatgccaaccttataggagaaaaatatttcagtatagctctgtctttttcttatgagtgaaatcaaacttttaaaaataggtttaggccggatgcggtggctcacatctgtaatcccagcactttgggaggccgaggtgggcagatcacctgaggtcaggagttcgagatgagcctggccaacatggtgaaaccctgtctctactaaaaacacaaaaattagccgtgcatggtggcacatgcctgtagtcccagctacttgggagactgaggcaggacaagtgcttgaatctgggaggcagaggttgcagtaagccgagatcgcgccactgctctccaacctgggcgacaaagcaagactctgtctcgaaaaaaaaaaataaaagttaaatgtcatgttatttccttttctgtgaagtatgtccatattctttatttattactaactcatgaattttattgtcttgaaagaactgcttattggggaattcaaccttaatttgcaattggttgcaaatattcttcctgattgaactgtgacttctggctttgcttcaggcagtttttggcatgcagaaatttatttttgcaaagacaaatgtatgaatcttttatgacttctgggtcttgtgtcatacttagaagccttccccacacctagatttttaaaatatgtgtaacagtttctcctagcagttttactgaatccattatttcccctacattgtgagatggtgaccttcatcaaatactcaattcctacatgtatttgaggctatttctagagtttctattctctttcacttacctatctactaattcatgagccataccacattttcaattattgtagcattgttatacttcaaatctaattggctactaactccttagtagtcttcttttttgggatttccctatctttgcctattttctacatgaactgtgaactggaagattaaattatccaaaatgaaacacaaagaggtaaagttatgggcaatattttttttaatagtatgctatataaatgatattcagaaagagaaaggaaacaatatttgaaaacataatgaatagaatgggaatttccccaagttgctgaaaaacaatattacattagaatatatgataaagcccacgcggaacaaacagaattaaatccacagctaaataagactgcaacatgttaagaacaatgagaaaatcttaagttacccaagtattgtctttatgctggtcactactctagccatttttcttatcatctcaatcttctcaactctgtaagattggcacatttctttcccatgttatgaaggacagaactaaggtagagtagttaagtgactaacataattttacaactactaaatgacagaaccaggatttgaactccagctgttttataccggaacccatgctcttaatcactatgctaaactttctagcaactcacctaacagtagactcctcaacagcaacaaaaaataagagtttaccactcactgacactccatgaaaaaactactgaaaactgtgcttcagaaagaaggaaactgaatctacacaaaagaaatgaaatacaaggaacaacagtgagcaaagaaataggtaaacatgtatatagggtggggaaacagttttcaaaacagaatgcaatttaaaaataagatgaaagaaagaaaatactgaagttaaaaaatgtcccggctgggtgtggtggctcacgcctataatctcaacactttcggaggccaagtcgggaggatcacttgaggtcaggagttcaagaccagcctcaccaacctggtgaaaccccgtctctactaaaaacgcataaaaaaattagctgggcatggtggtgcacacttgtagtcccagctactcaggaggctgaggcagaagaactgcttgaacctgggaggtggaggttgcagtgagccaagatcgtgcctctgcactccagcttgggtgacagtaagactccttctcaaaaataaaaaataaaaaataaaaaatgtcccaagttttagatttgaatagaaggagggtaaagacattgatcacaattttgaaaaacaaggacaaagtattatacaaatcttttaaaactcaattatatatgcagccaaactatcaatcaaggggaaagtgaacataaacattttcatgtggacaaaatctcaaaaaaaaatttacctcccaatataaagtcacactttaaaaactaaataagaaataaatatgggctgggcatggtggctcacaagtgtaatcacagcactttgagaagctaaggcaggaggattgcttgggcccaggaccagctgggcaacacagtgagaccccatctctaccaaaaataatttcttaaaaattagctgggtgtggtggctgatatgctttgactctgtgtccccacccaaatttcatcttgtagctcccataattcccacgtgttatgggaggggcctcgtgggagataattgaatcatgggggcaggcctttcctgtgctgttctggtgatagtgaataagtctaaagagatctgatggttttaaaaatgggagtttcccagcacaacctctctctttgcctgccatcatccatgtaagacgtgacttgctcctcttgccttcagccacgattgtgaagccgccccagccaggtggaactgaaagtccattaaacctctttcttttgtgaactgcccagtcttggcgggtatgtctttatcagcagcatgaaaacggactaatacagtggcacatgcatatagtcccagctacttgggaggctgaggcaggaagatggcttgaacccaggaggttgaggctgcagtgagctatgatcatgccactgcactacagcataggaaagagagccagaccctgtctcaaaagcaaaaattaaataaataaataaataaataaataaacatgagtatgtctattctcatgggttagtatgtacacatatttttcttagctctgtccagtgagagcctagaagcaacaatacaatagtaatgtgcacatgtaacatccagatcttggtttccaaataccattctccaaaaggaaccagggttccttgaagaaatggctgagtctgaagacaagaaagacaaagtaaaaaatcagaagaaaaggtgggatatatcaaaaggatacaggagccaatctcaaaaggagcccaatggctaaagctggaacaatttaagccacaagtaaattatgatagtaataaattataacccaaaggaaaaaaaaatgggtttctactgatatagacaattgaataaacaaatgtgggacaagggacaaatcttccttacaaaagaatcccaattaatacatgtagaaagaatataggaaatggaaaatcacaattagaatatcacagttataactgttgtaggtaagatccactgatgaatctaaaattaatgaacaaatttaaggaggaacagaaaagtcgcacagcctcaaaatatctaccctaaaatatttattaattactttggtggttttaacttatgtccatcagaagtggaaacttaactccctgccctttgagagtaagctggactcagagactcaattctaaccaacagcatatggaaaggaaaaaataatgactttacactggagaaacctggcagagaccagcttaaccaagtgatcaaggttaaaatcaccagtgataaatcaggttgatgtcacgcacctcctgatatgatgcgactgaaagggtacttcacttcttgaatattctcccccaaaacctgtaatcccaatctaatcatagaaagcaggagaaaataccaaattgagggacgttctacaaaatacctgacctctttataagtatcagggtcatgaaagacaaggaaagacagaaaacctgacatgggctgaagaaattaaggaaacgtttctactaaatgcaatgtgagatcctgtacaatgtttaagacatgatgggccagaagcggtagcttgcgtctataatcccagcactttgggaggccaaggcaggtggattacctgaggtctggagttcaagaccagcctggccaacatggcaaaaccctgtctctactaaaaatacaaaaaatttgccgggcgtggtgatgggcgcctgtaatcccagctactcacctgtaatcccaactactcgcctgtaatcccagctactcaggaggctaaggcagggagaattgcttgaacccaggaggcagaggttgcagtgagccaagctcatgccactgtactccagcctgggcaacagagcaagactccatcaaaaaaaaaaagaaaaaacacatgatgatatttttataatatagggattgacaaatatcataaatagtcccaaaggcacaaatggaaaaaaagaaaaaccaatagatttaactacataaaaattaaatatttctgtcaacaagagtccataaacaaagtcaaaagacaagccattgattgggaaaaaatatatgtatcacaaaggtttactaattagaatatataagtaacttctgcaattcaggtagaaaaacaaacaaaaaaatctcaatttttaaaataggcagaggatacgaacaggagaggataccaaaatgtacaatataaacctgagaagatattcagtcccaccatgtattttttttttttttttgagatggagtcttgctctatcacctaggctggagtgcaatggcacaattttggctcactgcaacctctgcttctggggctcaagtaatcctcccacctcagcttcccgagtagctgggtcagttccactattaattaggaaaatataaattaatacaatgatgtacaaaaaaattcaaagaatgatatttactaagaaaatagcttatatggaaggcaaaacagttgtgtgtttacgtgtcttatacagcaaataccatacacaagtaatcactcactcaagtaaataaatatacttacttactaaaaccaaagttgactgactgatcactgagaatttcaaactggacaggccgatcacccatacaatattttcttaataactcgaggcaggtatgtaatgttttccttgagggcttattttcatgaaaaagatcaccacctaacaaaataaaatccacctgatcaacagaaaaaggtgttaaaattagtatgttttacaggtaaaatttttgtaaactacagatgaaagagataaaaaaaaactcacaaaagacactattatatatggcaacttaaaaatttacattttatttattcaaagggactttcaatctggtaattaatctggttctaatttagctgactaagctatcttcaaaaaagccatcttccaattacaccaagtctctgattcaggccacacaaggtgatcatattttttctattatttgaatcaaacataaacttagcactttaacagaacgtatgggaagagataccaaattcaatccaaatcattcatttaattcattcagcatttatttacagaattcctacaggttctagaagctcaaaaaatagcaatctacaaaatagattatatccctgccctcattaaatactgactctatgcaagaccctctactgagtcctgaggatacaatgatgaataaaatatgatccctatcctaaatatgttcaaactctaatggaagaggcaaactgttatacatttaaacataagtcaaactctggggtgcactagaatggacacgtaagcaaccagcagcagagatgacactacgatgaatttgaactcaagggaggacaattcgcctgaggacagaaagtctagaaggaatgaactaacatggtggcatgttagttgcactaggaaagataaatgattgtgaggaagagaattctaggaataacttcagtgaaggagggaaatcatacagaaaaagtctaacacaggctttcaagacgtatacgatgcacctaaagaaacttaagttcttaatcacacaaaagaatacaaggtatagatcactgtgcgtatggtagttaggataactttaataaaaatgtgaggtttaagctaggccttccagaatgaacactatttgagtaaaaggaagaaaatgatctcaatcaaaggcatggaagaaacaaaacaaaaacaacaaaccaaatgaaaaacatactggggcgaaaagaagttgttgcttaatgggtgtcatttttgcaagatgagagtaattctggagattggttgcacagcaatatgaacatatttaacactactgtactatacacttaaaaatggttaacaagggaaattttatgttatgtatttaatatattttgccatcattcaaacatttaaaaaaattttttaaactggctggcagtgactccaggaaatattgaaaagaacacgactcacttctgtggtattcttgccgaaagtgcagaatctgaacctaatcatgaggaaataccacttatagccaatttgaggaagattctataaaataactggcctgtgtactcttcaaaatattagggtcatgaaaaacaaaggcaaggcagatgcaggaaaatgtaccagattaaaggagacaaagagacatggcaactaaatgcaatatgtaaacctggactggatcctggacaccaccaaccagcctccaaagtgctgtaacagacattacagggacaattggcaacatcttaacattatataatagcactgaatcaatactaattttctggttttctatgattatacatgcggtttactctcaaatggttcaggaaaaaaatcgtgtgtatttgtaaagagaagataaagcaaatgtgacaaaatgttagaaaacctgggtgacgggtaaggaattctatgcgctattcttgccaacttttctgtgagactgatgttgtttcaaaataaaaagtttttttaaaaaaagactccaagaaactagggaacagaactaagactggttagtgggcatgggcccacataataagggacttaaaagtcaggaagactttagattcaataataagaaatactaaatacaaatcaagagaatgagtaaatataatacacatctagaagtccctacctggggttatggggggtggaacagttacaattaagggacgcagggaagagaaacagtagaagcagaagtgaaggaaagggcaaagtagaattaagtagcttacactcaggagaagattctgttttagggctcaagagttaaaaaagaaagagcacatacaggattctctggcaggaaacagacctcctttggccacaagtttttttgccttcaaggaaggaaaaatgcaccttacattctattattgaaaagtcaaaaaagaacagatgctggtgaaattacggagaaaagggaacacttatacactgttgatgggggtgtaaactggttcaaccattgtggaaagcagtgtgacgattcttcaaagagctaaaaatggaactaccatttgacccagcaattccattacttggtatatacccaaaggaatataaatcattctaccacaaagacacagcacacatatgttcactgcagtactattcacaatagcaaagacatggaatcaacctaaatgcccatcaatggtagactggataaagaaaatgtggtacatataaaccatggaatactatgcagctattaaaaagaaccagataatgtcctttgcagggacacggatggagctggaggccatcatccttagcaaactaatggaggaacagaaaaatcaaatacttgtaagtgggagctaaatgatgagaagacatggacacaaagaggggaacaacagacactgggacctaccagagagcagatgataggaggagggagaggatcaggaaaaataatgaatgggtactaggattaatacctgggtgccaaaataatctgtacaacaatccctgtcatatgagtttacctatgtaacaaacctgcacatgtacccctgaacctaaaataaaagaaagaatccagccattgcctcacttaattaagaaatttaaaatatgtatacccactgctttctgattctttctaagcactaagatacagcatgaacaaacaaaagatttccactctcatggagttttccttctagtgaagacaacagacaataaacaagtaaataattcaataaattatttcagatagtgctattaaaaatatgctatgaaaaaaagcagagtaatgtgataaaacagtgcttggaagtatcagggaagacgtctccaaaaaggtaagacttgaactctcagaagtcggccccaccaagatcaatgtgctccaagcagaaagaactagatgtgcaagggcctcagagtagaacatgccggtgtggatgtagcactgtaaatcaggcagagagtagtaggagatgaagtttcatggcaggggtcaagatcaagtcgaaccttgtagtttgaattttatactagattcaatggaaggacacttggaaaattttaggcaacagagtgccatgatctgatttattattttaaaagttcactttggctgctatgctgagtagatgtagcagaaaagaatagaagcagaaagatggaaggggacctcctgcaggccatgtgaaatgtgatcgttttggactaagtttattagtgtgaaaagagtagtagagaggaaccatatatatttgggaggaagaactaaggacctagcagataaacttaagagaactctccagaaaagtcaaggctggcggtgttaatttgcaagtcaatttttacatttattctccaactctctcctgggctggcgtgttaactgcctgctgaaatttttccctgaatgtcccattgcagtctccaactctaagtttgtcgaaatcaaacaaagaatttgtcaccttcccacatgaagcagtacctcttccttatctacctatttctatttttggtacaactattcacccaaactccacacacttcagagtcactgtcatccctttgccctcatccccaccccgctacaactaaccaaagtacacaaatcctctttttgcagtatcccttgcattcatttcctcttttccatccctaaggtcaatacttcaaaaaaagcctctaactggtctccaattcatggtattatactccgctgccaaaagactttctcttgaactggatacaaatttctcaatctgatatttgaagtcctcattaatgcagctcaaatccttccttctagtctctcagcatgcttgctaactatgacctgctggtgagccaaattgactacagggcccctaacataccttatactgtctcacgggtttcctcactcctgcttcacatggatgtacattctctatgctccccactggccaaaagtctacccttcctccaaagcccaagttaaacacaaccttcttcattaaactcatcttgctataatctaaacgtgattttttctgcctctaaactcaaaggaaatgttatttagaattttcttagggctcctatcacatacaaccttgcatctgtggattgtggatatttgtctttcacaccagttttcttctacgttatctgaaagcagaagctttgacagtcaccttacatttcgaatagacactgccacaggatcctgcattcagtaaacaccccaaaaacatttgtaaattttaacagactatttacaaaagtagctcctacttgaatttaagacacaaagcatacaaaatcagctttgagctttcagtatattgatattcaagcaggcaaggtaagcacctgagcttataaaacaaatctctaactttagaaggaaaaataacttgttaaccaagggaatatggtagatagtgcacaaatacaaaccacactcacttcattttcctgggcaagtcttaaaatttcatcgagtgttacaaacgtatcatttcctctgactgcatctttctccataaatccaagatgaatatctgttgcaactaatattttaaatgtgttttcatcatcactatattaagaaagaagaaacatttcaatatattaataattcattaaaggatattcaaacaaattgagacaaacttataaaataaataataacagttatagagtaaaatcattttttttagccttagagttcatctgaaaatctgaagtattcaacgttatcattaacattacagttttcctaaccactagttcaatacagaacaaatgtacataaatctttacaaggttctataactgcttcaaaaatttataaccttgttataaccagttttacaaactcatgtaacccaggcccaaaagtttgcttgttttcctcagataaataaacttgttatttatctgacttcgtactcttccaggaaaatcgaagttaatttaaaaagccttcctctaagtttatgagtcaattttatactaatatgcaataatttacattcagggccttgaagacacttgcatgactctactctctacagagttagatttcattaataaagttggccaacacagaattgtttcaatttgaatttggtaatattcaaaggtactttaatgtgaagtagcaatgtaatagttattaatactcttacactaaatttaattgtatgaaatacttttatttttatgatctcatctcaaccctcacagataaagagtcaggcattattatctctgacaaatgagaaggctaaacccagagaaattaactgctttatcacataactagtgacagaaacaggactaaaacccatgatgaaaactcaggctattttcaataaaccacaatgaatttttaaaaaatctctgtatatatctccaaaattcaaatctttacaaacaaaagatatttccacaaacgatttctcttcaaaaacttcaaaaatgatatgcacacagttctcactgatatatccaagaaggtaggtcagatacttttcaaatcataatactacatgtttctgtagcaatttatgaagtattttctcatgaattctctcatttaagcctcaaaattaatctgaaaaaggtataattattccaattataccaatggcaaaattgaggcaaggctcagagaactgctgacttgcccaaggtcacacagctagtagggtccaaggacttgaaactagggtaaaagactccaagtctaaagtctttcccacataactttttttttttacgatctcggctcactgcaacctccgcctctcgggttcaaatgatactcctgcctcagcctcctgagtagctgggattacaggcatgcgccaccacgcctggctaattttgtatttttagtagagacggggtttcaccatgttggtcaggctggtctccaaatcctgacctcagatgatcccgctagcctcggcctcccaaagtgcacataacttttacagtccttttatttattcccattccattcaaattcatttccagcttatttaatactagaggaatttactctaaaaatcttaaacagaactgcattgactaataagaatttgtcaggaaaattcaagaatatttatcacttcaataatttaagatgaagcctaagaacataaacaatactatatcaatatatcaaattactgcaagactccaatctatagctgcatattagcttccagttaacaaacagataaatatttaaaacattccaaataccctttttgatgactaatatttctgttcataaacaggttccttatttactgcttattaaataagttttcttttactgtgatcacagttgacgagctttagaaaccccaaataacaagggattccagaagtcaggtgcttacagtgcatctgcagtactcatttttatggtcagtcaagctcctctgggaccaggttcttctccaagaacccctgggtactgtactcaaatgtcagaaaatgcactcgattccaaattctagaaattctaaaaacaaaattacatcataaaacacattttttaaaagcctgcacgtatttaaccaacatgatttacgctgcacaaggtacagacgtcttaattagactggcaaatttagaagtctcattttcatctaagcacccactatacttttttttaatgaactgagcatagaaaataatatatctccagtgtacatcctgtttcctagtttcaccaagatgattaaactcctattttcctttcccgtgctcttatgggaaattaatgtatgctaaataaatgggcagaaagggtcacatacggttctggttcaacacacaaacaactctagatgtgcagatatttttaagttgcacgcataggttactctggagaacagaggcaatcctgtatttcctattcaaaccccacgattttttttaaaggacctggctagtttggaaaagggaacgggcccgcgtttaaagcgagtgtaaataaacaaacacgtggtctgcggaggaacacctttaagcaccagcaggatgactgaaaatagccaggtttggggaagagtggctgccaccgcgagacaacccccaccacatctggagctccagattccgtcgggattccaagcctcaacacgccctcaccgcagggaacctcggaatcagaacgctgagcccgccaggacccctcccctgcccactcggcccgctcttcccgaggttccagttaactctgggcttccgcctgggaacctgcagaaacaggagacgaatgcgattcctaaattaccccactgctggactcttcgaagccccacaatcgcgacccaaggctgtcttcttttcgggaagaaagggcaggatccgtgaaaagaaaacaacacggtctgaacttgcctctgagaacccgcagggccgtaaacctgaattccgcgggagagaacggcgtccgtttctctcgcgacacttcatggataacgt

SEQ ID NO: 1870 - DNA, 76574 bp, Homo sapiens; identical to SEQ ID NO: 1869
  source 1..76574: mol_type = genomic DNA

SEQ ID NO: 1871 - DNA, 14944 bp, Homo sapiens
  source 1..14944: mol_type = genomic DNA
gtctatcagcgatttcatcttcaggcctggactacaccactcaccctcccagtgtgcttgagaaacaaactgcacccactgaactccgcagctagcatccaaatcagcccttgagatttgaggccttggagactcaggtaaggaatcaatttgctttctttaaatgacttaaaggaggtgatggataaggtatagaatggttttgaagactggaggttcttgatcttaattctagagtttccctagtcagacttcctaatagttctatgacttaaggaggggtgacgatatcaaggcttgctgcccactcactcctctaatcagtctccctctcaacaattaccctatgcagtcaactgtgaatcattccacaaaagtagtagattgcagcatatatattaaatcatggtttctaaaccattgggttcaaactggagctctaccactaacaaacaatataaccttgggcaaattactaaacctctaaagcctcagcttcctcatctataaaatgggggcaatggtacccattacattaggaaaattggaactaaaatcctgaatcccttaggacttcccaataccaaatgagaaaataatcagtcataggcataatgaaaaaaactccatttgtcttcctgtaaatgcttttgtctacattaaatgtaaatatacctagaagtataggtggctttacaggctaacattttctggaggggatttgtggacaccaagttgagcatgaaatcctgcctcaaatctatcacatgggaaaccaagagtaagagggggcgctgcagatgtgggggagctctaatgaaggaaaacaaggattaattttaatcatgccattactgttttctgaatccagtatataagtgattccctttccctgtttcccataaaatggcttaatctcactgagaatccggtggaaagaaatgtttaatccagcattgtgagcatttttgtgtgtgtgttttgtttgtttgttcattttttagtggagacaaggtttctccatgttggccaggctggtctcgagctcccgacctcaggggatccacctgcctcggcttcccaaagtgctgggattacaggtgtgagccactgcacctggccattgtgagcacttgttaagcttccctgaggaagtagctgagtttgatgttcagcttaatgtaactgagctcatagtacatagaaaacaggttccctatgcaagtctagtaggatacaggattctccgaagaaagtagttgatgtctagtaaggaaagcaaagagctaggagctctgaagaattccttgcaatcaggcaaggagagcaggaacgccctcaggtgatgtgcatatctaatgcagagtttgattgaaagtaaagagggagggagaaggaacacttcaaagttgagaagattcaggaaagaaggtagaggacatgtatagaccagtggctctggtggcggtagtgggatatgagcttgggaagtcatacagggctgaattccaaaggccttgaggggttagatgaagggtttctccagcaggtaatgacaggccagcaaaggagttcaggctcaggaagagcatcactcaaaacagtgatcgggagcttgatgtagcagccttgtggacaatggattagaaaagagaaagactgaaggcagaaaagcatgaatggaaatgagaaactcacaggtgactctggatatagaaaaaagacccacatgcaaaatgtattgcagaggtagaaatggcatgacttggccactgactgaccaacagccaagatgaagatggactgagagatgatggagctaaagtgaaatgtggtcccaactatctaagcctgggtggcaggagaaacaaataaaacaatctgagacacgaggcctgagaaaagaccactgacttcacagcacagtcctcaaagaccagtttcagtccactgactggcggaaactagttgccaagcattgagaagtgagtgggtggagaggaggtgggggaagagagtgggtagcaaagctttgaagcagctgcggtgaagaaaaagtgagcctgggcagtgggcaaggacattgctagattaaaagaagaggactttgggattcagggacactgaagtacattttagtcataaaaggagtatttagcaccttaacaaatgcaacttatctcatattctcaaaatgatactttgaaatggggaaggtaactattaccttaaacttacagagagaccacaagaggagcaagcaagagagctgggactaactctgtctgctacatattgccagaaattgggagactgaaggtgcaaagaagaaataatttcttggaagggctaacagcttggttggactgagatgggctgaaaagcacagagggaagggaagtaagagcactcttcctcggagataggtgcacaggaggccagaagggataaaaatgcaaaactattttgagtggaagagaatgaagatgaggtaacaacagtgaggcagtttttaaacttctcagtacatgatggtacgagtggacttaaaagtctattcaaaccaaaacccataaaggctgtgagatcttattcagtggatggacatgaaaacaggggtgcctttaaaaataaaaaaatatttgcaggagttagtgtgagtaattaaatgcggtactgagtgatcacctgagtctctattttaacattcatgctgatttggacaccagcaaatgtaaaatcttattgttatcatattgcggctaatgtggtccataacccctactaatctaccaactagtctttgagcataactgtgcattgggcactaagtcattgtgaacaatttattttaatgataaggcaaaattgcgagaatctccaatctccgtaggcgagttttatgtatttatgaattctcatggaacgaaagcttttcattacagtcagcccacaatgccataaatcgattaatatatttacctctcatatatgagacagatatatatataatcagatatatatatgaaagatagtttccataagaaataaaaaaacagagaaagcactcatgtgtttctttataaactactattttatacaaatatttgtttaaggtttgtagaagtatagttgccaccatgagataccattttaacagagaaatatcacacacacacacacacagccctcatggtcattattgccattagttacaacaggcatagcccaagtagaattggcttacaaaaaagtttatctcgccaataatacagacacagctttaatcaagcagttgatgaataaaatgaaattaaaacaatggcagtccaatcatctccttcagttcaaacaattgatgacctttgcattttaagttatcttcactaaagttacccctctggggcggagtgtagtgactcccagctcattccatacttgccataggaccttgggaaaaataacctctctcaacctccatttcttcatctgcagaaagtagtcaaaatgcctacttacgaaggtgttgagtgagttggcaataccatatacaatatctctagtatatagtaggtgctcagtaaacaactataattatctggactcacctatggtacagcagaaaaagcatcaacatcagagccatggtgagtgccttctagcttggctctgttgctaactgtgaggtctttactaaggcaaattctatacccagactgcagcttcctcatttgtgaaatgaacagaatggtttctgaggtttggactagctctagaaatcctacctagtgaccagaatcagtccgcaaactctttagtgggctatattaaaatatctgtttttgttagaggtcttgtagagtggcttgttgtacaaagcagatccccaggaccatgtggcatctggctatctagggcaggggcaaaatcaagtgagaaacaaccaaagtttcttctctctttcctctagcccatgcgccagacagataatacttttcaactgatttatagtcattcacatagtgcatatattggaaggagaaaagaggggtcataagggaaaggctgaattcctatttctcacaggagacaaagcagcctggtaccctggatgcctaatttgagagatccaagtcttcattttaaatctttacaggctgggcatggtggctcacagctgttatcctagcactttgggaggtggaggggggcagattgcttgagtccaggagttcaagaccagcctgggcaacatggcaagaccccatctctaaaaaaaatataaaaattagctgagtatggtggtggttgcccgtggtcccagctactccagtggctgaggcagaaggatcacctgagcccaggaggtagaggctgcagtgagctgtgatcatgacactgcactgcagcctgggcgacagagcgaggccctgtcatgaaaacaaacaaacaaacaaaaaatatttactaattatgtaacttggcacaagtaacctagcttctccgtgcccttgtttcctcttctataaaacacaggtgatgattcaccccttgcctgttctataaggctcagatgagatgccatgtgtcaaatttacttccagccctaaagtaggtataaatgtgacagtagtcagctgcctgttttacagcacacctgcagctactcagctctgattgacttcagtaagatatacttcaggctgtggtctaatggctgggatgtggcaccggcttcagtaagatatgtgacctggatagacagtcttgatttccaagacatcttacatgacttacaagcaataaagacaagagcaaagatgtgtccccaaaagagggattttcagattccaggaaagacccagtggagtccgcataagtggttaacatgaacaagtgaatgctaaggaaacccaagatgaagattgaacagaatcttaaaatgtctgagctggaaagggccgtattaattgccttctcacttcagaaatgaataaatcatgaaaactgataaatagcatttactacactctccctttgtcctaggcacaattacatatgttaacttatttatgtcttacatctcagagaggggtactgttctaactttacagaaggataaaatcgaaactaatgctcagcaaagtacaaagaacaagaatagcaacaaaaataactatttattccaacatgggttctttgcatacatttatttcttcaataatatttattaagaagtaactaaatccaaaaattattttagatcctgaacaagagagaacaaaatctctactttgatggaacttccattctgtggggaagagactgacaataagcaattaaataaataaggtaatttcctacagtgatcaatgccgtaaagcaattaagataggattttgtaaaagacagcaaataggagtacatgttatagattgagggttcaaggtaggctcctctaggagctgacatttgagctacacctgaacaaaaagacactagccatgcacagaccatgagcccagttaagtgttatagcagcccacgagataagaattattattatttcaattttacagttgaacctgaggcccagagaatttaaagaacttgcccaacatctcagaacaaatggaggaatcactattgaaacctaggcaatctgactcaggaggccacagtcttatatactgcattagaaagccttagagagccttttctttttctttgagaccgagtctcactctgttacccaggctggaatgcagtggcatgatctcagctcactgcaacctctgcctcctgggttcaagcaattctcctgccttagcctcccgagtagctgggattacaggtgcacaccaacatgcctggctaatttttgtatttgtagtagagatggggttttgccacgttagccagcccggtctcaaactcctgacctcaggtgatctgcccatcttggcctcccaaagtgcttggattacaggcatgagccaccgtgcccgacctagagagccttcttgatgtgacttgcacaaggtggcagagttagagacagagagaggcctggaatcgacccctcctgcttctacagatagtccttaccatactctgcaatgttgcctctggcccatcataatgcacaaaggcagataagcaaaaggacaaggacaagtccattgaaaatacatttttcaatattaaagcaaaagaaaagcatccaggaataagaaacaaagaggacatgcagtcatatatgcaaggtgtcctctacaaagataaagaatgccccaaacccagttgtcaagatcactggcagggactcctgggcccacatgctcttcctaaacaacccctccatctcctttctcagaactcagcagtaggccttgcctcagatccaaggtcactcggaagaggccatgtctaccctcaatgacactcatggaggaaatgctgagagaagcattcagatgcatgacacaaggtaagactgccaaaaatcttgttcttgctctcctcattttgttatttgttttatttttaggagttttgagagcaaaatgacaacacccagaaattcagtaaatgggactttcccggcagagccaatgaaaggccctattgctatgcaatctggtccaaaaccactcttcaggaggatgtcttcactggtgggccccacgcaaagcttcttcatgagggaatctaagactttgggggtaagtcagttgccttccatcccatgtcgtagggattctctggctgacagaagctgatgcggtataggccacatacagaattcaatccaatttgaagaattgggatccaacctgatgtcttctttatgtctaacacagtgggccaaatcaggggtgcatcagagaagttatcacttagatcacctctgggtgatcttatgtcaccttttggttttggggcttgtatatgcaggggtcccccatcccagtccattgccagaatcccaggcatacctgctccctggaaatgccccatgtggttgaggaaacagattcgaacaagaaaaagacaaaattcttggcacctccactgcttcctttaggcattcctcacagctccaagtcaggagccagagcttccaaccttgtctttgcctgctagcagtgatgatttcagctcatccactgctgcctctgttctctccccaggctgtccagattatgaatgggctcttccacattgccctggggggtcttctgatgatcccagcagggatctatgcacccatctgtgtgactgtgtggtaccctctctggggaggcattatggtgagtaaaagaatagcagccatttgggaaatggtgcagacaaaaatgttaaaaggctccacagggatatgccagattatttctgtgttgagggaaatatatgagtaggaaatattattgggttaaagtaattaagaagacaggttgaccaaattgagtataaatcccatggttgagagtcagtggtcctgtttcatgtgaattcagagaaaggggccctgcatggatctcacagggactgtccaaagcaagaactctccaaagtcagttctggtggggagggtggccctagacatttagactagatagcaagatgttttggaaagcaagaggcagcaggaacatccacttccatctaccccttcttgcttacaattctgtttggttactatggtacctggtgaaacctgtcccatcacaagtcagtctcattttgcttatcgacagagcagcactcttttggctgttttacgtacatgttttccaaatctgtaaccctgtctgggtgtggcacataggacagtgatgtttatttccccgtgatacttttcatagttgccactataaaagataagtccaggattaaaattttccaaacaagtagagatgggttagaacaagagtttcctccattctacagcctgaatgtgagaaaaggaagatgagcaatagtcatcatcacttcctgtaacagccaatgttttcatggagtgcctgtgccattcaggtcaagtatttccttctgcatcagttcactcttcagagggcatcagagtcatttatgtcactgtgaaccccaaagggcagttccacaagttaaaaacaaagaaaaactagaaataaaacttttaaatttatggtatgagtattaattgatgaggaaatttgagttctgtctctttggtcttactatattcctagtcacagatccccagatgattgagtaaaaggcatgaatttagtgtcactgagcctgaataaaggaggaatatgacagctgaaaaatgaatacaactgataaaaatgggtggatggttgtgtgaaagttgctgaaagtgtaggcttctttctgaccagttatcaatgttaaaaagtgatctccctctctcctctatctcctgtcttgcccaccccctctccatctcccccacctctcttttttacagtatattatttccggatcactcctggcagcaacggagaaaaactccaggaagtgtttggcaagtaaccatatgtccttctttcccacatgtcagagaagtacctatttttttcggttaaaaactgagacccttaaaaagccaaggtatcacagcctctcagccctaaaaagcaaagaccctccacaatgttattgtgattttatttatgaaaaacttagaagcgaggtctatctgaagtatgttcatgggaacagaactaaaagcagatccatgaaaaccatacctacagtcttaagaacgttaaatgctgtgtgaaaataatagacctttctgaaagccctatcatttctcccagatcaccatttaggaaaattatctgatcaatgtcatgattgattcaaattctagctaagccattttttggccgtaacattgaacaagtcagtttacctctatgttcctgagttttcacctagaaaggaagggtaacagtccttgctaccatgtgacgtccaatggagatgaaaggcagtagagtgtgtgatggtgcttcacaggctataaagtactacactgtggtcttgcccataaaacccctagggactcatctagatccagaggaaactggcctgcagagctgctgatgctgtatggatgaaaagagtttagcagcaagttcgctcccaaaaaattcctcccccaacactgttactaaactgtgtcactttcataatcaatgagggaatgggtggattgagatggttcctgtcttaaagtggcctgacacactcagtttggggggaaaactttttatgaacatcaaattattctctagatacagccagatttactgacttgccatgtgtaggtcatagagccaggaatgaaatatgcgcagcataaaataataatcaataatcccatatcattatggtacttgttatttatattttcctgtttcaaccttttatcatccctgcaaggtagaacattcacactgatattttcttacctatgctacccaaagacatcagccctaattgtattttggaagatagctgactggggctgattgcaacctatgtcagcaggaatagatgttgttactgttgttgcttctgctttttttatttccatttatttgatagtacagatctagagggttctatctgaaccttcccaacctatacttcataataccatcccactaaagtgtgatacaagaaacttcttcactctcttccctctacctatttatgaaggcagataataaactggataatatttatcttcacttattcaacaaacatttattgagtgcctactaggatggtggcagtggcagtgaaggaaatgcaaggatacaagatatagaatcaagggttactcttagaatttttgctttataaaacagatggatggtgaatgagatagggaagactgagaaaagaacaggatagagacatgattttattttatagtgacaaagaggctaaaaacaactgagagaacttcagtatatttagttgtagttgctttgtgagtcagggcagttgcatttggaattccctcccagattatgttttccaaagggaaatcaaacccaattaataaatctgtgtctccatttcaggtcaaaggaaaaatgataatgaattcattgagcctctttgctgccatttctggaatgattctttcaatcatggacatacttaatattaaaatttcccattttttaaaaatggagagtctgaattttattagagctcacacaccatatattaacatatacaactgtgaaccagctaatccctctgagaaaaactccccatctacccaatactgttacagcatacaatctctgttcttggtaagtgttcttggtaagtgtgagattggatttctctccagggaggaaggatgacttgtttattatgagcatgaactctggatccagaccacctgagtttgctagttactgtctgtgtggctttgggaaagaattttaaccacactgtgcctcaatttcttcaactgtaaaatggggatggtaacactatttatctaatagggttgttctgaggaataaataagttaatatatacaaagcatttagaacagtgtttggtacacagaagtgctatataagcattggctttaacattaattattctcaacatcattaatggcattaatatttaccattatattaactaagatgagcatagaagaaattcctaagatgttatgaatatcttttgcccaaggacttttaaatgtagagtttgaaagagataaaaaaaaatgcatctcccaaggatgaagaggtctcctaggcatgatgccacaccaactaaggctgaatacaatttaatttgagactcattacttattctttcctatacagaattgattcttcaactgattattcataccttactttctatcagcaatacacattaaccatctgttgtgtgccaaaagttgtgttaagagttagggttataaagatgctgtctcctgtactagcagttctcacagctattcattacttgtctaaagaattgatctcttaatcgttcaattatagtcaacaataacttactgaacaccaacaatgttctttgtgccattattacattttcaccttcattcttctgttgtttttcagggcattttgtcagtgatgctgatctttgccttcttccaggaacttgtaatagctggcatcgttgagaatgaatggaaaagaacgtgctccagacccaaatctgtaagtagtagcccctctggccaaaacctccctctagaaaatccacatccacaaaggatcatttatggagaatgtaatctgatgagttgttgaaactaggagcttgatttaaaaaaaaaaattggtcttggcatatttctagaaagcaaataatatgatgtcttgaaatttgaaataagtctgtagttagagcctacagttctatattctgtgcgtcttttttttttttttttttgagacagagtctcactttgttgcccaggctagagtgcaatggcgcgatcttggcccagtgcaacctctgcctccgggttcaggcgattctcctgcctcaccctcccgagtagctgggattacaggcacccgccatcatgcctggccaatttttgtatttttgtagagacgggggttcaccatgttggccaggccagtcttgaactcccgacctcaggtgatcctcccacctcagcctccgaaagtgctgggattgcaggcgtgagccaccatgccccacctctgtgcatcttcttattaaccttccctgctgcttgacttcaggcttccatcctgatttcatgattccatatacagtgtgtaaaagcaagatggttgaaggttgaaggctaagtcactagttctttggtttcatttttcagtattcccctcttccctccttttcacctaattcctcttccaaaacaacaggttaaagggctccacaaatgggaaataaaaacagaccaataatagatatattactaactgcttcagaaccagactgttagatttagaatttagaaatcatcgctaattacttcattttgcatttaaagaaaaatagtatcaaagagagaaaattattctcccagagttatattcactaaaggcaaatcagaacgaaaatctaaactcctctattactgcaatgttcttttcccaataccacgtggtcattccaggcactgtggtcaatgtctgctgcccttgaagatttattcagacttgagttttaataaatgacttgataaggatataagcacctgcaaaaaaattttggcatttaaaggcatataataaatgacataagtagcataaaaaccaggaggtatttgataaatgtttgtggagattgttgacaaaggtgtcagtggtaaaagtaaagaatggtttgtttaattttctgttttagaacatagttctcctgtcagcagaagaaaaaaaagaacagactattgaaataaaagaagaagtggttgggctaactgaaacatcttcccaaccaaagaatgaagaagacattgaaattattccaatccaagaagaggaagaagaagaaacagagacgaactttccagaacctccccaagatcaggaatcctcaccaatagaaaatgacagctctccttaagtgatttcttctgttttctgtttccttttttaaacattagtgttcatagcttccaagagacatgctgactttcatttcttgaggtactctgcacatacgcaccacatctctatctggcctttgcatggagtgaccatagctccttctctcttacattgaatgtagagaatgtagccattgtagcagcttgtgttgtcacgcttcttcttttgagcaactttcttacactgaagaaaggcagaatgagtgcttcagaatgtgatttcctactaacctgttccttggataggctttttagtatagtatttttttttgtcattttctccatcaacaaccagggagactgcacctgatggaaaagatatatgactgcttcatgacattcctaaactatcttttttttattccacatctacgtttttggtggagtcccttttgcatcattgttttaaggatgataaaaaaaaataacaactagggacaatacagaacccattccatttatctttctacagggctgacattgtggcacattcttagagttaccacaccccatgagggaagctctaaatagccaacacccatctgttttttgtaaaaacagcatagcttatacatggacatgtctctgccttaacttttcctaactcccactctaggctattgtttgcatgtctacctacttttagccattatgcgagaaaagaaaaaaatgaccatagaaaatgccaccatgaggtgcccaaatttcaaataataattaacatttagttatatttataatttccagatgacaaagtatttcatcaaataacttcatttgatgttccatgatcaagaaagaatccctatctctattttacaagtaattcaaagaggccaaataacttgtaaacaagaaaaggtaacttgtcaacagtcataactagtaattatgagagccttgtttcataaccaggtcttcttactcaaatcctgtgatgtttgaaataaccaaattgtctctccaatgtctgcataaactgtgagagccaagtcaacagcttttatcaagaatttactctctgaccagcaataaacaagcactgagagacacagagagccagattcagattttacccatggggataaaaagactcagactttcaccacatttggaaaactacttgcatcataaatatataataactggtagtttatatgaagcagacactaagtgctatagacactctcagaatatcatacttggaaacaatgtaattaaaatgccgaatctgagtcaacagctgccctacttttcaattcagatatactagtaccttacctagaaataatgttaacctagggtgaagtcactataatctgtagtctattatttgggcatttgctacatgatgagtgctgccagattgtggcaggtaaagagacaatgtaatttgcactccctatgatatttctacatttttagcgaccactagtggaagacattccccaaaattagaaaaaaaggagatagaagatttctgtctatgtaaagttctcaaaatttgttctaaattaataaaactatctttgtgttcttttctgcaacagatgattccaacatgggtgtttgtctattcttctttactcttgaaacattagaccatgggaggctcttacagccttgagttgatatttatacaacccaaatctaggtttgaacggtgaggtgtcaggtcatcaaatattcatgtctatatagtcttacacaggttctcaaaaaaaatgttcatgggataggtcattgataatggattccttattctgagaactccagacgactgaaatatatgagagaaggaaaaggacatagtaggagcaggcctgagaaaaaaatgaaagtcagaaatctttaaaaaaatacaagatcttatttctatcttattttttctcctcttctgaaatatatatgaggattcctctccaaacccatggtttctctaagaattttgagtcatttgtatgacctcaaataattagttttagctgacctcacataactccttataataggagacatctttaatgtctgctattaaagaaggatgaaaattcctatgaccttctccccgattatccctttggcaatatagagtcaaataataacattgaccaatagtaaacatgctttgccaagaagtagaagatatattctctagccttagtttttcctcccaatttgcatttttgtaaaaataatgttgtatccacaaaggaaataaactttaaaaacccaagtgca

SEQ ID NO: 1872 - DNA, 14944 bp, Homo sapiens; identical to SEQ ID NO: 1871
  source 1..14944: mol_type = genomic DNA
